United States Patent 9,012,723 (ISOLATED NOVEL ACID AND PROTEIN MOLECULES FROM SOY AND METHODS OF USING THOSE MOLECULES TO GENERATE TRANSGENE PLANTS WITH ENHANCED AGRONOMIC TRAITS) - sequence listing, part 17

SEQ ID NO: 82296 - DNA, 549 bp, Glycine max
  Peptide Sequence Number=SeqID_173981
atggcaaaactgaccattgttgaagcaggagcgagtgattgcagaacacccagcgcgaatgagaatggaggaagcccttgcggaactggagcgagtccaaacccagctcctgcaacgcatatcgaaactggagccaacggcgttcccgatttctccttcaagagagtcccttccgattactacgactggcccctcgaagcccgtcgcgacgccctctccgccgcctcaatccaccatctctgcaaaagcatcgttctcgttaacacgcaagcccccgccaacgtcgtcgattgcagcgaccgcaagaattccaaatactatgtcgttgtcgttcagtacaccgctcgcttcaacgctgaggctgtcaagaattttctgtattcgctcaacaatggaagtatcgcgaagaagaaattcaacatgaggctagctcctgaggagacatcaatggagttgactggatatgggcacaatgcagtgacttgtattggcatgaaaacagacatcccggtaagaatggacatgttgatcggtatcagattcttatga

SEQ ID NO: 82297 - DNA, 357 bp, Glycine max
  Peptide Sequence Number=SeqID_173982
atggtgggcgtcaaaatgttcctattgcaaatgaaccggatacttacccctatgccaaagggtccttttttatggttccttgtcgaagtctacgatgtttgtaggtctaaaagagcgtggggggcacctgcaaaagaaacttcaacgctcaatttatccggtataatagccaaagcccattttcacatcgacatcctcaaaaccaaagtcagcctgtatgcatggcaattcttagcagggttccaaaatttgatcctggtatcttcacatcttagatcgcttgcaagacagaccagtccattggaaggccatcctcatcaattgtggatgatgggtcttcaagtaaatgtgacatag

SEQ ID NO: 82298 - DNA, 1341 bp, Glycine max
  Peptide Sequence Number=SeqID_173983
atgggaactcgaacaaatttctacaagaacccatcaatctcctacaaaaaacgtttaagcatctcctccgttcttcagaacctccatgcttacaacatcgccgccggcaatgttcctcccgccgatccaccgcaagcgacttccaccgccaatgttcctcccggcaatccaccgcatctcactccctccgccagactcaaacgcagccggaatcccgagccaccggaatttctacgcgaataccgtgacgatgccccttcctctatgtcacaccacgattacatccaaaacagaaggaaagaagtcgtttcgtctcggaatcacgatcgcgttgaattgactgaagaagttttgggaaactctaattctactcttcccttggtggattatgatgcaagtgatgaagatactccttcagaatgtgaagaaacacatactcttctaaattctggtcaacaagaagaatttgatggagtaaaaaaaagcagaaatgagcagcgattccctgtctctggggaacctgtttgtcttatatgtggaagatatggcgaatatatatgcaacgagacagatgatgatgtctgtagcatggaatgcaaaagtgaacttctggaaattcttaaactcaatgagggatcctcccacaaccaagttagagatatctcctcatctggaattagtgctgctgtaccagttccagtttttggtgatgatacctgggattataatcaacatcactggtccaaaaagacatgtagtctttctacttatgaatgttggaaatgtcaaagacctggccacctagctgaagattgtatggtcactgatggaagtaatagatctagttccattccaaaggatcttcttcaactgtatagaagatgccaccagattggtaaagacttgttagctgcaaactgtaacgtgtgtcgcagatcatcaaatttggcaacatgccttgattgtagtattgtcctttgtgatggggcaggccacttgattgagcatataagaacacacccttcccatcaaaaatattattcacacaagcttaaacgtctggttaaatgctgcaagtcaacatgcaaggtcactgacatcaaggatctcttggtttgtcattattgctttgataaagcctttgaaaagttctatgatatgtatactgcaacatggaaaggagccgggcttgcaattatgtggggttctatatgctgtgaagaccatttcacctggcacagaatgaattgtttgaatgcgaatgtggaagaaagtgcatacattttaaaacccgatggccataaaggcaagcgtacgcaacttagtgacttcattttttga

SEQ ID NO: 82299 - DNA, 1554 bp, Glycine max
  Peptide Sequence Number=SeqID_173984
atggttttaaatgcggtctgtttggccgcgacatcaaggtatttgacattctgcaattgcatcacgaccacaattgcggccgcatcagccgcattttcccacaatgtgagcgagatacttgattcagagctgctgggcgaggggcttataccgaccctacaacatgcacatgacaatttgttggtagaaaatgctctgactgtgccatatcgagcaactacatacggacagctggttgaaagcacattcttatggcagttgcatgatttgcatagcattgaggctactgtatctgatggcattcaacttactcctcccggacttgatagtgtgttaagtgtcaaacgtcagcaatatgccatgcattgcaatcctatacaagaagaaataaaactgctttcagaacccttcaaaatttttgaatttgatttttggaaacggccagagagttctggagaaactgagctgtgtgtaaaggcaactaatgatgggagaattcatgctgtggtctcttggtgggtacttcaacttgatcgtgaagggaccatctattattccactgctcctaggtggataagctcaccaacaattacaagtcctgttggttggtgtgaccactggaaacagtgtgtttggtttgttcctggcagtggtatttccatattcaaaggggaagaaattcatttacatgctactcatactgagacaagtatctcatataatttagatactcaagtacctacatctgagattttgaaccataggtgtatgactggagatttgcagcttgtactgccaccagaaagggttgcaatctatggagacaaaggatggaggctttcaatgttgaaagcagtacaaagcatgggaagagatcacccgttatgcttagttgcagatgatagtgtgtttttacctcttcttgtggcacagctttcagaagcatcacatgtaatgtcattacttccggggcttaaggaaagaggcctacaatatttgcaagcggctgcccatgcaaatggtttgtcacgtaattgcatagaagttcttgaaaaaagggttgatctgttgatagcagaacctttctatgtagggcatgatggcatgcttccatggcagaacctgcggttttggaaggatcgtacaacacttaatgatatcctctctgaagatgctctgataattcctagtaaaggaatattgagagcatgtgccatctctcttcctgtgcttagtgagacatttgatgtgatggagtttgatttttcaaaacaaatatgcctatgtcaaggaaaatcccaggttaagttcaccaagaccggggtatgtcatggatttgtgctgtggattgactgggtgatggatttgcaaaattctgttgtgatatcaactggtccagataggagatattggaagcagggagtaaagcttcttggaacacctagaacagtaggacctcaaagatcaagaaatgtccaagcatgttctgcagttctggaagcttgtttcaatccattacagggggaactcaaaattatacttgatttcttatga

SEQ ID NO: 82300 - DNA, 339 bp, Glycine max
  Peptide Sequence Number=SeqID_173985
atgtttacgcttatgcagcaacggtctgatcaggacaaagtcagtcagggcgcaaaacgcaccggtatcttttctttcagatacgcaggccgcatgggaaagccgactaataacatgacggcgataagtgagagtgttttattcatcatggcttccatgcagatcatttatgcattaatagcatcccggacagattggggaaaccgcgcctgctatcgggttgctttcgcattgtcagcgaatactcacaacccagcaaccgaccgcattacagatgtgagaataaacagcgtaacgtctcaagccaattcgcagaccccatcaaaggttgcgaaataa

SEQ ID NO: 82301 - DNA, 390 bp, Glycine max
  Peptide Sequence Number=SeqID_173986
atgcctgcaggtcgactcctagaggatccccgctcttccgcttcctcgctcactgactcgctgcgctcggtcgttcggctgcggcgagcggtatcagctcactcaaaggcggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttga

SEQ ID NO: 82302 - DNA, 459 bp, Glycine max
  Peptide Sequence Number=SeqID_173987
atgttggagacaaagtcgaaaggaaaaacacaattggaagttacaacttcatcgatggaaacttggttgcctccattggaccttaggaagaagaaaggaaagtttcctccatgcaacaagcctatgcctcatcctagtccaaaggacaacattgccttgcatccaatcccttacaattggagagtaaaaaagcttcaagaatcaagtctcaaagaatcaagattcaagaacaatcaagatcaagattcaagactcaagattcaagattcaagagaagaaatcgagaaacaacagtcaagacttcacaagggaagtatttttcaaaattccaaatatagcactgtagaagcaaagcttcatggtgaatcaaagatgatgacaaaggagatgacaaaaagctcaaagattaatcaaagaacaactcaagtgaatcaagaacagctcaagagttcaagataa

SEQ ID NO: 82303 - DNA, 770 bp, Glycine max
  Peptide Sequence Number=SeqID_173988
atgaccattgctggccaccatgttcctgctggcctatttctacaccgacgtcttcggcctgtcggcgggcattatgggacgctgtttttaatctcccgcgtgctcggatgcgccgtgaccgacccgctgatggggctgctggtagaccgcacccgcacgcggcacggtcagttccgcccgttcctgctgtggggcgccatcccgtttggcatcgtctgcgtgctgaccttttacacgccggacttctccgcgcagggcaaaatcatctacgcctgcgtgacctacattcttctgaccctggtctacaccttcgttaacgtgccgtactgcgccatgcccggcgtcatcaccgccgacccgaaagagcgtcacgccctgcagtcctggcgcttcttcctggcggcggcgggctcgctcgccatcagcggcattgccctgccgctggtgagcatcatcggcaaaggggacgagcaggtgggctatttcggcgccatgtgcgtgctagggctgagcggcgtggtgctgctctacgtctgcttctttaccaccaaagagcgctacacctttgaggtgcagcctggctcgtcggtggcgaaagatctgaagctgctgctcggcaacggccagtggcggatcatgtgcgcgttcaagatgatggcgacctgttccaacgtggtgcgcggcggggcgacgctctacttcgtcaaatacgtgatggatcacccggagatggcgacccagttcttactctacggcagccttgccaccat

SEQ ID NO: 82304 - DNA, 720 bp, Glycine max
  Peptide Sequence Number=SeqID_173989
atgaccaccctgactcagatatggatgactttgctgctcagcaacatcctgcccagcgatcataattccgacctccccctgccgaagtgtcagctggtgtatgccatcctgacacggatgagcattcatgtggctcagttaatcgctgatgccatctatatatttgcaggtatggcgcctaccaggcaccctctggacccggataagtccaacagggccctgggatttcccgccttgatcacaggactctgccagtcgttcggcgtccccgtcacacctagcaaggtgattcggccgcccatcacccgagcttttattgagaagtactgcacgcagagacaggtccagggtgatgcaccacaggccacggacatgccgccacctcatcaggctggtccagccgaattgtttgatacggagcagtatatgcggcatttggttcgccaacaggcggccaaccaccgggcacatgtacagactcatgattgtttttatcagatgagtctcagcctgcagagccagggctttacttcttttccgtgccctactccggaccagttcagggcagaggtcgcatggcctggagattggcctgaggcccaggcaggagaggcaccagcaggggcaccagcagaggctcccgtcgaggcagatgaggcccgcgaggatgaagagatgaccgatttacttgatttcttgggagggagcggtgtcacatga

SEQ ID NO: 82305 - DNA, 498 bp, Glycine max
  Peptide Sequence Number=SeqID_173990
atgtcgcgccgttcgctcccgctcaatgccattgacgcatttttagtcaccgcgcgtcatctgaatcttacgcacgccgctgcggaactttgcctgacgcagggggccgtcagccgcaagattgcctcccttgagacgtggtttggttttccgctgtttgaacgccacgcgcgcggcttacgcctctccccgcagggcagcgccctgctgccggagctgcagtccgcctttgaacagctgctggccgtggcggaccaggcccggagccagcaaaccgtgatccggctcaaagccccgacctgcgcgatgcgctggctggtgccgcgcctgctggaggtggagcgcgaacagccggatctgcaaatcgctctcaccaccactaccgatcataacgtcaatttcaaaactgaatcctatgatgcggccatcgtgttcggcacgcacatgagcgcaggcgatctgctgttcgaagaggcgctcacgccggtgataagcccg

SEQ ID NO: 82306 - DNA, 1080 bp, Glycine max
  Peptide Sequence Number=SeqID_173991
gacgacgtgctggcggagtcgctgctgggcagcgccaccagcgagaatgaagccttctggcgtctgccgctggccgagtttcaccgcaaccacctgccgtccaatttcgccgatctgaataacatcgccagcgcggcacatgcagcgggcgccagcagcgcggcggcgttcctctcatggttcgtcagcaactatcagcagggctggctgcacattgactgctctgcgacctatcgcaaaaacgcggtcgatcagtggtctgccggtgcgactggccttggcgtgcggaccattgccaatctcctatcccttatgagtaaccgtcttgaagaggtgctgaagctggcggccaccgagcctgcgcaccgtccggaattttttcagctattgctggaggccgatgtctgggtgccgggcgaaagtcccgcggagcagtttgatgccacctcgccggtagaattacagcactgggagaaagagggtggcggcagcgtgatccctttctttacctcagaagcagcgatgagcgaagccatccagggtgagcagccgtacctgcgtttaccgacgcgcacgctgtttgaaatgacgctgggcgaaacgctgttcctcaatccgaaactgccggccggcaaagagttttcacccggcgagatcgcgcatctgctgggcgaagagggcagtgcgctgagccagcaaacggtgctggagggcggtcatgcattgctgctgtccgaagtggccgagccgccagcgcagatgatcgattcgctgacccagctgtttgcgaaatacaaacaggtgcgtcgcgcctacgttgccagcattcgtgagcgtgccgatgaacaggcgaatctgttgattgggattgaagccgacagcgatattgatgcgattattcaggcggccggcagcgtggcgaccgatacgctgcccgatgacgcgccaattgatatctgtgaagtggtcagcaacgagcagggtgtcagccatttcttcaccgcgcacattacgccgttttatgagcgccgctggggcagtttcctgcgcgatttcaaaggcagccagcggattatctag

SEQ ID NO: 82307 - DNA, 807 bp, Glycine max
  Peptide Sequence Number=SeqID_173992
atgcgtggtagtggctccaacacttcttcggcgacaatgagtgcagataaattggtggaaatcataggaagtataaagcaagagttgaggaaagaggtagaagacgaaaacaaacggactatcgacttattgcagaagcagttggatgcgatcaagagtgagttatcacaaattcaaacgcaacagtcagctccttttagaccgtctatccctgatgtattggttgcacgtgtcagcaccaaagaaagctgtgccgaggctgctgcaaatgttgttgctaaggagcggtctacacttgatgcttctattgtggggttatacattgtgtgtggcgatagtacacaggtggtggctgcgggaaaaatgtatggagttggtggcattatacacaatgttgcttacgcagatgatgtagtaagggtttgtgttgagacaatttacgatggtgacgccagtgtcccgtttccaacttcagagattcagtatgtcagggacgcgagtagcacattcattgcatggcccagacatctagtgaagcctataactgatgattcaaatcataatgcgcgttttccagttggacgtcttggtgaggctgaggttgcagctgaagctgatccgttgggcgaattgatgaagacattattttacgtgtacaagactccagtggaagtgccgtgggaggcaacgcaatttggacttcctgatgttggggcaaaatttttcatcacacatgttgatctagcggaaataatatcaggtgacaagtgtttgaacatatctatcctgcagctgtggaccatgtaa

SEQ ID NO: 82308 - DNA, 231 bp, Glycine max
  Peptide Sequence Number=SeqID_173993
atgtttgtcgccagtttcatcatccacacggtagacgaggaagaagcacagattggtgctgatcgttctagtgcaaactctaataaatctgagatttataaggaggaagcacggaatgcagcacagaagcataaacccaagagggtggagagtgtcaatgctgatgcagaagcctttggtgatcactggaaaattcagattgccttatgcattctgaagctgaagcactag

SEQ ID NO: 82309 - DNA, 480 bp, Glycine max
  Peptide Sequence Number=SeqID_173994
atggctccaaagaaacactccacgaagaggtctagaagagatgctataggagaaggatccaatgtcgcctcagagtttgatagtcatcgtttccggagtgccgagcaccaacaacgcttcgaggccatcaagggatggtcgttccacagggagaggcgtgtccagctcagggaggatgagtatacggacttccaggaggagatagctcgcagacgttggacaccgctagtgactcccatggccaagttcgaccctgagatagtcctagagttctatgctaatgcctggcccacagaggagggggttcggaacatgcgctcgtggttttggaggaaggccagcagtgtgagatcagctagaggaggagcaaggccaacgatttcgatgaggaagccatcgcctagctgttgtgcataccggggcaggatttcgcccggaacgctgcagggaggtgggtgcggatcatgcgcaccagcatga

SEQ ID NO: 82310 - DNA, 179 bp, Glycine max
  Peptide Sequence Number=SeqID_173995
atgacagaatttgtctgtgcggaagatgacataaatctccgcgtgtcaacaggcttgttggccgcgattgacaaaggtgttagtatgacagaaattgtgggggcggccgacaaaagcgaggctcttgctcctatgtatcctcaaggaggaactcagacctacgtagttctggctaactt

SEQ ID NO: 82311 - DNA, 816 bp, Glycine max
  Peptide Sequence Number=SeqID_173996
agcgatgccgaagacatccacagctgggtggagcagaagctgatcgagaaggtcggcgatttgggcaagaagctgcacaccggccgcagccgcaacgatcaggtcgcgaccgatctgaagctgtggtgcaaacagcaagtcggcgatctgcatcaggcgatcgtccagctgcaccaggcgctggtggagaccgccgaagccaaccaggatgcggtgatgccggggtatacccacctgcaacgcgcgcagccggtgactttcgcgcactggtgcctggcctatgtcgagatgctggcgcgcgatgagagccgcctgcaggataccctgaaacggctggacgtcagcccgctgggcagcggcgcgctggccggcaccgcttatcctatcgatcgcgagcagctggccggctggctgggcttcgcctcggcgacccgcaacagcctggacagcgtatccgatcgcgatcacgtgctggagctgctgtccaacgccgccatcagcatggtgcacctgtcgcgcttcgccgaagacctgatcttcttcaacagcggcgaagcagcgtttgtcgagctgtccgaccgtgtgacctccggttcttcgctgatgccgcagaagaaaaacccggacgcgctggagctgatccgcggcaagtgcggccgcgtgcagggcgcgctgaccggcatgatgatgacgctgaaaggcctgccgctggcgtacaacaaagacatgcaggaagacaaagaagggctgttcgacgcgctcgacacctggatggactgcctgcagatggcggcgctggtgctggacggcattcag

SEQ ID NO: 82312 - DNA, 414 bp, Glycine max
  Peptide Sequence Number=SeqID_173997
atgggatcaagtcagacgccttcacttaaaaagaggttctatcaagtcaaggtcaagagcctaggaatcgccagtctgaaagagttaggacagttgatgggtcagctccagcgacaagcctttcgcaaagcttacggtaagatctgggacctaaccatggctgaggtctccatggaggccattgcctccctcgcccaatattatgaccaacctttgaggtgcttcacctttggggacttccagttaacacccacggtggaagagtttgaagagatcctgggatgccctctgggaggaaggaagccatacctcatctcgagattctatccctccttagctagaatttctaagatagtcaaaatctcgacacaggaattagaccgtggaaagcaagtcgaaaatggggtggttggg

SEQ ID NO: 82313 - DNA, 387 bp, Glycine max
  Peptide Sequence Number=SeqID_173998
atggctccgagaaagcttcctgcaaagagatccaggaaggacaaagcggctgaagggaccagtgccgctcctgagtatgatagccatcgcttccggagtgctgagcaccagcagcgtttcgaggccatcaaaggatggtcattccaccgagagagacgcgtccagctcagggacgatgagtacaccgacttccaggaagagatagctcgccggcggtggacatcgctggttacccccatggccatgttcgacccagacatagtcctggaattttatgccaatgcttggcctacacaggagggtgtgcgggatatgcgatcttgggtgagggtcagtggattcctttcgatgcggatgccctcagccaattcctgggataccctttag

SEQ ID NO: 82314 - DNA, 285 bp, Glycine max
  Peptide Sequence Number=SeqID_173999
agaggggtggtgcgtaacggcaaaagcacccccccgacatcagcgcgggcaagtgtagaggtcacgctgcgcgtaaacaccacaccccccgcgcttattgtgccgctacagggcgcgtccctctctccattctggctgcgcaagtgtggggaagggcgatcggtgcgggcgtctttgctatttcgccagctggcgaaagggggatgtgttgcaaggcgattaagttgggtaacgccagggttttcccactcacgccgttgtaaaacgacggccactgaattgtaa

SEQ ID NO: 82315 - DNA, 345 bp, Glycine max
  Peptide Sequence Number=SeqID_174000
atggggtggcttcagaatcatcatctgattctgtctcttctgctgcatcttcctcttcctcagcagcttcttcttcttcttcggctgcttctcctgtcttcctcaggtgcctcttcctcttcttcagttgattgttcatcatcaatgccactttatgagagcattgtgatcagccgttctagctccatcttattttatgtggtggctttgatggttgcttccagcaccttgcacgtgtccttgagttcagcaatcagagcatcattggacacagcacctgaagcagcagctttccctgatgtcgagacaatgtctgggacatgtgtcccctcaaacagtttgtaa

SEQ ID NO: 82316 - DNA, 228 bp, Glycine max
  Peptide Sequence Number=SeqID_174001
atgacggtgagacctctgacacatgcagctcccggagacggtcacagcttgtctatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 82317 - DNA, 369 bp, Glycine max
  Peptide Sequence Number=SeqID_174002
atggttctcattcttctcatttatcatattttcatcttgagcctgagcccacatcacagcataaaatccaatacttattgtagcagctccaatcatactgcacccaaaattaaacccaatgttagacaaggttcaaggaagtatttacaaaatataaggctaagacaagaaagagggcttcgaaccattgggcgaatcgagctggcgtatggtcgaatcgaagtcaaggcaacaagatttctggacttagcgcaatttctgacaaaacttcacaaaattagttcgacttcgagcgatatggataaccgttctaaggagcagttatgtgcatgcaaggtgtacgtagcaggacacttggcattaggatag

SEQ ID NO: 82318 - DNA, 102 bp, Glycine max
  Peptide Sequence Number=SeqID_174003
atgcagattttgcagtacagcggctggagaaaaacatggatgcagaggatccaaattagggagataagagggcaaagacaagagaaaaagaaattactataa

SEQ ID NO: 82319 - DNA, 1437 bp, Glycine max
  Peptide Sequence Number=SeqID_174004
atgagaagaaagagattgactttgaagataagaagtaaaaagagatttagcaacaagaagcttaagctgccttatgtttcatatgctctcccacccattgtgctgttttgcttttgcgttttcttttactgtcacttctttacttcatctccggcaaatgagcctcctcattccatctccatctccaaccactcttctcttgccatttctacggagcttattccccattccatctccatcaccaaccattcttctctttccgcttctccgcctccgcctccacctccaccagtttatgagaaacctaatgatcaaaaaatagtttatgagaagccatgtgactacaccaatggcagatggatccgtaccaaaagaaatcctttatacaatagtaccacctgtgtcaacttgaaagaaagccggaattgtatcgccaatggtaggcctgatttgggattcctttactggaaatggaaaccaagtgaatgctatcttccaaggtttgaacctaacacttttctccaactcattagcaacaagcatgtagcttttgttggggactctctctcaaggaaccacctagagtccctcctttgcatgttaaacactgttacaaaaccaaacggattcagccaccaaagttttactaggtggctttttccttctcacaacgcaaccttgtccttctattggtccccatttcttgtacaaggtgttgaaagaaacaatcagggaccacgctataataattataacaaaattcatttggatcatgctaatatgaggtgggaaaaggatatggatcaaatggacatgattgtgttgtccttagggcattggtttttaattccttcagttttctactgggatgataaagttataggatgcgtgaaccgtcctgtttctaattgcaccaccgacattggtttttatggtccaataagaagggccttaaggactgctcttaatagcataattaagaagaaggtgaaaaagggaaatggaattgatgtaattttgagaacatactcgccttctcattttgaaggtgcttgggataaggggggtatttgttcaaagactgagccttatagagcgggggagaggcaacttgaaggagaaaatgctatgatcagaaggattcagtttgaagaagtggagagggctaaggcaagagccaaagaattggtaaaagctaagccaaaagctgaaaaatttaaagggtttaggttggaggtacttgatgtaacaaaattagcattgttgagaccagatggccatcctggtgcttatatgaatcctttcccatttgctaagggggtttcaaagcatgtgcagaatgattgtgttcattggtgcttgcccgggcctatagacacatggaatgagatttttcttgagatgatgaaaaacatggcacaagcagccgaggagtga

SEQ ID NO: 82320 - DNA, 1431 bp, Glycine max
  Peptide Sequence Number=SeqID_174005
atgggaaggaatgaggacaaggttggaatagcaatgttctatgctaagaacaccagaaagaaagagaactacaaggagaagaaaaacaagaagggaaaggctttgaagatgggaatcacaaaccccttcaaagaccaatccctctccctcatcaagagacttcttccttggaccctctatgctcttcttcccatagttttacttcgcttgtacttctaccctctacccttccctccatctccagaaactgagcttcctcattccacccccaccaccatcatctcacagtcttctctttctgattctacactaccttcttctccagaaaaggaaaaaacgtatgagcctccatgtgactactttgatggcaaatggatccgagacaggagaggccctttgtacaatggtacaacctgtggtacaatcaaagaaggccagaattgcataacacatggaaggcctgactctagctatctatactggagatggaaaccaagtcaatgcaatcttccaaggtttgagcctcaaacttttctccaactcattagcaacaagcacatagcttttgtgggggattctatggctaggaaccaattagagtcccttctttgcatgttatccactgcctcaacccctaaccttgtctaccggaacggggaggacaacaaattccggaagtggcactttccttctcacaatgtgagtgtctcattgtactggtccccttttcttgtgcaaggtgtagaaaagtcaaactcagggccaaatcataataagttgtatttggatcatgttgatgagaggtgggcaagggatatggatcaaatggacctgattgtgttatcaattgggcactggtttttgcatcctgcagtgtactatgagggtggttcagttttaggttgccattactgtcctggccttaattacactgaaattgggttttatgatgtgctaagaaagggcctaaggactacccttaatagcataattgataggagagtgggtaaagggtatggaattgatgtaattgtgacaacattttcacctgcacatttcgaaggtgagtgggataaggctggtgcttgtccaaagaccaagccttataggaatggggagaagcaacttgaagggatggatgctgacatgagaaaaattgagattgaagaagtggaagatgctaagacaaaagctaataattttggtgggattattagattggaggcattggatgtgaccaaattagcattattgagaccagatggccaccctggtccttatatgtatccttttccatttgctaatgggcatcaagagcgtgtgcagaatgattgtgttcattggtgcttgccggggccaatagacacatggaatgagatttttctagagatgatgaagaagtgggggcaacaccctaggactgaagagtga

SEQ ID NO: 82321 - DNA, 1221 bp, Glycine max
  Peptide Sequence Number=SeqID_174006
atggcgatggagaatggaatggtctgtagtggtgttggtattcgtcagattgacggcgagagatttagcaagaagcttcttccttctgcttcctatgctcttccacccattgtgctgctttgcttttccctttacttttactgtctctcctttacttcatctccagcaaatgagcctcctcattccctctccatcaccaaccactcttctcttgagcttcattccatctccatcactaatcattcttctctttcctcttctccccctccaccagtttatgagaagccatgtgactacaccaatggcagatgggtccgtaccaaaagaggtcctctatataatgctactaactgtcccaacatgaaagaaaaacagaattgtatagccaatggtaggcctgatttggggtaccttaattggagatggaaaccaagtgaatgccatcttccaaggtttgaccctaacacttttctccaactcattagcaacaagcatgtagcttttattggggactctatccaggaaccacctacagtccctcctttgcatgttaaacactgttacagaaccaaatggattaagcaacgaaggtgggaaaaggatattgatcaaatggacataattgtgttgtccttgggacattggtttttagttccttcagttatctactggggtgataaagttataggatgcctgaaccgtcctgtttctaatttttctaattgcaccacaaagattggattttatggtccaataagaagggccttaaggacttctctcaatagcataataaagaggaaggtgaaaaaaggaaatggaattgatgtaattgtgagaacatactcaccttctcattttgaaggtgcttgggataaggggggtatttgttcaaagactaagccttatagagagggggagaggcaacttgaaggggaggatgctgagatcagaaggattcagttggaagaattggaaagggctaaggaaaaagccaagaaatttagaaggtttaggttggaggtacttgatgtaacaaaattagcattgttgagaccagatggccatcctggtgcttataggaatcctttcccatttgctaatgggattccaaagagtgtgcagaatgattgtgttcattggtgcttgcgagggcctatagacacatggaatgaggtttttctccagatgatgaaaaacatggcacgaacagctaaggagtga

SEQ ID NO: 82322 - DNA, 771 bp, Glycine max
  Peptide Sequence Number=SeqID_174007
atggcttatgttggcatagaactcagctctcctactcttgcatcagctatacttaatgtcattccagctttcacttttgtacttgctctcattttcaggatggaagaagtacattggagatattttagcagccaagctaaagtcttgggaacaatagtgtcaattggtggagcatttgttgtgatactgtacaagggtccacccatctttaggacacattcatcatacacttcaaacaaacttcaattttcggcacaaccaaactggatcttgggagggatatttttggttgctgattctttccttagttccatgtggtacatatatcaggcttcggttgcaaagaaataccctgctgtaacagtcatagtattcttccaattcttattttcaaccattcagtgtggagtatttgccttaattgcagttagagatccaacggaatgggagctgaagttcgatagagggttgagtgtcattttatatcaggcaatagttgcaacaatgttacgttacaccctaaccacatggtgcgtccatagagcaggacctctgttttgtgctatgttcaagccagtgggaatcatcttcaccgtttctatgagtgcaatctttctgggggagaatttcggccttggaagtttgattggtgcggttataatcgtgataggattttatgctgtactatggggaaattccagagaggagaacaagattgagaatttggagtcatcgagccataatgctcctttattgcaagataggtcgtaa

SEQ ID NO: 82323 - DNA, 3873 bp, Glycine max
  Peptide Sequence Number=SeqID_174008
atggcggggagttcttcatcagctgctgtgtctcttcttcctgtaattaggcatgatgtgttcctcaacttcagaggggaagacacccgtgacaacttcattagtcacatttatgctgaactacagaggaataagattgaaacatatatagattacagactagccagaggcgaagagatttcacctgcactccacaaagcaatagaagaatctatgatttatgttgtcgttttctcccagaactatgcatcttccacatggtgtttggatgaactcacaaagatactcaattgcaagaagagatatggaagggttgtgatcccagttttctataaggtggatccatcaattgttaggcatcagagagagacatatgcagaagaattcgttaagtataaacatcgatttgcagacaacatcgacaaagtgcatgcatggaaggctgctctaactgaagcagctgagatcgcgggctgggattcacaaaaaaccagtccagaagccacacttgttgcagaaattgtgaaagatattttgacaaaattgaatagttcttccagttgtgatcatcaagaatttgttggaattgaaacccatattacacaaatcaagctcttgatgaagcttgagacactggatattcggatcataggaatttggggcttggggggaattggaaagactacgattgcagggcaaatatatcaccaattggcgtcacagttctgttccagcagtcttgttttaaatgttccggaagaaatagaaagacatggaatacaacgtacaagaagcaactatgagaaagagcttgtagagggaggcataagtatttcaagtgaaagactcaaacggacaaaggttctcctctttcttgatgatgttaatgattcaggtcaactaagagatttaattggagggcgtggtcgttttggccaggggagtcgaattattttgaccagcagagacatgcaggtgcttaagaatgctgaagctgatgaaatctatgaagttaaggagatgaatgatgaagaatctctaaaacttttcagtatacatgcttttcaccaaaaccagccaatagaaacttacaaggagttatcagaaaaggtattgcgttatgctaaagggattccacttgctctccagattttgggctcgttgctttatagaaaaacagaggaagtatggaaaaaccagttgcaaaagttggaaaagtatcccgattccaaaattttcaatgtattaaaactaagttatgatgggcttgatgaggagcagaagaatatatttcttgacatagcttgcttttatagaggttattgggagattttcgtggcacaacagctagagagctgtggtttctctgctaccattggaatggatgttctcaaagataagtgtctaatatctattttgaaaggtaacgttcagatgcatgatctgatacaagaaatgggacgagaaattgttcgtcaagaatgttgccttaatccaggaaaacgcagtcgattgtggaaggttgaggaaattcatcaagtcttaaaaaataacgaggggacggatgcagtacagtgtatattgctagacacatacaaaatcaataaagttaaactacattctaaaactttcgaaaagatggaaaatctgaggatgctccacttctttaattctcatgtcccctggagtgaatcaaatgtatttcttgcatcatctcttaaaagtcttccggatggtttaaaaattctttgttgggatggcttccctcagagatctttgccgcagaactattggccacaaaatctagtgagactggaaatgatacgttgccatcttgaacaactttgggaaccagatcagaaattaccgaatttgaaatggttggacctgcgttattctgggaaactaattcgaataccggacctttatctgtcaccagatattgaaggaatattactgactggttgctcaaagttcgaaatattcccagaaattaaggacacaatggaaaatctagctgtgctcaaattagacggaacagcaataaagaccctaccttcatccttgtgccgtttggtagcgcttgaagtattgagcctggacagttgcgcaagtcttgagactattccatcttccattggagatctcagcaaactctgcaagttaggccttacctactgtgaatcacttgaaacttttccgagcagcattttcaaattgaagttgacaaaacttgatttgagtcgttgctcaaagctgaggaccttccctgagatcttggagcctgcacaaacttttgctcacgttaacttaacaggaacggccattaaagaattgcctttttcatttggcaatttggttcatcttcaaaccttgcgcctgaacatgtgcactaatctcgagtcacttcccaacagcattttcaaattgaagttgacaaaacttgatttgagtcgttgctcaaagctgaggaccttccctgagatcttggagcctgcacaaacttttgctcacgttaacttaacaggaacggccattaaagaattgcctttttcatttggcaatttggttcatcttcaaaccttgcgcctgaacatgtgcactgatctcgagtcacttccaaacagcattgtcaaattgaagttgacagaacttgatttgagtggttgctcaaagctgaggaccttccccgagatcttggagcctgcacaaacttttgctcacgtttacttaacaggaacggccattaaagaattgcctttttcatttggcaatttggttcagcttcaaaccctgcacctgaacttgtgcactgatctcgagtcacttccaaacagcattgtcaatctgaaccttctctctgtactcgattgctctgggtgtgccaaattaacagaaatcccaagcgacattggttgcttgtcattattaagggaactgtcactaggtgagagccgaattgtgaaccttcctgagagcatttgtaatctttcaagcttggaattacttgatttaagtgaatgcaaaaagcttgaatgcatccctcggcttccagcatttctaaaacaactattggcatttgattgccaatctattacaacagtgatgccattgtcaaattcacttattcaaatcccatcaaattcccaagagtgtaacatcttcagattttgtttcaccaatggtcaacaacttgatccaggtgctcgtgctaatattatggatgagtcaaggcttaggatgaccgaggatgcatataggtctgtgttcttttgttttccagggagtgaagttcctcattggctcccttttcgttgcgagggacattcaataactatacatagagattctctagatttttgcagaaatgacaggctcattggtttcgctctgtgtgtcgttttccaactgccagataccaatgatattaaacgcaaatgcggttcttttagttactgcctaaactatgtatctgatcatggcaaacacattctacccaacaatgataacttaaaatcctatttctactggagggatcaagagagaaaacttgatcaagatcaagatcacacattcctgtggaaatataacttagaattcccagagatgagctgcatgagccgtatgctccctcgtgctcgcagcttcacttttgagatcagtccatattatgatgataacattttgcagccaccatctttcttatcaattgacagatacttcaaatcaactgtcaaagtaaaaaaatgcggaatatgccctctttataccaaaaagaaagatgataataatgcaggtgcaggcgactattctggatctgtgagattttcaaaaaatggcattgaagaacctagtggaagcaatgctgcatga

SEQ ID NO: 82324 - DNA, 186 bp, Glycine max
  Peptide Sequence Number=SeqID_174009
ttctacggagtgccgtcgccccagcaaggtatcaggcctcctataaccgggcttcatcaagaagtactgcgccccaggaaggcgcagggtgagacaccagagcagcctagggatggccggcagcgggcaacagacgcaccgccaccacctctagagttcacctcagctcatccacaaaaaggttag

SEQ ID NO: 82325 - DNA, 561 bp, Glycine max
  Peptide Sequence Number=SeqID_174010
atgtcgtatgccgacctgctaccatccttgcttagcaaccaaatggctatgtgtgtagccctcaagcacaaggtacaaagcttgattgatgctggatggctgacatttcaagaggatagtccaaatgtgaggactaatccaatttccaatcatggaggcttggcagtgaacgcagtggaagaatgggagtctcgagggctgagcgacaatggagatctgtgcttaatgcatccaggggcatcgaacgatgtggtaacatgtccaatagttgaggagctgctacattgcgaagaaaggggaaggagatgtatgcatgcagtcggcccccccccccccctgagtaagcctaagcctttggtgatccatttcaccagggacattaccactcagaggccctcaggcttccagccctctatagcaaaggcacctgtacccttcccttataagagcgataaggcagtaccatggaaatatggcgtacaggggcccaatggaaggcaggacgtgtccgtcatacgtgttaggaatgacattccatttgctaagattacaaagatttga

SEQ ID NO: 82326 - DNA, 540 bp, Glycine max
  Peptide Sequence Number=SeqID_174011
atgcctcaccaacctccaggatggaagcacgagattaaagccaggctctgtattccttgcaaggggtttattctgaatgctgagggccaaccatggaaactccttaggaaggatctgactacactagcccagacatggagtgtcttctcttactccaacttagttcccacatcccacacctcatatttgaacatggacagagccaggttggtttatggcttggtaacccacatggatatgaacattggtgccctgatctcaggtcaaatctcttctattgctctaagtaactcctctttacttggatttccagccttgatcactgccctctgcagagctagaggagttacctctgacagtatgacttatcagagcctgagtctggccattaacttggcctacattaggaaaaagtgttggaatgtggatgatctgacagttaactttagaggggcaaggaaggcaagggctcggccagctgatgttccttcttcttctactccaccagctcctccaggcccatctgcccaggacttttag

SEQ ID NO: 82327 - DNA, 192 bp, Glycine max
  Peptide Sequence Number=SeqID_174012
tgtaatagacaaaaaggaagcatagagtgtggctattacgtggtgcactggatgtccactataatattaggaagtttcagaaataattgggaaacgtattttaatgatgttagaccattggaagcagagagattgaaggcgcttcgcatccagtgggcacaatattatctcaaagttagaaatcaaacttag

SEQ ID NO: 82328 - DNA, 311 bp, Glycine max
  Peptide Sequence Number=SeqID_174013
atgactaggggcaatccaagtgatttacaaccctttgatactgaaatagatagaacctttcatagattagttagacatagtgtgcatcctagtcattctgtgcattctgagcattctgttgagggtgattctgattttgaacattctactactaatttttatactgagaacatggctcaacctccacctcatgagaggactcttagggagatagctgcacctgatttcacttatgaaagcttgtgcattcaatatcctgatgagggtgttccttatgttctcaagactggactaatacatttgctgcccaa

SEQ ID NO: 82329 - DNA, 76 bp, Glycine max
  Peptide Sequence Number=SeqID_174014
atggggctaagctctaacttctttaggactcttcttaaggaagcttctcaaggaggtgagcttagttatgagaggg

SEQ ID NO: 82330 - DNA, 257 bp, Glycine max
  Peptide Sequence Number=SeqID_174015
ggttcaattattgacaaaatcattcagctcaaaaagggtgcaaagggtatagttatcattcaagatggaaagactagggaatcagagagagcaacaacttctccgtatgaggaatcagaaagatcaacagctcctccaactggggaatcagggggatcagctgcttctccagctggtgaatcagggggagcaacagtttctctagatggggaatcagagatgataatcagaggtggagatgggagaaccactttcaa

SEQ ID NO: 82331 - DNA, 349 bp, Glycine max
  Peptide Sequence Number=SeqID_174016
atgggtaaagcagagaaggtgcaagagaaggtgaaggccgacatggaggccatgaaagagaaaatggccacaatgatggaggccatgatgagcatgaggaagataatggaagccaatgcagttgcagttgccgctaccagcactgttgctaaggtgaacccgatgcccccatctggcctcaaccaaatgaatcatccaacctcagctatgatttgggaaacacatgaaattccccaccacaatctagccgacttcgagccttgcctcggatatgccactgaagggcaagcggttggtgaaatgggaaagttggatcatctagaggaaaggctcagggccattgaaggag

SEQ ID NO: 82332 - DNA, 129 bp, Glycine max
  Peptide Sequence Number=SeqID_174017
atggagaaaaagaacaaacctgagaaaattcaagctgaaggcataattttggagaccgcgaaaatgcaaataggaacaaaaacgtggaagaaagaaaatcaaagaggtgccacaaacaacgaggtttga

SEQ ID NO: 82333 - DNA, 192 bp, Glycine max
  Peptide Sequence Number=SeqID_174018
atgactaaagcacgtcaaaagggggtacgaaaaataccaggagggttgaacatttttgttcttccctccttcccctatttaaagggaacagaaggggaagcttgccacccagctcgcccaggcgagctaggttgcttcctccagaaggcggtaccttttggagaacttcttggaaggcccaagtgggcctga

SEQ ID NO: 82334 - DNA, 456 bp, Glycine max
  Peptide Sequence Number=SeqID_174019
atggctccgaaaaagcattccacaaagaggtctaggagagacactgcggcggaagggtccagtgccgcccccgagtttgatagccaccgtttccggagtgtcgaacaccagcagcgcttcgaggccatcaaaggatggtcattccacagagagaggcgcgtccagctcaaggaggatgagtatagagattttcaggaggagatagctcgcaggcattggacgttgctggtgattcccatggccaagtttaaccctgaggtagtcttggagttttatgctaatgcttggcccacagaggtgggagtgcgagacatgcgttcatgggtgaggggtcagtggattccctttgacacagataccctcagccagttcctaggtgacccactagttttggatgaagaccagcagtgcgagttcagccagaggaggaacagggccgacgggttcgacgaggag

SEQ ID NO: 82335 - DNA, 462 bp, Glycine max
  Peptide Sequence Number=SeqID_174020
atgggatcgagtcaggtgccttggcttaaaaataggttctatcgggtcacgatcaagagcctaggagtcgccagtctgaaagagttaggacaattgatggatcaactccagcgacaaacctttcgcaaaacctatggtaagatctgggacctaactatggcggaggtctccacggaggccattgcctcccttgcccaatattatgatcagcctttgaggtgcttcacctttggggacttccagttaacacccacggtggaagagtttgaagagatcctgggatgccctctgggaggaaggaaaccatatcttttctcaggcttctatccctccttggctagaatttccaaaatagtcaaaatctcgacacaggaattggaccggggaaagcaagtagaaaatggggtggttggagtaccaaggaaatgtttggaagcaaaggcgagaaccttggtaagatga

SEQ ID NO: 82336 - DNA, 331 bp, Glycine max
  Peptide Sequence Number=SeqID_174021
aggactatacgccctcgcctttagagggttgctcgccttcgcctttagaggactacacgtcctcaccttcagagggcaacacgtgctcgcctttagaggactatacatcctcaccttcagagggctacacgccttcacattcagaggactacacgtcttcgccttgaggactacacgtcctcaccttcagagggctactcgccctcaccttcagaggactacacttccttaccatgaggactacacatcctcaccttcagaggactacacatcctcaccttcagaggactacacgtcttcacctttagaagactacatgtcctcgccttga

SEQ ID NO: 82337 - DNA, 189 bp, Glycine max
  Peptide Sequence Number=SeqID_174022
atgcaacactggatgagcggggttgcactgggggagactcgacataagcgcttgatggaagcttgcttgtggggcttctatggaggctggatctttgagcttcaatggggtcctttagtggtgattttccaccatggagatgcagcggaagacaaaggaaaagaggaattaatgaaacattgggcttaa

SEQ ID NO: 82338 - DNA, 630 bp, Glycine max
  Peptide Sequence Number=SeqID_174023
ggtgaacccttgggtactagtacccttgtctccagaggactatacatcctcgccttgagaggactacacgtcctcaccatcagagggctgcacaccctcacctccagaggactacatgtcctcgccttgagagggctacacgccctcaccttgggtactagttaccctcaccgtcagaggactacacgtcctcgccttgagaggactacacatcctcaccatcagagggctgcacgccctcacctccagaggactacatgtcctcgccttgagagggctacacgccctcaccttgggtactcagttaccctcaccgtcagaggactacacgtcctcgcctttgagaggactacacgtcctcaccaccagagggctgcacgccctcacctccagaggactatacgtcctcgccttgagagggctacacgccctcaccttgggctacgtagtcctcattttcattcctgggccacccctgatattggaggagggccaactgtgcgagcacaaccagagagggaggctatcacacaactactatgcataccggggcaagatttcacccgtgccgctgcaaagagacgagtgcggatcatgcgcaccaacatgaccactcttacacagatatag

SEQ ID NO: 82339 - DNA, 429 bp, Glycine max
  Peptide Sequence Number=SeqID_174024
actttatcctctcaatcggagaggcctacggggcattacgagagaaaaagctcgccgtgggtcaagaccagagagctacaggtacaccaggggcaacagagcactcaggcggggtcggggcaagggcagcacgtcacggaagttctcagcttaatcttaccagcgctatatcttgggtgcgcgatatggtgggactgtctagcacagacacccccaagcatccctgagttacagcagctggcggaggcaacgcaaatcggggaaccggcaagttcttccgcagaagtaaggcagctagtagaccacctcagtgagcaagccagggaggtggccagtgaagcttcaatggaaagaacacccagagctcttgcaatgtggatggctgggctaacgctagcattcgctatctccatagcgcttgctcaaaag

SEQ ID NO: 82340 - DNA, 1251 bp, Glycine max
  Peptide Sequence Number=SeqID_174025
atgtcgttaatgctgagcgtgatcgtcccgatgcacaatgcgggggaattattggagcctttcctggcctcgctgctggcccagcgtgagcagcggttggaggtgatcatcgtcaacgatggttccaccgacggttcgggggagatcgcacaccgttacgcggcggcgcatccgcatattcgtgtgatcgatcaagccaatgccggtgtttctaacgcgcgcaatgccgggctcgccgttgcccgaggcaaatatgtggcgtttcccgatgccgacgatgtgctggcgccggacatgtattccacgctgctggaacaggcggaacaacaccaattagacgtgatgcaatgcaatggcgaacgctatttcaccagccaggatgaattgcagccgatttttcccgaggcgcgtttgcgcaccaccgacgttatcaccggcgtacagtggtttgaacgtgcgctgaaatcgcgaaagtttattcacgttgtatggctggcaatatatcgtctcgactttattcgccagcatcgcctttatttcgagccgggattgcatcaccaggatattccctggacaacggaagtcatgtttaatgccaaacgggtcaaatatttaagcacgccgctgtaccgtcaacgggtgcacgacaaatcgatcagcaaccgccgtcgcaccggtcaggcgaacgtggattatcaacgccactatatgaaaatcgtcgagatgctggagcggctcaaccggcgctatgccggcactgtcgccattcgtccggctttccattggcaaatcacccgcgaagcgctgggcatttgccacagcattcgtcgtgagccggatccggctgcccagagtcagatcaccgaagagttctatcagcgcggcatcgacagagcgattggcgcagcgataacggctgctcgcaaccggcctgagccacaagacgttgggatccgccgcgttagcgcgtatactccttctcccttttgccggagaaaacgacacatgcatgcaggtatgccattactgagtcacgcggagcagcaggaagcggcggatcgcatccatcaactgatggagcagggcatgagcagcggtgaagccattgctcgcgttgcgcaggaaattcgcgagaagcatcagggcgctcaggttgcggtactgttcgatgacgatgatgaagacgagcagcatgaggccgtcccggaggcgtcgcggaatgacgatgctgaagaagacgaagactattga

SEQ ID NO: 82341 - DNA, 255 bp, Glycine max
  Peptide Sequence Number=SeqID_174026
atgggtagatggatatgggcttttgcagctggccagcagcagctttggatttcccaccaaggccaatcttttgaggagaaatatcagtatgcaggaagacatctgccctttgtgtggaagtgttcaggaggatgtgggccacttatttttcaattgtaccttgacaagaggtttgtggtgggaagctatgagttggatccaggttgtaggcccccttccaatcacaccgaagtgccatttcattcaattctgtga

SEQ ID NO: 82342 - DNA, 672 bp, Glycine max
  Peptide Sequence Number=SeqID_174027
atgctaggatttccgcgcgcgctccacgctgctcccgatgctcccaatgccttcgttcacgacgtttcagcgctccacgacttcctcgccgacacacgtagggacgatgccactgttcaggtccccgtccccaaggttctgccgccacttccgcctccgtccgacgctcttcctcttggccctaatgcgctcgatgagtccgcctccatgaaggccaagcgcattgccctccaacgcaagggcgccgccgccatgatcgctgccgaggagagctattgtcgaatttgcaagtgtggagaaaatgaaggaagtgagaaagctcagaagatgctatcgtgcaaaagttgtggcaaattgaaaaagaacattctatacactcctggatgttcagggggcagcagcttgctccctatatggtattctactccacctttcagaatccatcatcaagctaagcatagaatggaatttgagtgggataatgaatatggtagtggtagctcaaagatcatgaagcttaccatcacttatcagcctgatggtagatacctaattgaggtatcaaatgaaactaatttttccctgttcaattacgccacaaattctccaaaaacattaactcaagatgatattatatctttcagacagaacataatggatctcctgttttag

SEQ ID NO: 82343 - DNA, 588 bp, Glycine max
  Peptide Sequence Number=SeqID_174028
atggtagcaggaaatacaaccatagaaaaacctagggaagaatggagtgaggaagaaaagagattagttcaatacaatttaaaagccaaaaatataattgcatctgctttaggaatggatgagtacgttagggtatcaaattgtaaaagtgcaaaagatatgtgggataccctacaagtaacacatgaagggaatggaaacccaagaaatcaaagaagatcaaactttaaaccaaagaaaagggcagaagattcatcctctactctaagatgttatgaatgcaatcaacctgggcatctgagggttaattgcccaatcttcaagaaaagaatagagaaatctgaaaagaaagcttttaacgaaaagaatgcaaagaaggcctacattacatgggatgacaatgatatggacttatttgaagattcagaaaatgaagttgtaaacctgagtctaatggccaagagttatgaaagcgatgaagaggtatccttaaagaagaaatggcacatagatagcggatgctctaaacatatgacgggagatgcatcaagttcactcatatctctcccaagaaaagcggacatgtga

SEQ ID NO: 82344 - DNA, 363 bp, Glycine max
  Peptide Sequence Number=SeqID_174029
atggcagaatcatcaaagaagcgcaaaggatcttcctccaccaccaccgctaaggaacttctagagactcacccgcaccaattcctccctccctttcatctcctcgatcatctacattgttttcttcaaatgatcaatgccaaagtgtttcaaaattctgctttgactgagtttatgtctctgaaactgcctgactttcctgaattagttagagtcttctataataacttgaaaattcaggatggtattatttattctgaggtgcatagtattccaattattattgatcagtccttgttctttcccttgacaaaactacccagtcaaggtgttcattttgagggcaccattgttgatgactga

SEQ ID NO: 82345 - DNA, 510 bp, Glycine max
  Peptide Sequence Number=SeqID_174030
atggttaatgtcaatcttgcaattgggggaggatcaagcctacataaagagaagttccacaactatctgggggttgtagctcgagaaaaaattcctattgtccgtcacagttggaaagacgtaccaaaatctcaaaagaacccaatatgggttgacaatttggatccttctgttaaatatggtttggatccacaaactagggaggaatttgctgcaaaccaaaaaactcctaattggcagaaaaaaggcttaacaaattcaaaaaataatgactgcccccacttattgtctcgtgagggttatgatttgcttgaaaagaaccttatggagaagacaaggaagaacaaacaacaggatgcaataaatattgaggattcaacaatgattatcgaccctccatctccaattgcaagacatgtgaagtggaagatggcttgcacaaagcgatatggacagatgacatctaaggcgacacaagaaatatctaataaatttgtgagttcttgttaa

SEQ ID NO: 82346 - DNA, 651 bp, Glycine max
  Peptide Sequence Number=SeqID_174031
atggatttcgaaatctgccctattatgcagaaaaatgctgttgaattgtgcaacaaatttttgatgtgtgcagaaaaatgcttgtgcattgctggttatgggaaaggtgctgagaggaacgaggataagggctacgtaggagtgcagtggtacctggagatatgtcgctggggtcaggagaccttggggacatcagggcttaaaaatggacacaggaagttaaaatggcctctggtaatcgattaccaatggggtgtaatcaattacacaggtgagtttgggagaccctcgaaggcaatgagaggtgccgattccgtggcacaattcgactcactgctacttcatccggaggaacccgcacgcacacttcagcagtccgtggagtggatactacctacacctactccatatcgactagtggagccagttcaagtgataaaggtgtcatcctctggagcagcctgtggggttcggcattggcggcagtttgggaaacatgcagcaactgaccctcacggaggccgacagggcggcggtagccgagatagggaggttcctgatgctaaaaaggatgttctctatttaacaatgctcatgcgttcctatcttgtctcctggactgctagaccccgattcctcatgatagcctag

SEQ ID NO: 82347 - DNA, 141 bp, Glycine max
  Peptide Sequence Number=SeqID_174032
atggaagcctcaaatttcccttatacttggtggagtgggccactcaggaatgacctttattctctaaaggctaaaggccgaagtggagaaggacgaaggccaaagtggagaaggataaagcccccgagtggagaaggatga

SEQ ID NO: 82348 - DNA, 111 bp, Glycine max
  Peptide Sequence Number=SeqID_174033
atggataacagcatgaaggtaggagaagatgagtggagggagagggagaaaaggggcacgaaatttatgcctcaaataaggacttcctttgtgttccaccttggcttgtga

SEQ ID NO: 82349 - DNA, 668 bp, Glycine max
  Peptide Sequence Number=SeqID_174034
atgagtgcaaatgatatcatcattgataaacaggtgttttatgtccaagatccttgtgatgaaaggtggtcagcggttctacatggaaaaaccattggtgttaatcttgaagatgatgattcaacccttaatgcttctcacattcctttgtccacacacatgcctaccatcaatggagaagatgaagttgatgatatacatggaaatcgtaatgcaccttcaccatctacgtccaagaggactagacaagccacatggctcagatcattatttgccagacctgtgggtttggtgagaccactggttcatgtggagcctaacactaggaaagctactggcaaggatgatgatgatgagactatgtgtgacaagtatggtattaacaaagacaagtggaaccaattatatgaaagccatagagacccttcatgggaaggtacatcctttgtggcacaagtagagggtacatctacttgggttgttgtactgagaacaagagagggtacatctcttgtggatccgttcaagtggagggtacatccacttggttgttcaaagagaacaagggagggtacatcccttgtggatctttggcttgtaaaggattttacaaggttgaaagaaatctcaagaaccgttggttgcttggggactggatgtaggcacgg

SEQ ID NO: 82350 - DNA, 135 bp, Glycine max
  Peptide Sequence Number=SeqID_174035
atggctgatggaaaattgatagagatgaagggtagaattaacctagggttaaaaggtgagaatgactgtgggaaagcttgggctgtgcaaaggaggaaaatgagtgaccaaagtgaaggcaagagccatttctag

SEQ ID NO: 82351 - DNA, 429 bp, Glycine max
  Peptide Sequence Number=SeqID_174036
atggctcaagttcaaccaatcaacaaaaggtggaatgaagtggacaacaaggtggaggcaaaccttaaagcaattgaggaaataaaagctgcaactgatatggctctgaggaatacagagatggtagattctgcaaaggttgaagttgagggtgaactgaggcttattgaagaacaatgtgttaagggagggacctattatcccattactgtcaagaggcacctcaagaaggcagaacttcatattgatcttaatccaatattccatgaaagaaccaaacacatagaatttgactgccactttgttcaacagaagttgttggctaaggaaattagtatggggagaagtagctctaatcatcaaccagagagtgatctgaatcaagcaatctcaatccaggataaggaacttaaacctaggtggctataa

SEQ ID NO: 82352 - DNA, 792 bp, Glycine max
  Peptide Sequence Number=SeqID_174037
atgggttttttcaacacacatgtagatgttactgaaatcattttaggtgacaaatgtttgaacatatctatactacaattgtggatgatgtttatgaatgattggagggcaagcttaggttatggttcagtatatggtttccttgaaccgcagtctatacaccacgcaaaggacaaacgtgaagaatgtcaacaatacatagaaacgtgggtcaaggaatcacatcaacaactgtacttaggaccttacttgaatcaaaatcatgttggtttggctccttctgaattagccctggctatagagaggcatgtgttggattgtggttcaattgataatgttggcactgccggtatcttggaactgcatcttggagcaatcaacaacatccccaacaaatgtcacctagaaattgacacaagagacattgatgaggaaagaagaaataaagtggttgacaaaattcatcaatcagcaattaaaataaccaaaacacgaggtgtcaagttctctcatttccgtgtcatcaatcaggatccactatccctttctaatgaagcagtcatgaaggcagtagagactgcaacaaaagaactaaacttgacaagcaagttgatgattagtagagcctatcatgattcattgcttatggccaggttgtctccaatgggcatgattttcattccatggtacaaagggtacaaccataagcctaaagagtttgccaccattgaagatatgtcaaatggtgtaaacgtatcggcgctcaccctagccaaattgtccagtcaataa

SEQ ID NO: 82353 - DNA, 207 bp, Glycine max
  Peptide Sequence Number=SeqID_174038
atgaagctgctaagggtccagctcaaaagaaacaaaatcaagggtttcctaagctaccagaagccaattgattctgaaagatggatctttgttggagatggtaaatcggtggagcttcttatggtgaatcctttaatgcagaactgtgtggtactaagcgtagaattgataatactaactcaagaacattatggcataagcgcttag

SEQ ID NO: 82354 - DNA, 145 bp, Glycine max
  Peptide Sequence Number=SeqID_174039
ggcgaagtgcaaatctttaatcggtgaaaaaaatgcgtgggactatgtgatgcaatcctaccccgcaaggacattggatagaagactccaagtagattgggccagagatgcaagagaagaccctagggttcttatgagtcttagg

SEQ ID NO: 82355 - DNA, 181 bp, Glycine max
  Peptide Sequence Number=SeqID_174040
gatccccgtcctagatgaagggaatactttctccaagaacaccctcttaaggtcatcccagctgaaaatagacctgggagcaagggggcttcatggtggaacaaacaatatggaactccttaagatgtttatgaggatcttcacctgcaagaccatgaaacttgggcagcaaatgtattag

SEQ ID NO: 82356 - DNA, 327 bp, Glycine max
  Peptide Sequence Number=SeqID_174041
atgaaggacaagtatattgttcaaagcttgttaaagaactttgaaaaaatcaagaacaagcttgtttgcacatcgttcgcgtgtatgatatccactccacaagcttgtggttacgtgagcatgaactacaaccaatatatagatgttgtttacataaatgagcacatcttaaaagcttactccacacaatggtggcatcttgggaatgaagcgactattcctccttctaatgatgcatggacacttatccctgacccaactacaattcgtgcgaatggtcggcctaaatcaacaaggataaggaatgagatggattgggtcgtgtga

SEQ ID NO: 82357 - DNA, 804 bp, Glycine max
  Peptide Sequence Number=SeqID_174042
gtcgcggtaggcatccgccctgcggctttcatcctcgtcgtcggtgatgttgatgccaccggtgaaggcgaggcgcccatcgacgatcaccagcttgcggtgggtacgcaggttcaaccacgggcgcttgaacggcttcagcagctgccgtgggtggaaccagatcgcttcgccaccggcgtcgagcagcggctgcaggaagcggcggggcagggcggaagagcctacggcatcgagcagcaggcgcacctgcacgccggcctgtgcacgttccaccagcgcgtcacgcagggcggttccggcatggtccgggttgaagatgtagtactccagatgcacgtggtcgcgtgcctgtgcgacggcctcaagcagcgcggcgtaggtcgccgcggcgtccaccaaccaggtcacttcggtggggctgctcggcgcaagcccggtcgtggcctgggcgatcttggccagctcggtgcatgctccatgcccgaccgcgcgcgggccacggcgcaaacgctgccgcttcaccttctgcgggcccagcaggtagtagatgaagaggcccaggtacggcagcagcgccagcgacaggatccagctcagcgtcgccaccggctcgcgcttctgcagcatgatccagccggtcagcgcgagcaggtacagcagataggccaccgccaggatggtaccgaggtgggcaatgccgtccagccagtggcgcagggagtcgaagagggcgagcatccgccgatcatagcggcgcatgccacccgatgggatccaacctcgacccgtgtgccaggatga

SEQ ID NO: 82358 - DNA, 1768 bp, Glycine max
  Peptide Sequence Number=SeqID_174043
gcatcaagatcgtccagccgacgagcgtggtgatggccgtcgcgatgatttccactacgagggcggcatccgcagcttcgtggagcatctggcccagctgaagactccgttgcacccgaacgtcatctcggtcaccggcgagcacaacggcttcgtggtggacgtggcgctgcagtggaccgactcctatcaggagacgatgtactgcttcaccaacaacattccgcagaaggacggcggtacccacctggccggtttccgcggtgcgttgacccgggtgctcaacaaatacatcgagcagaacggcatcgccaagcaggccaagatcaacctgaccggcgacgacatgcgcgaaggcatgatcgcggtgctgtcggtgaggtgccggacccgagcttctccagccagaccaaggaaaagctggtcagctccgacgtgcgtccggcggtggaaaatgccttcggcgatcgccggcaagatcgtcgatgccgcccgtgcacgtgaagctgcgcgcaaggcccgcgacctgacccgccgcaagggtgcgctggatatcgctggcctgccgggcaagctggccgactgccaggaaaaggatccggcactgtccgaactgttcatcgtcgagggtgactcggcaggtggctcggccaagcagggccgcaaccgcaagaaccaggcggtgctgccgctgcgcggcaagatcctcaacgtggaacgcgcgcgcttcgaccgcatgctgtcctccgaccaggtcggtacgctgatcaccgcgctgggcaccggcatcggccgtgacgagtacaacccggacaagctgcggtaccacaagatcatcatcatgaccgacgccgacgtcgacggcgcccacatccgcaccctgctgctgacgttcttctaccgtcagatgccggagctgatcgagcgcggttacgtctacatcggcctgccgccgctgtacaagatcaagcagggcaagcaggagctgtacctgaaggacgacccggcgctggacagctacctggccagcagcgcagtggaaaacgctgcactggtgccggccaccggcgagcccggcatcgaaggccttgcgctggagaagctgctgctggcctacgcggccgcgctggattcgatcgagcgcaacgcacatcgctacgaccgcaacctgcttgaagcgctggtcgacttcgtaccgatggacctggaaagcctgcgcgctgccggtgaaggcgagggcctggatgcactggccaagcgcctcaaccagggcagcctgggcagcccgcgcttcacgctggaactgcaggaagccaacgacgagcgcccggccgctgtgctggtgacccgtcgccacatgggtgaacagcacatccaggtgctgccgatgtcggccttcgaaagcggcgaactgcgcgcaatccaccaggcatcgaagctgctgcacggtctggtccgcgaaggcgcgaccatttcccgcggtgccaagtcgatcgaagtcgacagctttgccaaggcacagaactggctgctcgaggaggccaagcgcggccgccagatccagcgattcaagggcctgggtgaaatgaatccggagcagctgtgggacaccacggtgaatccggaaacccgtcgactgctgcaggtgcgcatcgaagacgctgtcgctgctgaccagatcttcagcacgctgatgggcgatgtcgtcgaaccgcgtcgcgacttcatcgaagacaacgcgctgaaggtcgcaaacctggatatctga

SEQ ID NO: 82359 - DNA, 129 bp, Glycine max
  Peptide Sequence Number=SeqID_174044
atggaggagaagcctagcacatgggaagcttccttgagaagcaaggaaggtagattccttgggaagctagaggaagaaagcttccatgagaagctagagaggggctactcacactcctccaatagctaa

SEQ ID NO: 82360 - DNA, 153 bp, Glycine max
  Peptide Sequence Number=SeqID_174045
atgctggcgctggcgttcctgatcctggtgggcttcacgctgatgctggaaagtttccaggtgcacgtgccgaaaggctacatctacttcgccatgttcttctcgatgtcgataaagacttatctgagacgcgcttcgccgagagtttgctaa

SEQ ID NO: 82361 - DNA, 492 bp, Glycine max
  Peptide Sequence Number=SeqID_174046
ggccacgtaggcgccggtgatggcggcggtgcgggtgccaccgtcggcctgcagcacgtcgcagtcgagggtgatggtgcgttcgcccagcgcgttgcggtccacgcacgcgcgcaggctgcggccgatcaggcgctggatctccagcgtgcggccgccctgcttgccacgggccgcttcacggtcactacgggtgtgggtggcgcgcggcagcatgccgtactcggcggtgacccagccttcgcccttgccgcgcaggaagcccggcacgcggttctcgacgctggcggtgcacagcacgcgggtttcaccgaagcacaccagcaccgaaccttcggcgtggcgggtgaagccgcgttggatgacgaccgggcggagctggtcgggctggcggccgctggggcgggaatcggacatggtgcgggttccgtaatggcgagggagtacgccgccacgcccgcggccttcacggggcgggcaagggggctctga

SEQ ID NO: 82362 - DNA, 483 bp, Glycine max
  Peptide Sequence Number=SeqID_174047
atgccacccaccaggcaccctctagacccggataagtctaacagggccctggggtttccggcgttgatcatgggactctgccagtcattcggggttcctgtcaaccccagtaaggtgatccgaccgccgatcacccgggctttcatcaagaagtactgcacacctaggcaggcacaaggtgatgcacatcaggtcgcagacacaccgccaccacctcatcatgccagtcccgctggatcactaggcatgaagcgttatctacagcacttggttcgccaccgcagtcagcaggggcagagttccaccccttttgtgtgccctaccccggagcagtttgcggttgaggtcgcatggccgggagactggcccgatgcccaggcaagggaggagcctgcaggatcccccggtaggatggatgagccccgcatggacgaggatatgactgacctgttcgatttcttaggagggaatggagccacatga

SEQ ID NO: 82363 - DNA, 90 bp, Glycine max
  misc_feature (32)..(32): n is a, c, g, or t
  Peptide Sequence Number=SeqID_174048
atggatttgctgggtgagacctcctttaaggncggtgacattgaagcacactctagctccatgagggaaatcagtgcgcagacgtgttag

SEQ ID NO: 82364 - DNA, 495 bp, Glycine max
  Peptide Sequence Number=SeqID_174049
atgcatgacaaaggttgcatgcatctcatccctaaatatcatgatagaccctggggtactagtacccacacaatcagagggctacacgccctcaccttcacaggcctacacgtcctcgccttcggaggactacacgtcctcgcctttagagggctacacgccctcgccttcagaggactacacgtcctcgccttcaaaggactacgcgtcctagccttcagagggctacacgccttcaccttcagaggactacacgtcctcgcctatagagggctgcacgccctcgctttcagaggactacatgtcctcgccttccgaggactccacgtcctcgcctttagaggactacacgtccttgccttcaaaatgttgctcgctctcaccatcagaggactacacgtcctagcctttagacggttgcacaccctcaccttcagagggcaacacatcctcacctttagagggctacacgccctcaccttcagagaactatag

SEQ ID NO: 82365 - DNA, 171 bp, Glycine max
  Peptide Sequence Number=SeqID_174050
atggttaatagtgttttgaagggattcaacgataatcacagaagtaaatcgaaggcaactgctaaatggatttcaattgaatgtaataagcaaaggggaagcattgagtgtggctattacgtcatgcattggatgtcaactatagtcctaggaagtttcaaggataattga

SEQ ID NO: 82366 - DNA, 522 bp, Glycine max
  Peptide Sequence Number=SeqID_174051
atgatgggtacctcaaagccttacactggggcaataaggggcatcgtgcatgagcctcaaggtggacccttgggtaatagtaccctcaccgtcaaaggactacacgtccttgccttcagagggctacacaccctcaccttccgaggcctacacatcctcaccttcagaggactacacgccctcaccatcagaggactacatgtcctccccttcagagggctacacgccctcatctttagaggactatacgtccttgccttcagagggctgcacgccctcgccttcagaggactacatgtccttaccttcagaggactacacctcctcgccttcagagggctacgtgccctcgcctttagaggactacacctcctcgccttcagagggctacatgccctcgccttcagaggactatgtgtcctcgccttgagagggctacaagccctcgccttgagaggctgcaagtcctcgccttcagaggactacacaccctcgcctttagagcactgggggatcctctag

SEQ ID NO: 82367 - DNA, 498 bp, Glycine max
  Peptide Sequence Number=SeqID_174052
atggcagaatcgtcaaagaaacgtaagggttcatccgcctccgcctcggcttcaagagatcatcgttccgaaaccaacagcgcatccacagcaccaattccaccctccttatcttcttccacactattttcttccgaagaacagcagaaatggtactcaaatcttttctcatctcgttccattttcgaccctaagtttattgatatggaattcttttctgctgaaacttttcattgcgttcaagcctttcagaacctaggtcttatacctttcatgtcattacacttgcctgtttatcctgaattggttaaagccttttattgtaatcttgaaattcaggatagcactttgatttctgaggtttttgggataaaaatggtcatcgaccaatcccttttccatgacttaacccaattgtccagtgacggtgtaccatttgaaggtacactgaatgacgattggaaatttgatttctctgcacatgatgcccgccagttg

SEQ ID NO: 82368 - DNA, 552 bp, Glycine max
  Peptide Sequence Number=SeqID_174053
atgacagcgcattgcgccatgctgcagcattccggggttctggcccctgtactggcatccctcgcattaaacgtggcgcggattgccagagcgttgtcgcggcttgcgtcctataatattccaatgaatgctaccaacgctatcgaccaactggccccccaaaaatggaccgaaacatctcccgcagaacgtttgcgccttctggaggaaatccgtgcaaacatgaagaagtacggtgatgaccttgccctcgctgacagcaagatgaagaatggcatcctcggtgcgcctcttttttcacaccccctgtctaaggttgcgaccgtcgttcctatggcgagtacagtctcggccgccattctcctttacgaatccattctcgacggcaagatgcctcagccgctgagcgtggaaaaagttagcgaggatctctacgacatttatgtctttccgcaggagcggaaggacaagttgatgtacgcggatcagaagagtcgcatccgtgtgaaaggtgaaccgaaacaaatcaatccgatggaaaagccctgcccg

SEQ ID NO: 82369 - DNA, 231 bp, Glycine max
  Peptide Sequence Number=SeqID_174054
atggtccgtggcggcgatggccagcagcagcggtggtggaggatgatccctttcgcttcttcgatgattctgccatttgatgaagttttagggaatttcaatcggtggaatcgaaagaggagtgaaaatgaggaagattgggctttgcgggacgtgttttggagtagtaagccttctggtaatcgattacaggctgttgtaatcgattacaagctgtatgttcttgtgtaa

SEQ ID NO: 82370 - DNA, 151 bp, Glycine max
  Peptide Sequence Number=SeqID_174055
atggccgaccagcaggcgaccaagtccaaagccaaaggtagggcaccattgaagaggattccagtgtggccccacaagttgacacaggctttgacaaacaacgattccagagcggggaacatcaatagcgtttcgaggccatcaaaggatg

SEQ ID NO: 82371 - DNA, 286 bp, Glycine max
  Peptide Sequence Number=SeqID_174056
tgattgtgatgtggacataaccaagggcaaggacaatgaagcacttgaaggtcccatgactagaggcagacttaaacaagcccaatacgtcatagagacaaggctgacttatcaaggtaatccttgtggcgtctaccctgacttatcttccttcattggaagtggcatctaccctgacttatcttccttcaccggaagtggcgtctaccctgacttatcttccttcaccggaagtggcgtcatccaaacctctgtagcctgtatcaaacgatccgctcctactcag

SEQ ID NO: 82372 - DNA, 378 bp, Glycine max
  Peptide Sequence Number=SeqID_174057
atggatgaaattcattaccgacgaccgcttgaagatacagttgagttgttatgcaccattggtagaacaccaaatgcaattttaaacttacttgaaggccccagtatccctactcatgatgcggttctgtattacaacggaaggtggaacatgccacgccaaaacaactttgtgcgttacgcgttcacaggaataaatccccaatattctaaaattttaaaatttgaaattattgagctgaaatctgacgacgacgtgctgaaggtgttggtagagtcatttttctggaaacaatttgtgccaatagaaattttggctctgtttagtaaagtggttttggaaaatgatgacgaggtggttacgtccttgcatgtttga

SEQ ID NO: 82373 - DNA, 63 bp, Glycine max
  Peptide Sequence Number=SeqID_174058
atggcaatggttcagactactggaaaacgagggtttagcctgaatcctaatcctgataattga

SEQ ID NO: 82374 - DNA, 480 bp, Glycine max
  Peptide Sequence Number=SeqID_174059
atggaacccaaaggcatgcttagcgcgagaatacctctatactcactaagcgcaacaatcgggcttagcgctttctcaatctccatatatctagaagaggacaataagaggggtgattgtggttgtgagagagacaattacaattgtgggtgtggatatcagtttgtggagggtggcactggtttgagtttgatgcaaaggttagtggtgttgtgggtggcgatgcacggttgggtatggtgtttgggtgatgagtgcggatctttgttcatggaggttggtgtgcatgtgacagccaccaccaaccttgtcaccttgcgtcgttgctatgacagtgtctgcaatctccttaatgcgcgaggtgtcgacatggacaaggcggaggttgagatcaacggcaagggcacagttgacgatgcggtcgacaaacctaaggtagatgatgaggtggtaggagtggaggcgacgcgagggaggtag

SEQ ID NO: 82375 - DNA, 486 bp, Glycine max
  Peptide Sequence Number=SeqID_174060
atggaagatggtgcttccaaaacgaaggaggaatatatagaggaatctacctgcattgagttagggttagttaacagtctcaaccgtgagagacacaatgtggaacaatggcgcaaagttgagtttacaaaagaggagaagaagttaggcatggctggcagggaagattctaactcagggatctttcaacaacaaggctttcatgataacaatagcgcaaatttggaaggaagagatacgaatgaaattgatctagatgatttaccttatgggacattgatgaaagcatctcccgtgagagcaaacatggtgactggaattaggaatgaggtaaagattgggatctttagaaggaggatatattacttggacaagggctcgattactaggaaagaaagggagaacaggagatggaagttgaatattgcacaagtccaaaaaaatttcatagacacaacggtggaggctgttaaacagccttactga

SEQ ID NO: 82376 - DNA, 396 bp, Glycine max
  Peptide Sequence Number=SeqID_174061
atgaagaggactgatgcaacaataaaaaatttggaggttcaaataggccaactagctgagctagttgctgaaaagcccactaaaacctttacggtaaatattgagatgaagcctaaagaggattgcaaggagaaaagaaggaagaaagagaaagaaatgaggagaaagcaagaaagtattctccaagtcaatacccctcctcatcaactgattgtcaaggaagaaaggcatggaaaacatgagaaagccttaagtgtcattctttccttgatctctaccacttctcttgcaataatgtggaaggtgcttccagaatacatgagtttcatggcgtctctagctaagaggcgaaaatgcaaggaagatgtgttctacgtgaccttcatgccaccttga

SEQ ID NO: 82377 - DNA, 921 bp, Glycine max
  Peptide Sequence Number=SeqID_174062
atggctgaatcatttatcttcagcatcgctgagtctctaataacaaagcttgcttctcatgctttccaagaagcttctcgggtggtgggtttgtacgaccatctccgagaccttaaaaagactctctcattagtcaaggcagtgctgttagatgctgagcaaaagcaggagcataaccatgagctgcaggaatggctgaggcagctcaaaagtgtcttctatgatgcccaagatgtgctcgatgaatttgagtgccaaacactgcgaaagcaactgctcaaagctcatggcaccatcaaagacgaggtaagccacttcttctcaagttctaatccacttggttttcgttccaagatggctcaacaaatcaaagatctcagcaagaggctagacaaggttgcagctgataggcataagtttggtctccgaataattgatgttgacacacgagttgttcataggagagacacgagtcgcatgacacactcccgtgtgagtgactcagatgtgatcggaagggaacatgataaagaaaagctcatagagcttttgatgcagcagaatccaaatgatgacgataaaaatctctctgttatccccattgtggggattggaggcttgggaaaaacgacacttgcaaagtttgtgtttaatgatgagagggtagatgagtgtttcaaattgaagatgtgggtgtgtgtttctgatgactttgacatttaccaattgtttatcaaaatcatcaattctgcgaatgttgctgatgctcctcttccccaacagaatttagacatggtcgatctggagcaattacaaaatcaactgagaaacatacttgccggtcaaaaattcttacttgtcttggatgacgtatggaatgatgaccgtcttaaatgggttgagctgaggaatttaataaag

SEQ ID NO: 82378 - DNA, 1842 bp, Glycine max
  Peptide Sequence Number=SeqID_174063
atggctcaattatttctcttcagcattgctgagtctctcataacaaacttgcttctcatgctttccaagaagcttctcgggagagacacgagtcgcatgacacactcccgtgtgagtgactcagatgtgatcggaagggaacatgataaagaaaagatcatagagcttttgatgccgcagaatcccaatgatgatgacaaaagtctctctgttaaccccattgtgggaattggaggcttgggaaaaactacgcttgcaaagtttgtgtttaatgataagaggatagataagtgtttcacattaaagatgtgggtgtgtgtttctgatgactttgacattaaccaactcattattaaaatcatcaattctgctaatgttgctgatgctcctcttccccaacagaatttaaacatggtcgatctggagctattacaaaatcaactgagaaacatacttgccggtcaaaaattcttacttgtcttggatgacgtatggaatgatgaccgtgttaaatgggttgagctgaggaatttaataaaggtagggggtgctgcaggaagtaaaattctagtgactacacgtattgattccattgcttccatgatggggactgttacctcttacaagttacgaagcctttctcccgagaattcattgtctctttttgtcaaatgggcatttaaagaaggcaaagaggaaaaacatcctcatttggtaaatatcgggaaagaaattgtgaaaaaatgcagaggggttccattggctgtgagaacattggggagtttactattttcaaagtttgaggcaaatgaatgggaatatgattatgaatttagtagtgttgaggtaactaggctttgggaggcacttggtgtccttgcaccacccagaaagaatgagacaccggaagatgttgtcaaacagtatctggatgaattactgtcaagatctttccttcaagattttattgatggtggcactatttgtcaatttaaaattcatgatttggtgcatgatcttgcgctgtttgttgcagaagatgagtgtcttgtcctaaactcccacattcaaaatattcctgagaatattcggcatctatcttttgctgaatacaattttcttggaaattcattcacctcaaaatcggtagctgagctggaagcattgcccaaaggattaagaaaattgattagtcttcggcatttgtatataagtacaaagcaacctgttttgccttacagtgagattgccaacttgatctcgcttgcacagctgtctattggatcaagccataatatggagtctatctttggaggggtgaagttccctgctcttaaaacattgtatgttgctgactgtcatagtctgaagtctttgccactggcagttacaaattttcctgaattagaaactctgattgttaaagattgtgttaatctggacttagatctgtggaaggacgaccatgaagaacaaaaccccaagttgaagttaaaacttgttggattttcacgtttaccacagctggtggccttgcctcaatggcttcaagaaactgccaactccttacagtccttgtttattatgaattgtgacaatcttggaatgcttccggagtggctgtcaactatgactaatctgaaagtacttattatatcagattgtccaaagcttacatctctcccggataacatccatcacctaaccgcacttgaatggttgagaattgtcggttgtcctgaactatgtagaaaatgccagccccatgtcgctcctttggcaacccctggacgtggatcaggaatggtcaaacgtgagaaaaggggagaccatgatgtttga

SEQ ID NO: 82379 - DNA, 528 bp, Glycine max
  Peptide Sequence Number=SeqID_174064
atggcacctcctccttccattgtcgccccaacaaatcatccaccgccgcctccaagaaactcaaggccttccaattggagcagttccagtcctcccgcaaggctcaaatcaagaaggaacactccctcaaatccctctccaagtccctctccgtctggctcaacttcctcctccaaaaccctacctcctccggctgccacctctcagcctccaatgtcgcccctgctcttgccaccaacggcaagcgacatggcactccataaacctctgttgtcggcgttgattccacttggcgaactcccaagcgctagaggaagacctgcggaggttcctgattcctcgttttcgcaactcagtgattctctcaagggcgtgtgcagtttcgatgatttcaagcagcgaatgggggtttatctcagcctcccagcatgtaaagagatcttccatcaaattaaccgtgtcaccaagggatgttgtgcagcggagcacgtggaggcggacggaggacaggtggcgcttggtggatag

SEQ ID NO: 82380 - DNA, 135 bp, Glycine max
  Peptide Sequence Number=SeqID_174065
atgctgaagggacaaaactgtgatgaaccattgaccaccaaaggggacaatatctcagacaaggtgaccctaacgatgcttgagtatttgaggtcagaacaaaagacaatcgaaatccttgaagtaaggatttga

SEQ ID NO: 82381 - DNA, 137 bp, Glycine max
  Peptide Sequence Number=SeqID_174066
ggatcacgcccgcaaggcaactctatggacccagagaagtccaacagggtcttggagttgccagctctgattacgggcctccgtcggttctacggggtgcctgtcgcccccagcaaggtcatcaggccccctattaa

SEQ ID NO: 82382 - DNA, 189 bp, Glycine max
  Peptide Sequence Number=SeqID_174067
atgaaggttgaaatcttgctgccatctattaatcccgaagagagaaaagttccattggctacccttagctttcaagagtattggcaagacttaagcgtgcccttcaaggaacctgaggctacattccctcctactatgaaagggagcttatggacaacttccaaggctatagagcaaggggaagtatga

SEQ ID NO: 82383 - DNA, 327 bp, Glycine max
  Peptide Sequence Number=SeqID_174068
atgtgggccatcatcaaccaatacaaagagaagctaaatctagcttcaacccatgagcaaaggtcaaaagacgagtatgcgaaggtatcggtcctgcaagcaaaaagggaagcaagggagaaggtgatagattcattaaacagagaagcaataatgtggatggataggttctctttcaccttgaatgggagtcaagagcttccaagactgctagccaaagccaaggcgatgatggacatgtactcggctcctgaggaagttcatgggctcctcgattattgccagcacatgatcgatttgatggcccatataattaggaaccactaa

SEQ ID NO: 82384 - DNA, 815 bp, Glycine max
  Peptide Sequence Number=SeqID_174069
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatacagtaaataatcatggagaatcaatagaagaaaattcagcacctgtacgcgaccaattcacccaagataaagacgaggttgataccgattgtatgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 82385 - DNA, 174 bp, Glycine max
  Peptide Sequence Number=SeqID_174070
atgaagtttttcgacatgtcgggagtcgaaaggaagcattattgcgcaatccgtaaagttcagcccacttggaccttccagggtgttccaacagaaggcggtgccttctggtggaaggaacccagctcgcctcagcgagctaggcggcaaccacctccctcttttcccctataa

SEQ ID NO: 82386 - DNA, 564 bp, Glycine max
  Peptide Sequence Number=SeqID_174071
atgagcctcgatctcagggccatgaatctccgcgaccaccctgatggaatgggcaagccagcgttgttcaaagtccatcagttcatggtggtctttaatccagctgatctccatgtcgatggaggtgaactcggtttcgtgccgcgatgtgaaggagggttcagcacggaagaccgggccgatctcaaataccttctccatgccgccggcaatagccatttgcttgtagaattgcggcgactgcgcgaggaaggccgtggtgtcgaagtatttgacggagaaaacttcagctccatcgaattcctgcagcccgggggatccactagttctagagcggccgccaccgcggtggagctccaattcgccctatactggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 82387 - DNA, 414 bp, Glycine max
  Peptide Sequence Number=SeqID_174072
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtgggttttcccagtcacgacgttgtaaaacgacggccagtgaattgtaatacgactcactatagggcgaattggagctccaccgcggtggcggccgctctagaactagtggatcccccgggctgcaggaattcgatctggatggaccatggcaatggccgcaagttgatggacgcgttctacgccaactacaacatcaagcttatcgataccgtcgacctcgagggggggcccggtaccagcttttgttccctttag

SEQ ID NO: 82388 - DNA, 342 bp, Glycine max
  Peptide Sequence Number=SeqID_174073
atgagcaatttaaatcttgacgaagatgatgatcatgatgatgatgattatcttgagtctaactcatacgttgaagagtctttagacgaagatgatagtgttgacggtatatctgatacagacgatgaagtcaccgatattcctcaaccagtaagaattgttcacccagtagaagcttatcgataccgtcgacctcgagggggggcccggtaccagcttttgttccctttagtgagggttaatttcgagcttggcgtaatcatggtcatagctgtttcctgtgtgaaattgttatccgctcacaattccacacaacatacgagccggaagcataaagtgtaa

SEQ ID NO: 82389 - DNA, 285 bp, Glycine max
  Peptide Sequence Number=SeqID_174074
atggccaccaccgaagccttggaacgagaaaccaagaaggctcgaaaggaagaacacggcatgatcttgaaggaccagttaaaggcttaccttaggtcgaaaagaaatttgtcccaacagttaagcgaggctgaaaggaatatgtgggtcatcattgataagtacaaagagaagctaaacctagcaacggctcatgagaaaaggctaaaggataagtacaccaagatatcagcggaaagggaagcaagggaaaggataatctactcattcacagagaggcaatga

SEQ ID NO: 82390 - DNA, 917 bp, Glycine max
  Peptide Sequence Number=SeqID_174075
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgtggaggcattgcactggagatggtacagatcttcagtgtcccacgtggggaggggggaccactgtaggcagggttgtcccaggctccactccccatcttttggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 82391 - DNA, 636 bp, Glycine max
  Peptide Sequence Number=SeqID_174076
atgtcctcgccttcaaagggctacacgccctcaccttcagaggactacacgtcctcgccttcagagggctacacgccctcaccttcagaggactacacgcccttgccttcgtcagggctacacgtcctcggcttcagagggctacacgtcctcaccttcagaggactacacgccctcaccttcagaggactacacgtcctcgcctttagagggctacacgtctgcttcaccctcggaggactacatgtcctcgccttagagggctacacaggactacgcgccctcaccttcagaggactacacgtcctcgccttcagagggctacacgtcctcacctttagagaactacatgtcctccccttcagagggctacacgccctcgccttcatagggctacatgccctcaccttcagaggactacatgtcctcgccttcaaagggctacacgccctcaccttcagaggactacacgtcctcgccttcagagggctacacgccctcaccttcagaggactacacgcccttgccttcgtagggctacacgtcctcggcttcagagggctacacgtcctcaccttcagaggactacacgccctcaccttcagaggacccgggcttacacgtcctcgcctttag

SEQ ID NO: 82392 - DNA, 262 bp, Glycine max
  Peptide Sequence Number=SeqID_174077
atggcatattcgtcatcatgcgcatcaagtatacaaacgaggtctggtccaattgagggtgacgttttgtggatgcaacccaagcatgtttcagaacatgtttggaatggagaagcagacagaaaactacacatcagacgagcagtgccgacgtatcaaggtgaagaacaaataccagaggcaattgttcctctgcttcggcaatgtgggttttattggataattaagatgggatacctaaagataaatgcagccttaatta

SEQ ID NO: 82393 - DNA, 294 bp, Glycine max
  Peptide Sequence Number=SeqID_174078
ctaagcgagtatgtctcgcttagccagagtctttgtttttgtgttgtcgcgctaagtgcgccctacgcgctaagcgagtgctgttattttcataagaacattcactcccggaacatccttccggagaggaattttaatcttttagtcactgagtacaacgaattccattgggagctgatcaagcggaactggcacaaggccttgacccaattcatggacgggcacattgatgtggccctggtcaaggagttttactcgaacctgtatgaccctgaagacaaatcaccaaaatag

SEQ ID NO: 82394 - DNA, 381 bp, Glycine max
  misc_feature (16)..(16): n is a, c, g, or t
  Peptide Sequence Number=SeqID_174079
atgcaatctccccctncaaaagtatcagttggtctgtgtcgtcccgacgtggggatcgcacccacaaagacacccagtggacctgaagaagtccaacagggccctgaggtttccagctctggttacgggcctctgtcggccctacagggcgcccgttccccccagcaaggatcgtgcccgcaaaacactgtggacccggagaagtccaacggggtcttggggttgccagctctgattacgggcctctgtcgattctacggggtgcctgtcgcccccagcaaggtcatcaggccccctattaaccaggctttcatcaagaagtactgcgcccctaggcaggcgcagggcgaaacaccacagcagcattgggatggccggtag

SEQ ID NO: 82395 - DNA, 666 bp, Glycine max
  Peptide Sequence Number=SeqID_174080
ttggaacctcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatttctatgaacctgctgctttatatggctccaatagcagtgatggtattacttcctgcaacattgttgatggagggaaatgtgattcagatcacaatggatcttgccagaaaggatatcagaattttttggtatctgatcaagcttatcgataccgtcgacctcgagggggggcccggtaccaacttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagg

SEQ ID NO: 82396 - DNA, 61 bp, Glycine max
  Peptide Sequence Number=SeqID_174081
atggatgaagaaaaggtaaaggcaattagggaatggcctgcacttgagaatgcaaatgagg

SEQ ID NO: 82397 - DNA, 408 bp, Glycine max
  Peptide Sequence Number=SeqID_174082
atggctactccacccagctctcctcctcctcctcctcctactgaagcagcatcacagtcgtcgtctaccttgaaaccagctggggcagatagaccggcggtccacgttgatcctgcgaccgggaaggccgagggtccccacaacaagaaatttagaacatatttagggattgtcactcatgataaggtcgacgtggcatacgagaattggaagcaaattgaatttgatatccctaaagcatttgacattaggaaaaagaagaaaatacttcaaactatgagggagcgatggagacaatttaagtctaatttgacgtcaaaatgggcacttgcagccgacaaggacagtgtggatgacactgtttgcgaaaaatacaacattagtaaggagaaatgggggatcctctag

SEQ ID NO: 82398 - DNA, 510 bp, Glycine max
  Peptide Sequence Number=SeqID_174083
atgacattaacctataaaaataggcgtatcacgaggccctttcgtctcgcgcgtttcggtgatgacgcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccacccccgtcgggggcgggggctggggtataatttctggccccgtcgagggcaggggtggttatgagatttgggggcggaggtag

SEQ ID NO: 82399 - DNA, 321 bp, Glycine max
  Peptide Sequence Number=SeqID_174084
atgttggtgaagaaggacatgatggagaagattcatctcttctttcaaagattttggacaggtttgatggccttcaaacctttgttggtgaaaggtttgacactttggaattacaagtggatatgcgcttcaatgagatggagtcaagaatcaccaagaagttgtcatcatcaaaaagggggagattgtagaagcaagcttcatgatgaatcaagattgattcaaagaagttttgatgataacaaaggtgatgacaaaaagctcaaagatcaagaacaattcatgataacaaagatgatgatctcaagaatcaaagaatga

SEQ ID NO: 82400 - DNA, 255 bp, Glycine max
  Peptide Sequence Number=SeqID_174085
atggggatcgcacccataaagacacccagtggacctgaagaagtccaacagggccctggggtttccagctctggttacgggcctctgtcggccctacagggcgcccgttccccccagcaaggattgtgcccggagtgcctgtcgcccccagcaaggtcatcaggcccccctactaatcaagctttcatcaagaagtactgcgcccccaggcaggcgcagggcgaaacaccacagcagcattgggatggccggtag

SEQ ID NO: 82401 - DNA, 487 bp, Glycine max
  Peptide Sequence Number=SeqID_174086
atggcctcctcaaatcccttgtttcctgaaggaaattccattcacagaccacccattttcaatggtgagggttaccattattggaaaacccgcatgcagatattcattgaagtcatagatctaaatatttgggaagcaatagaattaggaccacatatacccagtatagtagatgaacacgagatggaacttcaacgtctcaatcagaatgaagaaaatgacaaaaagaagataatcatagcccttaaagcctcatcttccatacaagaagaaaaagaagaagaagattcagatgatgaagaatatttttctttctttgttaagaaatttcagaaattcatcaagaaaagaagaattgacaggcgtcagaatttcaataatggaagaaaatcacaagatgattctcaagtccttaggtgttacaaatgcaaccaaattggttacatcaaggccaactgtccttcaaatgaagaatggtcagagaaaa

SEQ ID NO: 82402 - DNA, 207 bp, Glycine max
  Peptide Sequence Number=SeqID_174087
atggggaccactaagggtacacaaaatgaattgaaaaagttcgatttcgggaacttaccggttgaagaccaaagaacgacgaagaacgatgaagaatggtggaaaatcttcgcgacatcgctcactgaaatgtctcggaagcgttacggaaacgccttggcttggattttcttcacggaaacaattttccttactaattttatgtga

SEQ ID NO: 82403 - DNA, 285 bp, Glycine max
  Peptide Sequence Number=SeqID_174088
atgtctgggcgctcctccactcgccaatttcctagtcaaaaactaggagggcatggtcataccaaatccaacccactcggagaatcatcttcttatatcgcaacgacttggccttcgtgtttgtcataccctaatttcgttcggggaccattgtttgatggcatgcaccctttgcttgaccgcttcgagaagtcaaaagagagcattgttgcacgattcgtgaagttccgtaacatgccggaaatcaaaaggaagcatttttacacaatccgtaaggtttcataa

SEQ ID NO: 82404 - DNA, 269 bp, Glycine max
  Peptide Sequence Number=SeqID_174089
atggacatcaatggtcaaaagaggttaaaatcttggagtgctaaaaggagcaattgttctaagcagaccctgtgggctcagtgcgcatccaccgctaagcgtagctttagcgcgcttaatgtgacaagggaatctgtaagagcacaagaatcaaggttgtgtgctaagcgcgagatcagcttgctaagggagacctttgtctttagccagactcaacgcatgactggcgccgagcccaaatccactatctcgccgctaagcgcgacatc

SEQ ID NO: 82405 - DNA, 549 bp, Glycine max
  Peptide Sequence Number=SeqID_174090
atggctaaagcacgtcaaaagggggtacggaaagaacttactggtttaagaccgaagaacgacgaagaacgttcaagaacggttgaaaatcttcgcgaaatcgcccacggaaacgttacggaagcgcctcggcttggattttcttcacggaaacaatttttttcactaatttcaagtgattctcgaattaccaagagggccgaacattttttcccttcacttctccccctatttataggaaaatgggggagaagcttgccacctagctcacctattgcttcctttagaagcaaccgccttctggaggaattttcgggaaggccaaaatgggtctggttggtatttgcacccccatttttactaaatacactccctttctcttttttggtgatttttttccgtaacgttacgaaactttatgaatttcgtaacgatgcttgttttctttccgtaatgttacgaaaccttacggattacgtaatcatccctttttttgccttccggaacgttacagaactttacagattgcgcattaacacttccgtttaa

SEQ ID NO: 82406 - DNA, 471 bp, Glycine max
  Peptide Sequence Number=SeqID_174091
atggaagccatgaaagagaaaatggccacaatgatggaagccatgatgagtatgaaaaaaatgatggaagtcaatgcggctatagttgttgccgcaagtatcgccatagaagtggacccggctcccccatctggcctcaaccaaataaatcatccaacctcggatatagttggtcagggaagcaaagagttgggaagtacatgcgacccccattttacacatgaagcaccccaccacaatctagttgacttcgagccttgtcacggacacgccactaaggggcaagcagttggtggtgtacccctgccaaacactttggagggccctcagtttcgcccacaacccttgtattttgcggtgagaagaatccctcctgttattgcggaaaagggaaaattggatcatatagaggaaaggcttagggccattgaaaatgtactatcggaagatgggggcgtacgcgaaagatga

SEQ ID NO: 82407 - DNA, 381 bp, Glycine max
  Peptide Sequence Number=SeqID_174092
atgccttccaaggttattttgatgatgccaaagaatcaagagttaagcaaattccaaagattcaagaatctagtttcaagaatcaagattcaagattcaagaataatcaagatcaagattcaagaatcaacagaagactcaatcaagataaggtacatcctttgtggtacaagtagagggtacatctacttggggataattatactgagaacaagagagggtacatctattgtggatcagttcaagtggagggtacatccacttggttattcaaagagaacaagggagggtacatcccttgtggatctttggcttgtaaaggattctacaatgttgaacagaaatctcaagaaccgtaggttgcttggggactggatgtag

SEQ ID NO: 82408 - DNA, 321 bp, Glycine max
  Peptide Sequence Number=SeqID_174093
atggattcctcatcgcgtcacttgaagattccttttcgtccttgctcgtcgattccacacaagcctctactatgccaaaacgaaggagacttagtatggatttcaaaacacaaagctagtaacggtgctctgggtcaaacacccacatcactacatgaaagagctgagagcatttcgggttttacaaaggaacatcatttggaaattccaaccatgccaatgtgtccggggttcagtgtaggaagcataagacatgcaatggtggttccaaagtcagaaaagatgcaaagacaagatgaaactaacaagaaacaagcatag

SEQ ID NO: 82409 - DNA, 138 bp, Glycine max
  Peptide Sequence Number=SeqID_174094
atggcggtagtgtttgagggcggggttctatggttatcagaatggagaaggaagaaagatgattggagacaccacttcaaggagaagatgagtcaaacacaagctcaccaccataggaagccatggataagagcttga

SEQ ID NO: 82410 - DNA, 1239 bp, Glycine max
  Peptide Sequence Number=SeqID_174095
atgtggtgttatgagtggaaaaagagtgaggctttgagagttggaagaccaaatatggatttagtgttcatgatgtttgggatgttgaattgcttggatgttgtggaagcttggagagattgctggggacccggtgttgagaggaacgaggataagggctacgtgggagtacgtgagctcagtgaaggtgggcaactggggatggtgggtgtatgtgtgatctgtggatgtggagagttgacttccaccatcgcccgaccgccacctagtaccacattggtacctggagatatgtcgcgggggtcaggagaccttggggatgtcaggcgagctcctggcagtcaaccgataaaagaacaaagaccacaaagcaaggagacttgtgtggtggctggccagctgcttagaaatgggactggaatgttaaaggggcctctggtaatcgattaccagtgctgtgtaattgattacacagaggaacaggccactgcgcagttcatccacgatcgagtggagatgaagtgcctagagggagcttgggagaccctcgaaggcaatgcgaggtgccgattccggggcacgattcgattcacgactacttcattggtgtatccagaggaacccgcacgcatgcttcagcgcactgtggagtggatattacccacgcctacaccatatcgtctagtggagccagtccaagtgatcgaggtgacgtcatctgaggaagaccctgaggaagatccagaggagctacctcctgagcccgctgtggatgctcttgactttctagagggtgatgaggacccactccctgaggtggactctcccgaggacgtcgtgtcggcatctgaggcagactcgacggaagatagcggccctggagagatggcgactatggacaccgttgttgaactgcattctccaaagatgggtttcataaacaccgtctttgaatctgaagttcgatctcgatcaatggaggccgaggcagagaacaacgacgtgaagaaggaagaaaacaacaatgataacaacaacaacaacaacaacaacaacaacaatgaaagtgacaacaaaattaggaattcgagcgagggtctgagcaagcccaagcgtcaaatgaagatgtcgtttcagcttgaaatgctcgagaaagcttatgtgggacaagaaggagttgtcggcatagaagccgcgaaaggcagtggcgttgccggattctccagtagaggagcccaa

SEQ ID NO: 82411 - DNA, 999 bp, Glycine max
  Peptide Sequence Number=SeqID_174096
atgagtagaaccagcgatgcgatgactgaagaagccaaagaagaccaaggaaatctggatgacatacagagggaggcgcagatgatgagcctgatagagcaccccaacgtggtgagggcctactgctccttcatggtgaagcggagcctatgggtggtgatggcattcatggcgcagggctcctgcctgcatctcatgaaggccgcttatcccgagggattcaaagaggcctccattggatctatcctcaaagagactctcaaggtgttggagtatctccaccgacacgaccacattcaccgcgacgtcaaggctaggaatattcacctcgatgataacggcaaggtcaagctcgctgacttcggtgtctccacttgcatgatagcgccggaggtgctgcaacctggaaccgaggcaacaatgggtttgacggtgtcaccgctattgagattgttttatgcaaggaaagaaataaggattctgatggtgggtcttgatgttgctgggaaaccaacaatactctacaaactgaaacttggagaaatagtcactacaacaatacccacaataggcttcaatgtggagactgttgagtacaaaaatgtcagcttcaccgtctgggatgtgggaggacaggacaagaatacacaaggtcttatctttgtggtagacagtaacgatagggaaagaattttagaagccagggatgaagcggagatggtaaaggactcttttgaacatgactgtggtgctgaggattggattgcaattggagatggtaaaggaaatatggcaatcattggagttgtcaatgatgattgtactcctactatcagattgtgctttacttgggtagctaaaatagagagacagctcttgggtacttattggtgtaaatctctgggatgtagggcaagggaacctccacaatgcgagaggcctgcgaaaaaaactttagggactcatggggaagaagacacgagctccgagagaacttag

SEQ ID NO: 82412 - DNA, 231 bp, Glycine max
  Peptide Sequence Number=SeqID_174097
atggaattctttattcaatcaattgatcccgatgcatggaatcctattgttaaaggtacatgtataccaattaaagaagtaaatggtggattcgtacctatagaatgggatgagatgaaagatgatgataaaagaaaaaacttgggaaccaaagatcacaatgatcaaggaatccaaggacttggcgtcaatgttgatggaagctctcttcagaaaattgcttgtatatga

SEQ ID NO: 82413 - DNA, 681 bp, Glycine max
  Peptide Sequence Number=SeqID_174098
atgacgtcagtttacaactccgatggcggtggacgatccatgacttcgagtcgaggtcatagcgagtctgtctactacgactatggtaatccttcgccggtggagttcgggatggacaaggaggtgatcacggagcccgtggattcgtccagagctcgggatagcatttcagtcacaattcagttcagacctttgagagagtaccatagaggagacgagatcatgtggtatgcggacggtgataagattgtgcgcaatgagtataatcgagctactgcttatgcatttgatagagtgtttggaccgcatacaaattccgatgaggtgtatgaagtagctgccaaacctgtggtgaaggctgccatggagtctttttggtattgtttggtgattctttggctaaggggagaccaatattctcctggtatcataccactggccatcaaagatgttttcagcattatccaagatgtgatcattattgggtcatttctatgccatgactcggattctaccgggaccgcacttcattgggctgtaaggtttgggagaaacctttactttatccttgggagaagggaataccaatgcaaagaaagagaacaagaaggacaaataaagcctccaatacctacccagttagtcaaacattacaaattgttggctgcatttaaggagtaa

SEQ ID NO: 82414 - DNA, 459 bp, Glycine max
  Peptide Sequence Number=SeqID_174099
atggaggacttgttgcacatatctattcaagtggagaggcaattgaaagctaagagtaattccaaattttcttccacttcttcatggaagtcaaattggcgaaacaaaaaatctttgacaaagtcaaaagatgaagctatgttcaaaaaatcattttctgcacctagaggagttggacatattgcttctcaatgtccaaataaaagagccatgatatttctggataatggagacatggagagcaagagctcaagtgatgatgaaatgccaccattagaggattgcaatgatgttgatgttgctatacctgtaaatggagatgtgcttgttactaggtgtgctcttaatttattgaaagataagctaaccaatgcacctttgctttgtttgcctaattttgttaaagcttttgaaattgaatgtgatgcttctagtgttggaataggggtcgtacagtga

SEQ ID NO: 82415 - DNA, 847 bp, Glycine max
  Peptide Sequence Number=SeqID_174100
atggtggctggaaatgcaacaatagaaaaaactagagaagagtggactgaagatgaaagaagattagtgcactacaatttaaaggctaaaaacatcattacttttgccctaggaatggatgaatattttagggtttcaaattgtaagagtgctaagaatatgtgggacactctacaagttacacatgaggaaagcaatgatgttgaatatgggaacttctacatcagtgatgacgtaggcactgatgtagtaagttgcgctttttacatcgttttacagaaagcaatgatgttgaatatgggaacttctacatcagtggtgaccaacgatgttgaatatgagaacttctacatcggtggtgacataggcaccgatgatttaccaggcttcatggaatcccttgtgaagcaaatgtctgtaaatcttaaacgcattcacagcttagggataaaaaaggtagcagttgggttattacagccaattgggtgtttccctgtgttaaatgtgatattttgccgtacgaactgcattggccttttgaacgtgatctccaaagatcacaacaaaatgttgctcaaagctgtgcaagaacccaacaaggaagcagcagtcaaatcagttttcataacactggacctctacaactccttcctctctgcaattgaaactatgcagaaaaagcgtgcagaaaagtctacactgatgaatccgttgcaaccatgctgtgagggaaacaagttggaagattcatgtggaagtgtggatgacgaaggatcaaagaaatacagtttatgtgagaacccgaaactttctttcttttgggacacacttcacccttctcaaaatg

SEQ ID NO: 82416 - DNA, 744 bp, Glycine max
  Peptide Sequence Number=SeqID_174101
atggaggaagcttctcaatcccgaagcactgacaccatcattgatcctccatctcccatcaaacgacacatgaagtggaagatggccagcacaaagaaaactacccaaatgacgtctcaggctgcaaaggaaattgctgacaagattggttcctttgtcgcccatggacgtcaggatatactgactgcttccattgggcgaccagaacaccctggtcgtgtgcgtgctactggagccggggtaacaatagagcaatactttggaccggctccaaggacctcccgcatgtcttcctccatggcttccgaatacctggagcaactgacacaacagatcagggaccagctggaggagtcgatcacacaaaaagtgactcaacagctaatcacaaaggagaattgtgttgatccctcagggaatgatccagacaaatgcgggttgtacatcgatgaaaatcctccccaactggttgccctaggaagactttatgagggatccacaaccattcacaacattcctttgttgcatgatcaagtcaaggttggtgttaaggaggttagagatacagaggctccaatttttgtacccactgaagaggttaagttagtggggcaggcacttaacaccttccttgcttggccaacacatcttatcaagtgtttatctgaacagctttttctgaagccgttacgggttatgtgggatgctactgtgtttggggtgtataatgacaacttcccctag

SEQ ID NO: 82417 - DNA, 204 bp, Glycine max
  Peptide Sequence Number=SeqID_174102
atgaagttctctaggaatatctctctcttgtgtcgcaacgtgcccttttgcgggcgagcgagggcgaggctcacgggtgcgctttccaaaggaggaaagatgcgcggagtcgccaccaacatttatttgtggaaaacgtcggaaaaactgaaggaaaccggtctaaatgaaaattcgaagttcggaagttgtatttacgtttaa

SEQ ID NO: 82418 - DNA, 147 bp, Glycine max
  Peptide Sequence Number=SeqID_174103
atgagaggcaccatgcatgagcctcaagtgaacctaggggcagatcataagttctcacccggtaggttgaaaactcgaaagggtagcctaggaaaaattagggaagagcaatgcaaacaacacatgcatgaagttgggcaacaatga

SEQ ID NO: 82419 - DNA, 372 bp, Glycine max
  Peptide Sequence Number=SeqID_174104
atgaatgaaaaagtgaaggtaattctatggatgaatgctcacctagaacctaagcttttgaatgctagaaaaaccatgaatttttggcagcctaaccccattacaagcctagaaagtccttcaaattcattttcttatttcagctatgactctaatgcttatgctcttatctttgaaaagctggatgttgtggaagcaatgctttccaagtttattttgatgatgccaaaaactcaagtcaagaatcaagagtcaagcaagtttcaagaatcaaagagtcgttcaatcaaagcaagtttcaagaatcaaagagtcattcaatcaagaatcaagattcaagtaaagaatcaagagaagactcaattaagataa

SEQ ID NO: 82420 - DNA, 297 bp, Glycine max
  Peptide Sequence Number=SeqID_174105
atgatagaaatctcccctgaaaaacacccctactctcctatcctaagattcgttaaccgttggatcgtcttcaaattttgtctggatatccctaagatacgtttctatagtctgaccattgggatcttgaaaataataaattttggtctcccgctaagcgagaaaggcgcgctaagcgcaattccaaccgaggggaattgcgctgagcggcccaaagctgcgctaagcccaactctagctgagaggaagtgcgctgagtgcccagaaggcccgctaagcgaaagttgcaggttataa

SEQ ID NO: 82421 - DNA, 354 bp, Glycine max
  Peptide Sequence Number=SeqID_174106
atgacaccggtaaaccgaaaggcaggaacaggagagcgcacgagggagccgccagggggaaacgcctgcccgggggatccactagttcagagcggccgccaccgcggtggagctccaattcgccggaatagtgagtcgtatcacaattctgctgacgcaccgtgcagcctttttttctgccacatgaagcacgttcactggaacaccctgcgttatcagtgccaacatagtaagccagtatacacatcttcgctagcggcgccaatacgcaaagccgcctcgatcgcccgcgcgttggccgattctaagcagctggcacgacaggtttcccgaatggcgaagcgggcagcctga

SEQ ID NO: 82422 - DNA, 587 bp, Glycine max
  Peptide Sequence Number=SeqID_174107
cccgcgcaggacgcgggccactagaagtacaccgtcgcggtgacagtggacgaatacgtgtcgggcgcgggcgtggtctgcgccggcacggtgccgttcacggtcagcgcttgcgacgagccgttgccggtgccgccgacacgatcggcggtgccggtgtcgccccagaccaccgtctggttgggcgcgggctggtacaactggtaggacaccacggacgtcgtgttgccggtagtggtgccctgcatgtagcgcgtggcgaaggtggagccggtgccggtgccagcgctcaggcccaccgtgtagggcgtggtgttggtgcaggtcacgttgaccgtggtggtgttgttcagcgcggtattgagcacgccgtggctgccgaaactgagattattcgcgccgatggtgcagttcgcggtgatggtcagcgtcaccgccatgttggccgtggtctgggcccgcgccgcttcgggccaggccgcgaccgtcgccagggtgaaagtcagagtcgtcgcgcacaaggacaagcgtttcatgaatcactcccacgaaataccgctgcactgtcagacctgcgtgaagaataa

SEQ ID NO: 82423 - DNA, 369 bp, Glycine max
  Peptide Sequence Number=SeqID_174108
atgccgatctccccctacggaagggtcatgcccacaagacacccagtggacccggaggagcccaacagggccctggggtttccagctctagtttcgggcctctgtcagtcctacagggtgcccgtccccccagcaaggtcatgccatcgtgacatagggatcgcgcccgcaagacacccagtggacccggagaagtctaacggggtcttagggtttccagctctggtaggcgcagggcaaggcatcacagtagtgggtaacaggcgcaccgccaccatctctagagttcacctcagctcatccacaaaaagattagagcgttgcctacgacacatggttgaccagcaggcgaccaagtccaaagcaaag

SEQ ID NO: 82424 - DNA, 577 bp, Glycine max
  Peptide Sequence Number=SeqID_174109
ttggaactcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacgggcggagatttcctggaagatgccaggaagatacttaa

SEQ ID NO: 82425 - DNA, 171 bp, Glycine max
  Peptide Sequence Number=SeqID_174110
atggagatttacgtcgtcttccgcgcagactacatctgtcaagcactaacccgtgagcatgcagagactaacgtcttgttctgccccctttgtcaaccagacgcaagcgagcccgttgacacgcggagatttacgtcatcttcggcgcagactacctctgtcaaccactaa

SEQ ID NO: 82426 - DNA, 831 bp, Glycine max
  Peptide Sequence Number=SeqID_174111
atgttgcatcgaccaaacgccatttccggagctgccgttcgttctccggactggtttaaatccgccactcgctggacccaattgacctttgcggaggacgacccggcgaaatatgaccccgagttctggatcgacgtcttcaagcgcaccaagtcgaatgcagtctgcctttccgctggcggctatatcgcctattacccaagcgaaatccccctgcattacgtgtccagcttcattggcgataccgatccgtttggcacgatcgtggaaggcgcgcgcaaattgggaatgcacgtcatggcgcgcgtcgacccacatgcgatccacgaggatgcagcactggcccatcccgaatgggtggccatcaatcaggacggaagtccgcgtgagcactgggcatttcccggtatctacgtcaccgatgcgctgggaagttataaccgcgacttcacaaccgacgtcattcgcgaagtcgtaaccaaatatgacgtcgatgccgtgttcgccaaccgctggcagggccatggcgtgtcctacagcgacgacaatcgcatacgattcaggcaggaaactggttttgatttgccgatgagaccggatgcgacggatccggcatggcaggcgtgggcggcgtggcgcagacgcatacttaccgagctcgtggtctattgggacgagacggtcaaatccatccgtccccatgccagcttcattccaaatatgagcgaaacattgcccaatcctgttcgtggaccaccaggcgcgacaaggtgtggaggttggctggtctgctggacggaacggcaaacgcattcgtggaacgttccgtga

SEQ ID NO: 82427 - DNA, 237 bp, Glycine max
  Peptide Sequence Number=SeqID_174112
atgagggacgacaagaggtctttgtacgtcattgggatcggggtgaattatggagttggccttgggggaaagttcctcatcacgttggaactggcgccaaagtgggcgttgccggccgggcaagtcgtggttggagccagagcttggggggcctccctctggatgggtgcgggcgctttaggctgtacgggtgctgaattggaagagtccccgacgcgagctgagaagctcgggtga

SEQ ID NO: 82428 - DNA, 983 bp, Glycine max
  Peptide Sequence Number=SeqID_174113
atggtgaaaagttggaacctcttacgtgccgatcaacgtctcattttcgccaaaaagttggccccagggctttcccggtatcaacagggacaccaggattttattttatttctgcgaagtgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccacccgcggtggcggccgctctagaactagtggatcccccgggctgcaggaattcgatctcgagcccgatttactggatgcgtttcaatcattgcaaagcgaaatgtgtttaaagcatgagttgcgtgatggcatgatacgactgtgtgaatctttctctgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 82429 - DNA, 204 bp, Glycine max
  Peptide Sequence Number=SeqID_174114
atgtctcctccacctctaggacctctcaatcactcacaaactcagctcacgctctcaggacggtttccttttccaactctggtctttgcagatcttcacacaacaaaatctctcaaactctctagaatttggacctctctctctctctctagaactgaagacatgcaagagttcctcaagaaaatggccaaactccctctctaa

SEQ ID NO: 82430 - DNA, 571 bp, Glycine max
  Peptide Sequence Number=SeqID_174115
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccaggcgaattggagctccaccgcggtggcggccgctctagaactagtggatcccccgggctgcaggaattcgatgatgtagtccctcttggatgtgatcctatgcttcaacagcaagcaagcaacactccaatgaaccaaatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 82431 - DNA, 342 bp, Glycine max
  Peptide Sequence Number=SeqID_174116
atgacatccactccacaagcttgtggttacgtgagcctgaactactaccaatatatagatgttgtttacacaaatgaacacatcttaaaagcttactccgcacattggtggcctcttgggaatgaagcggctattcctccttctaatgacgcatggacacttatccctgacccaactacaattcgtgcgaaaggtcagccaaaatcaacaaggataaggaatcagatggattgggtcgaaccatctgagcaccgacaaaaatgcagtagatgtggagccgaagggcataacaagcgttgttgtccaatgcaatctgagcgtgggagttgttcaaatcattga

SEQ ID NO: 82432 - DNA, 93 bp, Glycine max
  Peptide Sequence Number=SeqID_174117
ttcccagtgcctatgatgtacggcaccaggaggactattagtagtgtatatcaccttacgagactagagtatggtatagatcaacccgaagag

SEQ ID NO: 82433 - DNA, 528 bp, Glycine max
  misc_feature (248)..(248): n is a, c, g, or t
  Peptide Sequence Number=SeqID_174118
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggctccgnccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaacccccgttcagcccgaccggtgcgccttatccg

SEQ ID NO: 82434 - DNA, 591 bp, Glycine max
  Peptide Sequence Number=SeqID_174119
atgacattaacctataaaaataggcgtatcacgaggccctttcgtctcgcgcgtttcggtgatgacgcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccccgttggaagggccgcattttgtttgcttccacttgttgggtgccagcatgatgagatgctgcaggactcggttcaaaactcatactatactgaaggttcttgtatcattggtctggctacctactttcttaaacttcaggtgggtaccgagctcgaattcgtaa

SEQ ID NO: 82435 - DNA, 342 bp, Glycine max
  Peptide Sequence Number=SeqID_174120
atggcccagcagattccaccaacaggtgcaaaatatactgaacatagtgccgaaatatatcggggacgacatggttatgctcctcggacttacagaagaaaaggccagacaaataatggagaaggaggaagagggaagggatgctctgttttactccttggaaagattgaacccgacaatgagaatgacgaagtagtggttggaattagagatgcggtggatgtagacgatgatgttgaggaattgtggaaaatggatagggctaggatcctgttaaaaacaccatggccggtgctgattcaacacacagtaagagttcatattcaaggggaagtattcacg

SEQ ID NO: 82436 - DNA, 129 bp, Glycine max
  Peptide Sequence Number=SeqID_174121
atggcaaaaactcaagctacaggactccaaatgaggttgaagatgaaaggaaggaaagaatcactctttccggcgagggcaacacacaaaggtagtgaatgtcctttgatacagccagggtgttcttga

SEQ ID NO: 82437 - DNA, 420 bp, Glycine max
  Peptide Sequence Number=SeqID_174122
atggagtggaagagatatttctcaaaattggaggtggaacattttcaatgggcatgcccttggtatcattcccaagatatggtctttagttgtggcaattttcctaatgtgtcattaatgaggccaagaggatgcgtagcctacaccccgacagttgcttttaggcaactcaaatggactcaaggtgtgccaaatgttgaagagttgagagatagagagatagggaacttaaaagatgagtgtgctgatgcccatgaaagctcgacctgtgccaagaaagcaaggaagaatgctccgtctatgatgatggaattgcaagataaagttaaagcaatggaaagagagatggccaaaattaaaaaagaaaaagaagacccgaagataaaaattgtattcaagagaaaagattggagcgcctaa

SEQ ID NO: 82438 - DNA, 378 bp, Glycine max
  Peptide Sequence Number=SeqID_174123
atggccaatcccaattgtcaagggttccatcacagaggaccttctggctacaatcaagggggaaatttttctcaaggccaaggttggagatcccatcatgggaataacttcaacaaggatcaaggtggcccatccatccgaccttctaatcaagggcccaacatgtatgagaggaccaccaagctagaagacactctaactcagtttatgcaagtgtcattatcaaatcacaagagcactgagtttgccatcaagaatctagaggtgcaagtggatcaactagccaagcaactggttgaaaggtccacagggagttttgtggccaacactaagaagaatcccaaggaagaatgcaagacaatccttaccagaagctag

SEQ ID NO: 82439 - DNA, 249 bp, Glycine max
  Peptide Sequence Number=SeqID_174124
atggagttgtggaacgaaaacacagacattgttgaacttggtctcactcttttggctcaagcatctcttcctcttcctattcggattatgcttttctcactatgtgccttcttgggttattccactgctcataaaggctatgtctctgttgggaatgattttgggatgcactataactatgataaacctctacaggctacggagttttggatgacgccaataccagtgaaggaagataagtcagagtag

SEQ ID NO: 82440 - DNA, 135 bp, Glycine max
  Peptide Sequence Number=SeqID_174125
atgggatacgaagttttagtttcttgcgcggaagaattcgatgggaatgagaacaaaaagaggaaggaattttgcagaaagaaaatgatggtggtcaagcctctggagatggaattgtgcagcaaaaaaagttaa

SEQ ID NO: 82441 - DNA, 402 bp, Glycine max
  Peptide Sequence Number=SeqID_174126
atgaccaagagcaagggcaaggatccacttgaaggacttggaggacctatgacaagggctatgatgatgatgagaatcatgaaactggccaaatacaggctaaaggcccaagtggagaagggcgaaggcccaaatgaggacacaactaagggcaaggaccatgaagcacttgaagggcccatgagcagagacatacttaaaagggcccaacacagtgatgaggacacaactaagggggttcctgttgaaccaaattctgacttatcaaggttgattccttgtggcgtcactgtgacttatcttccatctctggaagtggcgtccctctccgtcaacaatcctgtatcaaacgttccgcctcgtaagattcacgtcatctggtatcagagcttcggctcttga

SEQ ID NO: 82442 - DNA, 501 bp, Glycine max
  Peptide Sequence Number=SeqID_174127
atgaaggaatctgatggattagacaactatgatggatccacggatgatgaagtggctctcatgcccaaaaagttcaagcaaattaagaaaaagaaggaaaattttcaacattcctccagacgtgaagattttagattcaagaagaagaacaaagaggaaaacaatgagatcatctgctttaagtgcagaaagcctggacacatgaaggatgacttggacaacgagaagagtaacagttcagacaacaaacaagccaaaatttgtcttatggcaaacacagatgataaggtttatgtaaaaacctcctctaagtctgatacttcttcttctgcttcatcaaatgatgaagaggatatgccctatgatgttcttcttcaaagctgtcatatgatttctcttcagtgtaaaaagtttaaagaaaaattcaaagcttttgcttcggaaaacactaaattaaggaaatcaaatgagaatctgaaaaaaaaaagattcagactctag

SEQ ID NO: 82443 - DNA, 1236 bp, Glycine max
  Peptide Sequence Number=SeqID_174128
atggttacaaatattgagtatgatgaacataaagggcgcatagcaattgggcgtgtgcaagctggagttttagaaaaaggcttggatgttcgagtatgtacttcagatgattcatgtagatatggaagagttactgagctttatgtgtatgacaaattcaatagggtccctgcaaataaggtggaggcaggagatatatgtgcagtatgtggaattactgatattcagatcggggagacaattgctgataaagtatctgggaaaccactaccttcaatcaaggtggaagaaccaacagtgaaaatgtctttctccataaacacttcaccttttgttggccgtgagggaaagtatgttactagtaggaatttaagggacaggctttatcgtgaacttgagcggaatctggctatgaaagttgaagatggtgaaacagctgatacatttgttgtcagtgggcgtggaactttgcatatcaccatacttatagaaaatatgcgaagagaaggatatgaattcatggttgggcctcccaaagttatcaacaagaaggtggatgaaaaactgttggaaccgtatgaggaattgctgcagattgcaactgtggaggtaccagaagagcacatgggagctgttgttgaacttcttggcaagagacgaggacaaatgttcgatatgcaaggagttggattggaaggaactacactactcaaatataagatcccaacccgtggccttcttggattgcggaattcaattttaactgcctcccgagggactgctattctcaacactgtttttgatagctatgggccttgggctggtgaaattagtactcgggatcaaggctcattggttgcttttgaggatggaacaagtacttcttatgcaatctctagttcacaggagaggggacagatgtttattggtcctggagtggatgtttataaaggtcaaattgttggcatccatcagcgacctggggacttgtccttgaatgtttgcaagaagaaagctgcaaccaacatacgttccaacaaggaacaaacaggcttttcagagtatgtttggtttatgtatcccaggttgacaacattattgattcttgatacgccattggactatagtctggatgactgcattgaatacatccaagaagatgaactagtagaggtcacccccgcaagtatccgaatgtccaagaatccaaaaattacaaacaagaaaacaaggtag

SEQ ID NO: 82444 - DNA, 339 bp, Glycine max
  Peptide Sequence Number=SeqID_174129
atgttttccaagaaggagggaatgatgagaatcatgaaactggccaaatacaggctaaaggcccaagtggagaaggatgaaggcccaagtggagaaggacaaagcccccgagtggagaaggatgaaggcccaaataatccttgtggcgtctaccctgacttatcttccttcaccggaagtggcgtctaccctgacttatcttccttcattggaagtggtgtctacccggacttatcttccttcaccggaagtggcgtctaccctgacttatcttccttcacgggaagtggcgtcatccaaatctctgtaacctgtatcaaacgatccgctcctacttag

SEQ ID NO: 82445 - DNA, 1197 bp, Glycine max
  Peptide Sequence Number=SeqID_174130
atggcagacactttcattggggaaatatcactgcagcaagttcaaccgcatagggaggacaattggatttggaagcatgatcaaagcggacactactcttcaaaaagtgggttagtaagagatagactaccaacaaggatgaaccttacaagaagacaggtgatgctgaataacaccatgtgcccattttgcggacttaaagaagaagaggctcagcacttattcttcaactgtagcagtaccctacctttatggtgggagtctttgttctgggctaatttatcaacagcaatgccacaaaatccaagagaccacttcctgcaacacacaatcgcgacagctgaagtaaagaatctcacaagatggaaatgttggtggatctctttgacatggtcaatttggaaccacagaaacaaaatagtgttccaaaaccacacgtttaatggtagtagactgctggatgatgcggttcttttactttggacgtgggtcaaaaacatggagaaggattttgctgcaattgcaatagcttggttctgtgtatacacaagaaccaactattctgctactctaacatgtatttttctagtacctctgaatcgacatggaaaatcaagtaaagcagttactaatgatacagaagatattcctgaagattcatctgccaagagagttgtcttctctctcttactttcttggccagagaggaagaagcctgaaagttcaacccaagagaaaaattcgcttaaggacaacaagagaaagagggagaagaaatttgagacagacaagcctggccaaaaggggtcatttaagactactagtaatgatggattaagattacccaagagaagtaggtattctaacgataaaaatcctaatgtaggtaggccagaagaaagtgaaaaaggcaagaaaagttggaacaatagtttcagtggtggtggtgggaagagaaagacgaaggtgacaagtacagcaaaggataaagcagcttctcatgtacctataggatcttccaaaatcatgaaactggccaaatacaggctaaaggcccaagtggagaaggacgaagacccaagtggagaaggacaaagcccccagtggagaaggatgaaggcccaagtggagaaagatgaaggcccagaggcagaggcactaccaagactactaattgttgttgaaggcccaaactaa

SEQ ID NO: 82446 - DNA, 259 bp, Glycine max
  Peptide Sequence Number=SeqID_174131
atgatgttgtccgatgccacaaaatctgactctgatgaggacatcaccaagagcaagggcaaggatccacttgaaggacttggaggacctatgacaagggataaagcaaggaaagccaaggaagctcttcaacaagtgttgtccatactatttgaatacaagcctaagtttcaaggagaaaagtccaagggcccaattggcaacctaggcattagccttttgggagaccaaatggtggctgacttgatggctgttggga

SEQ ID NO: 82447 - DNA, 135 bp, Glycine max
  Peptide Sequence Number=SeqID_174132
atggcaaaaactcaagctacagggctccaaatgagaataaggttgaagatgaaaggaaggaaagaatcactcttttcggcgagggcaacacacaaaggttgtgaaagtcctttgatacagccagggtgttcttga

SEQ ID NO: 82448 - DNA, 141 bp, Glycine max
  Peptide Sequence Number=SeqID_174133
atgattgaggatgacgggaagtggattcagaaacaagaaggaacagagggagctgaaagggaattagaggaaggtatttgggaaagtgaaggtgtagaggctgaaacaggaggagataggtcaggattgaggcagaaatag

SEQ ID NO: 82449 - DNA, 1074 bp, Glycine max
  Peptide Sequence Number=SeqID_174134
atggacaacacatctgctgtttttgagataaaaagcatactccatgaccttcgacagggagagtcctctgttactaagatcttgatgaagttcgtggaagaatccttggaaccaagtgatgaggacaaggcaaggaataagggcaaggaacctttagaagaacttggaggacctatggcaagggctagaacaaagaaggccaaggaagctcttcaacaagtattaaccatgctatttgaatttaggcccaagttacaagtggagaagcttcggattgttaattgcatcatgttccaagaagagattgtggctgcctcttggctgactgatgaggacatgttcaagagcaagggcaaggatccacttgaaggacttggaggacctatgtcaagggctagagcaaggaaagccaaggaagctcttcaacaagtgctgtccatactatttgaatacaagcccaagtttcaaggagaaaagtccaagggcccaattggcaacctaggcatcagccttttgggagaccaaatggtggctgacttgttggctgttggggggaagaaagtaggaggaaactcatgctgggaacatccattgagagctcggcaatggcaacaagaggataccagcctcaaccaccacaaaagaaaaaccggcgctagtgtgatcattgcaagaggtcaggccacaccaagaaaacatgctggatcattcatggaaaaccttcaaaagccaggcagttcaaaagcaaggaaggaagaggcaacacagcctttaaccatcaacaagctgagttattctccatgtccctataactatactgtctggatagctgatgggactcattctaaggtggggaagacgattggcaatgctgaagagtgtgttggactctacctccttcaagttgaaaaaccagaagaactcaagaaccattcttatgtagcagcaacagttccaagtagtgataattctatcatgttgtggcactatagattaggccacccaaatttcatgtgtccacgtgtccatgtccatgtcgtgtctggtgtccgtgtcggtgtcggtgcttcatag

SEQ ID NO: 82450 - DNA, 339 bp, Glycine max
  Peptide Sequence Number=SeqID_174135
atggcgcctaccaggcatcctctggacccggataagtccaacagggccctgggatttcccgccttgatcacaggactcttccagtcgttcggagtccccgtcgcacctagcaagtatttgcggcatttggttcgccagcaggcggccaaccaccgggcgcatgtacagacccatgattgtctttaccagttgagcctcagcctgcagagccagggttttacttcttttccgtgccctgcagaggcaccagcagaggctcccgacgaggcagatgaggcccgcgaggacgaggagatgaccgatttacttgatttcttaggagggagcggcgccacatga

SEQ ID NO: 82451 - DNA, 563 bp, Glycine max
  Peptide Sequence Number=SeqID_174136
tgttgtatttcaacggaagagtatatgaagacaatgatggtgtaatatttgaaggcagtaaaaaggccattcagattaaacgcggaattagtttcaatgctttgaaaagaaaattggagataagatttttagtttcaggaaaatatgttgcgttgcaaatttgtgatgacgaagatgttgaaactatgatcgaaagttttcaacaacaacaacaaatgtcagttctagagttgtacgtagaaaaggatgttgctggtggttctatgtttcatgctgcaaattctgttacgtcatgtggacgtaatgtatctcattatgagtcggaactgccaaaaaatataagcaatttacatgttgatgaagatgatgatgatgatgatgatgattatcttgcatctaactcatacgttgaagagtctttcgatgaagatgatagtgatgatggaatatctcatacagacgatgaagtcactgacattgttgaaccagtttcaattgttcacccaagcgaaggtgtaccagaaattcaaaatccattttggaatgatgctatgccattataa

SEQ ID NO: 82452 - DNA, 297 bp, Glycine max
  Peptide Sequence Number=SeqID_174137
atgcatgtttgcattttagtggagaaaacaccgagactttttcaagtctcgcaagttatccagaactacgtaggagcaagagcctcgcttttgtcgactgcaccgctttttgttatcatgacccaagagctggtagcccgcggagacaccttacagttatccgcacctcgtcattcagtgaccccaagtgtgattgatgagcagaggccaatgtggtcatctgcgccctttccggagatgtcagcatcttccggtggagactttttcaagtctcacaagttatctagaactacgtag

SEQ ID NO: 82453 - DNA, 444 bp, Glycine max
  Peptide Sequence Number=SeqID_174138
atggccaacggctgcatccgcgtctacagcggcctgatggacatgatgaacgacaacgaagtcgaaggcgtgctgggccatgaaatgggccacgtggcgctgggccacacccgcaaggcgatgcaggtggcttacggcaccgtggcgctgcgcaccgcggcgtcctccgccggcggcgtcatcggctcgctgtcgcagtcgcagctggcggacatcggcgagaagctggtcagcgcccagttctcgcagaagcaggaaagcgaagcggatgattactcgttcgatctgctgaaaaagcgcggcatcgatccgaatggcctggccaccagcttcgaaaaactggcccagatggaagccggccgtcagagcagcatgttcgacgatcacccgtcttcccaagcgcgcgctcagcacattcgcgatcgcatcgcggcagagaaataa

SEQ ID NO: 82454 - DNA, 741 bp, Glycine max
  Peptide Sequence Number=SeqID_174139
cgtgagctaggagaaagcgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtaccagatcggttgcccatgaaaaggggagcggtcagtacaagtgtaagaataaagaattttttagaagagacactggaactaggaaatgtggttgtccctttaggctgcgtgggaaaccagtgcgtgtaggtgaacgttggatagtgaagctgatctgtgggcctattcgatggaaccgtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 82455 - DNA, 1161 bp, Glycine max
  Peptide Sequence Number=SeqID_174140
atggcttctttccaggcttcgtcgcagcgcaatgccaccctggtcgaggccctgacggggctggaagcggtcaagaccctcaacgcccagggcgcaatccagcgcaactgggagcgttccaccgagttcatcgcgcagacgggcggcaagctcaagctgatctcgtcgtccaccgtgggcttcgtgcaggcggtgcagcagctggtgtcgatcgcggtcgtgatcatcggcgtgtacctggcgcaggattcggccctatcgatgggcggcatcatcgccgcctcgatgatcgccggccgctgcctggccccgctgggccaggtggccggcctgctgatgcaataccagaatgcccgcacctcgctgggttcgatcgacaactacatgaagctgccgatcgaacgcccggccgaggccgagttcctgcaccgcccggtgttccatggcggcctggaattccgcgacgtcagcttcacctacccgggcagcacccagccggtgctcaagaaggtgtccttcaagctcaagccgggcgaaaaggtcggcatcatcggccgcatcggctcaggcaagaccacgctggaaaagctggccttggcgctgttccagccgaccgagggcgcggtcctgctggacggcgtggacgtgcgccagatcgacccggccgacgtgcgccgcgccatcggccacgtgccgcaggacccgctgctgttctacggcagcctcaagcacaacctggcgatgggcgcgccctacgccgacgacgccagcatcctggcggcggccaacatggccggcgtgaccgagttcgccaacctgcacccgaacggcttctacatgctcatcggcgagcgcggcgagtcgctgtcgggcggccagcgccagtcggtggcggtggcgcgagcgctgatcaacgatccgcccatcctgctgctggacgaacccagcagcaacatggatcaccagagcgaggcccagctgcgccgccgcctgggcgaagccagcgccaacaagaccatcctgctggtgacgcaccgcaccgccctgctggaactggtcgatcgcctgatcgtcatcgataacggccacatcgtggccgatggccccaaggaacaggtcgtcgaagccctgcgccaggggcgcgtcggacgcggaagctga

SEQ ID NO: 82456 - DNA, 216 bp, Glycine max
  Peptide Sequence Number=SeqID_174141
acttatcaaggtaatccttgtggcgtctaccctgacttatcttccttcactggaagtggcgtctacccagacttatcttccttcaccggaagtggcgtctaccctgacttatcttccttcaccggaagtggcgtcatccaaacctttgtagcctgtatcaaacgatccgctcctactcaggttcacatcatctggtatcagagcttcggctcttga

SEQ ID NO: 82457 - DNA, 96 bp, Glycine max
  Peptide Sequence Number=SeqID_174142
atgtttgcttacagtcttttcgctaagcacaagcctcatgctaagcgcatctctgttcatgcgctaagccgcgagtctcaagcgcttagcgcctaa

SEQ ID NO: 82458 - DNA, 270 bp, Glycine max
  Peptide Sequence Number=SeqID_174143
atggtcataacgtttgatgaggacatgaccaagagcaagggcaaggatccacttgaaggacttggaggacctatgacaagggctatagcaaggaaagccaaggaagctcttcaacaagtgctgtccatactatttgaatacaagcccaagtttcaaggagaaaagtccaaggttgcatcagcctatttgggagaccaaatggtggctgacttgttggctgttgggggtgacttttggttgccaacaatttcagttacactcagccattaa

SEQ ID NO: 82459 - DNA, 447 bp, Glycine max
  Peptide Sequence Number=SeqID_174144
atgcctaaatcatctcccaacatgcatgtgaaccaagaagtatcaacaagagtcaagccaaggctattgtgcaagcaatcaatagggcaaagcacaccgaataaaataaacaatgatggctcaaaatctcaccaatgtgtctacactagggaatcagtgagagcaacaacttctccagatgacgaatcagaaagattagcaatttctccaactggggaagcaggggggtcagctgtttcttcagctggtgtatcaggaggggcagtagcttcatatgatgatgcatcagagatgataattagaggtggagataagggaactacttcaagcttaggagaaagaggtggattcaccactggagttcatggctcggctgacattggttcgacccgtgccggtgcaggcttcgaaggagcagcctcattggttctcaccaatggaagttga

SEQ ID NO: 82460 - DNA, 955 bp, Glycine max
  Peptide Sequence Number=SeqID_174145
agggttacacgccctcacctttagaggactagatgtcctagccttcagaggactacacgtcctcgcctttaaagggctacacaatctcgccttcagaggactacccgtcctcgccttcagagggctgcgcatcctcactttgggtactcgtaccctcaccttcagaggactacatgtcctcaccttcagagggcgacacaccctcaccttcaaagggctgcacgccctcgcctttagaggactgcacgtcctcaccttcagaggactgcacgtcctcacctttagagggttgcacgtcctcaccttgggtactcgtaccctcaccttcacaggactacacatcctcgccttcagagggcgacacacccttaccttcagagggctgcacgcccttgcctttagaggactaaacatcctcaccttcagagggctgcacgccctcgcctttgtagggctacacgtcctcgccttcggtgggctgcacgccctcaccttcagaggactacatgtcctcctcttcagagggctaaatgccctcgccttcagagggctacacgccctcaccttcagaggactacacaccctcgccttcagagggctacacatcctcctcttcagaggactacatgtcctcgcctttagaggactggacgtcctcaccttcagagggctacgcgccctcacctttagaggactatatgtcctccccttgaaaggactacacgtcctcgccttcggagggctacacgccctcaccttcagaggactacacgtcctccctttcagagtgctacacgtcctcgcctttagaggcctgcatgctgtcgccttcagaggcctgcacgtcgtcgtcttgaaagggcgacacgtcctcgacttcggagagctgcacgccccctcgcgtttagagggctacgcgtcctcactttcagtgggctccacatccgcaccttaa

SEQ ID NO: 82461 - DNA, 327 bp, Glycine max
  Peptide Sequence Number=SeqID_174146
atggtatgcgtaggttgcattagggttataccactttgggaaaagaggctggaagatctttccaggagatatcacgaccatctagttggtgatgagggatggcatgaggtcctcctgacgccaaggtgggcattgccggctgggcgaggcggggttggagccggagcttgggggttcccctctggatgggcatgggagcgcttggttgtacgggcactgagttggaagagtccccggcgtgagccgagaagctcaggtgatgttgcacatattggtgggtaccgtgagagatctgcggcggcttggcccatgcaggcgttgaagtga

SEQ ID NO: 82462 - DNA, 216 bp, Glycine max
  Peptide Sequence Number=SeqID_174147
atggcctcagcaaatttcttattcccagaaggaaattccatcaataggcctcctatcttcaatggagagggttaccattattggaaaacccgtatgcaaatcttcattgaagcaatagatttaaacatttgggaagccatagaaataggaccttatgtatgtacccaccatagtagatggaagcacatcaacaggcacaacaatagaaaaacctag

SEQ ID NO: 82463 - DNA, 453 bp, Glycine max
  Peptide Sequence Number=SeqID_174148
atggcttccaactcccaacaattcaatgcaagaaatggtgctattattcttagaggagtccatgaggtggccatggattcatcttcatctactgaaaataaaaagtttgaaggaaaacttgatgccttggtcaacctagtaactcagcttgccatgaatcaaaaatctgcacctgttgcaagaatctttgtccttctttacagcaacctggagtcaatgagcaacctgaagcttaatgctgcaaacatttataatagaccccctcagcagcaaaaccaacaacagcagaataactatgatatttcaagcaacatatacaatccaggttggaggaatcatccaaatctgaaatggacaagtcctccacaacaacaacaacatgtccctcctttccagaatgctgctggtccaagcaagccatatgttcctcctccaatacagcaacaacaatag

SEQ ID NO: 82464 - DNA, 208 bp, Glycine max
  Peptide Sequence Number=SeqID_174149
atgggggtgcaaatagcaaccaggcccacttgggccctccagaagattcctccagaaggctgttgcttctggaggaagcaacctggctcgcctggaaaatctaagccgaggcacttccgaaacgttttccgtgaggaatttcgcgaagattttcgaccgtttttcgacgttcttcattcgttcttcatcgttcttcgatcttcaacgg

SEQ ID NO: 82465 - DNA, 213 bp, Glycine max
  Peptide Sequence Number=SeqID_174150
atggggaaatggctccgaagaaactctccacaaagaggtccagaagagacgccacagcagaagggtccagtgccgcccccaagtttgatagtcatcttttctggagcgccgagcaccagtagcacttcgaggccattagaggatggtcattccacaaagagaggcgtgtccagctcagggaggatgagtatacggactttcaggaagagatag

SEQ ID NO: 82466 - DNA, 387 bp, Glycine max
  Peptide Sequence Number=SeqID_174151
atggagcgttctttccttctcgatcctcactaccacctcccatacatcttatgtgaccttggacagagccaagttgatttatggccaaggaagggtaggggtaagagatcagaggcccctactacttcagcaccaccagagacactagctccttcttcttccacagctccattacctcccactcagactccagttattcctcctacatctacatctgaggaggagacttctatagaccagatcctagagccatcctcagcacctatacctgatgatgccataccatctgcaccagtcacggagccagagcagcctatccaagaatcatcagtagctccagcactggatcttaatgaagatcagccacaggatgagcaggacatttaa

SEQ ID NO: 82467 - DNA, 455 bp, Glycine max
  Peptide Sequence Number=SeqID_174152
tggtcatgttggtgcgcatgatccgcactcgtcactttgcagcggcacgggtgaaatcttgccccagtatgcaaagtagttgggcgatagcttccctctctgtttatgctcgcacagttggttgccttccaatatcaggggggcagaggaccttaaattctcttaagatatggatatggagcccactgaaagtgaggacacgtagccctctaaaggcgagggcgtgtagccctctgaagtttaggacatgtcgccctttgaaggcaagggtgtgcagccctctcaaggcgagagcgtgcagccctctgaagttcaggacgtgtcaccctttgaaggtgagggcgtgtagccctctgaaggtgaggacgtgccgccctttgaaggcgagggcgtgcagccctctgaaggtgagggcgtgtagccctctgaaagggaggacgtgtagtcctctgaag

SEQ ID NO: 82468 - DNA, 477 bp, Glycine max
  Peptide Sequence Number=SeqID_174153
atgacaccttcgaccgaagatgtgaagaaagcaatgcaaggattgtttgctgtactccagctctctatgtggggctggtttcacacctttttctccaagaaggtaggcccgtctatccgctacaaggaaggaagaatcgagattctatcttcatgcgaaggatgtccaaatgttcccttgatgggaacaagggtgaccacaacgcgagggtactccaaggagttcgcaaggcatgtgatgcggcgtgaagaaaggacagagagcttaggggaaagcagtaatgggatcatcggcggctatcataagtggctgagagtccgaacacaaggactggattggctcccaaatctaaagactgtgagagacgatgaggttaaagcttcggaagaaagtgatgaggtacaagccctaaaggcggagcttgaaagagcctgggtagtcgaagagaagttcaagtccatagccatcaaagtctga

SEQ ID NO: 82469 - DNA, 246 bp, Glycine max
  Peptide Sequence Number=SeqID_174154
atggccttgatcaaatttagcgccattgccggggagcagtgtccaaagtgtataactagaggcaatccatctgacttacaaccctttgatcctgagatagataggacatttcataaattagttaggcatcatcttgtaccttttgagcatcctgagcattctgttattggtgattttgagcatcctgatttagagcattacaattttgaacattctgattttgagcattctgagaacatggcataa

SEQ ID NO: 82470 - DNA, 354 bp, Glycine max
  Peptide Sequence Number=SeqID_174155
atgagtcatcattcatctagtattaatggcaagggtactagtcatcaggaccctatatctagaatcttagatgagttgagttctctcaagttatggaaaggaaaactagaaagaaaagaaaaagaaaaagagagggaaggcataggtcacatcttagacctcactcccatacgagaaaagcaaagaaagcctcaagaggataacattaacctcccatacttccatgggaaggacaatctagaggctaccttagattgggaaataagggtagagcaacaacttaaaaggaaatccacttcaaattttatggctctcactcttatccaaagaaagaccaaggtcaaggcatcttag

SEQ ID NO: 82471 - DNA, 150 bp, Glycine max
  Peptide Sequence Number=SeqID_174156
atggaggattgccttgagggtcctctcttaggcaatcatggaacacagctccaaactcaaaaagcaatcatggaacacagctccagactcaaaagtggaggacacgtgaatgacaacgcaattcactcacgtggctccggaaaaggatga

SEQ ID NO: 82472 - DNA, 1176 bp, Glycine max
  Peptide Sequence Number=SeqID_174157
atgtcttactttggagtgattgaaaaaatctgggagctagattatagtcaattcagagtgcctgtttttaaatgtaagatcatgggaacactgccaaggtctcctctgcattcagatggtcattcagaagctatgtctaggaggagtagacaatccacacggctaagatggttgactttaagaaccttggatcatcccataccaacagttaacgtcgatcctacaactgggaaaggattaggcccacataaagagaagttccacaactatattggggtcctagctcgagaaaagattcctattgtacatagcaattggaaagatgtaccagaatctctaaaggacctagccaaatttgatatccaagaagcaccaaatgccaagaaggtcatgtccacggtagccgctagatggaggcaatttaagtgttccctaaccactaaatttgtgaaaaaggcacaagaaattcaaaaatataatcactgcccctacttactgtctcgtgggggttatgattttcttgaaaagaagctattagacaagaaaaggaagaaaagacaacagaaggcaatactaactgagaatacaccattgattgacgaccccccatctcccattgaaagacatgtgaagtggaagttggcccgcataaagcgatatcagcagatgacatctcaggcaacacaagaaatatctaataaaattgagttaaaggaggccatcaaaattgagttatcccaaaggcaatcgcagtactcaccctcaattaaggcaaatatacaagtattaggtgcacgtaagagcacaaaggggagcaatgctgaaactgctgtcaatccatcaggggaagaacatgttgctcatgtgatgctgactatggggtttgatgctcaagtctcgttgccaatgtcagaaattcagtatgtcaggccagcccttgacacattcatttcatggccgacacatgttgtgaatcttgtatcacatgagattagtccaaagaaactggttgaacctattcaaaggtcggatgatgttgctacagatgatcccttggatgacttgattaagagcctgtttatgaatgagtggagttcaagcgtgggtcatggtttggtgtatggattccttgagcctcagtccatacacaatgcaacagatagacgtgttgaatga

SEQ ID NO: 82473 - DNA, 216 bp, Glycine max
  Peptide Sequence Number=SeqID_174158
atggatagttgttgtatgaggtttgtgttgtctgaagacctggggaatgtgaatcccagggtgacctcgacacttgctgcatgtgcacgacagggtgactatgatagggtaagctatttcctaacgaatggtaccacattgcattttagagttgagtcaagtgcatgcatcattctgagcataattgatttgaattatggaaaagttgatgactag

SEQ ID NO: 82474 - DNA, 288 bp, Glycine max
  Peptide Sequence Number=SeqID_174159
atggcagtggaatggagaagaggaagagttgagaggagacgccacttcaaggagaagatgagtctagaagaagctcaccaccataggaggccatggataagagcttggaggaagaaggagatgaatgaagggagaggaagagaagagcatgaaattttgtgctctaaaagagatctaaaatctgaaatgaagatgctcttaataccgcatgatgtaagctccattggagcttgtaggcctaggatcttcttcatcaatgaattccgtttcttcttggaagatgaatga

SEQ ID NO: 82475 - DNA, 351 bp, Glycine max
  Peptide Sequence Number=SeqID_174160
atgccgtcatttatcactgatttccagctttttggtttggaacattcagggcaacagtctcaaaggaaacattccaaagtgcaagctcagtggaaaggcaaggcatctttaagaaaggctcaacctttgtatgcaagtatcagctcagaagttctttggttagacattcaagaatttgcaatggttaaatataagaagctaaacagcacaagcgtacctctagccattgcagatcaaacacgaagcagcgcaagcatgaacccgaagtcagctttgtttttcagacccttactcactcaaaatagatggtatatttttctgaatagagaagtaggcttggtgatactgtaa

SEQ ID NO: 82476 - DNA, 264 bp, Glycine max
  Peptide Sequence Number=SeqID_174161
atggccccaagaaagcttccatcaaagaggtccaggaaggacgccaccgaagaaggctatagcgctgccccacaggttgacacggactttgacgagcatcgatttcggagcatagatcatcaacaacgctttgaggaggagatagcccacaggtgctgggcaccacttgtgacacacatggctaaattcgacttggagatagtcatggagttgtatgccaatgcctggcctaccgaggagggagtccgagatatgcgctcctag

SEQ ID NO: 82477 - DNA, 424 bp, Glycine max
  Peptide Sequence Number=SeqID_174162
atggatattgactatgctattaggaaagacgaaccgccaggcattactgaaactagcactccagatgctgtcgatctttatgaaaagtgggagagatctaatcgtctgtccgtaatgttcataaagattaatatatttactagtatccgtagttccatcgatcagcatgaaaagctcaaagggataaggggtgtacatgatcacatcatgagcatgagggatatagtggctcaattaaaagccttggagggcgaaagggtgaacttaaccgttcatggaaagaagaaaggggatcaacccaaaaacaagggcaagattcctgctcaaccagtcataaagaaagagtccaagtgtttcttatgcaagaagaaaggacacatgaagaaaaactgcttaaagattaagagctggacggacaagaaag

SEQ ID NO: 82478 - DNA, 468 bp, Glycine max
  Peptide Sequence Number=SeqID_174163
atgactagaggattttactttccaacattatatgttttggagggaaagggaagagagggtcctgttcatgaagatatgtttcattggcaagctacaattatgggtcctccagacagtccctatgctggaggtgttttcctagtgactattcatttccctccagattatccctttaagccacccaaggttgcattcaggacgaaggtgttccacccaaatataaatagcaatggaagcatttgccttgatatattgaaggagcagtggagccctgctctaaccatttccaaggtaacctggtgcttggacaaactggctcaatcggtgttgctctcaatttgttccctgttgacggacccaaatcctgatgatcctttggtccccgaaattgcacacatgtacaagacagacaggaacaagtacgagtcaactgcaagaagctggacccagaaatatgccatgggctaa

SEQ ID NO: 82479 - DNA, 429 bp, Glycine max
  Peptide Sequence Number=SeqID_174164
atggcagcggaatggagaaggaagaaaaagaggagacgccacttcaaggagaagatgagtctagaagaagctcaccaccataggagatcatggataagagcttggaggaagaaggagatgaatgaaggcggagggagagaagagcacgaaattttgtactctaagaaagctctgaaatctgaaatatggttcagcccactaatccaagatcaagtacaagattctccactaagtgtgcttaggtgtcatgaggcatctcatgagcccgaaatctaccctaaggctcatgagaatcctatggccatctcttgcatctttggcccaatcttcttggagtcttctatccaatgccattgtggggtaggattgcataagatattttgcttaatcgaggagcatgctagacggtgcattcaaaaattgaattaa

SEQ ID NO: 82480 - DNA, 840 bp, Glycine max
  Peptide Sequence Number=SeqID_174165
atggccccaagaaagcttccatcaaagaggtccaggaaggacgccaccgaagaaggctatagcgctgccccacaggttgacacggactttgacgagcatcgatttcggagcatagatcatcaacaacgctttgagggccagcagtgtgagtacagtcagaggaggagacaggtctttggctttgatgaggaggccattgcccagctattgtgcatactggggcaagattttgcctggaccgctgtagggagacatgtgtggatcatgcgcaccagcatgaccatccttacccaaatatggatgacattgctactcagcaacattctgcttggcgaccataactctgaccttcctctaccgaagtgtcaactggtttatgccatcttgacacagtttacaggaacgacgcctacgagacaccctatggacccagagaggtccaataatgccttggggtttcccgcgctgattacgggcctttgtcagttctatgaagcacctgttgcccccaacaaggtaggcgtcgggcgagacaccacagcagcctggagacagctagccgcaggcagccgatgcaccaccgtcaccctcggagtccacctcgacccacttgcgaaggttcgcttgaacgagagtttctaccagtacgccctacgccagcagggtcgggattccaacccttacacatggcctactccagagcagtttgaggctacggtagcatggcctggggattggcccgactttcatgcagaggcggggcccacggagacctctggaggtggggacgaagcccaggatgatcaggacatgaccgacttgatagacttcctcctctga

SEQ ID NO: 82481 - DNA, 270 bp, Glycine max
  Peptide Sequence Number=SeqID_174166
atgaattttacagtgaaaaagcctgtaaatagcacgaaccaaaacaccaaccaattcaccccaattccggtgtcctatgctaacttgctcccatatctacttgataattcaatggtagccataaccccagccaaggttcatcaacctccatttctccgagaatacggcttgaacgcaatgtgtgcttatcatggaggagccccggcgcattccattgagcattttagggccctaaagcataaggtgaaaggtctaattgatgcaggctga

SEQ ID NO: 82482 - DNA, 612 bp, Glycine max
  Peptide Sequence Number=SeqID_174167
cgaggtggagacatcatcggaggatgcagtggcgcttccgttctccgggacgacagggccaacgaaggaggtggttctgatgcagaaacgtggatctttcaaggaagcgcctcaagatctctcttctttggcaactcaactccctcatcttcttcgtcgctgccttacatgattttgcaactggagaacgatgactctgctgagtcggattcgctcgccttgcttcgctacacgatagcagctgcagcagcaatggctcctaaacgaggtggaaaggctccgactcttgccgctaagaagaagcctgagaaggtttcgaatccgttgttcgagaagcgtccgaagcaggttgttgtgattgctcacgatgtggacccaattgaattggttgtctggcttcctgcactgtacaggaagatggaaattccgtattgtattgtgaagggaaaggcccgcttgggaacgaatgaagataaattggagttgagcagagttttggaggctaccaaggaattatacatggagttacatgctttggatagatttgcacaagattatcagcataagcgtgaagaggatgataattcaggtgcagctcaaagtggtaattga

SEQ ID NO: 82483 - DNA, 858 bp, Glycine max
  Peptide Sequence Number=SeqID_174168
cttggaggaattgatggggacccggtgttgagaagaacgaggataagggctacgtgggagtacgtgagctcagttaaaggtgggcaactggggatggtggatttatgtgtgattgtggatgtggagagtcgacttgcaccatcgcccgatcgccacctagtaccacatatgaaggtggtacctggagatatgtcgcgggggtcaggagaccttggggacgtcaggcgagctcctggcagtcaaccgataaaagaacaaagaccacaaagcaaggaggcttgtgtggtggctggccagctatggattttgagtgatatttggattatggcctctggtaatcgattacaaaggagtaacaggtcactggtaatcgattaccagttatgtgtaatcgattacacaatgcatattgcaggtttccatgttctgaagctgtgtaactcgagtttggcatctggtaatcgattaccaatgctgtgtaatcgattaccagagatgaaaagccttgaggcacaccttttaattgcatgtagtggttatgtgacgcattgtgttgctaccgaaccagcacgcacgcttcagcgcactatggagtggatattacctacacctactccatatcgactagtggagccagtccaagtgataaatgtgacgtcatctgaagaagaccctgaggaggacccagaagagctaccccttgagcctgttgtggatgctcttgactttccagagggtgatgaggacccactccctgaggtggattcttccgaggacgtcatgtcggcatctgaggcagactctacggaggagagcggtcctggagggatagcgactagtggaggttcttcattatag

SEQ ID NO: 82484 - DNA, 670 bp, Glycine max
  Peptide Sequence Number=SeqID_174169
ttggaacctcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggggaaaggtccaatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 82485 - DNA, 439 bp, Glycine max
  Peptide Sequence Number=SeqID_174170
gtcgatagtatttgcacgtaaacaatgggcagttgcagctgttgctaaggatgttgaccatgtggatcatgctgctaacgtgtttcatgagcagcctcaggagctaattacagatcatgtcgatgctgatacaaagggttttccaagtggacactatgatacattagtgttgacatcatatgctgatcatgtggcagccagagtttggaggtggcacaaggaaactagtagtttccatctacctgttggagaggtgactataaccctcgatgatgtggcatcattgttacatcttcccattacaagtgccttccataccttcgatgctcttgacgtacaccaagtcgtggagttgttagttgagatgcttgaagttagtacacaagaagcaaaagatgagactgagcaatgcagaggggcgtatgttcgtctagcctag

SEQ ID NO: 82486 - DNA, 168 bp, Glycine max
  Peptide Sequence Number=SeqID_174171
atggtgaacaagccatttgaaacttctgaaggcactcagggaactattgttccgaaggacaatctgctagaatttgcacttggtctttacattcttgtcgatgtaaaacttgcacaacaagttggtgcactcgggaaaaacagtattcactgctttcatcagtgctag

SEQ ID NO: 82487 - DNA, 480 bp, Glycine max
  Peptide Sequence Number=SeqID_174172
atgtgggttgtacatcgaagaaaattttctcgcctggttgccctaggaagagtttatgagggatccacagcggttcagaacatccctttattgcatggccaagtgaaggttggtgttcacgaggttaaagatgcagaggctctcgttcctgtacccactgacgaggttattttagtggggcagacacttaacaccttccttgtttggctgacacttctcatgaagcgtttatcagaacaagcagttgtgtctccagcaaaacctatagatgggccggatcctcaggttatgtgggatgctaccgtgttcggggtgtttaatgaacacttcccgttgtacataaagcacgaagatctatctgaaattgcacacggagatcaatgtctcaacatatctgttatacagttgtggattctgcatctgactgagacaagtatgcgatcggggaattccgatgtgtatggattcctcgagccatag

SEQ ID NO: 82488 - DNA, 789 bp, Glycine max
  Peptide Sequence Number=SeqID_174173
atgggatcgagtcaggcgcctttgcttaaaaagaggttctatcaagtcaaggtcaagagcctaggagtcaccagtatgaaagagttagggcagttgatgggtcagctccatcaacaagcctttcacaaagcttacgctataagacaagttggctaccctatgagaggggcaccattaaaggaagacctcacacctattattgcacgaggtttcaatagcaccaacgcagaggcacttcagaaggtccacaaggcatgggagatggtgcaaaagaaggacaaggaactcagaggcagtagcaacgggcccatcagtggctaccataggtggttgaaagcctacacgcaaggtctggattggctcccgaatttgagaaccacaaagggggtggaagttgaagctctagaggagaacgaagaggttcaggccctcagggcagaactcgagaaagcccaaacagtcaaaaaaaagttcaaatcagcagctattaggattcgaaaagaaaacgccgaactgagagacgtaaatatagccaccaccaaaaccttggagcaagaaaccaaaagggtccgtagggaagaacatggccagaacaaattccgaggggctctgtggggcagtaacaacgagcttaagctccggagagaggaaagagaccaatcacgagtaggcagtttgatcttgaaagatgaattgaggatttgcctaaggtccaagagaagcttgtctcagcggttatgcgagaccgagaccaacatgttagccatcatcagcaaataccaagaataa

SEQ ID NO: 82489 - DNA, 666 bp, Glycine max
  Peptide Sequence Number=SeqID_174174
atggccatttatgtattgaagcccttcgaccgaaatttcaaaggtgacatgattgcggacatcaagctctgtctggctgcccgcgaattgattgccggacagtatgaggccagcctggggggtggtgtttacaaaaaacgcattccgctcggcgccggcaaaagcggcggagccagagcgattgtcgcgttcaaatcacaaaaacacctgttttttgttaacggttacgctaaatcgaccacgaagagtggcatacgtgagattaaagaggatgagcttaatctctacaggcaggtagccagtcaactgtttgccatgacgactgagcaggaaagagcagcgataaaggcgagaaaaatgcgagaggaaatcgcgcatgattttaacccgctgggggtggttagcgatgagcttaccgaaaaaatcgattcacgtgtcagattacgtgagctgcgtacctctctgccggttttacaactgatgtcaggcgaggctattcgtgagttacgtgagcgtcatggtctgagtcaggccatgttagccgcctatattggcctgtccccggccaccgtggtgaaatgggagcgtgaggagaagaagccaaatggcgctgcgctgcgcctgcttaacatcattgatagaaagggtcttgaggtgttgcgttaa

SEQ ID NO: 82490 - DNA, 132 bp, Glycine max
  Peptide Sequence Number=SeqID_174175
atgtcaagggaatttcaagggaggggtttgccagaaatcgcactggatcgtcaacctaaattactaaacctcgatccctcgtcagaccgaatcaatccaagcttcgccctcagatccctcttgttggactag

SEQ ID NO: 82491 - DNA, 498 bp, Glycine max
  Peptide Sequence Number=SeqID_174176
atggggcatgctcggtcggatgggcatcgagtaggggggagatccgatattggccgagtaattgtattggtgcgggggataattggtacatggggttgtgaggggtttgttgggaatttggccatgtgggtgttgtggttacgtcatgggtgtctccctcctttttcttttccctatctgttccagtcctcctattgccgacacttgttgaagtggtgtaatcgaatttgccccttcttaggcctacttcgattctttcgcttgcaaatactagatccacaaaacttgagggcatgtatcccaccatcttctcatagtagaacacggcgagcatcggctaagtgcaacactcagtggctaagcacgaggaagaatccagaagaagatgagctgtacaggttcgttgagtgcacctcaccaggtcatcaagcgcactgcttcagctcatccgctaagcgagagaagtgcgctaagccgaaattcactgatgtgcgctaa

SEQ ID NO: 82492 - DNA, 132 bp, Glycine max
  Peptide Sequence Number=SeqID_174177
atgagagaggtactttcaaaaaaaggaggagaagacgaagccgaagatacagaaagaatcgtctccagcgcaccgatgggagacggggcccccgcaaggaaaagtgctgctctcataaccgactgtttttaa

SEQ ID NO: 82493 - DNA, 449 bp, Glycine max
  Peptide Sequence Number=SeqID_174178
ttaggccaccacttcaagaactctgtagcaccgcctacatacctcgctctgctaatcctgttaccagtggctgctgccagtggcgataagtcgtgtcttaccggcgccacgcttcccgaagggagaaaggcggacaggtatccggtaagcggcagggtcggaacaggagagcgcacgagggagcttccagggggaaacgcctgcctatggaaaaacgccagcaacgcggcactttttacggttcctggcacttttgctggcacttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaat

SEQ ID NO: 82494 - DNA, 597 bp, Glycine max
  Peptide Sequence Number=SeqID_174179
ggacttgcactgcctctggagcctaaggttggcccctcaactgctcatgttagcataaaggagagttgtgttaatccctcagggaatgatccagacacgagtgattcagacaaatgcgggttgtacatcgaagaaaatattccccacctggttgccctaggaagagtttatgagggatccataaccattcacaacatccctttgttacatgatcaagtgaaggtcagtgttgaggaggttaaagatgcagatgctcccgttcctgtacctactgacgaggttaacttaatggggcactcacttaacaccttccttgcttggctgagacatctcgccaaacgtttatcagaacaaggagttgtgggaccagcaaaacctatagataggctgcatcatgaggttatgtgggatgctaccgtgttcggggtgtttaatgaagacttccccctgtacataaagcatgaagatctatttgaaatagcacacagtcgtggattcaacaactaccttaaaggaatcattaatagtgctttgaaaggactggacgatactccacaacctaaatccaaggctggtgctaggtggattgttgttaaa

SEQ ID NO: 82495 - DNA, 69 bp, Glycine max
  Peptide Sequence Number=SeqID_174180
atggctgagtatgaggcatgcacacttgggatccaagcggaaattgacttcaaggtcaagttgctcaag

SEQ ID NO: 82496 - DNA, 504 bp, Glycine max
  Peptide Sequence Number=SeqID_174181
atgtcaatccttaccctcggaagcaaaaaaggagaaggaaaatttccaatccaagagaaagcaaaaagaaaagaaaagaaattcccaatcaaaagtgggagaaagcaaaaagaaaagaaggaaattccccaatcaaaagtgggagaaagcaaaaattggaagttttatctctttactgaagcacgttcgcattttagcgaagaaaatactgagactatttctagtctcacaagttatccagaactacgtaggtctaagttcctcattggaggatacgtaggagcaaaagcctcgcttttgtcgaccacaccgctttttgttaccatgacccaagaactggtagcccgcggagacaccttacggttatccgcacctcgtcatttagtgagcccaagtgtgattgatgagcaaaggccgatgtggtcatctgtgccctttccggagatgtcggcatcttccggtggagactttttcaagtctcacaagttatctagaactacgtag

SEQ ID NO: 82497 - DNA, 249 bp, Glycine max
  Peptide Sequence Number=SeqID_174182
gaacgtgagattgaaatccaacggctaaatcaaaatgaagaaaccaacaagaggaaacgaagcatagcactaaaagcctcctcatcaatgcaagaggaaaatgaagatgaagaatcggaagatgaagaagacttctcactttttgtgaagaagtttcacaaatttgtcaagaatagaagaagcgagaggcgtcaaaatttcaaccatggaaaaagatcccatgaaggctctctaactcttagatgctaa

SEQ ID NO: 82498 - DNA, 381 bp, Glycine max
  Peptide Sequence Number=SeqID_174183
atgacggtgaaaacttctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggaagcttgccatgcgattgcgaagaggttggagagccatctcaacctagggttggtcacgctaggcacatcgacacatgagttgatcgaagaatccctcaggattgccaggagtgtcatagaagactga

SEQ ID NO: 82499 - DNA, 630 bp, Glycine max
  Peptide Sequence Number=SeqID_174184
atgggttctcaaggtcaatcccaagcaatgttggtgagaaaagaagagggtgatagagtggtggtggaggaggagcttgggggtgttggggaaggtttatgtgaagagaaggaggaagaatctgactgttttacactgctgaacgtatttgaagcctgcaacactcacccaggcgagtttggctcgcctgggcgagctgatccacagctcaaaatttctgctttgtttctgttcggtgattgtgctctgcgtttagggtttgagatggaggcaaagaacaaagtgaagatcgaggattctacaacggagtctccaacttcggtccttgaagacgagaactggtgggattttggtaagatggatttcttcatgcttatcacgacttatgggaagctaggagacttcaatggtgccgagaaggtcttaggcttgatgaataagaatggttatgcacctaatgtggtgtctcagactgcacttatggaagcttatggaaaaggaggcagatataataatgctgaagcaatattccgaaggatgcagaaatggggccttgaaccttctgctttcacatacccgataattcttaaaacatttggtggtggttgtggtacttctggtttcctgtga

SEQ ID NO: 82500 - DNA, 285 bp, Glycine max
  Peptide Sequence Number=SeqID_174185
atgttcctcatattcaacactagtgctttgaaaggacttgatgatactccacaaccgaaatccaaggctgctgctaggtggattgttgttaagtgtaataaacaaaaaggaatcattgaatgtggctactacgtgatgtactggatgtccatgataatcttaggatctttcaggaataattgggagacgtattttaatgaagttagaccattggaagcagagagattcaaggcacttcgcatacagtgggcacagtattatctaaaagttagaaatcaaacatag

SEQ ID NO: 82501 - DNA, 153 bp, Glycine max
  Peptide Sequence Number=SeqID_174186
atggaagacgcacccgtgagcctcgcctcgctcgcccgcaaaagggcagtgggtttggtgaatcaacaaggagatcacccccaaggggagaaggggaagaaggagaaggagaatgggttggtcatcatggtggtggcgatcggcggctgttag

SEQ ID NO: 82502 - DNA, 135 bp, Glycine max
  Peptide Sequence Number=SeqID_174187
atggttatcaaaccaggtacctttgacatcaatttgagggtgaattcttcccaagaaggagggtgtgatagaggactatccaaggaggaagaatttagcttaggtggactcaacatggatggaccaatcacttga

SEQ ID NO: 82503 - DNA, 375 bp, Glycine max
  Peptide Sequence Number=SeqID_174188
atggctataaatattgaacacaagggagggtacatcctttgtggttcgtttcaagtagagggtacatctactttgttgttcaaagagaacaagggagggattttacaaggttattggaaatctcaagaaccgtgggttgcttggggactggacgtaggcacggtgattgtccatgctagtgtggaagcaatgccttccaaggttattttgatgatgccaaagaatcaagagttaagcaaattccaaagattcaagaatctagtttcaagaatcaggattcaagattcaagaatcaagtttcaagaatcaagattcaagaataatcaagatcaagattcaagaatcaagagaagactcaatcaagataagtactaa

SEQ ID NO: 82504 - DNA, 195 bp, Glycine max
  Peptide Sequence Number=SeqID_174189
atgagcaagaggctccaaaaggattgggctagaactgctgaagaaggccctagggttctcatgaaccttagggctagcctttgtgatgcaatcctccctaggaagggcccagtcactagagccatgagcaagaggctccaagaggattgggctagagctgctgaagaaggccctagggttctcatgaacctcagg

SEQ ID NO: 82505 - DNA, 415 bp, Glycine max
  Peptide Sequence Number=SeqID_174190
cttctccccctgctcctgcttcctctgcacctgctccctctacttcagcaccaccacttccttctgctccttctccaacaccagctccctctgctccaaggtcacagttcctatgttgcagagcatccaccgtggcttatgcctagtgatgcaaagtatgcatgactcggctcagcatcgaccttttatcagcatggatgagttcatggcacaggtggcctggccaggagtccagccttctcctttggggggaggtgaggcttctgcagcccaggagcctcagccagagccagaggtcgcacgagaggccactccagagacgactccacaggtttcacatgctacttcatttgttgtggaggtctctgagggtgaaaaaggtgctgaggacaccaactatgcagcaaatttatag

SEQ ID NO: 82506 - DNA, 255 bp, Glycine max
  Peptide Sequence Number=SeqID_174191
atgaagaagatcctaggcctacaagctccaatggagcttacatcaaaccgcctgaattcttttgcgtctttcttctcccttacaaaagattcaaagaattctcaggtggttagtcctttgaatctttgtaaaggggacttgatccaacaagtggtatcaaagcagaaggaaactccatccataggccacccatctttaatggtgagggttaccactattggaaaacccgaatgcaaatctttattgaagccatag

SEQ ID NO: 82507 - DNA, 297 bp, Glycine max
  Peptide Sequence Number=SeqID_174192
atgaaggctgatgactcttccactcaaaaagaagagcagatgaaacctatgcgaaataagcaaaatgcactccaccacaaagttgccaggtccatcaagttcaaccagatggacatacctgtggaccttgcgacggtgagtgttttcgcatgctggagaagcacacttgcaacggtggtcagcatggtgttgcgagagtacgagagtgggagtgagagtgtgagattgggagtagggtgtgcgagagtgcgagagtacgagagtgcgcgggaagtccagttttggtttttaaattaa

SEQ ID NO: 82508 - DNA, 195 bp, Glycine max
  Peptide Sequence Number=SeqID_174193
ctcatcagtggggctaagcgctcatctattgctaagcacagcttcagtgcgctttgcgcaacagaagaatatgtcagagcatcaatattaaggtcgcgcgctaagcgcgagatcagtgtgctaagcacagcagttctcttcagccaggctcaacacatgattggcgctaagctcaaatccactcattcgcactaa

SEQ ID NO: 82509 - DNA, 456 bp, Glycine max
  Peptide Sequence Number=SeqID_174194
gcccagaggggctcttcgttttttaccctaattatgtcctttaaatgctgcattaattactgtgcatgtcagagagagagagagaggggaatacggacagtcaaagcgccggaacagccaagagccaccactagccaccactcagtgcccctctcctcctccgtgaaccaccactcagtgcccctctcctcctccgtgaaccaacaccaccaaccacaagcactgtgtcaaacacccaacaccaccaagccaccgcaaaccaccaacacagccaccgcaaaccaccaacacagccaacacagccaccgaaaaccaccaacacagccaccacccaccaccgtacaaacaaaccacaaaaaaaaccaacagaatcaaaatccgaaacacattcaaaccacaaatcacacgattcgtaccccaatcatcgcacagaccacggaaaccgaaccggcataa

SEQ ID NO: 82510 - DNA, 519 bp, Glycine max
  Peptide Sequence Number=SeqID_174195
atgccaccgagaaagctttccacaaagagatctaggaaggacgccgcggctgaagggatcagtgccactcctgagtttgacagccatcgtttcaggagcgcagagcaccagcagcgtttcgaggccatcaaaggatggtcgttgcaccgagagagacgcgtccagcttagggacgatgagtacacagattttcaggaagagatagctcgccggcgttggacgtccctggtcactcccagggctaagtttgacccagatatagtcctagagttttacgctaaggcttggcccacggaggagggcatgcgggacatgtggtcatgggtaaagggccagtggattccttttgatgcagacgcccttaggcagttcctgggtgacccgctagtgttagaggagggccaggagtgcgagtttagtcagagaaggaaccgggccgatggatttgatgaggaggccatttcccagctgttatgcatattgggtcaggattttgcctggaccgcttctgggaggcag

SEQ ID NO: 82511 - DNA, 482 bp, Glycine max
  Peptide Sequence Number=SeqID_174196
ggccctgggatttcccgcactgatcacaggactctgccagtcgtttggagtccccgtggcacctaccaaggtgattcggccgcccatcacccgggcttttattgagaagtactgcacccagagacaggctcagggggatgctccacaggccgcgggcgcgccaccaccacctcatcaggctggcccggctgggtcatttgacatggagcagtatttacgacatttggttcgccagcaggcagccaatcaccgggcacatgtgcagacccatgattgtctataccagatgagcctcagcatgcagagccagggcttcgcttctttttcatgccctactccagaccagttcagggcagaggtcgcatggtccggggattggcccgaggcccaagcaggagaggtgcccccggaagttcccggcgatggagaggaggcccacgaggacgaggagatggccgatttgcttgacttcttgggaggga

SEQ ID NO: 82512 - DNA, 303 bp, Glycine max
  Peptide Sequence Number=SeqID_174197
atgcacacacaaagtttcacaattccagtatttcctaaaataggcctaactcacaaaaacagtccccagaggagtcgccaactgtcgcaacctacccttttgcgggcgagcgaggcgaggctcacgggtgcgtcttccaaaggaggaaaatgcgcggagtttccaccaacgtttatttgtgaaaaacgtcggaaaaaccgaaggaaaccggtcatgaagaatattccagattcaggagttgtatttacgtttgaggaaggtattagcacctttcacgtttgtcccaaaggacaacagccttaa

SEQ ID NO: 82513 - DNA, 390 bp, Glycine max
  Peptide Sequence Number=SeqID_174198
atggatgaagatgatgataatgatgttggaaatgatttggtatttgaagatgatgatgcactaaattggacaactgtgtatgaggcttcgggggttggagagcgtaggatgtatactaggaggaaaaaaagggaaagaaagcaaccaacaagtgctggtattactcctactgctgctgctgcccacacatctaaaaaacaggcaatgattgttggatcttcatcaaggaagcaaaaagcagtccaagaaaatgatgaggatctagagtttgaggatattgaacttgaatctgaagaagaagaagaaatcatgattaattttgaggcgtctgatggagaagagggagagggagatgctccactatcttatgataacaatgaagaggattat

SEQ ID NO: 82514 - DNA, 438 bp, Glycine max
  Peptide Sequence Number=SeqID_174199
atggaggggtaccttatggttatccgcacatttctgctaatcctgacccgtgaagtcaggtggcaggcggagatacccgagtggttatccgtacaaagacaacttctattaatcctgacccgtgaagtcaagtggcatgcggggaggcaagcaagcccattgacacgcaaagacttacgtcgtcttctgcaccttttgtcatctagagacggcgagtccgatgacatgcgggggtaccttatggttatgcgcacatttctgttaatcctgacccatgaagtcaggtggcaggcggagatacccgagtggttatccgtacaaagacaacttctattaatcctgacccgtgaagtcaagtggcatgcgggggtaccttatggttatccgcacctttttgtcaaccagaggcaagcgagcccgttgacacgcaaagactaa

SEQ ID NO: 82515 - DNA, 171 bp, Glycine max
  Peptide Sequence Number=SeqID_174200
atgagctgtacaggttcgctaagcgcaccgcttcatctcactaagcgcaccgcttcagtttatccgctaagcgagaaatacgtgctaagccaaaaatcactaacgtgcgctaagcggtccataaatttgcagagaccagagcttgaagcaggagccgatttgagagcttga

SEQ ID NO: 82516 - DNA, 381 bp, Glycine max
  Peptide Sequence Number=SeqID_174201
atggtgaaagttggaacctcttacgtgccgatcaacgtctcattttcgccaaaagttggcccagggcttcccgctgtccctcctgttcagctactgacgggggtggtgcgtaaccggcaaaagcaccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaa

SEQ ID NO: 82517 - DNA, 393 bp, Glycine max
  Peptide Sequence Number=SeqID_174202
atggcgaggattcctgacaagattaggtctattgatggatcaaaagaaacgcttaagcttgctgttaggatcaccgatctttggttcgttgggactcctaacaagtctgagcaagcggaaatggtttttgttgattcagagggtgatcaaattcatgctatttgtaaatcggaccacctcaagtcttggaaagttgatttaaaagagaattgcacttatgttatgcataatttcaaagttgttaagaatgatggtcaatttagagtgtgcgaacatgagtacaagttattttttattggagtgacggttgttagagaacccgatttgcatgaactaccttttaaggaatttagatttcagactcaccaaacattgttgataaaaatttcataa

SEQ ID NO: 82518 - DNA, 183 bp, Glycine max
  Peptide Sequence Number=SeqID_174203
ggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 82519 - DNA, 988 bp, Glycine max
  Peptide Sequence Number=SeqID_174204
atggcgcaactttgtcaggagagcatgttcatgtctcaaactcccacccatgccttgccgtcttatctgaatgccgacgaactcggcccctggggtaattacctgcaacaagtcgaccgggtcacgccgtacctcggttcgctggcgcgctgggtcgagaccctgaagcgtccgaagcgctcgctgatcgtcgatgtgccgatcgagctggacaatggcagcgtggcccacttcgagggttatcgcgtgcagcacaacacctcgcgcggtccgggcaagggcggcgtgcgtttccaccaggacgtgacgctgtcggaagtgatggcgctggccgcctggatgtcggtcaagaacgccgcggtcaacctgccgtacggcggcgccaagggcggcatccgcgtcgatccgcgcaagctgtcgcagtccgagatcgagcgcatgacgcgccgttacacctcggaaatcggcgtcatcatcggcccgtccaaggacattcccgcccctgacgtgaacaccaacgcccagaccatggcctggatgatggacacgtactccatgaacgaaggctcgaccgccaccggcgtcgtgaccggcaagccgatcgcgctgggcggcagcctgggccgcgtcgaggccaccggccgcggcgtgttcgtggtcggctgcgaagccgcgcgcgacctgaacatcgacgtgtccaaggcgcgcgtggtggtgcagggcttcggcaacgtgggtggcaccgccgcccgcctgttccatgaagccggcgccaaggtcatcgcggcgcaggaccacaccggcacggtgcacaacgccgccggcctggacgtccacaaactgctgtcgcacgtgtcgcagcatggcggcgtgggcggcttctccggcggccaggcgatggacaagaacgagttctggacgctcgaaaccgaattcctgatcccggcggccctggaaagccagatcaccgccgacaacgccgcccaag

SEQ ID NO: 82520 - DNA, 393 bp, Glycine max
  Peptide Sequence Number=SeqID_174205
gcaaggacgtttagtcctctgaacgcgagggcatgtagccctctgaaggtgaggacatgtagacctctgaaggcgaggggatgtagccctctcaaggcgagggcgtgctgccctctaaaggcgactacttctagtcctctgaaggcgagggcatttaaacctctcaaggcaaggacgtttagtcctctaaacgcgagggcatgtagccctctgaaggttaggacgtgtagtcctctgaaggtgaggacgtgtagtcctctgaaggcgaggggatgtagccctctcaaggagagggcatgctgccctctaaaggcaaggacgtgtagtcctctgaaggccagggcgtgtagacctctcaaggacgtgtactcctctacaggggaggacgtgtag

SEQ ID NO: 82521 - DNA, 465 bp, Glycine max
  Peptide Sequence Number=SeqID_174206
actaattattgattgtgatccggggaatggtattgctggcgctaacaccgatgacgggctggcgctggccttagcgctggcgtcacgcgcgctggccgtcgagctgatcactaccgtgagcggcaacacgccgagcgcggtgggagcgcgggtggctaaagcatctgctgcagcggctcggacgaacattccgatgcttaacgtcgcggaccgtattcggcgctgggcgaatgtgcgcggcagtgcgtcagcacgcagacgtaacgaagggcaggcgattggctgtatccgcgcgctgtccgtagcggagatcgtcacatggcctgcgtgtgccgcacgatgtcgcgctggtgtgtttcaacggtaccgagcagtcggcctttcatgtgcccacgctcaccaccgtgcgccagccgctgcgcgaaatggcacgcagcgccatcgccatgctgaaaaacggtcatg

SEQ ID NO: 82522 - DNA, 1491 bp, Glycine max
  Peptide Sequence Number=SeqID_174207
atgccggtgatcgattatcacaatcatcttgaaccggatgtgatttctaccaatcagaatttccgttcttcaaccgctatatggctggatggtgaccattacaaatggagagccatgagaaatttcggcattgatgaacagcttatttccggaaatgcttcagatcaggagaaattcaggaaatgggcagaggtagtaccttatacccttcgtaatccgttatttcactggacccatctggaactcaaaaatccttttggaatcagcgaatatttatcatccaataatgcagatgcagtgtatcatcagatgaatgaaagtttgcagacacctggttttttgccacaatccattattgaaaattttaaagtagaagccttatgtactacagatgatcctgctgatgatctggttcatcacaaggctttaaaaaatagtgggtttaaaacagctgttcttccggctttccgtcctgatacctatatcaatatgatcaatcctgaacaatatctttcaggaattaaaaagcttgaaaaagtctgtggtttttccatcgcatcaatctctgatgtgttgaatgcacttcagtccagaatcaattatttcgtggaagcaggggctaaagtggctgaccacggctttgaatatttcccggataccacaaaatggaatcatagccttgaaaaagagttttccgaattcctgaagggcaatctctcaacattttccgatccggatgcattatgcggctatttgctgaaagaactttgcaaaatgtatgcagaaaaaggctgggtacagcagtttcatgtaggagcaacacgaaacaacaattcagaaatgttcaggaaaatgggtgccaatgcaggatatgatgccattggagaaccatattacgcacagcgattgagcgttttgcttgatgcattgaattcagaaggaaaactggccaaaaccattatttacaatctgaatccggcatttaatgaagttctggctactcttgccggaaatttcaatgaaggaggcatcaaatccaaagtacagtttggagcagcctggtggtttcttgatcagcttgacgggatgaccaagcagatgaatacgctttccaatatcggtcttatcagcacttttgtcggcatgctgaccgattcccgaagcctgctgtcattctcaagacacgattatttcagaaggcttttgtgtaatctgttcggaagtgaaatggaaagaggtcttcttcccgatgatgaaaaatgggattcatcgaaaatattatgtttcggggaactgcttctccactttgccccggattccgaaggaaactggctgaatgagcagtctctgaagatttatgttggcggagcagaatacaatgtagcagcggcactttcccagtggaagaatgctgtaaagctgctatcagcattaccggagaattttgtggcaaaccagctggaatctcagcttaacaataaaggaatagaa

SEQ ID NO: 82523 - DNA, 418 bp, Glycine max
  Peptide Sequence Number=SeqID_174208
caccgcctacatacctcgctctgctaatcctgttaccagtggctgctgccagtggcgataagtcgtgtcttaccggcgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaat

SEQ ID NO: 82524 - DNA, 426 bp, Glycine max
  Peptide Sequence Number=SeqID_174209
atgaagctggaagagactctagctcagttcatgcaggtttttatgtccaaccagaagagcatagagtctaccataaagaatctggaggtccaagtgggacagcttgcactgcaattggcagatagatcatcaagcaattttacaactaatacagagaaaaatcccaaggaggactataaagtcgtgatgtctagaagtagaatggcaatccatgtggatgagagtgaagctgagaagaagatggaggaacataaacaacatctggcacctaagccagcacttgaacccatttctgattttgtagaacttgaagacattaacgaggaggctcaagatgataaggaagaagagacaccaataaaagagaaagaaaaaagaaagaataaaagaagcagaagcagaaaaataaaaaaagttgaaaaatga

SEQ ID NO: 82525 - DNA, 696 bp, Glycine max
  Peptide Sequence Number=SeqID_174210
atggtcgaggcgattcgcgcctcgggaagccagctggtgacgctggcgatgaagcgcgtcgatttacgccagcataatgacgcgattctcgcgccgctgctggcggcgggcgttaacctgctgccgaatacctcaggcgccaagacggcggaagaagcggtatttgccgctcgcctggcgcgggaagccttaggcacccactggctgaaacttgagatccatccggacgctcgctggctgctgcctgaccccattgaaaccctgaaggcggcggaactgctggtgcgcgaagggtttgtcgtcctgccctattgcggcgccgacccggtcctgtgcaaacggctggaagaggctggctgcgcggcggtgatgccgctgggcgcgccgataggctccaaccaggggctggaaaccagagccatgctggagattattatcgaacaggcgacggtaccggtggtggttgatgccgggatcggcgtgccgagccacgcggcgcaggcgctggagatgggcgctgatgcggtgctggtcaataccgccattgccgtcgccgacgatcctgtcgccatggcccgcgccttccgcatggcggtcgatgccggattactggcgcgtcaggccggaccgggcgcacgcagtacacaggcacaagccaccagcccgctgaccggctttctggaggcgctggcatga

SEQ ID NO: 82526 - DNA, 363 bp, Glycine max
  Peptide Sequence Number=SeqID_174211
atgaaagcaaggactgaaatatctcctgctcattggtgtgagcgtaattggagtacctttgagcatattcactcaaagaagagaagtaggattgagcaccaaaagcttcaagacttggtttatgttaagtataaccaagctcttctagatcgctttgagtgtcatgatgtgattgatcctattgctttaaatgatattgatgatagtaataagtggttattgggagaattggaaggagaagaagctgatgttgctgaggcaactggggctggtgaacctttaaaaaacacaatgagtcaaacacagataaacaaggcagcagctgcacctgcacctacaaatgaaaaaggaaaaaaaaagtga

SEQ ID NO: 82527 - DNA, 177 bp, Glycine max
  Peptide Sequence Number=SeqID_174212
atggaaagagagagtgttaatgtcttgaagcatcaactctcaagaggagtgatggttggacgaaatgatcgtgcaatagcggatgcccttcaagccttagctcaggctatagggaatccgaataggggagaagctggtggagctgttgagtaccaagggttggaccgcttccaatga

SEQ ID NO: 82528 - DNA, 108 bp, Glycine max
  Peptide Sequence Number=SeqID_174213
atgacgagactcaagcctgatgcagctacggctagggaggagaatagggcactgtattggatagggaaatcagaaatcacatgcatgtatggcagcttaaagagctag

SEQ ID NO: 82529 - DNA, 345 bp, Glycine max
  Peptide Sequence Number=SeqID_174214
atggttactaggcccaatacattgtgttgggaaagtataagggagaacgaaagtggcgagaaagagaagcataacaaaagtgggcatgtaaattcaaatgagcctattaggccaattgtgatgttggataatgcttatgaaacatctcaagatgatgggagcagtgctggcactgaagaaggctacgaaaaagctcctataaccaagcacaatgcccccaatgataacattcgaaggtgcaacaacaacttctacattagaaaagaggaagaagaggccactaagctacttgtctttaggaaacatatggggatgacacaagccaaaggtgaaaaggaggtgtag

SEQ ID NO: 82530 - DNA, 774 bp, Glycine max
  Peptide Sequence Number=SeqID_174215
atgcagaacaatagcttgctgttgggaatacagtgtgatcacagattattttacaacttacaaacatctttgtgtttattgggaaggaattctggcaggtacaaatttgatgatgagagggtgacaaaagaagataataaaagagcattggaggagcaatatggtggtgaggaagagttaccacagacaaatcctggattcaacaacactccatttaagttcaccaagtactcaaatgcttatatgcttgtgtatatacgtgaaagtgacaaggacaaaatcatatgcaatgtggatgagaaagacattgcagcacatttaagggagaggttgaagaaagaacaagaagagaaagagcacaaaaagaaagaaaaggcagaagctcacctttatactattataaaggtggcaagagatgaagaacttaaagagcagattggaaaggatatatactttgatcttgtagaccatgacaaagtgagaagtttcagagtccaaaagcagacatcttttaaccttttcaagaaattagaactaggcatgtgtgctatagagctagaagaggttgcaaaagagtatggcatacctgttcaatttcagcgctattggctatgggcaaagcggcaaaaccatacctatcgtcctaatagaccattgacacatattgaagaagcacaatctgtaaattctcatccttgctttgagattttcaatttattttctgcatttctttttgactcttttcttgattcaatatggagatgttctgtatga

SEQ ID NO: 82531 - DNA, 744 bp, Glycine max
  Peptide Sequence Number=SeqID_174216
atggcaacgtcggcgtggtctaaatatgcctcgtcggaggcgaagatccgtctagaaaaccgacaaccggacgatgatggtggaaaccagacaggaagggacagcgagcggcagaagaccaatggacaaagaaacatgtgtggaccaaaggacaataacctccagatcctgtcaacagtcacttactcaactactgacagtaaaaaaaacgcaatcggggcagctatgtctcaaagtcaaacatcatcacagcagactacctatgttgagaggttatcgaaagacagaataggtggtagccaggagatggaggcaggtacgggtatggtggaaatgggaaacacagctggaataagggaagaggaaaggaacaacactgtcaaaagtggaagaaatgaacttgaagtgggcccatccgcatcagcaaatattgagttaaaagggaggggatcacatgttgcaccacatgcagaggagagggacaggtcagcaatgggctttgctaatgacactaatgtggagtctcacataaagcaaaataatgatattgggcctaaaacaaatgggcttgtctggaaggtatattccagacatacatggtgtagaaagcaaaaagacaactcaaatgttgttgcacccgaatatggaaaggaggatggaataaatagcgtgaaaataagccagcccattgatgagtcaggccaatttgagacttccccattatatcgaagggcagtggattga

SEQ ID NO: 82532 - DNA, 342 bp, Glycine max
  Peptide Sequence Number=SeqID_174217
atggtgttgaggttctgttgtggctacattgcggatgcattgcagcattttgttggacaattgagagaagtgtccaacaaggttcacaatgcagaactgaaattgtttttggaagtggagctggggatggattcacgtcccatcgcaccacctgacaagaccaaggatgatatattacttttcttcaagctatatgatcctgaaaaagaggagctgcgttatgttggaaggctctttgtgaagtgtactggcaagccattggaaatcttaacgaggttaaatgaaatggctggttatgaccctgaagaagatattgcactttatgagtgtttttgcaactaa

SEQ ID NO: 82533 - DNA, 1219 bp, Glycine max
  Peptide Sequence Number=SeqID_174218
tgagcgtttcgcgatttctagtgcacagcaagaggacgaggaggttctcgtgccgcacgcggatttgcctgcgaacaatcaccaacccatggaagttgtagctcaacctgaaaatgccaataccgtggagagtcaacccgttgaagatcctccatcatctagatttacatggagaattgacaatttttcaaggctgaatacaaagaagctctattcagaaatatttgttgttgtgtttatctctgtcaaacttggttttatgcttggcaggcgtgtgcttattttcccaaagggaaacaatgtggactatttgtccatgtatttggatgttgcagattcagccactttgccctatggttggagtagatatgcacagtttagcttggcagttgttcatcaaacgcataataagtattccgtgagaaaagggggactggggagtggatggggattgggatggggtattgacacacagcaccagtttaatgcacgcgaaagtgattggggtttcacatctttcatgcctcttggtgaattgtatgatcctagtagagggtatcttgtgaatgatactcttatagtcgaagctgaggttcttgttcgtaggattgttgattactggacttatgattccaagaaggagactggctatgttgggcttaagaaccaaggagctacctgttatatgaattctctacttcaaaccttgtaccatattccttatttcagaaaggctgtgtaccatatgccaacaactgagaatgatatgcccactggtagcatccctttggccttacaaagtttattctacaagcttcaatacagtgacactagtgttgcaacaaaggagctgacaaagtcttttggatgggatacatatgattctttcatgcagcatgatgttcaagaactaaatcgggttctctgtgaaaaacttgaagacaaaatgaaggaaactgttgttgagggaactatacaaaagttatttgaaggacaccatatgaattacattgaatgcatcaatgtagactacaaatcaactagaaaggagtcattttatgatcttcagcttgatgtcaaaggttgtcgtgatgtttatgcttcctttgataagtatgttgaagttgaaagtcttgagggggataacaaatatcatgctgaacagtatggtttgcagagctatagcagcaccagaggtactgctgcagacaatacatag

SEQ ID NO: 82534 - DNA, 807 bp, Glycine max
  Peptide Sequence Number=SeqID_174219
atggattctgacattgcaaccgatgactcaaggcaattttttagttatgagtataaaaacatgcatttgttccgctcacggcaacaactcaacgggagacatggatatcactggaaaaatatgatacctggaagaaagaataaaggtctagaaaagagactagatgccatagaagacactaacaagagcattctaaaggtcatctacaaccttgttcgacaagaggcatgcagctctccaaagaatacaagagaccatgtccccatttctagaagccaaattacgttgcctttggaaaaaagagttgacttagttagcgcaaaatgctatgggaggcaccaagaaccaaaaatgtcaagtggatctcttggacgtgcttctttggcatatttgaaaaacattgaaaccattgttatcccaaaagatgaagatgctcatgacctaaaaaaatgttccactttcttcaggggggagttcatgcgtgaccataaaaaaagagtcgttaaaccaccaacacctttcaacctatgggaaccatgtgacaataacacaacttctgatgaattttgtaaggatggacctttcatgaccaactacaataggggtgtcaacttcaaggggaaaatacctatggaaatagcattgccacctcagaagctgacttacaatgttagtacctcagttggaaggaccttaaagaagcccaagattgaaactcaacagcgtgaagaaacttgtagactattaccagaaagatttgatgttgtcctctgcatgcctaagtcatatatgcataccaatttatga

SEQ ID NO: 82535 - DNA, 615 bp, Glycine max
  Peptide Sequence Number=SeqID_174220
atggagaaaattttcaatgaaggacacgagagaaaacagaaacatagaggtcactactacaaatcacatcaactacatcggtttaaatggaaggtctatgtcgggctaagcaccgacgttgcttcaggtgtcgttgtattccgacaacgactacaacggtcatacgatacccaagatgaacaacatgctgatttcatgcctatgttcaatttatcatctcaatcaccctccatgcatgccatggttctcaattccataattgacaggttgcctatgctacagcaaggactaaacatgccatgttctggtggattcttcaatagcacagggccatgcttctcatcatcacaaagtggagttgacaacaaagggatttatttggaaaatggaggcgtatttgggagtctaaatattggtgcagaagaggatgtgggcacgacttcttaccttgacgaacagttgcaggtggcgacaccactcaaaggggcacgacttcggcaacgtggcggtggtgggacgaacacgacgttcggaggtcggacgggagctgttggtttcgtcaatgttagggaaatggaagaatgtgacggaaagggcacaatgtcaggctggtaa

SEQ ID NO: 82536 - DNA, 60 bp, Glycine max
  Peptide Sequence Number=SeqID_174221
atggataagtggaagaatataaccgacatgggatacgtgattgcatcaaggtatttctaa

SEQ ID NO: 82537 - DNA, 207 bp, Glycine max
  Peptide Sequence Number=SeqID_174222
atgccaaaaccacctgcagatgaacttgctgatgtagacatgcctcgacatgcactggcttgccatgaaatagtagaaaggttggaaggcttgatcaacctgagggtagtcactaaaggaactgaagcatacactgtaaccgaggagtgcctaaggatcgccaggggtgtgactgcgcaagggaatgtatatgttcgatcaagatga

SEQ ID NO: 82538 - DNA, 183 bp, Glycine max
  Peptide Sequence Number=SeqID_174223
atgtgctatcaaatcattatttctatctctgcatatgatgttttagaagatacatctgatacaatcctccctaggaagggacaagtcactagagccatgagcaagaggctccaagaggattgggctagagctgctaaagaaggccctagggttcacatgaaccttaagggctccataaagtag

SEQ ID NO: 82539 - DNA, 195 bp, Glycine max
  Peptide Sequence Number=SeqID_174224
atggagaaatttaataggcacgccaccacgttagggtctgttcatggagggaacgccgatggcaccagcgacgcgaacgggctcgcggggcagacggttgggcgaaggggaggcggagtaaggctgagcgggcggcggcgcgccgtagctgtagctgggaggctggtggagatagccggacatgatgaaatttga

SEQ ID NO: 82540 - DNA, 282 bp, Glycine max
  Peptide Sequence Number=SeqID_174225
atgccgtgtcatcactcatgcattgcatttgttttcgtcatcattgtcacgggaagccggaagggtgttgaagtattggtcatcaaaattttcattcttgcaaacatggggtcgaaccaagcgccctcctttaaaaagaggttctatcatgtcaaagtcaagagcctagatctagccagcttgcgagagctagggcaacggatggatcaagttcgatgtcaagccttccacaaagcgtatgggaaaatctggggatttggccctgatagaagtgtccgttga

SEQ ID NO: 82541 - DNA, 249 bp, Glycine max
  Peptide Sequence Number=SeqID_174226
atggctggtctaaaaaaagctagacccaccatcgtcatcatccgcaccgcatttgttttccccgtgagcgtcgtcgtcgtcttcttcgtcggcatttcattctgtgaccgcgccgccgtgggtgttgactatcccagccaagttgacggtggtgttgctgcctccgcgtgtcggcattggcgaggtaagcatcgttgcactgagttcatcggtgtcgttagtagcagtggaagttacggatcaacttaa

SEQ ID NO: 82542 - DNA, 387 bp, Glycine max
  Peptide Sequence Number=SeqID_174227
atggccaaaatacaagttccaaaagaaggaaaaacctattctaatatttacaaagaagagtggaccaaaccttggcccatgggctcagaaatctaccctgaggttcatgagaatcccagggccttctttagcagctctagcccaatcctcttggagtcttctatccaatacccttggggggttaggtgcggtgaaggtgaaggtgcattgcggtggtcggcggcagcaaatgagatggacgaagatgagtggatgtatgaaataatgtctgaacaagtggatatggattatgaaaatgaagaagcatgtggtgtgaatgaaccacatgttgattgttcgaatgcgttcaatacttctcaggtgtttgagtgtcgagaggatgtttag

SEQ ID NO: 82543 - DNA, 354 bp, Glycine max
  Peptide Sequence Number=SeqID_174228
atgatcatgaaggcagatggagaaatcaccaatgaatttgaaatcaatgaagaagaaaaagtggaagaagagcttgaggaggaagctatgcagggtgatatgcaaatgccccatcctaggccaaacaaacttcagtggcttagtgaagatgaagaggtaaaaatgactcagcaggttgagatgtgtctcaccattggaagatacaatgatagggtgttgtgtgatgtggttccaatgggggaatttaaagatgtctttcccaaggagattctgatgcaatcctacccccgaagggcattggatagaagactgcaagaagattgccagagatacaaggccctagggttctcatga

SEQ ID NO: 82544 - DNA, 237 bp, Glycine max
  Peptide Sequence Number=SeqID_174229
atgtcagtgaaaaatctcatcaagcgcctaggagtacatgacaagacaaaccacacactgggagaccagtcagggtcacactattttgtgataatgctccaaccatgtaggattagcataggcttaaaggagcactcaaacccagtgcatttacccccaaggcctagaccccgaagagactatcaaggtctctccctcctgattcaagtccaacccaaaaaatattttaacacgtga

SEQ ID NO: 82545 - DNA, 291 bp, Glycine max
  Peptide Sequence Number=SeqID_174230
atgtcaggattcacacgcaattctcctcaaatttcagccagcccgtatcaattagacttcacactttatgcttcagggtcatacaatgctcaatggaacgccccggggcttttccatgacaagcacacgttgcgtttgagtcgtattctcggagaaatggaggtggtcttcgtcattggaagtgcagtagacagactttgtggtagatttagggatggcctttgtggatacctgggtggtggacccacatcgatcctttcactggcgaagaccaaatctgcaaagctttga

SEQ ID NO: 82546 - DNA, 750 bp, Glycine max
  Peptide Sequence Number=SeqID_174231
atgccctcacttttagaggactacacgtcctccccttcaaaggactacacgtgggctacatgcccttgccttcagaggacaacacatcgtcgccttagagggctacacgcccacaccttcaaaggacaacacatcctcgccttcagaggactacacatcctagccttcagagggctgcacgccctcaccttcagagggctacatgccctcgccttcagagagctgcacgccctcaccttcagagggctacacgccctcgcctttagcgggctacatgccctcgccttcagaggactacatgtcctcgcattcagaggactgcgcaccctcgctttcagaggactacatgtcctcgccctcagagggctacacgtccttgccatcagagggatccacgccctcgcctttagaggactacacgtcctcaccttcagaggaatacacaccctcgccttcggaggactacacgtcctcgccttcagaagactacacgtcttcaccatcagaggactacacgtcgtcgccttcaaagggctacatgccctcgcttttagaggactacacgtcctcgccttcagagggctacatgccctcacttttagaggactacacgtcctccccttcaaaggactacacgtgggctacatgcccttgccttcagaggacaacacatcgtcgcctttagagggctacacgcccacaccttcaaaggacaacacatcctcgccttcagaggactacacatcctag

SEQ ID NO: 82547 - DNA, 62 bp, Glycine max
  Peptide Sequence Number=SeqID_174232
gtcgactctagaggatcccccaaccaagaagctacccgcttcttacatagaattctcagatg

SEQ ID NO: 82548 - DNA, 165 bp, Glycine max
  Peptide Sequence Number=SeqID_174233
atggggcaaaacacaccaaaagattatgatgatggatggctcaaattctcacaaaggtgcctgaatggtaggggtggtagtcagtgctcttttgaggcaatgaaaggcctctttgcatttatcattaaagtcaaactccacctccttttgcaacaagttggatag

SEQ ID NO: 82549 - DNA, 129 bp, Glycine max
  Peptide Sequence Number=SeqID_174234
atgatgacaaggagtaaaaggtttgtggaagttaaggatcatgatagtattgtgcataagaagaaaaatacaggcaagaaaagtactgatgacatgaaaaatgaggtgaaaggtgaaagagaattataa

SEQ ID NO: 82550 - DNA, 789 bp, Glycine max
  Peptide Sequence Number=SeqID_174235
atggctacctcaccaaaagaaacttcagctcctggttcaccctctgtaccatcatctccatcatccaccaaagcaccatcaaaccaggaacaacctgaattcaatatccaacccatacaaatgattcctagttcagcccctggtcctgagaaactggtccccaaacgacaacagggagtgaagacttctgaaaaccctagccttgcaacaagtcctagggaagtagacacggagatggataagaagatccgcagtattgtgagtaacattctgaaaaatgcttctgtgcctgatgctgatgaagatgttccaacatcttccaccccgaatgtctctgtccctgatgctgataaagatgttccaacatcttccaccccaaatgtttctgtccctgatgctgataaagatgttccaacatctttcaccccaaatgctgaagacccctcttcatccagcaaagaggaatcaacagaggaagaggatcaagccacagaggagacccctgcaccaagggcaccagaacctgctccaggtgacctcattgacctagaagaagtagaatctgatgaggaacccattgccaacaagttggcacctggcattgcagaaagactacaaagcagaaagggaaaaacccccattactaggtctggacgaatcaaaactatggcacagaagaagagcacaccaatcactcctaccacatccagatggagcaaagttgcaatcccttccaagaagaggaaagaaatttcctcatccgattctgatgatgatgtcgaactagat

SEQ ID NO: 82551 - DNA, 276 bp, Glycine max
  Peptide Sequence Number=SeqID_174236
atgggggagacacctgaagtaccccgagaccacactctagtcgacttcgagcctcacctgggatataccattgaggggctgcctcccgccatggtggaaaaggataaattcgatcatatagaagaaaggctgagggcaattgaaggaagtggagactacccttttattgacatggcaatttgtgaagttccgagacatgccgaaagccaaaagaaaagcgttgtagcacaatccgtgaagttccgtgacatgccaaaaattaaaaggaagtgttag

SEQ ID NO: 82552 - DNA, 507 bp, Glycine max
  Peptide Sequence Number=SeqID_174237
ggggaaacgcctggtatctttatagtcctgtcgggtttcgccaccactgatttgagcgtcagatttcgtgatgcttgtcagggaggcggagcctatggaaaaacggctttgccgcggccctctcagcgttctgttgagaactggtatttccatggcatatccttattggaaagacagtttggatcgaattcctgcagcccgggggatccactagttctagagcggccgccaccgcggtggagctccaattcgccctatagtgagtcgtattacaattcactggccgtcgttttacaacgtctgactgggaaaaccctggcgttacccaacttaatcgccttgcagcacatccccctttcgccagctggcgtaatagcgaagaggcccgcaccgatcgcccttcccaacagttgcgcaggtttccctgaatggcgaatgggacgcgccctcgtgaccgctacacttgccagcgctgatgtccggcggtgcttttgccgttacggataa

SEQ ID NO: 82553 - DNA, 384 bp, Glycine max
  Peptide Sequence Number=SeqID_174238
atggtctgcaatgaccatgctcacatgaccgacagattgcttgcagggtcattcacctttgagtgtcgcatcatgcattatgtcctttgtcaagttttgcttcccaggtaccgaatgcataaggcattacgagccaatgcacctctttcgtatccccatcttgttaccttgtttcttcaccatttcaatgttcctttagaggatgaaccttttgttaaggttaaaagatcttttgctattggtgctggtgctgttacttctttcggatatcagaaagatatggatggccaatgggtgcgtaagcaagacctgccacctcccattcctgatgaacgtgttggacaagtggcctcagatatcttaagaagggggggggggggttga

SEQ ID NO: 82554 - DNA, 354 bp, Glycine max
  Peptide Sequence Number=SeqID_174239
atgatggataccttagagccttacactggggcaatgaaaggcaccatgcttgagcctcaggcgaacctaggggaagtgagtaaatcaaataggacatacactctgagggagttcccaaagagatttgcaaaagataggatgaggttgcatgaattatcacctctttcaaaaatcaaatcaaatcaaaatcacaaaatagggaaagaatgtcatgaacattgtacaactttccatggcattgcattgttgcatacgttcggggaccattgtttgtcggcatgcgactttcgtttgaccacttcaaaatgtttaacacccatcgctatggaatccgtaaagttcagggatgtttag

SEQ ID NO: 82555 - DNA, 288 bp, Glycine max
  Peptide Sequence Number=SeqID_174240
gtggattatttcattgaaagtgatccaacccttgatactcagcatgatgtaagcttcattggagcttgtaggcctaggatcttcttcatcaatggattattttgcttcttggaatatgaatggcagcgaaatggagaaaagaagagagagaggagacgccatttcaaggataagatgattctagaagaagttcaccaccataggaggccatggataagagcttggaggaagaaggagatgaatgaagggaaagggagagaagagcacgaaattttgtgctctaaatga

SEQ ID NO: 82556 - DNA, 1539 bp, Glycine max
  Peptide Sequence Number=SeqID_174241
atgacgcaggaggatatttccgactacgtgggcgccaacatgaaggatgccatcagccgtacttccggtgtgggtgacgttcagctgttcggttctcagtacgcgatgcgtatctggatggatccgaacaaactgaacaacttccagctgacgccggttgacgtgattaacgcgattaaagcgcagaacgcccaggtggcagccggtcagttaggcggtacaccacctgtgaaaggccagcagcttaacgcgtccattatcgcgcaaacccgtctgacctccgccgatgagttcagcaaaatcctgctgaaagtgaatcaggacggttcgcaggttcgcctgcgcgacgtagcgaaagtggagctgggtggcgaaaactacgacatcattgcgaagtttaacggtaaaccggcttccggtctgggtattaaactggcgaccggcgctaacgccctggacaccgccacggcgatccgtgcagaactgaagaaaatggaaccgttcttcccgtcaggtctgaagatcgtttatccgtacgacaccacgccgttcgttaaaatctcgatccacgaagtggtgaaaacgctggcagaagcgatcattctggtcttcctggtaatgtatctgttcctgcaaaacttccgtgcaacgcttatccccactatcgccgttccggtcgttctgctggggacatttgccatcctcgcggcctttggcttctcgataaacaccctgacgatgttcgggatggtgctcgccatcggcttgctggtggatgacgccatcgtggtggtagagaacgtcgagcgcgtcatggcggaggaaggtctgccgccgaaggaagcgacccgtaaatcaatgggtcagatccagggcgcgctggtcggtattgcgatggttctgtctgcggtatttatcccgatggccttcttcgggggctctaccggtgcgatttaccgtcagttctcgattaccatcgtctcggcgatggcgctgtcggtgctggtagcgctgatcctgacgccagcgctgtgcgccaccatgctgaagccgattcagaaaggcggccatggcgagcacaaaggcttctttggctggtttaaccgcatgttcgataagagcacgcaccactacaccgacagcgtaggcaacattctgcgtagtaccggtcgttacctggtgctgtatctgattattgtcgtcggtatggcttacctgttcgttcgtctgccaagctccttcctgccggacgaagaccagggcgtgttcctgagtatggcgcagcttccggcgggtgcgagtcaggaacgtacgcagaaagtcctcgacgagatgactgactactacctgaccaaagagaagaacaacgttgaatcggtgttcgcggttaacggttttggttttgctggtcgcggtcagaacaccggtatcgccttcgtgtcgttaaaagactggagcgaacgcccgggttcagaaaacaaagttgaagcgattaccggccgcgcgatggcccgtttctcgcagattaaagatgcgatg

SEQ ID NO: 82557 - DNA, 456 bp, Glycine max
  Peptide Sequence Number=SeqID_174242
atggcgatgttactagcttatcaacacttgttcaagtggaaacaagcgcgatacaatccttcttccatggctgcgacccaaaatcatcatgtcccttggaaacctcctttgcctagtttcccaaacccagtggtgagttttgtacggcttcaagctaatcttgtatcgaattcctgcagcccgggggatccactagttctagagcggccgccaccgcggtggagctccattccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtg

SEQ ID NO: 82558 - DNA, 330 bp, Glycine max
  Peptide Sequence Number=SeqID_174243
atggcttacgaacggggcggagatttcctggaagatgccaggaagatacttaacagggaagactataaaagataccaggcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgcccttatccggtaactatcgtcttgagtccacccgggaaagacatgcaaaagcaccactggcagcagccactg

SEQ ID NO: 82559 - DNA, 354 bp, Glycine max
  Peptide Sequence Number=SeqID_174244
atggcagaggtctccacagaggccattgcctccctcgcccaatattatgaccagtcgttgaggtgctttacctttggggttttccagttatcactcatggtggaagagtttgaagagatcctaggatgccctctagggggaaggaaaccatacctcttctcaggattctatccctctttagctagaatttctaagatagtccaaatctcgatgcaggaattagaccacagaaagcaagtccaaaatggggtggatggagtaccgaggaaatatttggaagcaaaagcaagaatcttagcaggtaaaggcgaatgggcctcgttcatagacatcctcgcgccttttgatctttag

SEQ ID NO: 82560 - DNA, 439 bp, Glycine max
  Peptide Sequence Number=SeqID_174245
tggtatcaaagcattgatttaccaacaacggtatcagagttatgaccgggagcatacaaagcaaggtcttgatcaggcattagaagatgaaagattggcttctataaatgaaactaagtggactaagatccaaaggaggactgtgagcacgattcagttagtccttgctcccgagataaaacacaatgtgttgaaggagacatcaccgaaggccttgtgggagaagctcaagaatatctatgcatcaaaattgctaaccaatcatctttgtttgaagatggagttgtccttcaaagctttggttcaaatgttgtttatgggaagatcaactttgaatttggatgaggtaactgtcgctcttagagaaaataagagaatgataagtactgaaaatgttgatgatgaacacaatgcaatagatgtggtggagtctgagtga

SEQ ID NO: 82561 - DNA, 570 bp, Glycine max
  Peptide Sequence Number=SeqID_174246
atggtcttctacaacacagaaaaccctaaattctccacctcgctctctctctcttcatacctccatcgctgtggagatccccataaagccggtgaagatatagaggcacaggtgttcgttgctcacgagattgagttggattcttcaccgtcggaagctatcctctttctcgtccgaacatggcatctacatccgccttatcaagtggaacaactagtgttctacaatagatggaatcatcacaatactatgctgagaacaatcttgccatggcaagacgatgggaggggatataacattgtaatgacaaccatcctatcatctgatgttcttgttggatatttttcatgggctgagtatgatatcatggcaccagtgcaacgaaaaactgaagttgctcttgcagctgcattcatttccaattgtggtgctcgaaatatgcggttgcaggatcttgaagcccttgaaaaatctaatatcaagattgactcttatggtggttgtcataggaaccgtgatggaagagtatctccctttgtgcttgatcttgttaagtgtgtctctgtttaa

SEQ ID NO: 82562 - DNA, 801 bp, Glycine max
  Peptide Sequence Number=SeqID_174247
atggttggatgtggcggttttataagggatttaagaggcagcaggagttgtggatttgctaaaagaattggttatgcaaattcctttttggctaagctatggggtttcgatgttgattctgaagttgttgtgaagtgcataattggaggtagggaaggttgtgctacagatgccttagctaatatagcatgtcatcttaaggatagttatgtgatgtacgaacaacctccgcctattattaggtcattgctcctagttgatgtcaatgggggtttcaacttcccgtctcattctgataatcaccaagaactcgctcaattaaaccatccgacgatcccacaaagaaaactaagccacacccacgttttagaatctcgcaaaccgcaagatcacaaggttatgatcatagggctcaacttcttgcttactctagacaactcagagaaaatgctcggtcccataaaaatgttcaagttcaatttccccaaaatcagtcaaaccctaaaggccaggcaaaagcggttattgttggctgaaccggttccagtatactcgcctttaacccaaatactatctagctctagtacccagtttggatgtgatgaatgtgttgaacataagggaagagaggtaacgaacaggtccaagaagagaatgggaaatggaaataagtgttgcaagaggaaactgaagagcatgttcaaaagattgccatcttttggttttgatgtttatggtctctttctcctagtgccagttcttttagttgaattcttaaagcctgatattgttgtgcactaa

SEQ ID NO: 82563 - DNA, 327 bp, Glycine max
  Peptide Sequence Number=SeqID_174248
atggcaaaagatgaactttttgacatgttagatgttaagtcccacttgagtcaatcgcatgagacatggaagcaggagattgcaagaagccaatcccaagtggatgttcttgtccaaatacaacatgttccttctgcagtcataacaaagtttgtcatgttgtgtacaaaaaatcaggttcttgtccaaatgcaacatgttccttcttcagttaatgctttaaaattttatgcaaatgttcagccaaacataaggtgcaaatggcttgtttatttctatcttttaagggtgtacatgattgcatcgactgtcgttttcataatttga

SEQ ID NO: 82564 - DNA, 660 bp, Glycine max
  Peptide Sequence Number=SeqID_174249
atggacaatccagatgcaggaaatcttagtgcaacaaggatgtgcaaaagcattgaagggaaaggaaaatatgtcttcatgctttctcaaaaggagaagggtgatatgattgacaaggacaagagtgttataatcttgtgtcttggtaataagtcactaacaaaggttgcaagagagaagaccacgactgaaatatgggatgctattctatatggaaaggatcaaactatttccttggatgatgttcacaaatcagttcaaataaaagagcttcaaaagctacaagatttgaaaatcgaggataatggtgaaggcttgaatgaagattgtcatgagaaaaaggccaaggaatctaggaatttggttgattcattagatgttgtggttgctttggatggttgtgagagtgtgagggactactttgaaaccttggagctcaaagaaggtggaatggtacttctaggcaataacaaatcatgtgcggagcaagcttactctactaaaatagaacatggtatgattaatgtttctaacggttcttcaatagtttctaagggaactaagaggaatggtttatacattcttgatggttctgccaatatttcttatgcatctattactagccaaacaccgcatgatagaccaagttatgacatttga

SEQ ID NO: 82565 - DNA, 606 bp, Glycine max
  Peptide Sequence Number=SeqID_174250
atggtagaaccatctaagaagagaaaaggatcaacccccacaaccaccgctacaagacaacaccgccatgacacttctggtgacccaccagcaccaactcgtccttctctttcctcaccccgttccttgactctattttcttccgacgaacagcgtcaaaatcaaggtgtaccttttgagggcactttgattgatgattggaagcatatttattcaactcatgatgcacataaaatggtttgcaatgaacatgctgatatgatcgccagattgcttgctggttcattcacttttgagtgtcgtgtcatgcattatttgtgtcgtattgttgtggcctctgaggaagatttaattttgctgtgggctcttcaaacgagccgtcaaattgattgggctcatcttgtccggtaccgtatgcataaggcattacaggtcaatgcacctcttccatatcctcaccttgtcactctctttctccatcattttaatgttcctttagatgatgaaccatttgttaaagtcaaacgttcatttgctattggtgctggtgttgttgcctcctttggatatcgaaaggatgtggatggtcaatgggtgcggaaataa

SEQ ID NO: 82566 - DNA, 171 bp, Glycine max
  Peptide Sequence Number=SeqID_174251
atgggagattcggctaaagttgtgataaaacaagacatgaagggaagaaggcataaatatgggtttaacaacaatgaacgtgagaaggcacagaagaaaagggtgcaccaagagcggctacgcaagaagtttgcacttgaggagggaaggatatttgcagctaatgaacaa

SEQ ID NO: 82567 - DNA, 384 bp, Glycine max
  Peptide Sequence Number=SeqID_174252
atgtctgctgttgtttacaaggactgggttttcactgatgaagcattgcccaatgatcttgtcaagagaataaattttaaaaatttctacaacatcctgagggtccaaaataggaaatatctgttggtgcttaagattgtaagtggacttaaggttgtggattttaggcaacttgaggtgctattggtaaacaaggttgatgaatttgaggtgagaaggccacttgaggcattagcagatatgggactaaatggagagtacaatttgaaggagttaatgagattgatagtaaccattcttgatggcaatgacaaattaatcatgggtgagaacatggacagtagtgaagattggagacaaacaaatgcttgcttcagttattga

SEQ ID NO: 82568 - DNA, 488 bp, Glycine max
  Peptide Sequence Number=SeqID_174253
atgactaggggcaatccaggtgatttacaaccctttgatcctgaaatagatagaacctttcatagattagttaggcattgtgtgcatcttggtcattctgtgcattgtgagcattctgttgagggtgatcccgaatattctgattttgagcattccactactaatttttatactgagaacatggctcaacctccacctcgtgagaggactcttagggaaatggctgcacctgatctcacttatgaaagcttgtgcattcaatatcctgatgagggtgttctatatgttctcaagactggactaatacatttacagcccaagtttcatggtcttgcaggtgaagatcctcataagcatcttaaggagttccatattgtttgttccaccataaagccccaggatgtccaagaagatcatatctttctaaaggcttttcctcattctctagagggagtggcaaaagattggctatactaccttgcccccag

SEQ ID NO: 82569 - DNA, 858 bp, Glycine max
  Peptide Sequence Number=SeqID_174254
atggtattcgtagtgctcatgatttgttcggaagcccgttttggaaatgtcttcttcaaccatcagaatttgatggaaaccttgacgaaggtccaacttggtgaaccaggaagccttgccaaggtggaggaaggtctgtggggtgagaaagatgggggcaaatttggtaatgagctgttggatttcgggtatggggtggggtggttcctagcacgggtttggagtggtggtgggttggagggccagatggaaaaaggaggaggtggatccattgtggatcatctttctgatttgttttgtcgaagcattgagaggcccaaacacaacgctcagaaatttggcaatttgaggttgtacgaagctatgggtactcccattatcaatgaggacagtgagtcaagtttgatgaataaaaccatggacacaaaaggttgcaggtgtggacagaccagagagggcattaaggctaatatgtggaaggttttgaagtggttgagtgtcaaaggtgggatctgccctttttcacagcgaagggccatatcttctggagtgcaaaggacaaagccggtgaggcaactggctcatgatagcattagccacaaagtcgtcgatgctgcttccgaggaacacgatcctctccctcagcaacagccccatcacgttgccctccgtgcctctcgccgtcatcgaaggtgtttggggcgtagagagcttgaaggtgaggcccaagttccaaaattgggacctaaagtttgggtttttggaggggattggcaaggccgtgaagacgcacctctgaggggtttttggagggtttggggtgaagaaggaggaggaaacaaggaacttagggtttga

SEQ ID NO: 82570 - DNA, 1749 bp, Glycine max
  Peptide Sequence Number=SeqID_174255
atgctcccttctcacgtcgatgcagatcttgccaatgaagaaggttggtggtacaagcaggagtataagatcaacgagttgagtataaactcagtgataactacgccttctcacgaggagatcttgtccatcaactcatatactacgcagaggccttatgaactcagaggctacgcatattccggtgctggaagaaaagtgactcgtgttgaggtaacatttgatggtggagaaacgtggcacgtgtgcacattggaccatactgagaaaccaaacaaatatggcaagtattggtgctggtgcttctggtctttggaagtggaggtgatagacctgcttgggaccaatgagattgctgttcgagcttgggatgaaggcctcaacacccagcctgaacacctcaattggaatcttatgggcatgatgaacaactgctggtatagagtgaaaacaaatgtgggcaagcctgccaagggtgagattggcatattgtttgaacatccagctcaaccaggaaaccaaccaggtgggtggatgggaaaggaaagacatttggaaaaatcactagagaaattaccaagcatcaaaaggagtggttccactccatccatgaacataacctcaaaaaggttctctatttctgaagtcaaaaagcactgcacctctgactctacttggatcatcgtccatggccatgtctacgactgcacccgcttcctcaaagaccaccccggtggcgttgatagcatcctcataaatgccggcaccgactgcaccgaagagtttgacgccatccattctgacaaagcaaggagattgctcgaagattttcgaattggcgagctcatgaccacagactacacctcagactcagagcctgacaactctatgcatggcgattctgaatccacccatttggcccctatcaaggagatcaccacaccaagaccacaacgcaaggttgcacttaactcacgtgagaaaatctcatgcaagcttgtgtcgaagacctacatttcccataacacgaggctctttcgttttgcgttgccctcggaggaccagctcttgggtttacccgtgggaaagcacattttcttgtacgccaccattggtgacaagctatgcatacgagcctacactccaacaagtagtgtggacgaagtggggttctttgaccttcttatcaaggtgtacttcaaaggcgtgcaccccaagtacccaaatggaggactcatgtcccaacatttggattctctctccattgggtctatgttggacgtgaagggcccgttgggccacatagagtacaccggaagaggcaacttcatggttcatggtaaacaaaaatttgcaaagagactagctatgttggctggtgggaccgggatcacacccatttaccaagtggcacaagcaattttgaaggacccagaagaccacactgaaatgcatctagtgtatgctaaccacgccgaggatgatatattgttgagggaggagttggatgcgtgggcaaagacacattgtgatcggttcaaagtgtggtacgtggtgggaattgcaaaggaagggtggcaatacagtgtgggacgcatcacagagagtattatgagggagcaccttccaaaatcatcgagcgatgccttggctttaacgtgtgggccaccacccatgattgagtttgcggtgcaacctaacttggagaagatggggtacgatatcaagaacgacctgcttgtgttttag

SEQ ID NO: 82571 - DNA, 666 bp, Glycine max
  Peptide Sequence Number=SeqID_174256
atggaggaaaatcctaatcctaaagctcaaaggttctttgatatgcttgcaactgcacaagcaccgttgtgggaaggatgcaaggatcattcaaaattgtcagcttctttgggtcgagttgagacctcaccccctcctccatgtttgtctagccttaacgtttggaatagagttgctcatttaccgctctaccttgagttgcaagaagaaaaagattttcctggttatggtgttgaacatgttggtcgtggcaagttctttaaaccaaaggaagcttatgcaatgaccaaatcacaaagactcgttgttcttaaatgggtcaaagaactaaatttaccagctggctatacctccaatttaggaccaaattataaggggaacgtgtacagactaggtactttgagcaaaaggtttagttgctcaaaatcaggtccatctaattctattgctcctatggaagaccaaatagaggaaatgtgtgagacaattaataaattgaatgttgagcttttgtcaaaggcaaataaggagaagacacttgaggaaaagatgttgcagttgatggagaatcatgaccaccaaactcctactccatcgactaccatagctgatggaacagagcactatgttgatgatgctcaggttgatcattctcatgacatgtga

SEQ ID NO: 82572 - DNA, 441 bp, Glycine max
  Peptide Sequence Number=SeqID_174257
atgcagtttagtaactacattgcacctgtagggaaactctgtgcagtgtctggccactgtttgccagattacatggattggttctacatgattttgcacccattcatgagtctggcacagccaggggatcctcctagagttccatcggttcagcaatataacacatttgttgaaccagatgtgtatcaacaatcgatggcggtagcggcacctgatgaggcagttgatgtgcatcatcttcgacatgcagtgataatatatttttttgcaattgctgataagttagagaggctactaaacttgaggatcctgaccgaaggaacagaagcctatactattgctgaagaatgtatgggcatcacaagaagctacattagccaaccaaatatacggacagtcattgaagttgttttatttttgccttttatatgtcatttataa

SEQ ID NO: 82573 - DNA, 2226 bp, Glycine max
  Peptide Sequence Number=SeqID_174258
atgcgcgaaggcgacgtcgcgccggcgctggcgtctccgtcgccgccggtggtggttgccggccggagccggtcgcagggcttcacgacccggcgagtgacgcctgcaacggcggtggacggatcctccgccgtggagcgtgttctccccaacggcgacttctacgccgggagattctccggcaacgtcccgcacggatccggaaaatacctctggaccgacggatgcatgtacgagggcgagtggaagcgcggaaaagcctcgggaaaaggaaaattctcgtggccttcaggcgcgacctacgagggcgagttcaaatcgggacgcatggaagggttcggaaccttcgtcggatccgacggcgacacctaccgcgggtcgtggagctccgaccgaaaacacgggttcgggcaaaagcgttacgcgaacggtgacttatacgaaggctggtggaagcgcaacgtgcaagacggtcacggccgttacgtctggaagaacgggaacgagtacgtcggggagtggaagaacggcgtgattaacggcaagggagccctactctgggccaacggaaaccgttacgaggggttgtgggagaacggggtccccaaggggcacggcgttatgaagattcatcaccgtttgctctggggtgagaattttaacgtgaagcggttttcggttgacggaagagggagcgttaataacgataagagtttccccaggatttgtatttgggagtcggagggtgaagctggtgacatcacgtgcgatattatcgataatgtggaagcgtcgatgttttaccgcgacggaacgacgtcggattgtgaagagaaagagacgaggaggaacccttgtttctctagcgaggtgaagagacccggggaaaccgtttcaaaagggcataagaattatgagttgatgcttaatttgcaattggggataaggtacactgttgggaaggaggcttcgacgttgcgagagctcaagcagagtgattttgatccgaaggagaagttctggactaggtttccggctgaggggtcgaagcttacgccgccacatcagtccgcggagtttcgatggaaggattactgtcctgtggtgttcaggcatttgaggaagctatttcaggtggatcctgctgattacatgttggctatatgtgggaatgatgctcttcgggagctttcgtctcccggaaaaagtggaagcatcttctacttgacccaggatgatagattcatgataaagacagtgaagaaatctgaagtcaaggtgcttattcggatgcttcggagttattaccagcatgtgtctcgatatgagaattcactcgtgaccaaattctatggggtgcactgtgtcaagccaattggaggccagaagatccggttcattgtgatgggcaatcttttctgctccgaatatccaattcatagacgattcgatttgaaaggatcttcacatggccgcaccacagataaacctgatgaggacattgatgaaacaaccaccctcaaggaccttgatctcaactttgtttttcgtgtacaaagaaattggttccaggaactcatcaaacaaattgagcgggactgtgagttcttggaagccgagaaaattatggattacagtcttttggttggcattcattttcgtgatgataatacatgtgacaaaatgggattgtcaccttttcttttacgcactggcaatcgggattcttatcagaatgaaaagttgatgcgtggttatcgctttcttgaagcagagctacaggatagagatcgtgttaaatctggaaggaaatcattaatcaggctaggagccaatatgcctgcaagagcggagcgagtggcccggaggagtgatttcgatcaatacactactgctggaatcagccatttgaccccttattgcagtggggagacttacgatgtcattctatactttgggattattgacattttgcaagattatgatatcagcaaaaagcttgagcatgcttacaagtccttgcaagttgactctacttcaatttctgctgttgatccaaagctctactcgaagaggtttcgtgattttgttgggagaatattcattgaagagaggaaaaaatgcttcaaatttgaaacccttggcaaaggtcttggagttaaaatgccacgccacggtcaagtggctgacagaagctccctggatttcgggttttttatggcttaa

SEQ ID NO: 82574 - DNA, 216 bp, Glycine max
  Peptide Sequence Number=SeqID_174259
atgtcaagacacgacacgatcattatagtcatacaacacaacacaaatacaaagcgcaaggaggctcttcgctatgcgaaggtatgggggagggatgttgtacgcagccttacccttgcatatgaggttgtttccggattcgaacccatgaccaacaagtcaccaaggcacaactttactgctgcaccagggctcgccctctttaaactttcataa

SEQ ID NO: 82575 - DNA, 324 bp, Glycine max
  Peptide Sequence Number=SeqID_174260
atggctgctctgtttcttgattttgtagtcgttgaggcagtgcccgccctcgtcacagtttcggcattgcggaggagccgtcatggcggcatagaggcgctcgacgacttcaatgacacgattgatctggaagaattcaacaacgaaacaaatcagatgatgcttgccatggcaaaaggattggccgttaaaacaagcttaaaagaacaacgtgcctgtcaaggtgcaaaagaagtgaagagggtagtgggcgtggcaaatgcgaaaggagagcgtgagaagggttcagacgcgctttgtgctttttttagttttgatttatga

SEQ ID NO: 82576 - DNA, 480 bp, Glycine max
  Peptide Sequence Number=SeqID_174261
atggggcagagatttgtgagagataagcagaagtgccctgctccagaatcctgcccttacataccaataggtgttgatttatttgcttgtcctaagaagataagtcacatagctaagcatcttgaacttccacttgtcaaagaaaatgagagtttaccttccctcttcattgttaatatacaggacatcagttcattggatataaagagagggaatgttggcttccttaatcaatgcttagttctttccaaaagatcgttcattaacatgtatcatgatctaggctattattggttacgcgttgtcatatatattgcattggccataactttagccactattttctatgatttgagcgcaagttatgactcaattaaggatcgagattcacttgttgcattcataaatggattcattactttcatgatcattagtggattcccttcctttgtggaagtcatgaaggcacttaattcataa

SEQ ID NO: 82577 - DNA, 222 bp, Glycine max
  Peptide Sequence Number=SeqID_174262
atggcagcggaatggagaaggaagagagagaggagacgccacttcaaggagaagatgagtctagaagaagctcaccaccataggaggccatggataagagcttggaggaagaaggagatgaatgaagggagagggagagaagagcacgaaattttgtgctctaaaagagctctgaaatctgaacccactaaattcaagatcaagttcaagattctctactaa

SEQ ID NO: 82578 - DNA, 1935 bp, Glycine max
  Peptide Sequence Number=SeqID_174263
gaacatggccagacagagaggtcccagtgggtgcttgattctcccaaccctcctcctctctggaagaagctatttagttctgtcaaggaaaccattctgcctcatggcaacaagttctgcttctcatccaagaggaaaaccatcaatggacatgcactctcatgcctgcagaatttgttcccaatcattagttggttgagagattacaaagtctccaagttcaaagatgatctcttggctggcttaactcttgccagtctctgcatacctcagagcataggatatgctactttagcaaaagttgctcctgaatatggcctgtgtaagtatgtggcttcagtctacactgctactgattggtttgataccagtgttgttcctcctcttatttatgctatgatgggaagctcaagagaaattgcaattggacctgtagctgtagtgtcaatgctgttagcctctctggtcccaaaagtggaagatccagttaccaatcctaatgcctacagaaatcttgtctttactgtgactttcttcaccggaatttttcaaactgcatttggtgttttcaggttgggttttcttgtggattttctttcacatgctgccttagttggatttatggcaggcgctgccatcattattggtcttcagcagctcaaagggttgctggggcttagtcactttacctccaaaacagatgtagtatcagtgttggcatctgtttataagtcactacataatcaaattgcccctggacaaaaaggcagaagaaatagaaagcttttctggttgcctgctatttctcctcttctctcagttatactatcaaccttgattgtgtatttgtccagagctgataagcatggggttaatataataaagcatgtcaaaggaggtctgaatccaagttctcttcaccagttgcaattacatggtccacatgtcggacaagcagcaaaaattgggttgatttgttctgttattgccctcacagaagcaatagcggttggtcgatcttttgcttccatcaagggataccatcttgatggcaacaaagaaatgttgtcaatgggaatcatgaacattgcaggatctttgacttcatgctatgtggcaactggttctttctcaaggactgcagtgaatttcagtgctggatgtcaaacagctgtgtcaaacattgtgatggctgttacagtgtttttgtccctggaattgtttacaaggctcttatactacacccctgtggctatccttgcctctatcgtcctctctgctcttcctggattaattgacctaagtgaggcttgctatatctggaaggttgataaattggactttcttgcttgtattggtgcttttcttggggtcttgtttgcaacagtagagattggccttcttgttgcagtgataatctcgtttgcaaagatactgatacaatcaattcgacctggaatagaagttctaggtagagttccaagaacagaagccttctgtgatgtgactcaatatcccatggccataagcactccaggcatcatagtgattcgcataagctctggctcactctgctttgcaaatgctaattttgtcagagaaaggcaagcaagcaatttacaaatgattttcagagggtgggtctcacaagatgaagatgaccttaaagaaaccaccaagggtagggtccaagcagtgattctggacatgacaaacttgatgaatgttgatacttccggaattctagcacttgaggaactgcacaagagattgctttcccgtggggtagaattagctatggtcaacccaaggtggctagtaattcacaagcttaaacttgcacactttgtagacaaaattggaaaagaatgggttttccttactgtcggagaagctgtagacgcatgtctcgctaccaaaattgcaagagcttga

SEQ ID NO: 82579 - DNA, 366 bp, Glycine max
  Peptide Sequence Number=SeqID_174264
atggcaagagatatgcttgctatacttatctttactctagcctctgagtctgtctttagtaccaaaggaagagttcttgatccgaattgttgttctcttacacctcaaatgatggaaacacttgtctgtacacaagattggatcaaaagaacaccatcaccactgccttcaaatgaaaatgaggaatttttggagtttgaaataattgaagaagcaaatttggttattccttcatgcaggcctgttaaggtgtggcaaaagttgcaggtttatgccaggggaaatgatgttaatctcactgattacaaaggaaaggtccttctcgttgtcaatgttgcctcacagtggtatgtactaattaattaa

SEQ ID NO: 82580 - DNA, 384 bp, Glycine max
  Peptide Sequence Number=SeqID_174265
atggctcctacatataatgattgggaatttgtgcattcaatctttccattcttagagattttctatgatgctactttatgcatttctggttcatctcacgcgacaagcactatgtatatgtttgaggcctttgggattggaatgaaaatcaaggaaatgtctacttccaggggtgtgaatatgagtgtgagaacaatggttgtacgcatgaaggaaagatatgataagtattggggcaatcctaatcgtataaatagttttgatggtgaagggggtgaattgacttataagttgagggataaagtggaatctagcttgagatcacttcttgaagagtatagtagaggtggtgatgagtttgaagttaactcacaggaggcttga

SEQ ID NO: 82581 - DNA, 93 bp, Glycine max
  Peptide Sequence Number=SeqID_174266
atgggtgcaagggattcatcattcatgaacaaggctcatcacgaggtgaggaaggagcatcctgggctagctaaggtgtctattatgttgtag

SEQ ID NO: 82582 - DNA, 501 bp, Glycine max
  Peptide Sequence Number=SeqID_174267
atggttattaagagaggcaggatacagaataagtccagaatgaagggcacctttaagatgctgagattcactgaaacggatgcttatgattttgcaaagccatataatgaagtggctcagtatttcaaccacaagttaaaggaagttgtggttctacttcgcaaagatcttcctttggctgcaatcatatatgtaaatatctactctgttaagtactctcttttcagcaacccaaggaaatatggatttagggacccccttgtagcttgttgtggctttggagggaagtataactacaataatgatgttggatgtgcagaaactatagaggtcaatggaagtagaatttttgtgggttcttctacaagaccatctgttagagtggtatgggatgggatccactacactgaggcagctaacaagttcatctttagtcaaatttctacaggagctttctctgatccaccccttcccttgaatatggcatgtcacaagtcgtga

SEQ ID NO: 82583 - DNA, 624 bp, Glycine max
  Peptide Sequence Number=SeqID_174268
atggatgaatcaacgaaaaagagaaagggctcttcctccaccactgccactgctggccattgtcgccacagaccatctgaagcacccacagcaccgggcactattttttatgactggaagtttgattactcgagtcgtgatgctcgccgtatggtctgtaatgaccaggctgatatgaccggcagtttgcttgctgggtcattaacttttgactgtcgcatcatgcactacatcattgttcacattttgttaccccgttcgtctaacctggctcaagcctccgaggggggacttgattttgatatgggctttccttaccgattcctcttgatgatgaaccttttgttcaagtccagagatctttttgccattggtgctggtgcaataacttcatttggttatcgtaaggattatgatggacagtggcttaggaaacaggacttaccacatgagccattcattggtgatcatttcgatgccatggatggttgcctgaatgccatggatgcacgtttcgcaggaatggacacccgcatcactcagcttgaagacgacatgggtttcattcatcgttgtttcgatcccctggctgactcttatcttgattatgctttattttattag

SEQ ID NO: 82584 - DNA, 271 bp, Glycine max
  Peptide Sequence Number=SeqID_174269
atggccgaatcatccaggaagcgcaagggttcatccacctccactacggcaactagaacaccacgtctcggagccaccggagcatccccgacacaaattccaccttccttgtcatcctctacattgttttcatctgatgaacagcgtatctgtcaaggtgcaccttttgaaggcaccattgttgacgactggaagtttgattactctaggcttgatgcccgccatatggtttacaatgatcaggctgatatgtctgacagattgcttgccg

SEQ ID NO: 82585 - DNA, 270 bp, Glycine max
  Peptide Sequence Number=SeqID_174270
atgtttgtattcaacagtgctttgaaaggacttgatgatactccacaaagtaaatccaatgttggtactaggtggattgttgttaaaaaaaaaggaagcactgagtatgagtattacgtcatacactggatgtcaactataatctttggaagtttcaagaataattgggaaacgtatttcaatgatgctacaccattggaacaagagagattgaaggcgctttgcatccagtgggcaaagtattatttgaaagttagaaatgaaacttag

SEQ ID NO: 82586 - DNA, 381 bp, Glycine max
  Peptide Sequence Number=SeqID_174271
atggttgcttcaacaaacaagcattgcttcaagattaattcaagatcaagcttttgcctcaaaacaaagtgtttccaagagatcaaagctctggaacagatgaaagccgacatgtcagctttgaaagaacaaatggcttccatgatggaggtcatgttaggaatgagacaactcatggagaaaaacgtggccaccgctgtcgctgttagttcggctgccgaagcaaacccaactctcctagctaccgtgcaccatcctccctctatttttgttgaacccagtgtttcctctaaatggtcatttagaaacgaaatgctaacatccaaaatctcatttatggttatgagcatatctcatcagcatactccctttccctggtag

SEQ ID NO: 82587 - DNA, 250 bp, Glycine max
  Peptide Sequence Number=SeqID_174272
atggaacttcaacgtctcaaccaaaatgaagagaccaataaaaggaaaagaagcatagcactcaaagcctcctcctcaatgcaagaagaagaagaagaagaagaagaagaaactgatgatgaagaggacttctcactctttgtgaaaaagtttcataaattcgtcaaaaatagaagaatggagagaagccataacttcaacaatgggaagagatccccagaagtttctcctacacttaaatgctataagt

SEQ ID NO: 82588 - DNA, 398 bp, Glycine max
  Peptide Sequence Number=SeqID_174273
aggaaggaacatctacacaggattccctttacactgctacttctgttaatgataatgaaatatatctgaatgttgttggagctccaaattacaaggggaacatgtatgggctaggtactttgagcaaacggtttagttgttcaaaatcagctccatctacttctattgctcctgtggaagaccaaataaaggaaatgtgtgagacaattaataaattgaatgctgagcttttggcaaaggcaaataaggagaagacacttgaggaaaagatgttgcagctgatggagaatcatgaccaccaaactcctagtctatcaactaccataacagatggaactgagcaccatattaatgatgctcaggttgatcgtcctcatgacatgggaaatgatcattga

SEQ ID NO: 82589 - DNA, 276 bp, Glycine max
  Peptide Sequence Number=SeqID_174274
atgtttcaaatgcaaggagaacaaacaagggatctttatgaggaagggttcatgccaaattattattggtggacaaaccacagtgaagagttaccacaatttcctccaatagtgtttcaaggttcatactacgaaagtggtgggcaaaggaaagaattgaatccttacgagcaaatgatcatagatcatgttggaccatcaattggccaatacatagaacaagagtgtgtaattgagacaaaatgcatggaggaaaatcctaatcctgaagcttaa

SEQ ID NO: 82590 - DNA, 584 bp, Glycine max
  Peptide Sequence Number=SeqID_174275
ccgctgccataggccctgctgtgaccagccatgaacagtctctcctctctccccctatcccgcaacctcagctggcggtacccaccttctttgcccctatcccgccagctccaaaggcgggactgcccaccggtacccattataccgccattggcactggcggctcacccttcccgccagtgccaccggcggcacccaccggagttgggatgggcgtgggtgctgtgcgcgtgggtgatgggggcggcttgatcggcggtggcaacgacggaggtagcgatggagtcagcggtggaggcagcggcgtggtcggtattggggcggctggtggcggtgactgcgaaaggaaggaagatggagaggagttggttagtcggtggagtagctcgtctaaggtgaaggtgacatggagtggattagagggaagcttggcgatggcttcttcaatgcattccattctagttttgggcggaggtgcttcagccatggtgggagggttcaatgaaagcaccaattgttatgatcctagagttcgaggactaggagacctccagaaaaagaggattgaagagaaggaatgctga

SEQ ID NO: 82591 - DNA, 1116 bp, Glycine max
  Peptide Sequence Number=SeqID_174276
atggatggtgttatttctacctggagaggaagctctaaatctaagtctccttttgaacaggttgcatcatcactcactggccgtactaaaacagtgggtgttatttctctttttgggatgcctgatgcagaagctttagccttatcaagaatgcatagtctcggtgtcgaaagtagcatgatgtacttcttttgcggcttatctgtatttcaactcatgaaactcaagatatgggtaggcattgtcgcgggaggaatgtttaggtttattcttatcttaattcgaaccatacttgctgcacaactgaagaaggaggagcaagagcagcatgttgaagtgtttacctacagcctaatttcgttactctttcttcaagggggcaaacggatccacgtccatgaattggtccgcgagggctgtgtccctgagtttggcaagtgctcctggtttaagatacttgtggaacaacatagggcttcttcattgggaggacatgcttatgcttgtggtgcatgcctttgtcattgtcataatggttggaaggggacttgtaaaacaaagaactctgacgctcaaataagaatatgtgtaaggagactaaagcaaggactatttgttagccttgtagataattctcgacttatagataataaccgggagcttaaagataattacataagcctcccaagttctgagtcggtttgcgggcagaagaggttgtccggtgctgaaaaagtttcatcctgtgttgagggaagggtgacgagtttgtcaagccctccaagtgtggacgagtgttgtccggtgtcgggcgtggtagccttgacaaatgtgagagttacaagtcgatgtggcttgtcaagcccccgagcttggtcatgtgttgtccgagctgcttctgccaagttgttcgtgatggacgtgtgtcaggtaagtagtgattcaaggggctcgattgaacagtccattagagatcgagaggtcatcccaattggcggttcctcgtctgagcatactcgtcgaggtgcctctgatagcaagtcctcctctttagagaaggtgaggacttcgtgtcgaactagtgggagcacttctcacccttgtggaagggcatga

SEQ ID NO: 82592 - DNA, 603 bp, Glycine max
  Peptide Sequence Number=SeqID_174277
atgtggaccaccacgggggaggagcttgccaggcgagctcagctcgcccaggcgagcaaggttgcttcctccagaagcaacagccttctggaggaaggatctggaaggcccaagacgccaagtatctcaaagcgactaaccaaaggttgcgtgtcatcaagtaataattcccggacgaaattagggtatgacaccacccccgtgactgttggaaatgctggggtctgtggtggtggcttcgtcatggcggttggtgcacgattgcaatctctcaaatttcgcatcactgccatgactatcggagatgtcgagatccgcggtggtggctttattgtggcggctagatgcacggtgtggttggagatgccaaggccttcgtcggtggagatgacaatgttgtgtggttgcctgtgcagtgcagatacagtggtggtgagattaaaggagagggaagagaaagacgcagagggtgtagtcatcagaggcgaaggcaaagatgtcaacttgaggatgtcgtccttggaaggagttacggcggatggggttgcagtcaacggtgtggacatcgcgagtgtgttcctagaaggagcatatggggtttga

SEQ ID NO: 82593 - DNA, 291 bp, Glycine max
  Peptide Sequence Number=SeqID_174278
atgaacaatgttcaaaatattttgagagagggcagaatacggagaggtttgagaattgtggagcattcaatggagtatggcaagattggaggagtgagagaaagggatcagaagagaatgggaatgggaaatggtgaacggagtgagaatgaggatggaatgacaatgggaaaagaagagatgggaaaacccgggaggacacgtggagggaggggcaaaataatgggaagaggaaaagaaataaaagcaagcacgagcataacacttggattgaagcgggaaaaatcataa

SEQ ID NO: 82594 - DNA, 459 bp, Glycine max
  Peptide Sequence Number=SeqID_174279
atgaattggcgtggagcggttgcggtgctcgtttatgtcatcgcattgtgtcttgaagagaatcagctaaagaaggttacaaatggagatgaaatgcattatctattaaaaatcaattattacccaccttgtccatgtcctaatctggtcttgggtgtgccaacactcacagacatgtcctacctgacaattctggtgcccaacgaggtgcaaggtcttcaagtttgtagggatggtcattgcatgatacggagcaatggaaaatataaggcagtttttcacagaacaacagtgaacaaatacgagacaagaatgtcgtggccagtgttcataaagcccaaaaaagagcacgaagttggtcctcacccaaagttggttaaccaagacaatccatcaaaatacaagaccaagatatacaaggattatgcttactgtaagctcaataaaatccctcactga

SEQ ID NO: 82595 - DNA, 498 bp, Glycine max
  Peptide Sequence Number=SeqID_174280
atgaaggtgctaagggtgcaaaccatagcttccaaatccaaagatgctgccatcccagtcatgtttgttaggggagagacagagcaaccaggcatcacaactgttcaaggggtgaaccttgaggtgccaattattgactttagtgacccagatgaagggaaagtgatgcatgagattttggaggcaaggtatggcacaaagcttcagaaagaggtgaatggcaagaaagggtgggtggatcatttgttccacactgtgtggccaccttcctccattgactaccgttactggcctaagaaccccccttcttacaggcctgcggaccagcccgtttggcccgtggggtctgcagggcggggacgaaccaatttatttggtctgtgtaagaagcgggacggactgacccgatccgctgccaatgcggacttatgcgggcgggccttacgcggaacgggtcggcccgcttacccacccctactctttccatcgagatcttag

SEQ ID NO: 82596 - DNA, 342 bp, Glycine max
  Peptide Sequence Number=SeqID_174281
atggagatggaacttgtattggctgatgtaatgagatatcaaaggaatttgggcaacaagggcgacagaggttggttggaaaagttacataaatcggctaaactgtttcgattcgaagtgcttcaagactgggatgatatagtgaatttgtgtgctaaagatagagccactggtcatggagctgaaactgctatggatgctgatgaagtgataaaaaaaatagatggtagagtcgatgatgaagatattcaagaagtgttaagtgaagctttgatactagatcttaatagacaacaatggactaaagatattaaatggttaactgacgatcaaagcagttag

SEQ ID NO: 82597 - DNA, 156 bp, Glycine max
  Peptide Sequence Number=SeqID_174282
atggctaggagactccgggaagattgggccagggatccaggagaaggccctagggttctcatgaaccttagggtagattttgggttcatgggagcagatcgcttgatacaggtcacagagttttgggttgtcgccacttctagagagggaagataa

SEQ ID NO: 82598 - DNA, 384 bp, Glycine max
  Peptide Sequence Number=SeqID_174283
atgccagttggtctacgctatcctgacccaaatcagtgttcatgtagcacaacttatctcggacgccatctaccagtttgtaggtattgcacctccgagacacccagtggacccagagaagtccaacagggcactgggatttccagcattgatcacaggcctctgccagttctacggggtaccggtcacgcccacaaagctgatccggacccccaattaacagcgctaggaccccatactcccaagcagttcaaagccattgtcgcatggcctggggacaggcctaattttcagggaggtacaggtcccacagaggctcaaggagatgaagacgaagctgatgaggatggagatatggcaaatgtgatggatttcttcctttaa

SEQ ID NO: 82599 - DNA, 192 bp, Glycine max
  Peptide Sequence Number=SeqID_174284
atggtggaagttcttcagagagcttattctgatcataatcctctatatgctaatgatgttctcacttccctggataatgtgaaggaagagacactggtttttaacaaggaagtgttagagagtatcttttgctgtaaagaaagagctttaggcaaggatcaaaggcctagagaagtacttggagaacgttga

SEQ ID NO: 82600 - DNA, 345 bp, Glycine max
  Peptide Sequence Number=SeqID_174285
atggatcctgtaggattcatctttggtggatattgtggtgttgattgtcggttggaggatttgggtttcaaaggtcctctttttacttgggagggacgtggtgttaaggagatgttagattatgcagttgggaatgagttatggaggtttggttttcttgactctactgtgattcatctcctattcttgaaatctaaccataaggttattcttttacgtacaacccaggataattttgttgggggtgtgaagcctttcaaatttcatgcttgctggcttgtgaacaactctttccatgatgttgttaggggaacatggaatggtgcacaacattatttggcataa

SEQ ID NO: 82601 - DNA, 351 bp, Glycine max
  Peptide Sequence Number=SeqID_174286
atggctataccacccagctcccctcctcctcctactgattcaacatcacattcaccttctatcatgaagaggacaataaaagcaacccggctgagatcattggctactagaccagttggggcagagagacccctggttcgtgtggatcctttcaagtctgatttgacgtcaaaatgggcacttgtagccgacaaggacagtgtctattgcgacttacccttcagcgggagggcgaggcgagatggaaaaggtgttgcccttgctcctatgtatcctcaggcttttgaaagattcattttaaataacaagcaaaaagaggctgttaaggcgttgaaccttgaacgatctcgg

SEQ ID NO: 82602 - DNA, 213 bp, Glycine max
  Peptide Sequence Number=SeqID_174287
atggagtcgccaactgtcgcaacctacccttcggcggcagggcgaggtgagatggaaaataagggttcgagagttgtttacgcacagggaagttttttactttttacgatcgacaagggtgttgcccttgatcctaagtatcctcaggaaacaagggcacttggtggacttgcagctcacccaggcaagctggagctcacccaggcgagctga

SEQ ID NO: 82603 - DNA, 549 bp, Glycine max
  Peptide Sequence Number=SeqID_174288
atgaaagccagagccaaggcagtggctgacacatactctactcctgatgaagttcacagtcttttcaattactgccaacacatgtttttgcattactcattgcattcattctttaacagtcatcgttgtcgtcaaaacataatcatagtaatcaaaaagaacaaatgcactttacggaacccttaccaaacacgtgccaaggctagaatcatgagcgagatagaggaagttcaagaacagatgaaggtcgacatggaggccatgaaagaccaaataaccaccatgatggaggccatgatgagtatgagaaaaatgatggaggtcaacacggctgcagtcactgccacaagtgccgccactaggtggacccgactcacccgtctgggaggtgaagcattgggaagtacgggcagcccccattttgtgcaggtccagagcaagcatcccttcccaccatatggcttgcctcccaacaatgcaccacccaatgttgtacatgtgcccaatgagaatgtcgaccactctgctcccatacttattgagatctaa

SEQ ID NO: 82604 - DNA, 606 bp, Glycine max
  Peptide Sequence Number=SeqID_174289
atggatccccttgccgatttggaagctaaagcagtacaatcggcaaattggggtagcatcctattagctagggatttgttttgtggagtcaagcctacatccaaggctaacaaaatttatgtcgagcctcatgacccacagttcgtggctcgtcaatttggtcttactcaacatcttcatatggcctttctgacaatgacttcacctaagtctcgtcttttattgtcgactaaaaaaatgcctattttgaaaaggcttcctttttaccttttacaagccaatgaccatgttcaactagatcctatttctcaaactccaagtcaacccaaccattttcttctcgtccagcttttgttttggctaaaaagaagaaaagttcatcagttggaatcaccattaaccattcaccagctctgtaatcagaaatttgaccaagccaaacaaaccctttttgcacctcctattccttctacttcggctgccccatctacaactattccccaagtggaaatcatggattatatcgtggaggtttcagccggaatttctagtgctcaagttgttgttgttgccccgaatattgctattggtgcctctaagcattga

SEQ ID NO: 82605 - DNA, 90 bp, Glycine max
  Peptide Sequence Number=SeqID_174290
atggctatgtggatcaaagaaaatatacaacatttattctcaattctcatgaatgagagaggatttgaagattcaaaccaacgtgtttga

SEQ ID NO: 82606 - DNA, 237 bp, Glycine max
  Peptide Sequence Number=SeqID_174291
atgggctctgaaatcgcgccgtcgcgcttagcgccactgtcgtgcttaacgcgacgagctgatctcgcgcttagcgcgttgcttcaattcaggtgctcttctagattccttcttcacgctaagcgcgctgaagccgcgcttagcgatggatacgcgctaagtgaacttagtgggcttagcgcgacagtcactttggcacttcaagaaattagctcctttttacctaaaattgtatag

SEQ ID NO: 82607 - DNA, 105 bp, Glycine max
  Peptide Sequence Number=SeqID_174292
gcatactgcaaaattgatggaatgtcaacggatgttttcattggtgggattccagcccagaatagagctggtcatttgcttatatgtctcctgggcattcattaa

SEQ ID NO: 82608 - DNA, 231 bp, Glycine max
  Peptide Sequence Number=SeqID_174293
atggctgaagaggaaaagcgcaacaagaaggaactcatccaacaccttcaaccagaactggaccagcagatccaagaaggagggaggcaactcgtccaacccatcaacacagtctccacatggaaagcagatgacatattgcttctgactgtccaaccagtgaatctgaaatcaatgaagaagaggtggaagaagagctttaggaggaagctatgcaagatgatatgctaa

SEQ ID NO: 82609 - DNA, 513 bp, Glycine max
  Peptide Sequence Number=SeqID_174294
atgggaggtgaagaaaatgtaaagcatcttgaagattgttctgtttccaataagtataactacaatgcagcagacagtgaatgtctgacgattcatgaaggtgttgggacactggaacacaggataataagaatgttgagtagactatatgctccaataaattttagagtaaaccctccagttgatcatcccaagggtttactcaaattactttactgtattggcattcagataggggcttatcatgatgttcatgatcatgggtactcctctgttgtgaattggggtaagtttggtgtccttctaaatggagctttgctggctattccagtggggataaagcgcaaatctctggcaccccttgtattttttggcaccactggtactatgttggatattattatgggaattagtgcttgcgaaagggaacatgcagagcgccaaatgaagttacttgaagcgcaaaatgctgctgccgagacttctttgggtgaaacagaaattgattcataa

SEQ ID NO: 82610 - DNA, 636 bp, Glycine max
  Peptide Sequence Number=SeqID_174295
atggcctctgccgatccttctgcctcagtggagttgtggtttcttggccaaggatatcatgaccacttggaaaaaagagctagtgctgtcccaaacgacaagaaatctgagtgggaaaaacttgactttcaactatgtgctgtgctgtggcaatcggttgagctggatgttttggaaactcttagatcattcaaaacatgttctttttggaagaaggctcaagagatatttgccaatgatattcaaagtaaagctcgagcagcagtggaagagttaaaaaggtttcttgtagctgattctttggaagaagtaaataggaagctggacaagttttacatggttcttattttgagaagcctacattcagattttgatcatgtgcgtgatcaagttccgtcaatggactctctaattactagacttcttcgtgtgccccatgtgttgaaagatgaaaacttagctgaagtcgaggaaacatcagccatggttgcacctcttggaagaggaggaggacgtaacaacagaggaggccgcggtggaaggagtggacgtcctcaatgcacctactgcaggaagatgggtcatactcaagaaaattgttactttactccttacatggcttttctgacaaggtag

SEQ ID NO: 82611 - DNA, 291 bp, Glycine max
  Peptide Sequence Number=SeqID_174296
atggagaaggagaaggaaacgcaagggctggaacgagcaagttgtcaataccgaaaaacaaggactgaaacggcggcgtgtggacctcacgcgccggaattggcgtgggttggtggcggtgtgtggaggcgcgtggctggtattctggccacgcgacttccacaagtgagtcgcactcttcaaggcgcacccaaccctgggttcgccagaagatacgatggccggagatggtggaggccggcggcggacagcgaccagagtcaaaacaattaccctttgataccaacttga

SEQ ID NO: 82612 - DNA, 447 bp, Glycine max
  Peptide Sequence Number=SeqID_174297
atggcaacgcagctgatccgtgatcgcgtcgtgatggagtgcctagagggtgtttgggtgacccttgagggcaacgagaggtgccaattccgcggcacagttcgactcattgctacatcgcttgtacatccggagcaacccgcacacacacttcagcagcctgtggagtggatactacctacacctaccccatgtcgactagttgagcccgttcaattgatagaggtgtcatcctccgaagaggatcctgaaggggacccagaggagttatctcctgaacctgctatggatgcccctgacttaccagaggatgatgatgacccacttcttgatgttgattctccagaggatattatgccagcacctgaggcagactctacagaggagagtggtcttggagggatggcgaataacgacgactcttcatcacagcagacgactccttag

SEQ ID NO: 82613 - DNA, 349 bp, Glycine max
  Peptide Sequence Number=SeqID_174298
atgatgacaaaggtgatgacaaaaagctcaaaggtcaatcaaagaatgagttcaagatattcaagatagaatcaagaacacttcaagattcaagaggaaagttgatttcaagaatcaagaatcaagattcaagagatcaagatttcaagaatcaagattcaagagatcaagattcaagactcaagattcaagaatcaagagaaggcttaatcaagataaggtacatcctttgtggtacaagtagagggtacatctacttgggtttgactgagaacaagagagggtacatctcttgtggatcagttctagtggaaggtacatccactaggttcaaagagaacaagggagg

SEQ ID NO: 82614 - DNA, 249 bp, Glycine max
  Peptide Sequence Number=SeqID_174299
atgataattcaaaaagggggttttagaaagtactattgggcttatggaaagcccactccagaagaaacaagtgcctccagaataggccatgaaaatcgttctggaaagctcgttcaggaaatatgtccaaacgtgacacattgcgacctacctagcatggaaagttggaggacgagaggtattcctgtgctagaacctctggcgtggagagttggaagaagacttgagttggagaagaatagttggtga

SEQ ID NO: 82615 - DNA, 270 bp, Glycine max
  Peptide Sequence Number=SeqID_174300
atggcgcaatgtataaaggttgcaatagcgttgttcctcctctacaagtcggcgtcgggttacgctctcttggaggcgcatggcctcgacgaaattggacacaacacggaggctgttcgcaactccgtttcagacctcaacaggtttggcaaggttgtcaagtgccgctccttcaaccccttcaactccttcaacaggttcgcaactccgtttcggacctcaacaggttgtcattcaaaggaactagtatttctaaaggctttcatttga

SEQ ID NO: 82616 - DNA, 183 bp, Glycine max
  Peptide Sequence Number=SeqID_174301
atggagagagaaaatagaatcgcacaaagacaatacatatggaggcttcaatccctttttcgtctctctgacgtttgggaactctatcagaacagtcggaggaaaaactggaagaatctcaggaaaccgctagagatgccgctatcgctatcggaagacatggttttattgtccatgttgtga

SEQ ID NO: 82617 - DNA, 309 bp, Glycine max
  Peptide Sequence Number=SeqID_174302
atgggcgaggaagagaaaaaaccagaggaaaacaaagtggaggagaaaaaagcagaggaagaagaaaagaaagaagaagagaaaaaaccaaaggaatcaaaagatgacaaggaatccaaggaggaatttgtgccgccagaaatcatgcaaggcacaacctttgcaatgcatggacactttaagcacgatttctgtcatcttttaagttatggactattttgcaacacttatgcaaaagataggaactattttgaatttttcattaagttagggactaatatgcaacaggaatacaaagtcagggactaa

SEQ ID NO: 82618 - DNA, 1305 bp, Glycine max
  Peptide Sequence Number=SeqID_174303
atgctgaagaaggttggggatggtgtgttgcattacacatggattgatatagggactccaaatgtttcatttcttgtagcattagatgctggaagtgacatgctttgggttccctgtgactgcattgaatgtgcttccctgtctgccggtaattacaatgtgttggacagggatctgaatcagtatagaccatcattatccaacaccagcagacatctaccttgtggtcataagttgtgtgatgtccattccgtttgcaaaggctctaaggatccttgcccttatgcagttcagtattcctcagccaatacctcaagttctggatatgtcttcgaagacaaactacatttgacatccaatggaaaacatgcagaacaaaattcggtgcaagcctctatcattttaggttgtggaaggaaacaaactggtgaatatttacgcggagctggtcctgatggtgttctagggctaggacctggaaacatttcagtcccaagtttactggcaaaggcaggacttattcagaattccttttcaatctgtttcgaagagaatgaatctgggagaattatctttggtgaccaaggtcatgtcacccaacattcaacaccctttttacccatagatgggaaatttaatgcttatattgttggagtagagagcttttgtgttgggagcttatgtctcaaggaaactaggtttcaagcacttattgacagtggatcttctttcacatttcttcccaatgaagtttatcaaaaagttgtaattgagtttgacaaacaagtaaatgcaaccagtattgttctccaaaattcatgggagtactgctataatgccagttcacaggagttgattagcattcccccattgaatctcgctttctctaggaatcaaacctatttaattcaaaatcctatttttattgatcctgccagtcaggaacaggaatacaccatcttttgtttgcctgtaagcccttctgatgacgactatgctgccattggacagaacttcctgatgggttatcgaatggtctttgatcgggagaatctaaggtttagctggtctagatggaattgccaagatagagcaagtttctcatcaccttacagtgttggatcaccaaaccctttaccggtggatcagcagcagagtttccctaatgctcatggcataccgcctgccattgctggacacacgtcccccaaaccctctgcagccacacctgaacttattacctctaggcattccttagtttcattgttactgatatgtcacctttggctttggttattttgttaa

SEQ ID NO: 82619 - DNA, 1893 bp, Glycine max
  Peptide Sequence Number=SeqID_174304
atgagtcgctacgacgtgaagagcattgcaaatagtactcttcctattggtggtttatctggcaagaacaagaactccacagattctgcatctgagagcaaaagccatgagccaagccaatccgatggagatccatcatcggcttcatcgcaagacccttcagattactggtccatcttggggtaccataatactccccttgacaacagtggcatcaggaacactactagtactgttactacaactacttttccatcctccaacaatggcactgctagtagtttgacacccttcaacatggagttctcaagtgccccctcaagtaccggcagcgataacaatgccgcgtttttcagtggaggaggcatctttgttcagcaacaaactagtcatggtcatggaaatggaagcagtggttcctcctcttcttctttaagctgttcaatcccatttgccacgcccatattttctctaaatagcaatactagttatgagagcagtgctggttatggaaactggattggacctaccctgcacacattccaatcccatgcaaaaccaaaagcaaggaagaattggaatcacaaagacatgattgcaaaggagattcttcagaagaattggaatgacaaagacatgatagggtggtcgttctccagaagaattggtcaattgtgtatattccagcaagttgagatgagtggaggcacacataaccaaaacaatgaaacaggtgatgtaaaagatcatacgaacggaggtagcaatggtgatgatgctttgactataaatcagttgctatccagactaacaagggcagaagacaacattgataaaaaattacagtggctggagttccagggcaataagcgcaagagacaagatgacgattggttggataaactaaaggacctgaaaaaaagagctattgatgtgaaaaactcactgcatcagtctgggtcgactaatgaattccccgagccttatgaattgggtgatgagtttgatgaattattgctaatgaagccttggatgttgctagatgagcgagatgaaaatatggagaagatgtgggatcttctggagcatgaggaagttttgattattggcatagatggaatggggggagttggaaaaacattcatggcaactcatttcaagaatgagattaaaagaaaggggactttcaaggatgtcttctgggtcactgttttcgatgatttcaccactttcaaattgcaacatgacattgcagcaacaatacaggttaagctttacggagatgagatgactagagcaacaattttgacgttagagttggagaaaagaggaaaaacactgcttattttggatgatgtttgggaatatattgatctgcaaaaggtggggattcctcttaaagtgaatggcattaaattgattatcacaactcgtttgaaacatgtgtgtctacagatggattgcctaccaaataatataataagaatgcaccctctctctggtgaagaagcttgggagttatttttgctaaaacttggacaccgtggaacacctgcaagacttccccctcatgtactagagattgcaagatctgttgtaatgaaatgtgatggtttacaacttggaatcagtgtgatggctcgaaccatgaaagggaaaaatgagatctattggtggagacatgcattgaatatacttgacagattggagatgggagaagaggtcttaagcgtactaaaacgtagctatgacaatttaattgaaaaggacattcaaaaatgtttcttacgatctgcactgtttcctaatgagactaggaaagaggaatgggttatgatggttgttgagagtggtggcacagtgagtttgtttgtgatattccagcaagcatag

SEQ ID NO: 82620 - DNA, 324 bp, Glycine max
  Peptide Sequence Number=SeqID_174305
atgtcgatgagggacttacagagctcaaatccatcgaggaggaacatcaacggaagcaatgacaacaagatcggcttcagtgtcgaccgtagccagcgatttgagaagcacacgtatggctatatagaattcgtagtccctcggcgtacctacatacatcatcgtcgcctatttgggggtggagattccgttgcgacaggggtttgggtttttttggggttagggttttttgcggtttcactggaggagaggggaatgggggtgaaggacgaatgtggggttgggggcggtggtggcaccagggagaaggtggagaaagtgtaa

SEQ ID NO: 82621 - DNA, 1416 bp, Glycine max
  Peptide Sequence Number=SeqID_174306
atggctaatacaaaggccaatcaaagtgagtctagtgcaacctcaccaaatgagacctctaagaggcaaagaatgtcacctgcctctgttgaagaatgtccaagacttattcctaatatcccggatgagttatcccttcagattattgctagacttcctagaatttgttactaccatgtaaggctggtgtctaggaggtggaaaacaactataacgagtttggaattatataaagtaagaaaagagcttggtacaactgaagaatggctatatctgttggttaggattggacaaaataaactcttatggcatgctctagacccccgttctcgaatatggcagagattgcctattatgcccagagttgtcgatgaagaagattcccaaaaggtttcttctaggctttggatgtggaacatggtcgaaggtatcagaattgctgaaattattagaggtctgcttggacagaaggatgtattggatgacatgcccttttgtggttgtgcttttggagctgttgatggatgtctttatattctaggtggattctctaaagcttcaactatgaaatgtgtatggcgatttgatccgatacaaaactcatggaagaaggtgaattctatgtctacaggtagggcatattgtaagacaggtgtcttgaataacatgctttatgttgttggaggggttagtcaaggtcaagctggattgattcctcttcaatctgctgaagtttttgaccccttcaaggatacatggtccgacgtacctagtatgccattctcaagagctggagtcctgcccacagcttttttggctgacatgttaaagcctattgccaccgggttaagctcgtacaagggaaggttatatgttccccaaagtttgtattcatggccattttttgttgatgttggaggagaaatatatgatcctgaaacaaattcatggatggaaatgccaaatggaatgggtgagggatggcccattaagcaagcaggaaccaaactgagtgttgtagtgaatggtgaattatatgcttttgatccttcaaattctgtggatagtggaaggatcaaggtatatgatcaaggagaggatgcatggaaagttgttattggaaaagtccctgtatatgattttacggaattggagtatccatatctactagctggtttccatggaaagcttcatttcatcacaaaagatgccaatcatgatatttctgttctgcaggctgacctgtgcagtaatttggattcttcacaatcaacctcgacacctcaatcacccaaatccatggaggatgaattgttgcaagaatcaactgaaacagatgaagttatttggaaactagttgcaagtaagggttttgggcaggccgaacttatcaattgccaagttattgatatctag

SEQ ID NO: 82622 - DNA, 141 bp, Glycine max
  Peptide Sequence Number=SeqID_174307
atggacacccgtctccgtgtgattggtgatcccatgaatggagttcaacgggggtggggtcacaacccactttttgaggatccacctagtgagtgtggtggtggggccgccactgtgagatatgagctaatctctaagtga

SEQ ID NO: 82623 - DNA, 240 bp, Glycine max
  Peptide Sequence Number=SeqID_174308
atgtttaatccaactcaatttcaagccaaagaagagaaggttaaagttgttgatgactcgcttagcgaggcagatccgctcagtgagatgcatccgcttagcgaggcatccagctcgcttagcggatgggaaaccctagaagaggataagccagagatctacatgcttaacgcgcagccagcccgcccagcgaggacgttgtcacttctcgcacttagcgcgcccatgctcgctaagtga

SEQ ID NO: 82624 - DNA, 96 bp, Glycine max
  Peptide Sequence Number=SeqID_174309
atgactccattgatgaagaagatccaaggcctacaagctccacatggagctacatcaattggtgtcccccaagtggtggatttaggacctgtttag

SEQ ID NO: 82625 - DNA, 1185 bp, Glycine max
  Peptide Sequence Number=SeqID_174310
atgagttatcattcatctagtattgatgttaagggtactagtcataaggatcctctatctagaatcttagatgagttaagttccctcaagttatggaaagaaaaccttgaaagaaaagaaaaaggaaaagagagggtagaaataaatcaagatgaaataaaacaaataagggaagaagaaagaaggaaaatactaaaagaagtaagaaaagaaaagcatgcctcctatagtagtcatgacccttgcaagagcctaagtgaagaacttcgcgactattatgaaggaaggcataggtcacatcttagacatcactcccatgggagagaaaaggaaagaaagcctcaagaggctaacattaacctttcatacttccatgggaaagacaatgcagagacttacttagactgggaaataaaggtagagcaacaacttaaaaggaagtcaacttcaaaatcttattgccctcactcttatccaaagaaagaccaaggtcaaggcatcttaggggcggcaccttctaagcccaaagacgataaggggaagacaatagaaaagcaacctcttaaggctagtatgcaagagaagactagctctataaagtactttaaatgtcttggaagaggacacattacttctcaatgccccaccaagaaaaccatgattatgaggggccaagaaatttatagtagccaagatgaggctactacttcaccttactctagtgaaagacaacctttaatggttaaggaggagtgtaaggaggtaagtgtctcttccaagaggttagctaagaaggaatgtcattttgcaataaagacaaacattaaagaaactttccttcttagaaaacctccacatcttcccctttataaaaagacacttgttagcaataccatacctcttgggcttgagattattcctcaactaaaggagttgttggatgagggtttggtttgtaagagcttaaatccttgtgctttgttggtgcctttccgcggcatgtcggaagtcgaaagggagcattgtcgcgcaatccgtaaagttccgcaacattccagaggtcaaaaaagggattattgcataattcgtaagggtgttccaacagaaggcgttgccttctggtggaagcaacccagctcgcctggacaagctgggcagcaaccacctccctctttttccctataa

SEQ ID NO: 82626 - DNA, 231 bp, Glycine max
  Peptide Sequence Number=SeqID_174311
atgactcccaagaaaagtgaacatgttaagatgataacaaaagatgatgacaaaggtgatgacttcaagatgttcaagatagaatcaagaacacttcaagattcaagaggaaagttgaattcaagaatcaagaatcaagattcaagagatcaaggttcaagactcaagattcaagaatcaagaaaaggctattcaagaatcaagaaaaagcttaatcaagataagtattaa

SEQ ID NO: 82627 - DNA, 228 bp, Glycine max
  Peptide Sequence Number=SeqID_174312
ggaaacatcccttagcaccaccatacctcttgagcttgaggttattcctcaagtaaaggagttgttggatgagggtttacttcgcaagagcttaaatccttgtgctttgttggtgcctaaaatagggcttctcatgaaccctaagagaataaaggtcattcctgagtggcctactccaccaagtgttgaggaaagaattaatgagtttcaagaacctctggatttgag

SEQ ID NO: 82628 - DNA, 507 bp, Glycine max
  Peptide Sequence Number=SeqID_174313
atggtcagatggagaacatacaacttcaaggtagatggagaacaaagagagcaagaaagcttagatggagaagaagacagagagaaggagaagacaacgcgaaggagacgaaacatacctagtgcgacgaagacaatgctggagtgcgacgaacacgatgctcagatgcagatagggaccttgaagcttctccttgatgctgtggtcgaggtccacgacggcattatccttgttgtggatgtagtccatgtagttgttgatagtgtattggtagaaagagttgttttgtttaggggaagaagagaggtggatgtggaatttggcaatttggacgaggcaatggatgagagcgaggaatgttggccattgggtcctatgatggctaagaggtgtgtgggtatttggagaatggaggagttggaggctagggtattctttgatgcaaaggtgagctgggttgaaagtgggtttgggttatggatgttgggttatgggtatttgacttga

SEQ ID NO: 82629 - DNA, 831 bp, Glycine max
  Peptide Sequence Number=SeqID_174314
atgactgttctaactcctcttgatcccgaaatcgaaaatacttttcaaaagttaaagggagaagcttcacgtgccaagaagcaactatttgaagaaggatcctcttcaagttcatcaatcgaagcaaccgaaatagacaacaaaggaatggtggaagtagatcaaactatgacgaaattagcaaccgatcaaggaattgacgcgagccaacccattagaccaccaaacaccaaggacaaccaaatcaatttccccgcatgggtccacaagaacctcaaccacaaccaattcatgggagtaagcaccgaggactcccatgctcatctcacaagatctatacaattatgcatatcggtaaggttgtcaggaatcaccaacgattataaaaggatgatcaatgcatcagccagaggaaactacctcaataaaaccaccactcaagtgaataccataattgaagatttgacagctagtgagaaaactatagaaacaaatctatcaaatcccccaacagaggaggccatcaaagatcaaaatgcattgaggtaccaaccgaggaggttaactacatgggaggacaacaatgatcgtacaataacttccaacaaagagggtgtgacatgggagttgaagaagaaaaaaggtggaagaaagcaccatgctaaaggaagagatgaaagcacaagccaacccttgaacccaagcatgctaagaatccataagcaaagagatgatgagaggatggccaaattcaagaaatacatggagatgttacaagggaagaaaaaggaaccacctattgaaaaactcacatgggatgtgctacattaa

SEQ ID NO: 82630 - DNA, 238 bp, Glycine max
  Peptide Sequence Number=SeqID_174315
atgttgccacctaataacaaaaagggtgcagaaaggccaaaacttaggaagaaggatcctgatgaaagctctaccaggaacaaaactaagttgaggaaaacaaatgttcatatgacatgcagcagatgtggacaaaaaggtcataacagaaagacatgtaagtctacaccaaaaggtcaacaaccaaatactcaagctattcaactcaacaaagtcaagatattggaaccccaatcag

SEQ ID NO: 82631 - DNA, 300 bp, Glycine max
  Peptide Sequence Number=SeqID_174316
atgatttccaatgctaatttttttgctttatatgcagtggatgaagatgttgcttctgatgcggaagagatacacgttgattgcccaattattggggaaggaggtgacgaagccaatgtcgatgaggaattggctgaaagctctaaccctcctagccacaacccaaagcacatgcctccaaataaggaagtctttgataggaaagatgatagagtcaatcaagacatgaagattgtctctaatctttgggcggacaaggccgaggaagatgacaactctttacacctaagtgctttgtag

SEQ ID NO: 82632 - DNA, 612 bp, Glycine max
  Peptide Sequence Number=SeqID_174317
atggcgtttggggttgttgcaatagcctttctttcaagtgtgagtctctaccatatggtagcctccccctcaaggagcttaaccatggttgcgttaacctatctagtcattgtcgctaacatgctctattaccttgcactgtcgcactctccaccgttccacgaccataggacacgttgcctgatctccacctcgaataagtataatggagttggcggtggatctatggacatagagatctcttgtatcgaaaatcttcttggcagtatattggcagcaatgactagaccagcagggggcagccacggtgttttgatgataacaaaagatgatgacaaaggtgatgacaaaaagctcaaagatcaatcaaagaacaactcaagtgaatcaagaacaattcaagagttcaagataagaatcaagaagaattcaagagttcaagataagaatcaagaagaattcaagactcaagaagaaagtttagagtcaagaatcaagattcaaggttcaagatctcaagaatcaagatcaagattcaagactcaagattcaagaatcaagagaaggcttaatcaagataagtatggaaagtttttctcaaaaattgagtag

SEQ ID NO: 82633 - DNA, 1104 bp, Glycine max
  Peptide Sequence Number=SeqID_174318
atggcgaatggcagccatggcaaagaagtgtcgcatcgtgtggtaggagacactattggattgaaggatgggatacgtaatacctgttgtataggattggaatcttgcatgggagatgagaagaaaggggtttcttcgaagaagaaaacagaaacaaccgagctcttgaaacccaacttcacagtcaaacagctactgtacatgcacggaaaaccagacacactttctaaacagcaaagaaatgatgatctgaagattgaaactagacctgaagaggctgacgaccctgactgtgttgttgcacctgagttctgggtttcggactttgaaaccttctgggctgggccatgcttggtgaggcacaccagatccagtgatcactggaaaaaatggcggtggctggcggcagtgatgttggcaggagataatgggcgacagcatacggcaggcagagcgagatcgacccgctttgataccaacaatgaatatcccctttttatacctcgccaaaattattgctctactgacggagaaaactcatggtctgagagaagctcaagcaattttggagttgcttcggtggaatctgagaggaggcatcgcctagattcatctgggagtactagctttaattattctttggcttcttcgcattctgttcaaacacacaaagatttgcagaaaggaatttcacttctaaagaaaagcgtagtctgcatcacagcttactgttacaactccctgtgtttagatgtcccttctgaggcatctacatttgaggcttttgcaaagttattggcaacactcgcatcatccaaggaagttcgatctgttttttccttgaaaatggctcgctctagcattgatatatcaattagttacaacaacaaaagccttatccctcttgctgagagaattgaaaattatctgccaagttctactggtagttttctttatgccgctgatttatctgacggcaaaaatgagtgcctaattgaagggtgggatattgttgagcatcccacttttcctcccccaccatcgcaaagtgaggatgttgagcactggactcgagccatgttcatagatgctaaagggaagtga

SEQ ID NO: 82634 - DNA, 1107 bp, Glycine max
  Peptide Sequence Number=SeqID_174319
atgggtatatatgatccattccatcaagtgaacatgtggggggacagctttaaaattgatggaagcttgaactcaattgctccccaaatgttgatgattaagcctagcatgcggaacaagtctgaatgtactcctcacgaatcaagggaaccttctggagatgatcaagagactaacgacaaagctgatactaaggcactaagacgtcaagctcaaaatcgtgaggctgctcggaaatgtcggctgcggaagaaggttgtaaaaactgaatttataggaaggtggccggcttatgttcaacaattagaaacaagccgtgtgaagctcatgcaattggagttggagattgagaaagcaagaaagcagggtatgtacatacgccgtgcactagatgtcagttatatgggatcatccgcaacagttaacccagcaaggataactctgtttgaacttgaatatggacaatggattgaagagcaagatagacagaatcaagaactgagaaatgcattgcaaactcaagcatctgaaatgcagcttcatctacttgttgagagttgcttgagtcactactcaaatcttttcaggatgaaagcagaagctgcaaaggctgatgtcttctatttaatctctggtgcatggaaagcatcagtggaacgcctttttctttggattggaggatcccgtccatctcagcttctaaatatcattgcaccacaacttgagcctttgactgatcaacaaattgtgagcattagcaacctccggctttcatctcagcaagctgaagatgcactttcactaggattggacaaactccagcagagtctggtccacaacataccatcagatccattggttgtaggacactacgggtttgagatggctgctgccatggacaaaggtgaagcactagaaggttttgtaaaccaggcagatcaccttaggcaacaaactctgattcacatgtctcggatcctgacgactgggcaagctgctaaaggcttgctggctatgggagaatactttcatcgtcttcgcactcttagttctttatggactgctcgttcatgtgatccttcctttcccactcaactctcaaactga

SEQ ID NO: 82635 - DNA, 84 bp, Glycine max
  Peptide Sequence Number=SeqID_174320
atggctggagcagcagttttaagggaaggagtagaaacagcagaagcagcgacagcagcgtgtgacgaaggagcagcggaatga

SEQ ID NO: 82636 - DNA, 618 bp, Glycine max
  Peptide Sequence Number=SeqID_174321
atggaagaatgtgaagccgcattccggcaattcaaagaaacactatccaccccactaactctaacaaagctagacccaggagaaacaatgtactcgtttggagatagcaatcgacatgaaagtccaagtgctaaggtgttcaacaactttaaattaatggttaatcagttgaatagagcattccatgtcaaagaaccaatttttcaaaagtatgcaatcaaaattggggtaatcaaggaaaggttcaagaagatggaattcatctacatcccaagagagaaaaatctaaaagcggatttactctcaaagctatccaacatcgaggaaaatgtgggaatggaaaatgttgttcaccaaacaatccataccctgagattgaatatcaaagaaaggttcacctcactagagcatcctcaaagcaacggtcaagctaaagcaacaaattggatcatcttgacaatcccacgttccgtcgcaagagaaacgccattcaagatggtgtacggcactgaagtcatcattcttgtggaaataagggatccaacctttagaattgcaaatttgaacctaaatcaatatgaagggaacatcaaaatcaagcttgacctcattgaataa

SEQ ID NO: 82637 - DNA, 384 bp, Glycine max
  Peptide Sequence Number=SeqID_174322
atgatagaattctccgtggaagcaattacatcccttactcagtattatgatcagcccctaaggtgtttcacgtttggggacttccagctagtaccgactgtggaagaatttgaaaagatcctgggatgtccgctgggaggaagaaagccatatcacttttcggggttctatccctctatggcaagagttgccaaggtaattaaaatctcggtacaagaggtggaccgtgtgaagaaaaataggaacggggtagtcagaataccaaggaaacatttggagggaaaggcgaaggcattggcagatcaaagggaatgggcctcgtttattgacatctttgcactgttgatatttggtgttgtcctctttccaaatatggagagatta

SEQ ID NO: 82638 - DNA, 306 bp, Glycine max
  Peptide Sequence Number=SeqID_174323
atggatgaggaagaactagtgaaaggagattaccaaacaagaattcaatttttgatggtggagatgtcgcccgttaccgacatcgataccagtggcatccatgccctcgaagagttatttagaagtcttcagaagagagatgttcagcacctctttgaccagcttgttctggcaaaccctggcccaatagtaatagacaagctccacacatcaaactttgctactttgcttggtgaggacaagatcttcctcactgttgcagaggctgttgcatactgttcaacaaagctggctgaagaaccttga

SEQ ID NO: 82639 - DNA, 393 bp, Glycine max
  Peptide Sequence Number=SeqID_174324
atgaagcatagcactaaagcgtcctcatcaatgcaagatgaaaatgaagatgaagaatcagaagatgaagaagacttctcaatctttgtgaagaagtttcacaaatttgtcaagaagagaagaatcgagaaacatcaaaatttcaaccatggaaaaagattccaagaagactctccaactcttagatgctacaagtgcaaccaatttggtcacatcaaagcaaattgcccctcaaacgagcaatggcctgagaagaatgagaagaaaagtcatgaagaaagaagatccaagaaggcgtatattgtatgggatgacaatgactcatctgatggttcggagaaggagatcaaccatctatccaaggactatgagagcgatgagaacatctcttaa

SEQ ID NO: 82640 - DNA, 567 bp, Glycine max
  Peptide Sequence Number=SeqID_174325
atggtgtcaatttcgtatattgttggtggagggtctagcatggattatttagtggtattaactctgaattttgtatctgagatttttataggcttgcttatcagtgttggaactgaaaggatgttagaagtgatggaatccccaagtcagactctgagtcagttgacaagttcttctgaaaaatattcttacctggtaataggaattatgaagcatatcatcgataatgaagattggtgctacaccctgtgcttgtgcaataagtctgtctatcttgacgaaaaacaatggttttgtgataaatgtaataggcatgtcaaaaaggttgttccagactatttggataacactgaaatagaagtgctaacgtggaaggtgccgccagtggcactggcgatactggctgacgtggagggagccgctttctccattggcgagacacgtcacatagagtctcgcctctcccattggcgagacaccttcacgttgcagcttcactgttgcccagggtcagaccttcacgttacaggttacagcttgcccaaggtcagtcacagcagtgtttag

SEQ ID NO: 82641 - DNA, 123 bp, Glycine max
  Peptide Sequence Number=SeqID_174326
atgggtttacatcacttgtggatcagttcaagtggagcgtacatccacttggttgttcaaagagaacaagggagggttattggaaatctcaagaaccgggggttgcttggggactggatgtag

SEQ ID NO: 82642 - DNA, 177 bp, Glycine max
  Peptide Sequence Number=SeqID_174327
atggcgacctcgaggcggtccacacaagcggtagaaagttcgacgtccgtcattcgaggactaacaaatttgaaggcaagccctggcgcaacagttaagttgtgccttgatgaccagtttggtcatgggttcaaattcggaaacaacttttatgcatatgcaaggcagcaaagatga

SEQ ID NO: 82643 - DNA, 129 bp, Glycine max
  Peptide Sequence Number=SeqID_174328
atgaaggctaatctcgagttagcaatggtcttactacttgtttctcccaagaatgccatagtattaagattgaagtttgtgaagttatatgagcattttgtcccgttgatgtgtattggaatctcataa

SEQ ID NO: 82644 - DNA, 396 bp, Glycine max
  Peptide Sequence Number=SeqID_174329
atgggaaattgggttcatttgatgtacctcattatgttggctgatctcgatcgagtcagatggtatagttggggctttgcttttctggcaagaccatacagggaaatatgtagggccactgaccctgatgccaaaaccatgggtggttgtgcgtcattgttgcaatcttgggcatggtatcgcatgcccttcattgcagaaagagttaatcggacaccatcgcatatattggttacgagatggagtggtggtggattaagctttactgttcttgtgaaatctatatctccactttttggatgctttggagtcaacatctttcgtagactcctccatatggacagcccacacccctctaatttgtttcttgatagtagaatggcaccaagtggatag

SEQ ID NO: 82645 - DNA, 1695 bp, Glycine max
  Peptide Sequence Number=SeqID_174330
atgggtgatccagctgatgaaaatcttgaaactaaagagatggatgcaagaagtttgtcattttcacatggtcaggaaccatatgtccacaaggttggaattcctccaagacaaaaccttttcaaggaattccaatccactgtaaaagaaacacttttcgcggatgatcctctgcggtccttcaaggatcaatctaagtcccggaagcttgtccttggaattgaagccattttccccataattggctgggggagaacttataatctcacaaaacttagaggggatcttattgctggtctaactatcgctagtctctgcattcctcaggacattggatatgcaaagcttgcaaatttagatccacagtatggattgtactccagctttattccaccactgatttatgctgtcatgggtagttctcgtgacattgcaataggaccggtggcagtggtttctctcttgctggggactttacttcagagtgagattgatcccattgcaaatccagtagactatcgacgacttgcttttactgccactttctttgcggggattactcaagcaacacttgggattttaaggttaggatttttgatagatttcctttctcatgctgcaattgttggttttatggggggagctgccatcacaattacccttcaacagctcaagggcttccttgggattgaaatgttcacaaagaaaactgatgttatctctgtgattcattcagtgctgtcatcagcccatcatggatggaattggcaaactatagtaattggagcttcctttctggcttttcttctgtatgctaagtatattggaaagaagaacccgaaattcttttgggtgccagcaattgccccattgatatctgttattctctctaccctttttgtattcttaatccgtgcagacaagcatggtgttgcaattgtaaaacatatagacaaagggctcaatccttcatctgtcaaggaaatttattttactggtgattaccttgggaaaggtttcagaattggcatcgtggctggcatgatagcattgactgaagccacagcaattggaagaacatttgcttctatgaaggattatcaactggatggaaacaaagaaatggtggcattaggagctatgaatgttgttggttcaatgacttcttgttatgtagcaaccggttctttctctcgctcagcagtaaatttcatgtctggctgtgaaactgcagtatctaatattgtcatgtctgttgtggtgttcttaaccttacaattcctcacacctcttttcaaatacactccaaatgtcattcttgctacaataatcatttctgctgtcatcaaccttgtggattataaggcagcaattttgatatggaagattgataaatttgactttgttgcttgcatgggagcattttttggggttgtttttgcctcggttgagataggacttttaattgcagtctctatatcctttgcaaagatcctattacaagtcacaaggccacgaactgcaattctggggaagatccctaggactactgtctacagaaacatccaacaataccctgaagccacaagggttcctggtgtactgattattagagttgattctgcaatatatttttccaactccaactatgttaaagaaaggataaacccagtcagtatcaaatatcttatgtga

SEQ ID NO: 82646 - DNA, 318 bp, Glycine max
  Peptide Sequence Number=SeqID_174331
atgcagaaggtattctgcgcttcactatccatgttcacacattattgcagcttgtggttacagcacatcttaaaagcttactccgcacaatggtggcctcttggaaatgaagtagctattcctccttctaatgatgcatggacacttatccctgacccaactacaattcgtgcgaaaggtcagccaaaatcaacaaggataaggaatgagatggattgggtcgaatcatctgagcaccgacaaaaatgtagtagatgtggagccgaagggcataacagacgtcgctgtccaatgcaatctgagcgtgggagttgttaa

SEQ ID NO: 82647 - DNA, 435 bp, Glycine max
  Peptide Sequence Number=SeqID_174332
atgtttgtcgacccaaagaatgcaaacacagttacattggctgaagttgcggagacattacagtatatggtgtcaccgcaagggaggaacacatggacagttgatgatcttgtgccttatgtggagaagatcacgattttattagaagagcaagagagaatcactgagccgatgtatcagtatccgttcaaaggtcatcacactgatatgtctgcaagcgaacattcatttggtgctccgcattggaatgtacccggagcaatacctgatatgggtgacttattaggtgttgatttgagtcaagagttttttgctgaggctgaggaagtacaagcggggaggcatcgtggcagaagaaatcctgatcgtcaagcgcgaagatgggatcgaccatgtggcacatcctcacgtcaccacggacatgataatgaatga

SEQ ID NO: 82648 - DNA, 1203 bp, Glycine max
  Peptide Sequence Number=SeqID_174333
atgaagactcgtacctctaagaagatctctgcaaaatgggttccaattttctctgtatcttccttccttattggaatgctcataacaaccaggatgtgggaaccaccagaatctaacggggtgttactgtcaaatcaccgacatgagcaagaactacaagtggtgtcaggggattgtgctactaaaaagcctgtgcaggatgaggatgtaatgagtaaagtgtacaaaacccatgaagccattcagggtgtcagatctctagacaagcaagtttccatgcttcagatggagctggcagcagcaaggagtacacgagaacccgagatctcggatggttcgaataacaccttggcctcgggggtaaccactgaaggcccaccaaggaagaaggtgtttgtagtgattggcataaacactgccttcagtagcaggaagcggcgtgattcggttagagagacttggatgcctcaaggtgaacagcttcttcaattggaacgcgagaagggaattgtcatcagattcatgattggtcacagtgcaacttctaacagcattctagatcgagctattgattcagaagaagcccagcacaaagacttccttcgcctggaacacgctgaagggtatcatgaattgtctgcaaagacaaaaacattcttttctacagcagttgcaaaatgggatgctgagttctatgtcaaagtggatgatgatgtccatgttaatttaggtgtacttgcaacaacccttgctcgtcatcgttccaaaccaagggtctatgttggatgtatgaaatctggacctgttctttctcgaaaggatgttaaatatcatgaacctgagttttggaagtttggagaagaggggaacaaatatttccgacatgcaactgggcagatatatgcaatctctaaggatctagccacctacatttccattaaccagccaattttgcacaaatatgccaatgaagatgtgtcacttggtgcatggttcataggtctggaagttgaacatatagatgaccgcagtatgtgctgtgggactcctccagattgtgagtggaaggcacaagcaggtaacatatgtgttgcatcctttgactggagctgtagtggaatctgcaagtcggtagagaagatcaaatatgtgcactcaaagtgtggtgaaggggatggagctgtttggagtgccttagtttag

SEQ ID NO: 82649 - DNA, 432 bp, Glycine max
  Peptide Sequence Number=SeqID_174334
atgaggtctttcagcaaactcatttacgaaaggatactggaagaatttgaggctagactatctcaagctaggtctaatgctacatcaagtgttggtgaatcccaagtcactcccttagaccctactgaagaacaaagacttaggagttggtgttgggttgcagctgtaggaccaaagcataagggacgcctttatggtattggagaccttgttgatacttacaaatgcagaaatgacagcttcatgcagcatacgcaaggatcttccagttgtgctgaagatgctacagagattaaccgcccgagggaagagctgcatcaatcaaaagaggatatgcgcgtttttcagtcagtagtccttcagctcctacctctagaggcacagaacattattcattaccaacaacaatctcaccaacagcatcagcactag

SEQ ID NO: 82650 - DNA, 309 bp, Glycine max
  Peptide Sequence Number=SeqID_174335
atggctttagcaagcatcctgattataaagttctcctctctccggctcaccggtgtgaaagaagaaacacttgtaatagagatgggtgagagtgcattgctgacaattgcttgtgggaagaacaaagcaactaagtttcaagctaatcaaaaggggaatggtaaaataccatctcaaactgatattaagaaggtggaaaagtgtttcttttgtaagaaaaagggacacataaagaagaattgccccagattccaaaaatggcttgagaagaaagggtatgcaaaacctaaggaaaccagtgggaagtga

SEQ ID NO: 82651 - DNA, 249 bp, Glycine max
  Peptide Sequence Number=SeqID_174336
atgattgaaatgcttaccttggcggccgacgctaacgatgctcgacggtggacgctggttcgtggttcgtggctcctcttgacggcaacacgactcccttcacggtggttcgtggctgaggaagaagaagaagatggtagcgcgaggaagaaggatggctgcaaggagaatgcgaggaagaagaagaagaatgcgaggaagaagaatggctttgtggggggaagaagaagaatgcgaggaagaagatga

SEQ ID NO: 82652 - DNA, 684 bp, Glycine max
  Peptide Sequence Number=SeqID_174337
atgttgttcaagctaagcgagtgtgtctcgcttagccagaatgtgtttttgtgttgtcacgctaagcatgctctgtgcactaagaagaggaaagccaccgcctctagaccccgggagccctatgacaccactcaatttatatcagagggcgcctgggagagatattcacagaacgttcactcccggaacatccttccagagaggaacgtcgttctttatgttaatgagtatgatgagttccgcagagaactcgagaggcgctgctggcacaaggccttgaccaggcagttggatgggcatattgatgtggccctagtcaaggtattctacgctaatctctatgatccggaggacaaatctctgaagcaggttagggtgaggggcaaattaattaagttagatgctgagtccctcaacaccttcctggagactcttgcgattctggagcctggggagcagtacaccacctacaccagattctgtcattcgcgcccagaccctcaggagttggctgccagactttgtattccagggtgcaaatttgttcttaatgctgaaggagcactctggaagctcctaaggaaggacttaaccaccttggcccagacgtggagtgtgctctcatactccaaccttgcccctacctctcacacatctgaccttaatatagaaaggcgaggttag

SEQ ID NO: 82653 - DNA, 285 bp, Glycine max
  Peptide Sequence Number=SeqID_174338
atgagtgatggattttgcggtactcatttgcagatcatggttaggactagaggattaggtcgtgccttaggtcaggtcactggcagagtcatccctgcgtcagatgttcaggatgacccggtggaggcaccagctgctgtggaggacattcctgcggacattcttgtggacgcaggcgtagaggcggctgaggatcagcctcagggatttccgggtggtccgagcgacccatccgtgttgacagcgtatgcggatcacgttgcttgcagcgtatggacgggagag

SEQ ID NO: 82654 - DNA, 429 bp, Glycine max
  Peptide Sequence Number=SeqID_174339
atgcagctggcctttggacaaaaatacagcctcttgttcatcaatctgaaggaatatatcacagaacttatctttaaaatcatagactctttgcatcatgatgactaccagagatgggcaatttggcagtggagaaatgagaaaatatgggagaattttgaaacaccagcaatgatctttgtttctttggcataccaaaacttgatcgaatggaaaccggtcagaactccatcttctaaacctgttcagcatcagcaacgaattgaatcatggcatcctccgcctacaggccgtttaaagtgcaatattgatgctttgctatatatacaacaacttgacgaatggctatcccaacccagcagaactcgaagcttggagcttattgcatgctcttacgtggataaaggagcagaatcttcagaacattga

SEQ ID NO: 82655 - DNA, 384 bp, Glycine max
  Peptide Sequence Number=SeqID_174340
atgtgctctctcagcttgaactctggtctttacgaccgcgaggtccaactgtccagggaacgacaactttttggactgtgtgcccctactttcggaaccttttcaactaggacaagaggtccatggatcacattttgttgtgccacattagggcatagaaaatgtttaggtgatgtattgaatgttagagaactgacaatagcccatcatcatgttgttcactcctattgcagccgccttcacagcatccattctctgtggggacaaagaatttggaacaacttgaagatcatgaaaggaggtgagacaatgttgacactactacgagtatgtttctttgccaccatccagcattatatcttcactgccggtgaagatgagtga

SEQ ID NO: 82656 - DNA, 1281 bp, Glycine max
  Peptide Sequence Number=SeqID_174341
atgaaccacctaccgcgaatattcggcaatagaaagaagcaagcctccgacatggacccgacgaagaagaagaagaagagtaagggtaagaagcatcagcagccgaagctcgagcgccgcaacgccgccaagcacttcgaatacgacgccggatcgttgtgctcgtcgcgcgatgagtacgacgcctcgacgtcgtcgtcgtcgtcgttgcactgcacgcgctcgatggagctcttcgaccgcaagagcttccgaatcgagggcgtggagggcgagttcgaccagatttgccgcagcctcggcctctccggtcccgaggacttctccattccggccgccgcctgggaggccatgaagctccgttgctcctcggacctacttcctcgccgcccgaagcacggcggcgaggaagaggaattcgacgaagagccgaaggagaaggagaaagaggaagtggaaattgcagtattagagagcgaggatcgagctagggttttggatgaatgtgttgttcctgctgagagcagtggttgctgtggtggaattaagggttttcggcctccgatgttgaagccgccgccgggggttagggtttcggtggtggacgacgccacgtgttccacgtgggatttgatgcgggattttgcgccgaaaggggaaggaggagggaaggatagttacgtggaattaaattcttctgatgatgaagatgatcatgagcgagaagagaaggaagaagaagaagaagaagaagaagaagaaggggaagttggtggagtgagagtggagagtgtagaagaggaaaatgcggcggcgattgcggagattgtgggtgatttttcagggttttctacttcgaatgaagatgattcttctagcactagcactggaccaaggtctaataatatatctcccaatgggagaatcaagcgtgttattaccgcgggtaactggcagaagggtgagcttttggggcgaggttcgtttggttctgtttatgaagggatttctgaggatattaaatgtgcaaatatattggtggatgcaaacggatctgttaagcttgcagattttggattggcaaaggcaaccaaattcaatgatgttaagtcctgcaagggaacagcattttggatggcccctgagggtggtagttatagaggggaggtgtggaaggagagtagacctcttggtattctcgttgcttttctcttttggcttaggcttcaggctgagagtttcttctctatggaacacttgctctgtgaggggaggctatag

SEQ ID NO: 82657 - DNA, 732 bp, Glycine max
  Peptide Sequence Number=SeqID_174342
atggggtataaattatgttattttaagagggcgagccctggtgcagtggctgcgtacaacatccctcccccataccttcgcatagcgaagagcctctgggcaatgggggatattagatgtgcaaatatattggtggatgcaaacggatctgttaagtttgcagattttggattggcaaaggaacccaaattcaatgatgttaagtcctggaagggaacagcattcttctggatggcccctgaggtttgccttcaatctcctcctctaaagaaagctaaagaggagagcacacaaaagaactttgatgaaggcgaaactgcacaattagggttgtccaaggtggttgtcacaaagggggcaacaccaaaccaacatgaaatggcccctaacctcggaaatgtgcgtgcagaacctgtttggcacggagaaatagggcatgtgcggatgcgggagcgtggctcattaaaggttgctggaggatggcggcagttgctgaaaaatgagttagaaaagctaaaaatgttgctagaaatcaagcagctagtagaagggtccactggaatgtggaaagccaaggaaagaagtttgccggaaaagggtggtagttatagaggggaggtgtggaaggagagtagacctcttggtattctcattgcttttctcttttggcttaggcttcaggctgagagtttcttctctatggaacacttgctctgtgaggggaggctatag

SEQ ID NO: 82658 - DNA, 630 bp, Glycine max
  Peptide Sequence Number=SeqID_174343
atgggtgcttccactgtcgataagtacagtgacgtgagtctgatgaatgaagccataaatctggaaggtcagggtcttctatgggaaatgatcagggtttgggtgagggtcaattggtgtgtctccaggttctgcgatgaggaggaatatccgggtcgacgccaatcctggattttgtcttcctgtaatttggcaagtgttgtggcatggggcaacgatatgcgttgcatggctaatacctctcggcgaatgtccggtgagagaccagagatgaagcaactaagaagaaatggaggtggtaagccaattatccggtcatggcaaagtgggattctagtgcctgtagaaatcccggccatgagtggtggtggaggcataggcataggggaggggtggttgaggcagtcgaggagtaattcgaccttagttgccagggttgtcgccattacgactggcgagaagcgtggtgcagagggtctcgccattacgactggcgagaagcttttcaaaaatgcaaaaatcatttcctatgagtattttcctataaaagccattggaatgcatcacttatcctctctagttcacataccaggctcaaataatattgagtgtgtgtttcacttgtgttag

SEQ ID NO: 82659 - DNA, 546 bp, Glycine max
  Peptide Sequence Number=SeqID_174344
atgtcaaggcagagttggatcttttcggtagatccatttgcatatgttttgtggcaacgtgagagtaacggttacggtcaagacaattcaaatgccagggcggaagatataggcagagaagggtgctttagtcaatttaaactaatttccattttcctcccttggtcttggactgcaatttttctttttgctttgattttctttctgttcttagtttgttatcagtcattatcaagtactagtggtcaagttgacccggttaacaacaacctcagaacggggatgtcagaagttgggattgtacataacatggttgtgatagcaacccaaaggcaaattgccctaatggggctcctttttgaaagtatttgtttcaaaacaatttacaacatgggtctgttattttacgtaaaatacatgcaaaccgtcagtgttactggcaagaagcccctgcgtgcaacacgtggcgaaaacgccactgccactagcggaatagtcagtggtctcgctgcttgtgctggcgatatagccatgcatgggatgtag

SEQ ID NO: 82660 - DNA, 924 bp, Glycine max
  Peptide Sequence Number=SeqID_174345
atgattgaggaggatatacaagtattagttactcgtgtgagcacaaaggggagctgtgctgaacaaaggggaggatatacaagtattactccatcaggggaagagcatgtcactaatgttaggccaataatggggttgcatgttgaacatgatcattctactctagtggcattgggaaaaaaaacccttcacactttcattgcattgctgagacatctagtcaaacttgtttcacatgagattcgtccaaagaaacatgatgaacctgttcataggttgactgttgttagtggaactgatcccttacttgatttgattcaaaatatgtctgatctttatgagaagcctcttgaaatgttgtggaatggaactcaatttgggattccaaatttgtggatgatgtttatgaaggagtcgagttctaggttgggttgtggtcagctgtatggattccttaagcctcaatccatacataatgcaaaggatagatgtgatgaagcccaaaattacattgaaacatgggtcaaggaatcacagagagaggtctacctaggaccttacttgaatcacttgttgttgtgtgtcctaggaacgatgttattgtctggttctgttcattgtggagtaatggaggcaatttggataagttgtgctagatatcccactagaaagaactttgatgaatttgtccagtggtttactattctagaacctaatgttgtaaaagcatgccccaatgagatgatagcttgcaagaggcttctagatagagcaaaccttaaagagtatcagttgtctgccatagaacttcaaaaggttgctagagggttactacagaggttattcaactcatacttatttccaaagactaacgaaatcaacaattattgcacaatgtttctagaggacaacattggcacgtag

SEQ ID NO: 82661 - DNA, 339 bp, Glycine max
  Peptide Sequence Number=SeqID_174346
atggaacttatttacctaagcttgatggatcaacgactcaagaacactaggagcaagattggaagaagaagaaaaactggacctgtttccctcaatgttgaactttgtgaaaaacatgatttttttcactctcctcctctccaaatgcctacccaaaccctaacaccttcttctccaccacccacaaccatcggtggccaccacaagccgccgttgcttgccgccaaaccaccacagcaagaggaacattttaattggagcagaatccacctcaaggattcagtggagaaaaattcctattgcatactggttttcaagaaaaataatgtttttgactaa

SEQ ID NO: 82662 - DNA, 408 bp, Glycine max
  Peptide Sequence Number=SeqID_174347
atggaatactgcctgaaaggagtatacgggacttacgggagtggacgcggtggaggtgtcggtcctcatcatatgttaagggtggcgtctacttctaggcaacaggaaaaggtgcagaacaaaaacatgaagcaacaagccggagaaactaaggtcaaaacgcaaagcactatcagcaggcaaaacaagatgcagaaaatcaagacggaagcaacaaataagcaacacatcatacatagagaaaacataattaagcaacagatgagacatagagtaatcatcgacccggtatggaggtcctcaaaaccttgtgaatgtgaccaacaagaacctgtaatgaggaagaagatgaaatggctgagacctgaagttggacacacgatgcacatggaaagggggaaatgttga

SEQ ID NO: 82663 - DNA, 281 bp, Glycine max
  Peptide Sequence Number=SeqID_174348
gacaacccaaatccaaggggaaggatacaatcctggtggtggttgacaaactcactaaatatgtccacttcataccattaggacatcccttcaacgctatcgaagtagccatagtttttctacaagaaattgtacacagcttaagttcagttcaacatatcatccccaaactgacggacaaattgatgcaatcctaccccgcaagggcattggttagaagactccaagtagattgggctagagatccaaggaaaggccctaaggttctcatgagccttagg

SEQ ID NO: 82664 - DNA, 426 bp, Glycine max
  Peptide Sequence Number=SeqID_174349
atggccattgttcagaacctggggatggacaacaagaagaggaggaccattatttgcaaaaccaagccagacctcaacaaaactttcaaggaagctaccaagaggtggctcaggggtccacaacaacaacaagctcctccagatagaatgtccaagatggaagatactttaacacattttatgcaggtatccatctcaaaccagaagaacactgatgcttttattaaaaatctagaagttcaggttggacaactggcaaaacagctatctgaacatggaagtggatctttctcagcaaacacacatgttaacccaaaggaacattgtaatttaattacaaaaaggtgggggactatggttggtttgaaggataatggtgagaaaaagaataaagaaggagttgaaaaagaaaaaatgatgaagtag

SEQ ID NO: 82665 - DNA, 177 bp, Glycine max
  Peptide Sequence Number=SeqID_174350
atggcagtagaatggagaagaagaagagttgagaggagacaccacttcaaggagaagatgagtcaagaagaagctcaccaccataggaagccatggataagagcttggagtccactaatccaagatcaagtcccagattctccattaagtatgcttaggcatgtaaagcatgaatga

SEQ ID NO: 82666 - DNA, 243 bp, Glycine max
  Peptide Sequence Number=SeqID_174351
atggttaacacaatcaagattgagaaattcatagggaagaatagcttcaggctttggtgcatcaagatgcaatccttgttgaaagaacggggcatctgggctcctccctccagtcaatcatcaaagattgataagtcaatgcttgagttacaagaggaaaagtcacattcgctaattctcttatctttgtctgatgaggttctttatgaagtttctaaaaaactgactattgttgggctttga

SEQ ID NO: 82667 - DNA, 345 bp, Glycine max
  Peptide Sequence Number=SeqID_174352
atggataagcgctcctgggtgcagggccaatggatcccctataatgaagatgccatcaaccagttcctggggcatccattggtcctaaaggaggggcaacgttgtgagtacatcaagagaagaagtcaggtcttaggatttgatgaggagaccataggccagctactgtgcttcccgagacaagactttgcaccaagcgtgatgggaaggcatcacacctccaagacacccagtggacccagaaaagtccaacagagaactggaatttccagctttgatcacaggttacccccacaaagctcatccgacaggcatagcagtcggggcaggaacgtaacaccctga

SEQ ID NO: 82668 - DNA, 1475 bp, Glycine max
  Peptide Sequence Number=SeqID_174353
tcaagaacctagaactagccagcttgagagaacaaggacagtggatggatcaagttcaacgtcaagccttcagcaaggcatatgggaaaatctgggatttgaccatggtagaagtgtccgttgaagccatcacatccttcgttcaatattacaaccaatcactcagatgcttcacttttggggactttcagttgacaccaaccatagaagagtttgacgagatcttaagatgcccatcaggaggaaggaagtcgtacctctttgccggattctacccttttatggcaagaatagaaaaagtgatcaagatcttgaaacaagagctagaccgagtgaagcaaaataggaatggggtggtagggataccaaggaagcgcttggaggagaaggcagaagctttggcaaatcaaggggactggttccctcggtggaaagaaggaggggcagaagtgttatgctcgtgtgaaggattcccaaatgtccccttgatgggaatgagggtttgtattaattataatcctatgctagccataagacaactaggctaccctatgagaggtgcgtcatcggaggagatcatcgtgcctttcgtcgcgcgaggtttcattgaagccaatgcaaaaatacttcaaagagtccgtaaagcgtggagtacagtggaaaggaaagataaggagcttaggggaagtagcaatggcatcatcggcggttatcaaaagtggttgaagtctaggatgcaagggataacttggctcccaaagctaaaaggcctaagtaggaaacaagccgaagtccctgaggaaaacgaagaagtgcaagctttgaaagcgaagctcaaaaaaacgagagtggtcaaggagaagctaaagacagcagtcactagggtccgaaaagagtgtgatgagctgagagaggtcaacatgactatagtcgaagcattagagcgggaaacaaaaagggcccgaaaggaagaatggagcgagaacaagttccgaggggctctatggggcagcagcaacaagctcaagcttagaaaggccaagagggaagagtcaaggatggaaagcatgatgttagaggataagttgaaggtttgtcaaaggtcgaagagaagcttgacggaacagctaagcataacagaagaaaatatgttgacaattattgatcaatataaggagaaggtgaacctagctgctagtcatgggcagaggctggaggatgaacatgcaaaggtatcaactctgcaaattgaaagggaagcaagagagagggtgatagaatcattgcacagggaagctatgaaatggatggataggttcactctcactctgaatgggagtcaagagcttccaaggttgttagccagagccaaggcaatggtcgacacatacttggctcctgatgaagttcatggtcttttcgattactgccaacacatgattaaactaatgacccgcataattaagaatcactga

SEQ ID NO: 82669 - DNA, 195 bp, Glycine max
  Peptide Sequence Number=SeqID_174354
atggacgagtttggcagtggagggcacaagttcaatgtggatttcaacctcccgacgagattttgtcagtcataccaacagttgaatcttgctttgcaagataacctccatggccatcgactctatggttggtggtggtttgacgtagtgaactcgagttgttggtggttgttgatgtctccggcagggccatag

SEQ ID NO: 82670 - DNA, 216 bp, Glycine max
  Peptide Sequence Number=SeqID_174355
atggaggagttgattaacaaaagacaactttctctcaaaataatctcaatgtcattacgttggcttggtggctccacaaaagaatctcactcctcatcctctactgttgtcattctgctcccacgaacaaggattcgtgatcatcacagtatgatgcatgtgtctgacctcaaccctcagttgcaatgtggtaacattcccaaggaaatagcctaa

SEQ ID NO: 82671 - DNA, 300 bp, Glycine max
  Peptide Sequence Number=SeqID_174356
atgtctaaaaaaccagtggaatactcaatgctaaaggtgtttggatgtccaacatactatcacataagtgaaagtaagctagagcccaaaaccaagaagggattctttacgggctatggagatggaatcaaaggatttcgaggcaaggttgaggatgtcactaagcaagtggagtttaagagctccacaataagcagcattagtgatcaaaaacaaattgaagcaccaaatgaggctgatcaggatcttcaaatgcaccatcaacataagaatttagcactagttgaagggactaactag

SEQ ID NO: 82672 - DNA, 405 bp, Glycine max
  Peptide Sequence Number=SeqID_174357
atgcataaggcattacgggccaatgcacctctgccttatcctcaccttgttactctttttcttcatcatttcaatgttcctttagatgatgaaccatttgtcaaggtcaaaaggtctttctcttttggtgctggtgcggttacctcctttggttaccgaaaggatgttaatggtcagtgggttcacaaacaagacttgccaccgcctattcccgacgaacttaccctatctcctccaccacaaagggttgattccacttctcttctgactgaagtacttacagagctccgcgaccttcgagcttttataggtgagcacttcgatgtcatgaacacttggattactaggcttgaagatgatatgagcttcatcaggcattgcttcaatccctcggccgactcttag

SEQ ID NO: 82673 - DNA, 462 bp, Glycine max
  Peptide Sequence Number=SeqID_174358
atggcttcttatgatgaagtaaaggactccattgatgaagaagatcaaggcctacaagctctacacggagccccattacttggtagtgtacaagatgcctttgtttgtaaggaagttaaagcacttctaggcagaaaggtatctagtggacgcaaaactcttaaggattttcaagacttggaagaaagggtaaaatccttaaaagctcttaaagattcagaagaacaatgcaaggaaatgtttaaacaaaaactcttacttcaaaaggaatgcacccttgctaatgatgaacttgataagctgaaaatgaaaaactcggatctatggatgaaattgggtcatgagattcataagtgcaattacctccctgaaaagggcaacccatcaaagggtctatccaatgcttaccagcacccacttgctaacaaagaaaaaggacccaaaaagatttggggtacctaa

SEQ ID NO: 82674 - DNA, 447 bp, Glycine max
  Peptide Sequence Number=SeqID_174359
atgagcgatagccaagagacagaaccaaacccaaacaaccaggctaaacttgacttcaagaacaacccaccatctgcttcattcgaagaaggtgaagttgtacaaatcgtcagatctacacgaatgtccattgtcactgtagaagtttcattgaaagacaaagagcctaaggttcacattcaacacttctttgacattgagtcattggagactattgggtgtattatcaaggcacacctaatgttgtgcaacatccaccgcttcttcgagaacctaaaggtggtggtgcctaaattcatccgagagttctggaggacagccaaggtctatcattatgaggtaattagcaatttttttgttggacaagtacttggcattattgtgaagctatcagtaaaaaccattgctcaaccattggttgtgagcgtaaaggcaccaagttcatga

SEQ ID NO: 82675 - DNA, 273 bp, Glycine max
  Peptide Sequence Number=SeqID_174360
atgatgatttggcctctatgcaggctctgtagcatagcaaataatgtctcagaggtgaatgaagatggtcctgtaggaggagttggagtaggaactggagctagtagaaggagaagagagatattgcgcaaaattattatgcttcgtgaatacatcaactggattctccctcgtcacaactatctagaatttgaccttcttcctagaatgcatgaagtggtatctgatttcaatatgcttagtcctctcatgatggacttgatccttggctaa

SEQ ID NO: 82676 - DNA, 462 bp, Glycine max
  Peptide Sequence Number=SeqID_174361
atgatgatctggcctttgtgcaggccctacagcataacaaataatgtctcaaaggtgaatgaagatgatcctgtaggaggagttggagcaggaactggagctaagggagtgggagctgaagctggtaactgtggaaaatgtggagtcaatgtggatggtgctgaaggatctggtaaagtagatgaagaaggagaagaagtatctgatgctgttgaagtagggggagcctcagatctcttaccattgtccttccttggccttctgaatgtcactgttggatcatctagattccaacagttcttctttatatatgccaagttaatggcagggctaaggctctccaaagatcttgaatctgatgtggttcctctagctttacacaaagttgtgattaagactagaaatccaagcctagaggagtcatgttgggcaatgatagaaatctggtgggagatgaggtag

SEQ ID NO: 82677 - DNA, 297 bp, Glycine max
  Peptide Sequence Number=SeqID_174362
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccgggtag

SEQ ID NO: 82678 - DNA, 588 bp, Glycine max
  Peptide Sequence Number=SeqID_174363
atggcgataacgcgctcgaccagagaattgtcgaagcgaagagcaacctcgcagaggaaggccgtttttaccggtcggttattaccgctgtcattgtttgtgcgctattgcttgttcttaaccactttacggccccggccagcgtatggtcattgtgggtatcggggatctggtttgcactgctgggaggcggctgtgaagataacgaagattgaccacatacacgtatacgtcgagaacatcaaactggcagaacgctggtaccatgaggttcctggtttttcccgcgatgactcgctgtatttctggtttgagcagggagggccgctggttatcagaaatcacggcgcatcactttccctgtttcccaggaaaaatcagcatcccggccatacggtggctttcgttgtagaagcggctgagtttctcagttttgtgcctgctctcaacgccaaaaatatcccgtttaccgtatgcgatcacgatgtatctttatccgtgtactttaacgatcttagcgataacaagattgagctgaccagctacgaataccttcaggcaaagcagctactggagagcgttgtatag

SEQ ID NO: 82679 - DNA, 210 bp, Glycine max
  Peptide Sequence Number=SeqID_174364
ctcagcctcagtcagcatgggcagggttttgctcctttcgcgtgccctactctagatcagtttagggctgaggtcgcatggcccggagattggcccgaggcccatgcaggggaggcacctgcaggagctcccagcgatgcagaagaggcccgtatggatgaggagatgacgaacttgctcgatttcttgggaggaagcggagccacgtga

SEQ ID NO: 82680 - DNA, 537 bp, Glycine max
  Peptide Sequence Number=SeqID_174365
atggcaagagtagcaaaagtggtcaagatctcgacacaagagctagaccgagcgaaacaaaacagaaatggggtggttgggaaaccaaggaagcgcttgcaagagaaagaaaaaactttggcagatcaaggagaatggacttcattcattgatgttttagcactgttggtgtttggaatcatcctctttccaaatgttgacgggctagtgtatctagcggcgattgatgtttttcttgcttatcaccacagcaaggaaagtccggtcgttgctgttttggttgatgcctatgacgcgttcgaccgaagatgtgagaagaacagcatgagaattgtctattgcacacccactctttatgtatggttggtctcccccatttttcatcatgaaaatagacccatctgtcccctgcaaggtcatcgcatgtgtgccgagaaagggaaagcaaattgggaagaactcttggcaggaatggtaggggcatctgttaattggttcccccgatggaaggaaggaggggccgaagttttatgctga

SEQ ID NO: 82681 - DNA, 782 bp, Glycine max
  Peptide Sequence Number=SeqID_174366
atggccccgaggccagctccgcctcaaagaggtccaggaaggataaagcggccgaaggaaccagttccgctcccgagtatgacagccaccgctttaggagtgctgaacaccagcagcgcttcgaggccatcagggttcgccggcggtgggcatcactggttaccccccatggccaagttcgacccagacatagtccttgaattttatgccaatgcttggcctacggaggagggcggccaggagtgcgagtatggccagaggaggaaccggtctgatggttttgatgaggaggccatcgcccagttgctgtgtataccgaggaaggattttgcccgaactgctacagggaggcgagtgtggatcatgcgcaccaacatgaccaccctgacccagatatggatgacgttgctgctcagcaacatcctgcccagcgatcataattccgacctccctctgccgaagtgtcagctggtgtacgccatcctgacgcggatgagtgttcatgtggctcagttgatcgctgatgccatctatctatttgcaggtatggcgccgaccaggcaccctttggacccagataagtccaacagggccctgggttttcccgcactgatcacaggactctgcctgtcgttcggcgttcccgttgcacctaccaaggtgattcgaccgcccatcacccgggcttttattgagaagtactgcacccagaggcaggctcagggtgatgctccacaggccgcaggcgcgccaccaccacctcatcaggctggcccagctgg

SEQ ID NO: 82682 - DNA, 465 bp, Glycine max
  Peptide Sequence Number=SeqID_174367
atgaccatgattacgccaagctcgaaattaaccctcactaaagggaacaaaagctgtttatctcaaaatatctgtcactttataaaagaatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 82683 - DNA, 456 bp, Glycine max
  Peptide Sequence Number=SeqID_174368
tcattcggagttcccgtcacacccagtaaggtgattcgaccgccgatcacccgggccttcattgagaagtattgcacgcctagacaggcgcagggtgatgcaccacaggccgcagacgtgccgccaccacctcatcaggctgacccaactgggtcatttgacacggagcagtatttacggcactcgattcgccagcacgcggccaaccacagggggctggggcaggtccatgagtgtcactaccagctcagcctcagtatgcagagccagggtttcgctccttttgcgtgccctactccagatcagttcagggcagaggtcgcatggcccggagattggctcgaggcccaagcaggggaggcgcccgcagaggctcccgacgatgaagaggaggccagcatggatgaggagatgtcggatttactcggtttcttaggagggagtggagccacatga

SEQ ID NO: 82684 - DNA, 408 bp, Glycine max
  Peptide Sequence Number=SeqID_174369
atggtgttggatctagaagtcctcgcacaattccttcatcatcttgttattcagattggtggcattgtctgtgataatattcttgggcagtccataccagcagattatttcctttttaatgaatttgactaccacgattctcgtgacactggagtacaaggcggcttcaacccatttggtgaactagtcgatcgcaaccaagatgaagtgatgcccgttcgaagccttgggctcaatggccccgatcacatctattccccacatggagaagggccacgatgctgccaaaacgttcaaaggcatgggcggagcattgacattgtccgcgaatgtccggcacttatggcatttcctaacatggatgcaacaatcgctctccatgaagagccagtaatatcccgcccttag

SEQ ID NO: 82685 - DNA, 431 bp, Glycine max
  Peptide Sequence Number=SeqID_174370
gctccctcgctacttacgagctcaaaaacggagtgtggttgctcgttatagtgctgaacagagtaaagggcggacgagaaggccccgggcccggatggaacgctcgatttttcaaagattgctggaacatagtagaaaaggatgtgactaggtccaaaacttctttcggaacgggaagtaaaggagaggatgtgaaaccgaaagacttgaacttctactggagagcctaccacaccggagtggaaagagagggaaagagtctttcttctttgtcgccttcgatctatgaaattgcgagatctgcatttgagagagtccgtgcgaaggctactagttcaactgcttcaccaacgagttcagcagctcaagtcaaggccgataccgcttgccgggaaggacactctcgaatccgaatcaaagagaagggatag

SEQ ID NO: 82686 - DNA, 1607 bp, Glycine max
  Peptide Sequence Number=SeqID_174371
atggcagtttcacttcccgtgatcgggcatccacagcgcttttcttttcatagtcagggcctggatagccaagcattggccgagctggcctgtggtttaaaagcaacacaaacgcctttggtagtgctgacggccagtgcgtttgaagcgcaacgcctgatggatgaaattccgtattttggtaaagatattcaggtacatttgctgccggattgggaaactttgccttatgacgtgttttcaccccatcctgatttgacctcggagcgcctggccacgctctatcagctgagccagaatcagagcaatgtggtcattgtgcccatggccacggccttgctgaggttgccacctgtttcttacctggccgctcatacctttatgctcaaaaagggccagaagctggatgtagatgctttgcgtaaccagtgtgctcaagcaggctaccaccatgtgagccaggtcatggggccgggtgagttcagtgtgcgtggcgggctggtcgatttatatcccatggggagtgcgtttccctaccgtatcgatttatttgacgacgaaatcgagaccatacgcacctttgatattgatacccagcgcagcgtctatcctgtgccagaaatccgtatgctgcctgcgcgtgaattcccgatggatgaagcagccattacgcgcttccgcagccagttccgtgagtattttgaaggcgatccgcagcgcgcaaaaatttataaggatgtgagcaagggtacccctagcggaggtgtcgagtggtacctgcctttgttctttgagcagacggctactctgtttgattatctgccggcacaaaccgtactttgcctgcacggtgacctagacaaagcagcgcaaaccttctgggcggacgccaatagccgctacaaactgatggcttatgatgctgagaaaccgattttacgggcagaaagtttgctacaaaaggccgacgaatttttcaaacagacacatgcgtttgccttggtttaccagcagcttgagctgcaaaaactgttgcctgctgtggatgtagaccgccgtgcagagcatcctttgcacaagttgcaagggtttattagccagtttgatggccgtgtgttgattgccgcggagagtctgggccgtcgggaaacgattgcacagttattcaccgaacacggcgtcacgttctcgctggctgaagattgggctggatttgcacagtctaattttccggtcatgctgggggtcgcgcccttgcatcaaggcctggtggatggtgataaggctgtcattaccgaagcagaactgtatgccagtaccgtgcgtcagcagcgccgccgtaaccaggaaaaagcacgtaatgctgaaggcatgctcaaagatttatcagagctgcggctggacgatccggtcgtccatgagcagcacggggtagggcgttataaaggcctggtcaatatcgactttggcgaaggcgaaaccgagctactgctgatcgaatattttggtgatgacaagctgtatgtgccggtgtcgcagcttttcctgatctctcgctactctggcggcccgtctgagagcgcaccttttgcatcgtttgggcagtg

SEQ ID NO: 82687 - DNA, 1679 bp, Glycine max
  misc_feature (1563)..(1563): n is a, c, g, or t
  Peptide Sequence Number=SeqID_174372
gcacagatcacatcaacggtaccggaaatgcattggcaaataccatcactggcaatgctggcgacaacatcctcgatggtggagatggtgtagacaagctgatcggcggggctggcaatgatacttatatcgttgacctcgtccgcacaggcactaccgctgccaactacaaggtcacactacaagacaccatcactgaagctgctaatgccggcaatgacaccgtgcaattgcgtttgctcggcagcaccgattacagcgctatggcaagtgccaccaccctcatccttggggctaaccttgagaacctcgatgcctcagatacagggtctaccaaactcaacctcacaggtaacgctctcgccaataccctcacaggcaatgatgcagataacatccttgatggcggtgcaggcgtagatacgcttgtcggggggagtggtaacgatacctatatgctggacctgaaactccagggcactggcgctggcgctactgtagtgattgaagattcggttactgagcttaacggtactaccgaaggtattgataccgttaaattacgtgggaccgctaacctcaccacagctacaacactgaccctggataatgactgggctaacattgaaatcctggatgcttctgctactggatcaaccaagctcaaccttaccggcaataatctcggcaataccttaatcggcaacgctgcagctaatatcctcatcggtggcactggcgacgatacgctcaacgggggcgccggggctgacatcatgacgggcggcgatggcgatgatatctatatcgtcgataacgtcggcgaccaagtcattgagaacgacggtgaaggtacggacgaagttagagccagcatcagctatacactctcagataacctagagaacctgaccctgactggcactgctgctatcaatggcactggtaacgagctggacaatacgattaccggcaatgctggaaacaatatccttaatggtggaactggtgcagacaccctcatcggtggcaaaggcaacgatacctatatcgttgatgacgtgaatgatgttgtcgttgagagcctcaacgaaggcaccgatcagatcaatgcgagtatcagttactcattagcattggctgcaaacgtcgagaatctcttactcacaggcacagatcacatcaacggtaccggaaatgcattggcaaataccatcacggggaactctggtaacaacacccttgacggcggtgatggcgtggacaaactcgcaggtggattaggcaatgatacttatatcgttgacctcgtccgcacaggcactaccactgccaactacaaggtcgcactgcaagacacaatcactgaagctgctaatgccggcaatgacaccgtgcaattgcgtttgctcggcagcaccgattacagcgctatggcaagtgccaccaccctcatccttggggctaaccttgagaacctcgatgcctcagatacagggtctaccaaactcaacctcacaggtaacgctctcgccaataccctcaccggcaatgatgcagatnacatccttgatggcggtgcaggcgtagatacgcttgtcggggggagtggtaacgatacctatatgctggacctgaaactccagggcactggcgctggcgcttactgtagtgattga

SEQ ID NO: 82688 - DNA, 441 bp, Glycine max
  Peptide Sequence Number=SeqID_174373
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgatccccggcaagatggggtttgatgtgggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 82689 - DNA, 396 bp, Glycine max
  Peptide Sequence Number=SeqID_174374
atgggaggatattcagcttttgatagtaggacaaagaagaaaattcttcagattgtcggcgagcgctggaggcagtttaaatctgacctgactaggaaatgggcacttgcagccgacaaggatggtgtggacgacattttctgtgaaaaatatggcattagcaaggagaaatgggcccagtgtcagacccgcagagacccctcatgggaggatgtgcggaaaaaggcacaggcctcccagaagcaaaacactgctccctacatattgtctcatgggggttatgaatatttaaaagaaaagctcatggctgagaagacaaagaaaagactggaagaagctgcccagtctggaagcactgaaggcatcattgaccctcaatctcctatcagacgccac

SEQ ID NO: 82690 - DNA, 831 bp, Glycine max
  Peptide Sequence Number=SeqID_174375
atgatgaaacacagggagtgcgtgctgggcctggtgctggcgggattgctggcaccgtcggcgcaggccagtggcgacgacggcgaaacgctgcggttccaagtggccgctcacgtgcaggcgcacgccgatccccagcaggatggcagcatcgccgtgcagctgtcgccgtcgggcaagcgccagacgctggcgggcgcggccgatgccgacggcaattcgcgctggggtctggaggacgtcgacttcgatggctacccggaactggtcgcacgcgcctcggtgggcatggtcaatgaagcggtgacggtgtaccgcttcgatccggccagtgcttcgtatcgcgtgctgcaggccgacacccacggcaaggacagttgcggtgacctgatggggctgagcgtggacgttgccacccgcaccctcaccagcagttgccgcagcgggccgatgtggtacgccgaccagtaccggttcgcgggtgcgaagctctacctgtaccgcgccgagagcgtgttgatgctgggcgatacgttgaacgccgcgctgcagtgggaacaaaccgaagaacagggccctctggcggtctggcgcacctatgaccccgccggcggtgtgctggagagcgccattgccgatggcctgggtgcaccaccggatgggccgttgcgtggtcagcaggccaccgtggtacctgcgcgcctgttcctgttcgaccggcccggtgcgtccagcaccaagcgttacctcgtgcagggcgaccgcgtggaaatgctggatgaacaggccggctgggtgaagctgcgctaccgcaacccgaagcagggcgcg

SEQ ID NO: 82691 - DNA, 975 bp, Glycine max
  Peptide Sequence Number=SeqID_174376
atggtgccgactgatgagtcacatcagcggctgctgccgttttacggtgcgggtgcggcagcggccaacgccggcagctacgcgctggcgctggatctggcggaagccggctttggcgtcaccattgcgccggcgccgctggttgccgcgcggcatcgcctggcctggcgcgctttacccggtcagccgctgatgcggcgtgtcggcatttgctacgcggttcaggcgcaggccaatccggcggtagaacggatccggtacactgccggacgcaccggatcaaagcggattagcgcggcgccgcgcatggtcgcgctccagcagcagttcgccgcgctcgaccgggccattttccagcatctgcagaatctgcgcgatatagtcgtccagcggcatggcgcggggatcgctgagctgttgatcaccggtgggaaaactggccagcggcaggaaggccagcgcggaactggttgccatcagcgtggcctgcggctgacggcgcagcagcggcaaaaacgcggcggtgacgcgaatcacaccgaggatgttggttatcacgatttgctcagcaatatcactggtccattcgtctgccgtcaccgtttccggctgcgagataccggcgttggcgatcagcacgttgatatgcgggaactgcgcgtgaatcgccgcggaacagcgggcgagggcggtggcgtcattaacgttcagagcaaaaccggtaatggccggacgctgggcgatgatctcatcgagcagcgcctggcgtctgccggtgataatgacgcggtttccgcgatcgtgaaaaacctcggtcaggcggcggccaatgccgctggttgcgccggtgatgagcagggtgttgttggtcagtttcatagtgtgccttgtcagtcagagaatgaaaggccacgtgcgaggcccattccggttcagggcgcgttggatgacggtaacgcctacggcaagtcagaa

SEQ ID NO: 82692 - DNA, 826 bp, Glycine max
  Peptide Sequence Number=SeqID_174377
atgaatacacaacaattggcaaaactgcgttctattgtgcccgagatgcgtcgcgtccggcacatccactttgtcggcatcggcggtgccggcatgggcggtattgccgaggtgttggcgaacgaaggctatcacattagcggctccgatctggcgcccaatccggttacgcagcatctggcctcgctgggcgcgaccatttacttcaaccatcgcccggaaaatgttaccgacgccagcgtcgtcgtggtttccaccgccgtggcgcaggacaacccggagctggtggcggcgcgtgagcagcgtatcccggtgatccgccgggcggagatgctggctgagctgatgcgtttccgtcacggcattgcgattgccggcacgcacggtaaaaccaccaccaccgcgatggtgaccagtatttatgcggaaggcggtctcgatccgacgttcgtcaatggcggtctggttaaagcggcgggtacgcacgcgcgcctcggcagcagccgttatctgattgcggaagcggacgaaagcgacgcctctttcctgcatctgcaaccgatggtggcgattgtcactaacatcgaagcggatcacatggatacctatcagggcgattttgagaacctgaagcagacgtttattaacttcctgcacaacctgccgttctacgggcgcgcggtgatgtgcgtggacgatgtggtgattcgcgatctgattccgcgcgtgggccgtcaggtcaccacctatggtttcagcgacgatgcggatgtgcgggtcgaaaactacgaacagcgcggcgcgcagggccacttcaccctgattc

SEQ ID NO: 82693 - DNA, 407 bp, Glycine max
  Peptide Sequence Number=SeqID_174378
cgaggaagcggaagagcgcccaatacgcaaaccgcctctccccgcgcgttggccgattcattaatgcagctggcacgacaggtttcccgactggaaagcgggcaatgactgaagttggcactgagtatgtggtcaaaagcatccttacaactcacaaatctggtgctccaatccttcccaagggagagtttggaactggaatcaatccggatatggagtttgtacgcatgtgcttcgcacaattcggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 82694 - DNA, 594 bp, Glycine max
  Peptide Sequence Number=SeqID_174379
atgctagctatcatcgccaagtaccaagaagagttaggtctagccacggcccacgagcatagggtcgcggacgagtatgcccaagtatacgcggaaaaagaggctagaggaagggtgatcgactctttacaccaagaggcaaccatgtggatggatcggtttgctcttaccttgaacgggagtcaagaacttccccgattgttagccaaggccaaggcgatggcggacacctactccgcccccgaagaaattcatgggcttctcggctattggaaaaacaccataactaaatgcgccacaaggcatccctatcgcaccagatccaaatctagaacgatgggtgatcaagaggagacacaggaacagatgaaagccgacatgtcggctctggaagaacagatggcttccatgatggaggccatgttaggaataaggcagctcatggagaaaaacgtggccaccactgccgctgtcagttcggctgccgaagcagacccaactctcttggcaactgcgcaccatcctccctcaaacatagtaggacgaggaagggacacactggggcacgatggcaacccctcacctgggatataa

SEQ ID NO: 82695 - DNA, 513 bp, Glycine max
  Peptide Sequence Number=SeqID_174380
atgactaccctgactcagacatggatgacgttgctgcttagcaacatcctacccagtgatcataattctgaactccccctgccgaagtgtcagctggtgtatgccattctgacacagatgagcgttcatgtggctcagttgatcactgatgccatttatctatttgcacgtatgccgcctaccaggcaccccctggacccggataagtccaacagggccttgggatttccagctttgatcacaggactctgccagtcgttcggagtccccgtcgcacctagtaaggtgattcggtcacccatcacccgagcttttattgagaagtattgcacacagagacaggcacagggtggcgaccctcaggccccagatgcgccgcctccacctcctcaggctgacccagctgggtcatttgacacggagcggtatttacggcatttggttcgccagcaggcggccaaccatagggcgcatttgacttccaacttttctttgaaaaaattttttcactga

SEQ ID NO: 82696 - DNA, 240 bp, Glycine max
  Peptide Sequence Number=SeqID_174381
atgaaacaaaaaggaaaaagaaagaaagaccgcgaaggtcgacatgttatagttaagaagtataaatcattcgtaaagagcaaacccatgactaattttgcacgttgttttcaaatcgtcattgtcacgcgtgccttatggagtgatatgggagttcggcccgagaccgacaccttgacacccaaatttgttttgccccagatatcaagattgggttcccacgataaaagaccccattga

SEQ ID NO: 82697 - DNA, 459 bp, Glycine max
  Peptide Sequence Number=SeqID_174382
atggatgagaaagctagggaaaatgaagagaatgagaaggaaggaagaacccatgctgcgacttccattcctacatggccaaatttcccaccagctcaacaatgtcattactcagccaatatcagcccttctcattacccatcacccaatcaaccacaaaggccatccctaaatcagccacaaggctcacttactacacatccaatgccaaacaccacccttaacacaaaccaaaacaccaaccaggaagggaattttccagcgaaaaagcctgtagaattcaccccaattctggtgtcatatgctaacttactcccatatctactcgataattcaatggtagccataaccccaaccaaggttactcaacctccattttctgagggtacgactagaatgtaccatgtgcttatcatggaggagtgccggggcattccattgagcattgtaggaccctaa

SEQ ID NO: 82698 - DNA, 639 bp, Glycine max
  Peptide Sequence Number=SeqID_174383
atggggatgagggactgcattaattataaccctatgttggccataagacagttaggatatcctatgagaggtgcgccatcagaggaaaccatcacacctttcatctcacgagggttcaacgaaactaatacaaagaaacttcagaagatccataaggcatggaataaagtgggaagaaaagataaagaacttagaggaagaagcaatggtgtcataggcggctatcacaaatggttaaaatctagaatgcaagggatagcttggctcaaaaagctaaaggatctgaatggggaagaggcaaaagtgcttgaggagagtgaaaaggtgcaagccttgaaggctgagctcgaaaagacaaaagtagcaaaagagaagctgaaggtggtagtcactagagttaggaaagaatatgataagctaaaggatatcaacatgaccacgactgaggcgctagactgggaaatgaagaaagccagaaaggaggagtggagcagaaacaagtttcgaggcgctttgttaggcagcagtaacgagctcaaacttagaaaggccgagagagacaaatcaaggatggagaacatgatgttagaggataagttgaggaattttcagaggtcaaagggatgtttgaaagagtag

SEQ ID NO: 82699 - DNA, 696 bp, Glycine max
  Peptide Sequence Number=SeqID_174384
atggggacaaatcaaaccggcaagaggttttaccaagtcaaggttaaaggcctagataccaccagcatcaaggaattagggcggttgatggaacctctccaaatgcaagccttccgcaagacttacggaaagatcttagagttgaccatagcagaggtatccatagaagccattgcatcactcacccaatactacgaccagcctttgagatgcttcacgttcgaagacttccaattggtaccgaccattgaagaatttgaggagattctaggatgtcctgtcgggggaagaaaaccatatcttttctccggttgtctcccctctttgagcagaattgcaactgtggtcaaggattcagcaagaggtttggactgcgtaaaacaaactcgaaacggcatagtgggcctaccacggaagtacctagaagacaaggcgagggatatggaaaatcaagaagattgggtcccgtttatggatgtgttagcattgctaatctttggggtcgtcctctttccaaatgtagatggtttggtggacctagccgcaatcgacgcgttccttgcataccgccatagcaaggaaagtccggcgatagctgtcttggcagatttatttgacacatttgaccgaagcaaggcacgaggcatccatgtccgctccaaagccatcgctcgtgtactgaaaagagaagaatag

SEQ ID NO: 82700 - DNA, 336 bp, Glycine max
  Peptide Sequence Number=SeqID_174385
atgatgacaaaggtaatgacaaaaagctcaaagatcaatcaaagaacaactcaagtaaatcaagaacaattcaagagttcaaagataagaatcaagaagaattcaagactcaagaagaaagttaagagtcaagaatcaagattcaaggttcaagatctcaaaaatcaagatcaagattcaagacttaagaagaaagttaagagtcaagaatcaagattcaaggttcaagatctcaaaaatcaagatcaagattcaagactcaagattcaagaatcaagagaaggcttaattaagataagtataaaaagtttttctcaaaaattgagtagcacatga

SEQ ID NO: 82701 - DNA, 177 bp, Glycine max
  Peptide Sequence Number=SeqID_174386
atggttaaaaagaggctaagtcatgaagtgctaaaagtgacagttgagctcagctcatcagttgggctaagcacgaattcatcactaagtgcagcttcagcgcgcttggtgcgacagaagaatttgacagagcatcaatatcaaggtcgtgcactaagcgcgagatcagttcgctaa

SEQ ID NO: 82702 - DNA, 330 bp, Glycine max
  Peptide Sequence Number=SeqID_174387
atgacaagagacaagtcaaagttcatgtctctaaaagctaggaaaggaggatttgtaacctatgttgataacaacaaagggacaattctttgtgtttatgtagatgacatcatatttggttctactaataaatctctctatgaagattttgtgcataagatgcagggggagtttgaaatgaagtttgatatggataaaagcaaggaggctgcaactcttatggctacaattgcaaccttagggtggatgaaaaagggaaacttattgatcaaacgaagtacagagcagacagaagtattaaagaatgaaagagagcttaaaggaaattga

SEQ ID NO: 82703 - DNA, 402 bp, Glycine max
  Peptide Sequence Number=SeqID_174388
atgaggggcaccgtgcatgagcctcaaacgaacctaggggcagatcaaaagttctcacccatcgatgttggaccccttaagggctgcacctcctcgcctgaagagggctacacgtcctcaccttcagggggctatacgtcctcgccttcagagggctatacgtcctcgcctccagagggttgtacgtccttcgccttcaaagggctacacatcctcgccttcaaagggttttacgtcctcgccttcgaagggctacacgtcgtcaccttcaaagggctgcacgtcctcgccttcaaagggctacacgtcctcgcatccaaagggttgtatgtcctcacctttagagggctacacgtcctcgccttcatagggttgtacgtcctcgcctccagagggatacac

SEQ ID NO: 82704 - DNA, 402 bp, Glycine max
  Peptide Sequence Number=SeqID_174389
atgtttgaaaatgatgatgagttgaacatcaaaatcctcaactgtcttacaagaacttgggaaccaaagatcacaataatcaaggaatgggaggacttagcatcaatgtcaatggaagctctcttcaaaaaattgcttgcatatgaacatgagtttattcaacaatctcatatagaagaaatagaaaagaaaagaaaaggaattgcactcaaggttggttcttcaaaggaagactacaaagataactctagtgatgacgaagatgttgagaatattagcttgatgttgaagaagtttggaaaatttctcaaaagatccaaagacaaaaaattctctaaaccttcaaagaagatacaaagcaacaacaacaccttcacatatttagttactcatgcaatctga

SEQ ID NO: 82705 - DNA, 891 bp, Glycine max
  Peptide Sequence Number=SeqID_174390
atgaagccattagactcagtttattttgattttccttggcaggggaagccaagaggtggctccactcatttaagggtaaagctgaagacccctaaagaggcaactgagctaattgagaatatgttagctagagatcatgccattctgcgcgacaaaattcatcaacccacaaagaaaagcttgttagaactatcatcacatgacgctttattagcacataataacttacaggttgtaccatctgtggtgaggctcatgaaacaagccaatgtattcacattgaagaaaacactcaagaatttcactatatgggaaatcaacagagacaaggatatactcaaggaggattctcaggcttccagcaggggtggaccttctaacaggccaatccaacaagggcctaacatctttcaaaggattactaagctggaggagactttgactcagtttatacaggttcaggtgggacaactagccaagaaaatagctgacaagtcatccaacagttttgtggcgaatacagaaaagaatcccaaggaggaatgcaaagctgtgatgacaaagagtaagaggtttgtggaggcagaggaagaggatagtgtcttgtccaagaagaaagctactgaaaagaaaggtactgataaaaagaaagatgaggtgataggtgaaagcaatcaggaaaaagaaaaacaaataatggtcaagaaaaaagaattaaatgaccaagaaaaagaaaaagaagtagaaaaagaaaaagaaaatgaaaaaaatggaaaaaatgaaaaagatgaaaaaaaaaataagaatgaagagaggagtagaagtgaacaagctagagagaagaaaagagaaaaagttgtgaataaaggtgcggaagtaccatatcctgtg

SEQ ID NO: 82706 - DNA, 999 bp, Glycine max
  Peptide Sequence Number=SeqID_174391
atggcccctagaaagcttccatcaaagagcgccgaacatcagcagcgtttcgagaccatcaagggatggtcattccttagagagaggcgggtccagttgagggacgatgagttccctgattttcaggaggagataggccgcaagcgatgggcaccacttgtgaggggccagtggatccccttcgacctagacgccctcagccagttcttgggccacccgttggttttggaagagggtcagcagtgtgaattcagccagaggaggaatcaggtctctggttttgacgaggaggccattgctcagcttttgtgcataccgaggcaggatttcacccagaccgctgcagggagacaggtgaggatcatgtgcaccagcatgactaccctgacccagatatggatgacgttgctgcttagcaacatcctacccagtgaccataacttcgatcttcctctaccaaagtgtcagcaggtgtatgccatcctgacacaggtgagtattcacgtggctcagttgattgctgatgccatctatcaatttgtagggacggtgcctgcgagacaccctatggacccgaagaggtccaatagggccctggggttaccagctttgatcacgggtctctttcagttctatggagttcccgttgcccccagcaaggcaggcgcagggccaggcaccgcagctacccgaggaagatcagtagccagaggcagatgcaccaccgccgccacaagaggaggcaccatctctgaggcagctaatcacaaagggcaggggcggctgaacgagacattatatcgttaccacctacaccagcaaagtcaggaccccagtcctttcccttggcccactcccgagcagttcgaggccacggtggcctggcctagggacgagaccgagtttgagacacaggcagggcccgcgaggacctctggaggtggggatgaagcccaagacgatcaagacatggcagacatgttggatttcctcctatga

SEQ ID NO: 82707 - DNA, 231 bp, Glycine max
  Peptide Sequence Number=SeqID_174392
atggcagcggaatggagaaggaagagagagaggagacgccacttcaaggagaagataagtctagaagaagctcaccaccataggaggccatggataagagcttggaggaagaaggagatgaatgaagggagggggagagaagagcacgaaattttgtgctcaaaaagagctctgaaatctgaacccactaatccaagatcaattccaagattctccactaagtgtgcttag

SEQ ID NO: 82708 - DNA, 729 bp, Glycine max
  Peptide Sequence Number=SeqID_174393
atggctccaaagaagcttctctctaagagggcaaggaaggacgccgcgagaaaaggatccagtgcgactccacaagcggacatagaatttgacggacaccggttccgaagacctatgactaaatattactcgaaaatagtcatggaattctacactaatgcatggccacagaggaaggagtcggggataagcgcttctgggtgcggggccaatgggtcccctttgatgaagatgccattaatcagttcttggggcatccattggtcctggaagaggggatttgatgaggaggccataggtcaactgttgtgcattccgggacaggacttcccacgaagtgtgacgggaagacgggttagtatcaatgtggcccagctaatctcgaatgccatttaccaatttgtagggatcgcacctccaagacacccagtgggcccagaaaagtccaatagagcattgagatttccagccttgatcatgggtctctgccagttctatagggtgccagggcaggaccatcaacaacaactagccatagatgccaccatccctagagtccatatctgctcatatgcaaaggatggaactctacatttcggggccacagttgcatcgcctggagataggcctagttttcaagtaggggcaggacccgcaggtgccccaggagatgaagatggagctcaggaagatgatgacatggccgttgtgatgaactttttcctttaa

SEQ ID NO: 82709 - DNA, 330 bp, Glycine max
  Peptide Sequence Number=SeqID_174394
caaaataggggaggagcttgccacccagctcgcccaggcgagccaggttgcttcctccagaagcaaccgccttctggaggaagaatctggaaggcccaagtgggcctgctttcggaatgttacggaaactcacggattgcgcaacaacacttccttttgatttccggcacgttacggaatttcacggattgcgtagcaatgctcccttttgatttctggcatgtctcagaacttcacgtattgtgcaacaaagggtgccaagtacctcgaagcggtcaattaaaggttgcatgccatcaaacaatagtcccagacgaaattagggtatga

SEQ ID NO: 82710 - DNA, 144 bp, Glycine max
  Peptide Sequence Number=SeqID_174395
atggctggtgttgaggcttggttgaaggagattgagaatattttccaggtgatggatgtagaagcaagcttcatgatgatgaatcaagttgattcaagtagttttgatgatgacaaggatgatgacaaaaagcccaaagaatga

SEQ ID NO: 82711 - DNA, 333 bp, Glycine max
  Peptide Sequence Number=SeqID_174396
atgtggttggacatgtatttaaaaaaaaccttatacaagaggcttcttggaatggtttcaagtatcccgctcgattcaatccatatgttttggaggagacttagttttttagaccaagtgttgtgtgaggccgaagtcaccatcaaggaagagattgagaccatatctaaaagatctgaggaacttgatgctggtggtaaagttactctcaagagtaaacttcgagaaatttcataccctgatcaaaactctgtgtcctcctccgacaaaggtcaacaccaaaggagcatcgaagaaatcgatgaacagaagccaaagatccacaaagcgtga

SEQ ID NO: 82712 - DNA, 1017 bp, Glycine max
  Peptide Sequence Number=SeqID_174397
atggaggaggcggtcatcttgttgatggagttgctcgaggtctcaggtcaggaggctagagctgagactgcacaggcacgtagggcatatgtacgcctattatgggtatgggatatctatctgagtagatgcgaggcccgatggtggattatagcagctcgtgcttatctcctccacttggttggttgcactcttttcactaacaagagtgcaacacacgtccatgtagtgcatctggaggcttttcgagacctaggtgagagtgggaggtatgcatggggagttgccgtgctgcactttcctagtgttcatgactgcgtcactgacgatccgtatgatgagacatccccacgtgcctatcggtggcttacgacaaaggcttatatcaagggattacgagcaccgggccaagttagatggggtcctattgtggtcacagttcgaccagatagggtggtacgacagttcgagtacgttcagaccattcctccatcgtctgttagtgcctccttgtcatatgaggatatcgacgacaggtggatgcattacgaggaccatatagcagatgcgggtgagatttttgttgtgcttgggcaggtatcagcagattacatggagtggttcttccagatatctcattcgttcgtcacacccacacaggcaggtgatgagcccagacatccacctgccccacaacatgaggaatacgtcgagtcaagtatcccggaggttttagtgggagcagacgttggaccatcacaggcacctgcaatggatggttgtgaagcgatcgcagaaaggttggagcgtgtgcttaacctaaggatggtcactgaagacacagagttacatgagatcgtggaagattgcctcaggatcgctagggggctgacaactcaaatggaaatgttagggcgcaatgaagacaatgcacagatcattgatagatcattttatgtcttatatttgacaatatttttgtatttgttacattattttggttataacttttattga

SEQ ID NO: 82713 - DNA, 378 bp, Glycine max
  Peptide Sequence Number=SeqID_174398
atggagtcaggtgacatgcgggggtatcgtatggttacccgcaccttttgtcaaccaggggcaaatgagcccgttgacacgcagagactaacatcgtcttctgcaccttttgccatccagggacagcgagtcaggtggcaggcggagataccttatggtcatccgcacctttcatcaaccaagaggaacgaattcgacggtttttaccctcgtcgtccgaagacattcaagcttgacgaggcgcgagattcttctctgctgggcggggacgatcgagtgcaatggcgtagggaagtgtcgtggttgtccaactttgtcactttcaagacactgaagtttgttgacgcttctgatgcattttcttttatttctgaatga

SEQ ID NO: 82714 - DNA, 355 bp, Glycine max
  Peptide Sequence Number=SeqID_174399
tactaataccggggacccagccgtcgatttcgagcaagaagcgagttggacaaaggatgaagaagacgaagacgtagggcttcccccagagctagagaggatatttactcataaggatcaagagataaggcccatcaagaagagacagaactcgagttttgatgataacaaagatgatgacaaaaagctcaaaagtcaagatcacttcatgataacaaagatgatgacattcaagaatgagttcaagattgagtcaagaacacttcaaggatcaagaggaaatttgatttcaagaatcaagaatcaagattcaagactcaagactcaaagattcaagaatcaagagaaaaattaa

SEQ ID NO: 82715 - DNA, 363 bp, Glycine max
  Peptide Sequence Number=SeqID_174400
gtcgactctagaggatcccccaaccgcgccggcctgacgccgcgcatcgtctttaccgccaccgacgccgacgtgatcaaaacctatgtgcgtctgggattgggggtgggggtgatcgccagcatggcggtggatccggtgcaggatccggatctggtgacggtggatgcaagtgatatcttcacctacagcaccactaaaatcggcttccgccgcagcaccttcctgcgcagctacatgtacgacttcattcagcgattcgcgccgcacctgacgcgtgacgtggtcgacagcgcggtggcgctacgttccaacgaagagatcgaggcgatgttcaaggacatcaagctgccgattaagtaa

SEQ ID NO: 82716 - DNA, 921 bp, Glycine max
  Peptide Sequence Number=SeqID_174401
atgacgaatttcagaatccgtcttaaagtatttatgtccagagagaatattgaggtagactctcttacagatctatatgccggagcgaactggatggaaagggaaacctatgatttctttggaatcaaattcaagggacatccggatctgagacctattttaaatatggaagatcttggttaccacccgatgctgaaggaatatcgtcttgaggatgataactcattatctaatatacttaaccaatacgaaagtaaggagcagattgacggtcagttgtataccctcaatttaggtccgactcaccctgctactcacgggatcttccagaacgttttaacgatggatggggaaagaattcttcatgctgagcaaaccgtaggttacatccaccgggcatttgaaaaaatttctgaaagaagaaattatacccagattaccacccttaccgaccgtatgaattattgttctgctccgattaacaatctgggctggcatatgacggttgagaaactgataggaattgaagttccaaagcgtgtggattatatccgggtaattcttatggaattagcaaggatcggggatcacctgatctgtaacggagtaactggtatggactctggagcaattaccggacttacttatatgttcatcgaaagagaacgtatttatgatatttacgaacagatctgtggtgcgagaatgacaaccaatatgggaagaatcggaggtgtagattatgatgttcgggtagcacaaccttattcttcttaccaggactttgattttatcattcctgtaggaacagctggtgatacctacgaccgtttcatggttcgtcaacaggagatctgggaatctattaaaattatcgagcaggcatataacaatcttcctgaaggggatttccatgctgat

SEQ ID NO: 82717 - DNA, 732 bp, Glycine max
  Peptide Sequence Number=SeqID_174402
atgacatgcgaagacaaattatggtcattccgcacctctttgccattcagacacagtcgtttccgatggcacgcagagacaaattatggtcattctgcacccttttgtcatccagagacggcgggcccgatgacatgcggagacaaattatggtcattccgcacaccttttgccattcagacacagtcgtgtccgatgtcacgcagagacaaattatggtcattctgcacccttttgtcatccagaggcggcggacccgatgacatgcggagacaaattatggtcattccgcacccctttgccattcagacacagtcgtgtccgatggcacgcagagacaaattatggtcattctacacccttttgtcatccagaggcggcgggcccgatgacatgcggagacaaattatggtcattccgcacaccttttgccattcagacacagtcgtgtccgatggcacgcagagacaaattatggtcattaagcacccttttgtcatgcagagcggggggaaatacccgagtggttaccgtataaaacattcccccttttgctatcgtaagacagaacgcttgatagcatgcagagacatggtcgtcttctgcaccttttgttccctcgggaacaacaagtcatttgcatgtggagattttatggtcacccgcgactctcgtcaaatcgagaggaacgaaattagtgtcttatctttactttccttttatctccaataa

SEQ ID NO: 82718 - DNA, 408 bp, Glycine max
  Peptide Sequence Number=SeqID_174403
atggagaggagtatgatatatgctgccagtggtggagctcttggtgatatgacccctcctgaggctaggaatttgattgagaagatggcttccaactcccaacaattcaatgcaagaaatgatgctattgttcttagaggagtccatgaggtggccacagattcatcttcatctactgaaaataaaaagtttgaagggaaacttgatgccttggtcaacctagtaactcagcttgccatgaatcagaaatctacacctgttgcaagagtctgtggtctatgttcttctgcagatcaccatacagatctctgcccttctttgcagcaatctggagtcaatgagaaacctgaagcttatgctaaaaacatttataatagacctcctcagcagcaaaaccaacaacaatag

SEQ ID NO: 82719 - DNA, 723 bp, Glycine max
  Peptide Sequence Number=SeqID_174404
atgcaccgattgcccgtagagcgacatgaagcctgcctgcaaccgtttttcgctcagccccacggcctgcgccagctggcgcacgctgccgcaatcggcgtattcgtgctggatgcggcgatgggcctcggccagccgcctgcggtccgcgggcggcggctggtcggccgcgccgcggccggccaggtgcgccagggtcagggccagcgcctcctgggccttgccctgcagatacagcgcggcgacctcgccacgatcctggctccaggccaggatctcgccggccacgcgcgccaggccgggccacagcggcagcgtcgccagttgggcgtcgcgcgccggcacgctgccatcggccgcgaacgcggcggacggcacctggcgcaaggtgcgccaccacagggcgcgcatggcttcgctcgaaaaacggatatcgaccacgcggatgtcgcgccggcccttgaattcgtcccagcccggcaccggctcgaccgtgccgtgcaggatgacgctgcccggctggatgcgcagggccgtgccgccctcgaagcccaggccgaactggccttgcagcacgatcgccacgcccacgctggactcggccgcgccgctggcggcccagtccgattcgggccggccgtccaggcagccgatcgagatgccgcccggcagttcgtgctgggagcggatcctgagccagtccggcggcagcaggcgcagcag

SEQ ID NO: 82720 - DNA, 627 bp, Glycine max
  Peptide Sequence Number=SeqID_174405
atggaaaaacggctttgccgcggccctctcacttccctgttaagtatcttcctggcatcttccaggaaatctccgcccgttcgtaagccatttccgctcgccgcagtcgaacgaccgagcgtagcgagtcactggcacgacaggtttcccgactggaaagcgggcagtgagcgcaacgcaattaatgaccccattcacattttccatcatcaacagttgaagaacattatagtttctcacattgatcttctgtgtgacctagaagaccacggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 82721 - DNA, 363 bp, Glycine max
  Peptide Sequence Number=SeqID_174406
cagatgccatgccgcggatgcggccacaaacagggcgctgctcaggaatgcggctatcgacatatgcagcaggcggtaagggaaggaggggttaaacaccacggcgaaccagtccaccggcacgacctgaccgttgacgatctcatagccctgcggggtctgcatccagctgttcgacgagaggatccagaaggtagaaataatagtgcccaacgccaccatgcaggtggcgaagaagtgcagacccggcccgactttgttccagccgaacagcatcacgccgaggaacccggcttcgaggaagaaggcggtcagcacttcataggtcagcagcgggccggtaatgctgcccgcaaactgtga

SEQ ID NO: 82722 - DNA, 387 bp, Glycine max
  Peptide Sequence Number=SeqID_174407
atggtgaaagttggaactcttacgtgccgatcaacgtctcatttcgccaaaagttggcccagggcttcccggtatcaacagggacaccaggatttatttattctgcgaagtgatcttccgtcacaggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 82723 - DNA, 213 bp, Glycine max
  Peptide Sequence Number=SeqID_174408
ggcgaggctcacgggtgcgctttccaagggaggaaagatgcgcggagtcgccaccaacgtttatttgtggaaaacgttgggaaaaccgaaggaaaccggaaggtcgacaaaagcggggcttttgctcctacgtaccctcctttggagaggaaatcagacctacgtagttctttcttatgcgtgaatcaagcgattcttttacttgaagagtga

SEQ ID NO: 82724 - DNA, 829 bp, Glycine max
  Peptide Sequence Number=SeqID_174409
atgaagacaattgcctccacctcgctgcctgctcacgttcagcaacctcgctacgatcgcgcgcaattacgctcccgcatcgttcattttggctttggtgcctttcaccgcgcgcaccaggccttgttaacaaaccgggtgctgaatgaaaaaggcggcgactgggggatctgtgagatcagcctcttcagcggtgatgtgctgatgagccagctgcgcgcgcaggatcatctgtttaccgtgctggagaaaggtgctgaaggcaatcagccgattatcgtcggcgccgtccatgaatgcctgaacgcaaagctggactccctgcccgccattattgagaaattttgtgagccgcatgtcgcgattgtgtcgctcaccatcaccgagaaaggctattgcatcgatcctgcgaccggtaaactggatctgcacaacgcgcggatcgtccacgaccttgaaaatccgactgaaccgcattctgccccggggattctggtcgaagcgctccatcgccgccacgagcgtggcctgcccgcctttaccgtgctctcttgcgacaatatcccggataacgggcacgtagtgaaaaatgcggtgctgggcatggcgcaaaaacgttccgctgcgctggcggagtggatcgaaagccacgtcagttttccgggcacgatggtcgacaggattgttcccgccgcaactgacgcctcgcttgcggaaatcaccgaagcgctcggcgttgaagatccgtgcgccatcagttgcgaaccgtttattcagtgggtggtggaagataactttgtcgcgggtcgtcccgagtgggaagtggcag

SEQ ID NO: 82725 - DNA, 48 bp, Glycine max
  Peptide Sequence Number=SeqID_174410
atggagaatttcgctaagcaatcactacgcatagctccgaactcgaag

SEQ ID NO: 82726 - DNA, 327 bp, Glycine max
  Peptide Sequence Number=SeqID_174411
atgaagtcaggtgacatgcggggttaccttatggttacccacacctttcgtcaaccaggggcaaacgagcccgttgacgcgcagagactaacatcgtctcctgcacctttttgccatccggggacagcgagtcaagtggtaggcgtaaataccttgttttttactcttgtcgtccataagcattcaagctcaacgatgtgcgagattcttctctgctgggcagggactattgagtgcactggcgaagagaagtgtcgtggttgtccaactttgtcatttttaggacacagaagtttgttgacgcttctgatacttgttcttttttaa

SEQ ID NO: 82727 - DNA, 735 bp, Glycine max
  misc_feature (120)..(120): n is a, c, g, or t
  Peptide Sequence Number=SeqID_174412
atggaatttgatgaggaggccattgcccaactgttaggcatatcgggtcaggattttgcccggaccgctgccgggagacgggtgcggatcatgtgcaccagcatgactaccttgacccanacgtggatgacgttgctgctcagtaacatcttgcccagcgatcataactccgacctccctctgccgaagtgtcagctggtgtatgccatcctgacacggatgagcgtccatgtggctcagttgatcgctgacgccatttatttatttgcaggtatgccgcctaccaggcatcctctagacccagataagtctaactgggccctggggtttccagtgttgatcatgggtctctgccagtcgtttggggttcccgtcacacctagcaaggccactgacgcaccgcccccacctcatcaggctgatccagctgggtcattcggcatggagcggtatttccagcacttggttcgccagcaagcggccaaccacagggggcaggtgcagatccatgagtgtctctaccagctcagcctcagtcagcagagccagggcttcgctccttttgcgtgccctactccagatcagtttagggatgaggtctcatggcccagagattggcccgaggaccagacagaggaggcacctgcaggagctcccgacggtgcagaggacgcccgcatggatgaggagatgacatatttactcgatttcttgggaggaagcgaagccacgtga

SEQ ID NO: 82728 - DNA, 204 bp, Glycine max
  Peptide Sequence Number=SeqID_174413
atggtagaagacatgtgtttcctctacaagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 82729 - DNA, 528 bp, Glycine max
  Peptide Sequence Number=SeqID_174414
atgaccgaccctctcaatgagtcaatctcatgctttctcataagggatgaccgggcttcagaggactacacatcctcgcctttagaggaccacacgtcttcgccttcagagaactacacgtcctcgccttcaaaggactacacgtcctcaccttcagaggactacatgtcctcaccttcagagggctacacaccctcgccttcagaggactacacgtcctcgccttcagagggctacatgccctcaccttcagagaactacatgccctcaccttcagaggactacacgtccttgcctttagaggactacacagggctacacgccctcgcctttagagggctacacatcctcaccttcagagtactacatgtcctcgccttcaaaggactacacatcctcgccttcggagggctacacgccctcgccttcaaagggctacacgccctcgccttaagagggctacatgccctcgccttcagagggctacacgccatcgccttcagaggccgcatgtcctcgcgttcatag

SEQ ID NO: 82730 - DNA, 225 bp, Glycine max
  Peptide Sequence Number=SeqID_174415
atggagtcaggtgacatgcgggggtaccgtatggttatccgcacctttcgtcaaccaggggcaaacgagcccgttgacgcgcagagactaacatcatcttctgcaccttttgtcatcctgacccatggattcagggacagtgagttaggtggcaggcggagataccatgtggtcgtctgcacctttcgtcaatcgaggcgaacgaatttaatggtatcaggatga

SEQ ID NO: 82731 - DNA, 98 bp, Glycine max
  Peptide Sequence Number=SeqID_174416
atggatgccttggaaatttatttgaatgaagtagaaatgcaaatagaaataaaggtgaaaattgtcaagtgtgaaagaggtagcgagtacaatggaag

SEQ ID NO: 82732 - DNA, 304 bp, Glycine max
  Peptide Sequence Number=SeqID_174417
atggcgaagtgtgttaagcatctcaactcggctgacaaggatttaaatggccaaggggaaggaaaagaggaaaatgattcctccaagaagattgttaagaaggaaaattattttgcaacaaaaggtgatatcaaaagagcactccttcttaaacaatctttctactttctcctttcaagggaaacatcccttagcactgtcatacctcttgagcttgaggttattcctcaattaaaagagttgttggatgagggtttggttcataagagcttcactccttgtgctttgttggtgcccaaaatag

SEQ ID NO: 82733 - DNA, 192 bp, Glycine max
  Peptide Sequence Number=SeqID_174418
atgggtcgccaatatcgtgtcagtcccaaaaaaggatgggaagataaagatgacattaaaggatatggaaaagacaaccttcatcactctatggggaaccttctgctacaaggtgatgtcatttgggctgaagaacgttggggcaacatatcagtgggccatggtggcattattccacgacatgatacataa

SEQ ID NO: 82734 - DNA, 192 bp, Glycine max
  Peptide Sequence Number=SeqID_174419
atggagccagagcagcctattcaggattcatcgggagctctagcactggaccttaatgaagatcagccacaggatgacttgcagccattagaagagaatgagcatgtgaatagaactttgactgaaaatgttagtcagattgtcagagtgattgtgaaggaatgtattgaccatatctcggtgagagtgtga

SEQ ID NO: 82735 - DNA, 264 bp, Glycine max
  Peptide Sequence Number=SeqID_174420
atggcatgggatgaattgcaaagattgagacttgtaagtgctaaagttgatgtctcgctaagcgagctcaatgcacttagcgagtgtcatccgctaagtgaggcatcaacgcgcttagcggataggaggaatctggaagggaatctgtcacgcaggcacgcactcagcgcgtcatcagctcactcagcaagtcgtttgtcaccttccaggcttagcgcgagtttggtgctgagcgattattcacttactcgtgataagcgctag

SEQ ID NO: 82736 - DNA, 357 bp, Glycine max
  Peptide Sequence Number=SeqID_174421
atgggggttaaccaaatagtaagtggttccagcagggattctcagggcatcaccaggctgaagacgaatgtgaccatattggttcttgaagagagtgtggaagctgttaaagctgaagtgataagggacgtggaaatggacgaggttgctcacgcttgtcttgttcttttttcgccttttcaccctcctggcgtcccttttctttccgttccctctccttgtgtggttactgattttctctttcttcttgttgctcctcatgctcaggaacaagcctgcaacgaatcttacattgttgtagcttgtatggatcctgcccgctcttgcaactctgtaggcatcgctgcttctgtgtaa

SEQ ID NO: 82737 - DNA, 1485 bp, Glycine max
  Peptide Sequence Number=SeqID_174422
atggaaatctccggcaccgttccgagctcggggtcctctctccgactcagcagcgatgatggcgatcctctcttaggttctcgtatcagagctggaaaagacgatgctttaacagcggacacagatctagaggcttcctcctctggtcgaattgcttctagaaagcaaaaatattgggtgagcagcatcaaattgtttggggtagaattatcccctgataatgttgctgttgcgatggtttattttgttcaaggtgttttagggcttgcaagactggctgtgaacttttacttaaaagatgatttgcatttagaccctgctgaggcagctgtgatttctggtttttctgcattgccgtggcttgtcaaacctctttacgggtttattaggtcatacctagttttgtcagggctgcttggtgcactctcgtggagtttgatggctacttttgttgacaacaaatatagtgctggtttttgcatacttcttggatctctatctgttgccttctcagatgttgttgtagattcaatggttgtggagagggcacgtggtgagtcccaaagcacctcgggatctcttcagtctttatgttggggttcttcggcctttggtggaattgtgagctcctacttcagtggatctttgctggatgcatatggagtaaggtttgtttttggtgtcacatcattgcttccattgataacatctgtagttgctgttcttgtaaaagaacaacctatgtttggtacaacaagagggctaaatattctttttgctgggccagagtttttggaaagttcaaaacagcgcattattcagctgtggggttctgtgcgacagcgtagtgtttttcttcccactttatttattttcttgtggcaagcaactccgcagtctgactctgctatgttctactttaccacaaattctcttggttttaccccagagtttttgggacgtgtcaagcttgttacctcaattgcatctctgctcggtgttggtctttataatggatttctgaagaatgtgcctttacggaaaatattttttgcaactacccttttaggttcaactcttgggatgactcaggttttccttgttactggactaaaccgtaagtttggcattagtgatgagtggtttgcaattggtgattcattaattctcactgttttgagtcaggcttctttcatgcctgttcttgtgctagcagcaagattatgtcccgaaggaatggaggcaactcttttcgcaactctcatgtctgtatctaatggagggagtgttgttgggggattgttaggggcgggattgactcaactatttggaattaccaaggacagatttgataacttggcagctttgataatcctttgcaatcttagctcattattgcctctgcctcttcttggccttctccctgggggcaatcctgatgtgaatgaggaggacaattccgatattgagatgaaatgtaattga

SEQ ID NO: 82738 - DNA, 1044 bp, Glycine max
  Peptide Sequence Number=SeqID_174423
atgccgtgcggtggtgttccacttctgatgatgttacaacttacaagggagttctcatacaaggatgggaaatgtgtggaaactggaaagtgttttatgggggatattgcagctgccatggtgtttgtgcagagccgtatgaaggtcaatttaaagctggtgtggataatgaaaatctatggactatggagtttggtcttcagacaaaccaaagatagggctgtggagtggtggtatttcatgatgtgggagtttggaccatttcatgatgcttgtcaaacagaacaatctgattttgggaggcagagcattgtgattgaggactatcactcttctgcatcggttacaattttatccgatgtggtcgctcttgcatcggttgaggagataacagatagagactgggagtttcctttcatggagttcacggcactctctaacgcttcccaacttgggagcatcaacccccgcagaaccaaccttcaaagtttaacacaaaccctcttgctttttcttatgtttctttcccttcttcctctcgcagaggttgctcttgcaaagccattctcaacacccacacacccacctctagcctttggacctccttccgctgattttgagctctctgttttgacggctctgtccccattggatggtcgttattggagcaaagttaaggaactgactccttttctgagtgaatatggcttaatatactttcgggttcttgttgaggttaaaaacattgagagggtcacaaatgatgatgtgaaagcagtggagtacttcttgaaacaaaagtgtcaatccaatgcagaagtggttaaggtgcttgagtttttccactttgcttgcacatctgaggatataaataatcttgcacatgccttgatgctgaaggaaacaatgaattctgtcatgtttcctgtcatggatcaaataatcaaagctttgtgtgacatggctaaagataatgctcttgtcccaatgctttctcacactcatggacaggaatgttcatttgtgcatttgttgaaaatttaa

SEQ ID NO: 82739 - DNA, 135 bp, Glycine max
  Peptide Sequence Number=SeqID_174424
atgggtgtaggtatagggcattctcttcttgcctataaaagcacacttcaaggaatggggaagcttcaggtattcagtgcaacatgggcttcagtgacacagtttataccttactgtggtgacattccattttag

SEQ ID NO: 82740 - DNA, 615 bp, Glycine max
  Peptide Sequence Number=SeqID_174425
atgaaggtccaccctgttcctcgaaaacgcaacatctcaatccaatttggcggcgacgggggcaacccgatgtcggaggctcaggcgctgttggggatcgccgggaagaagctccggcgactaccgcacgtgttcagctgcgtgctggagctgcccttccgctccgacgccgacgttgcggtggaggaagcccccgactgcttccgctttgtggcggagaccgatggaatcggcgacgtgagggcgcacacggtggaaatccaccctggcgtgacgaagatcgtggtgagggacggcggctcggtggagctctcgctcgaccagctggagctcgatatgtggaggttccggttgccggaatcgactcggccggagctcgccagcgcggtgttcgtcgacggcgagctcatcgtcacggtgccgaaggggcacgaagaggagaatgatggggatggtgatagaggtatgggtggaggtagacttgtgcttgttgttgttggaactagtttctctgtgaattttattgttgctattgttcagtcaggaacaaaaatgttttatctggattctggagaatggtttattcatcatggcaatggcaattatccaaaatag

SEQ ID NO: 82741 - DNA, 318 bp, Glycine max
  Peptide Sequence Number=SeqID_174426
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccaggggcggtgttcatgttggtaaagaaagtaaagaggcaagtgtgggagttagaactcataactattag

SEQ ID NO: 82742 - DNA, 87 bp, Glycine max
  Peptide Sequence Number=SeqID_174427
atgaaggtagaacaactttttgcttgccatcatattagtgaagagagaaaagttccattggctacccttagctttcaagggaattaa

SEQ ID NO: 82743 - DNA, 519 bp, Glycine max
  Peptide Sequence Number=SeqID_174428
atggccccgaggaaacttgcctcaaagagatacaggaaggataaagcggccgaaggaactagttctgctcccaagtatgataatcaccattttaggagcgctgaacaccagcagcgctttgaggccatcaagggatggtcatttctccgggagcgacgcgtccagctcagggacgatgagtataccgatttccaggaagaaataggtcgccggcggtgggcatcattggttacccccatggccaagtttgatccaaacatagtcctcgaattttatgccaatgcttggccaacagaggagggcgtgcgtgatatgaggtcctgggtgaggggtcagtggatcccgtttgatgcagatgctattggccagctcctggggtatcctttagtgctagaagagggccaggagtgcgagtatggccagaggaggaaccagtctgatgggttcgatgaggaggtcatcgcccagttactatgtataccggggcaagattttgcccggactgctgccaggagacgg

SEQ ID NO: 82744 - DNA, 803 bp, Glycine max
  Peptide Sequence Number=SeqID_174429
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttcaccgtctttgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 82745 - DNA, 501 bp, Glycine max
  Peptide Sequence Number=SeqID_174430
atggttgctatcaataagcaatttcgctggaaacttggcagtggtaatcaaatcctattttgggaagactcttgggtgggagatggaattactcttaaagacagatacccagaattatatcaaatatcatcccaaaaattaaagacagtggcaagcatggggatctttggagaatctggttgggagtggaaattctcctggagaagatatctatttgacaatgaaatggggggagaagatatcaattctaatgtaccatatatctgccctattctcaggggagtattcattgatgattcatggaccgacgacccacacaaggtgaaggaagaggtgaaatcctttttcttccataggttccaagaaccaattggtcagcgacccaagattgatggaatcaggtttcaaactgttaatcaacagcagaataacgagcttcgggcacctttcatggacgaagaaattcagaacgcaattcacaaaaggattgcatggatttaa

SEQ ID NO: 82746 - DNA, 659 bp, Glycine max
  Peptide Sequence Number=SeqID_174431
ctgaacggtctggttataggtacattgagcaactgactgaaatgcctcaaaatgttctttacgatgccattgggatatatcaacggtggtatatccattggaacctcttacgtgccgatcaacgtctcattttcgccaaaagtatggtccaagatcgagctggccgacagcaacagctcggccctggtatcaagcttatcgataccgtcgacctcgagggggggcccgggtaccagcttttgttctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggatctatattccgcttcctcgctcactgactcgctacgctcggtcgttcgactgcggcgagcggaaatggcttacgaacggggcggaattcctggaacatgccaggaagatacttaacagggaagcgtttccccctggcggctccctcgtgcgctctcctgttcctgcctttcggtttaccggtgtcattccgctgttatggccgcgtttgtctcattccacgcctgacactcagttccgg

SEQ ID NO: 82747 - DNA, 210 bp, Glycine max
  Peptide Sequence Number=SeqID_174432
atgtacactctcgtttacagcactgggatttccagcattgatcacaggtctctgccaattctacgagggcagggccaacagcaggagtcgaccgcagatgcaccaccactgcctccacatcagccaccatctctagagtccatctcagctcacatgcagaggatggagctccagatgcacgcatacatgcatcatttggttgatcaatag

SEQ ID NO: 82748 - DNA, 270 bp, Glycine max
  Peptide Sequence Number=SeqID_174433
atggagagcaaaatcctctgttggttcttccttatgcatgctttgttaggatcattcaacagtgggaactggattcctttgaggagcaggccacacagggatccttcctttccccatggacgtcaggatgttctcgccgctgctattggacgtccagaacaccctggacgtgttcgtgctgttggagccggtgtcaccatcaagcaatactttggatcggctccacggatgtcccgcagctcttcctccctgcctcctgaagaattgtag

SEQ ID NO: 82749 - DNA, 378 bp, Glycine max
  Peptide Sequence Number=SeqID_174434
atgtacaatcatcatgagaaaggaagaggtcctaatcttgaaagtgtattggcagacttcatgacatatcaagctaattctaaagaaggattgtcttatctggatgacctgttaatgcaattcaagggtacagtagatccaatgcaacaagcgtttaaaagagctgagactcagattggtaagttggtggatgatatgactaaagttgtggtcagaagagaagaagagtatgcagagattgaaacacatcaagaaagcaaagataaaggtcgattagaacttagtgtagaggatcaaaaaatctcctttgacctctttgcagcaatgaaacacccagatatgagtgatgcctgttttgaagaagaagaggtggagtag

SEQ ID NO: 82750 - DNA, 159 bp, Glycine max
  Peptide Sequence Number=SeqID_174435
gatgttctcgccgctactattcgacgtctagagcaccctggacatgtccgtgctgctggagccggtgtcaccatcaagcaatactttggatcggctccacggacgccccgtagcacttcctcgttgcctcttgacgaattacagcagctgacccagtag

SEQ ID NO: 82751 - DNA, 438 bp, Glycine max
  Peptide Sequence Number=SeqID_174436
atgggaacaaatcaaaccggaaaaagattctatcaagtcaagattaagggcctagatgtcaccagccttaaagagttagggcggttgatgggacctctccaaatgcaagccttccgcaaggcgtacggaaagattttagatttgaccatagcggagatattcacggaaaccgttgtatccctcacccaatactatgaccagcctttgagatgcttcacgtttggagacttccaattaggattcggcaagagagttagatcgtgtaaagcaaactcgaaacggcatagtgggcctaccacggaagtacttggaaggcaaggcaagagatatggcgaatcaagaggagtgggtcccgtttgtggacgtattagcattgctaatctttggggttgtcctctttccaaacgcggacggtttggtggacctagctgcgattga

SEQ ID NO: 82752 - DNA, 387 bp, Glycine max
  Peptide Sequence Number=SeqID_174437
atggccccgaggaaacttgcctcaaagagatccaggaaggataaaacggccgaaggaactagttccgctcccgagtatgatagtcaccgctttaggagcgctgaacaccagcagcgcttcgaggccatcaagggatggtcatttcttcaggagcgacgcgtccaactcagggacgacgagtacaccgatttccaggaggagatagttcgccggcggtgggcatcgctggtcacccccatggccaagttcgatccatacatagtcctcgaattttatgccaatgcttggccaacagaggagggcgtgcgtgatatgaggtcctgggtaaagggtcagtggatcccgtttgatgcagatgctattggtcagctcctaggatatccttta

SEQ ID NO: 82753 - DNA, 714 bp, Glycine max
  Peptide Sequence Number=SeqID_174438
atgaggggagcaccaacggaagaaagcctatctcctttccttgtgagagatttcggcacgcaaagtttcaagattattcaaagagtccataaggcgtgggaaagcccgttaaggaaagataaagaacttaggggcattcgtaatggcatcattggtggttatcatgaatggctgaaagttcatacacgagggttagattggctctctaagctaaagattatcaacgaagagaactttgaagctcctgaagaggatgaagaagtccgagctctaaaaaccgaactaggaaaagcgagacttgccaaagaaaaattcaagttggtcgctacagacgtctggaaagagtgtgccgggttacgagaagaaaatgcagctaccgcaagagcccttgagcaagaaaccaagagggctcgcaaggaagagcatggccatgaaaaatttcgtggagctttgtggggcagaaacagtgagctcaagcttcgaagggaagagagagaccaatcacgagcacatagcatggtcttgaaagaagagttagccgcttgctcaaggtccaaaaggaacttgtctcgacgtttatgcgagacagagaccaacatgttagccatcgtcagcaagtaccaagaagaactaaatcaagccacggaccacgagcatatagtggcggacgagtatgcccaagtgtacgcggaaaggaggctagaggaagggtga

SEQ ID NO: 82754 - DNA, 397 bp, Glycine max
  Peptide Sequence Number=SeqID_174439
atgggcctagttttttcagacctgctgagatccctcgtgggaggatgtgcagaaaaaaaacacaggccatctagaagcccccacgtgttgtctcgtgggggttatgattatttagaacagaagctgatggctgagaagacaaagaaaaaactagaggaagctgctcagtccggaagcactgagggcgtcattaaccctccatctcccatcagacgacacgtgaagtggaagatggcgcgcaccaagaaaactgggcagatgacgtctaaggccgcaaaggaaatcactgaaaagattgcgtcacaagattcgtttgtcccccatggtcgtcatgatgtcctgactgttgccattgggcgaccagaacaccctggctgtgtgcatgctgctggagccg

SEQ ID NO: 82755 - DNA, 108 bp, Glycine max
  Peptide Sequence Number=SeqID_174440
atggcccctgcagcagaatatagaagtttagttgctgccacagctgatattctctggattcatactcttgtcttggaacttgcagtcccttattctagacctagatag

SEQ ID NO: 82756 - DNA, 258 bp, Glycine max
  Peptide Sequence Number=SeqID_174441
atggtgaaagttggaacttcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 82757 - DNA, 129 bp, Glycine max
  Peptide Sequence Number=SeqID_174442
atgcagaggctatcatcgtctcctacaccttctgtcgtcctgacccgtgaagtcaggtttttactctcgtcgttcgaaaacattcaagcccaacggcgcacgagattcttctctgctggccagggatga

SEQ ID NO: 82758 - DNA, 786 bp, Glycine max
  Peptide Sequence Number=SeqID_174443
atggagcataagtttcatccatctaaggttgcggcaagggctatcactttgtccattaggcaacaatttggtcagccttggcctagatggggagcgattccaaaagatcatcaggaactttttttcctgcgttttaagctatctcaagctaggtctgatgctgcatcaagtgctggtgaatcccaactcactcccttagaccctgatgaagaacaaagacttaggagttggtgttgggttgcaactacaagaccaaagcgtaaggaacgcctttatgatactggagaccttgttcatacttacaaatgtggaaatggcagcctcatgcagcatacgcaaggatcttctagtagcgttgaagatgctgcagagattaactgcccgagggagaagctacgtcaatcaaaaagaggagatacacattttttagttagtagtccttcagttcctaccttcagaggcacgaaacattattcatcaacaacaataacctcagtaacagtaccaagaccagcaacaacaacaccaggaccagtagcaacaccaccagcaccagcaagaacaacaacaggaccagtcaagctctttaaacgcaacacaggccaagtcaaaccaaggatgatgggagcaaccgcagtgttagcattgggctgcacaggaagagacatatctggtgttggaaggaaggttcactttttcttgccatcatcccttccacgtagtgctctattgccttttgttggacaaaacatagatacagaaacatattggacatgtatcaagtga

SEQ ID NO: 82759 - DNA, 225 bp, Glycine max
  Peptide Sequence Number=SeqID_174444
atggccatgacccttccgtgcccacatcctttcgtgccaaccaccaaagcaactgttctacaaccaaaccaaagcaacagcaccaccaaccttgcaatcgtatcaccatcgtcaccaaccaaatcgccactaaccacccgcaacccaaacccccatcgagcatcaccatcaccaatcaaaccaccaaccacccacgacccaaaccaccatcgaacaacaccataa

SEQ ID NO: 82760 - DNA, 255 bp, Glycine max
  Peptide Sequence Number=SeqID_174445
atgtcccattgtcgcaacctactcttttgtgggcgagcgaggcgaggcttacgggtcgacaaaagcggggcacttgctcctacgtaccctccgtcgaagaggaaatcagacctacgtagttttttccaaagggcaaatcaagcgattctttttacttggagggtggaaaataggggaggagcttgccacctagctcacccaggcgagccaggttgcttcctccagaagcaaccgccttctggaggaacatcctag

SEQ ID NO: 82761 - DNA, 333 bp, Glycine max
  Peptide Sequence Number=SeqID_174446
atgtcggctttgaaagagcaaatggtttccatgatggatgccatgctaggactgagacaactaatggagaataacgtggccaccgccgccgctgttagttcggctgccgaagcagacccaactctcccagctaccgcgcatcaccctatcccaaacgtggtaggacgagaaagaagcacactggggcacatcaacaacccccatccggggtacaatcgagtggcttacccctatgggttaccacccaattacacaccaccagtcatacgtgacgacgcaggtcatgtccctccccccatccttgaaggggagccttctcgacagctggatgag

SEQ ID NO: 82762 - DNA, 495 bp, Glycine max
  Peptide Sequence Number=SeqID_174447
atggggagaagagagagtgcattaggcaaagatatagagcaacaacctaccctcctagaggagtatcacttgaggaataaatcagaaagaagccctgtaacttatatatctagtcatggctttactgagaatagccattttcctgaaggaaaagaggagttaaaagatggttacatttctgagaatgggaaactggttgatcatttcttgcaagccattcatgctgcagagaaaaggcaggctgacttagatgcatatgtttctaatgaacagaagaaactgttaaaaggaaatatatggaaagaagttgaaagatgcagctaccagagaacttatgctcgccgaggaggttgcaatgttggacaggagctaaaaagagagagagcaaaagcatcccttgctatcaagtcacttcgacaaaagatggaagacaaactgaagatagaactagaacaaaaggaaattgaaactgatttgaagttgaaacaaacttag

SEQ ID NO: 82763 - DNA, 201 bp, Glycine max
  Peptide Sequence Number=SeqID_174448
atggcagcggaatggagaaggaagagagagaggagaggccacttcaaggagaagatgagtctagaagaagctcaccaccataggaggccatggataagagcttggaggaagaaggagatgaatgaaggccaactaatccaagatcaattccaagattctccactaagtgttcttaggtgtcatgaggcatgtaaagcatga

SEQ ID NO: 82764 - DNA, 849 bp, Glycine max
  Peptide Sequence Number=SeqID_174449
atggctctgaagaagctttccacgaagaggtccagaaaggacgctactggagaaagctccagcgctaccccgggttttgaccggcaccgatttcggagtgccaagcatcagcagcgcttcgaggccatcaggggatggtcattccacaaagagaggtgttgggcaccacttatgacccccatggctaaatttgacccggagatagtcatggaattctatgccaatgcctggcccaccgaggagggggtttgggatatgcgctcgtgggcttccggcttggacgaggaggctattgctcagctgttgtgcataccggggcaggattttggccagaccgctgcaagaaaatgggtgtggatcatgcgcaccaatatgaacaccctgactcagatatggatgacgttgctgctcagcaaaattctacctagcgaccacaactccgacctccccctgccgaagtgtcagctggtgtatgctatcctgacatggatgagcgttcatgtggctcagttaattgctgacaccatctatctgtttacaggaatggcgcctatgaggcaccttttggacccggagaagtccaacagggccctggggttcccagctctaatcatgggcctctgccagttttacggggtgcctgtcactcccaacaaggagccttcatcaagaagcggccaaccactggggacagagcagtttggggctgcggtcgcatggcctggagactggctcgatactcagacaggggcaggactcgcagggacgcctggagatgcggatggagcacaggaagatgaggatatggctgacttgcttgacttcctgggagggcgcggagccatgtga

SEQ ID NO: 82765 - DNA, 306 bp, Glycine max
  Peptide Sequence Number=SeqID_174450
atgaggtcctttaatggtgattttccaccatggagatgcagcggaagacaaaagagaagaggtgagaggaggcgccatccactagggaataagccatggaagaaggagcttcaccaccaagatgagccttggataagaagcttggaaggatgcttcaatggaggaaaagaaagagagaggggggagcacgaaattgaaggaataaaagaggcaaagaagtggaactttgaagtagcttccttgagaagctttcttgagaaaacttccttgagaagcttctttgagaaaacttccttgagaagctag

SEQ ID NO: 82766 - DNA, 354 bp, Glycine max
  Peptide Sequence Number=SeqID_174451
atgggaggtgcctgtgaagaaccacgggagctccttaaccctgcccctctacaactgctacatttcttagtaggggggccgcctccagcagtggaagagacagaaaaacttgatctcatcgaagagagattaagggctatcaaagggttcattgattaccctttcgccgacatgacaaaattttgtttggcacctgatgttgtcatccctccaaagttcaaggtaaaacaggcaagattggtgaagtgcaaatttcatgaactcgttaagccacttatcttctggctaagcgcatcattcgctaagcgcccaatttggtggctaagtgcatggacaattctggaagaaggttga

SEQ ID NO: 82767 - DNA, 471 bp, Glycine max
  Peptide Sequence Number=SeqID_174452
atgtatgctctcggccaagaagggaaactacctatcgccagatacctcaagcgagggttgtctctccagatacttatagggggtttcaatagatctcttttccacctaggtctcaagagtatgcctctagcctattggaaaaagaaaggaagaaggaaggcaagactactaaaacaaggctctttaaagccagaacgagtcctctctcgcgagagggaaaaaatcctttctgtttttaggttcctaggactttactcaaaaaatttaactcatggccaaatcaagaaggaacaaaatttaaaagatgaggccaacaacgaacacaacactcaacctcgtatgacactgtattggattaaagaaattggttttcctcttcaagggtctagcattcgtgcccaagaagtcatcaattgcccccgcttcaatcccattctcactccctttacctctggcaacgacaaaatttag

SEQ ID NO: 82768 - DNA, 558 bp, Glycine max
  Peptide Sequence Number=SeqID_174453
atggatgatgaaacttgttatgttagtgcactacacagcctaaaagttcatcaagtgctgttggacatgaatgggaaaatggaaggtgcaggattttatctcaatgccacacaagagaaatggaagaattggcgcatgtatgactatgttgtcaaggagttgccaaagcttctgagtgataattttccacagcttgaaatatcaaaagcttctatatttggtcattctatgggtgggcatggtgctctaacaatcttcctgaaaaatcaggataaatataagcataagccacacatccccaaggtgtacacccgcaaacacccaagggttgcataccacccaacagttacaacccacccaaagggtgtaaaccactcaatagttacgattcacccaaagggtgcaaggtcagaagatgtgaatctaggggacatgacccttgggaacagtcaaaacgaatcgaaaggggacatgacccttgggaacaatcacaaccaaccgaaagatgtgaatcaaggggacatgacccttgggaatagtcacaaccaaccattatga

SEQ ID NO: 82769 - DNA, 327 bp, Glycine max
  Peptide Sequence Number=SeqID_174454
atgaatactttgaagcatggcttcaaagcgctgagagtcatgggcagctggtgtaggcgtggcagaagtgggaggagctggtggtgcagaaaaagaaggagcatttgctggtcgagcccttaccttcctgacccttctgaagttaactgtcagatcatccatattccaacagtttttattaatgtaggccaaattaatggccaggctcaggctctcataggtcagactgtcagaggtaactcctctagttctacacagggcaatgatcaaggctggaaatccgagcctagaggagttactttaggcaatggtagaaatctgacatga

SEQ ID NO: 82770 - DNA, 465 bp, Glycine max
  Peptide Sequence Number=SeqID_174455
atgaggttgtcggctctcaatgagtatgggagtggagttattgacatcctcatcgagagtgtacgccacattgggtggtgtatagttgggaggcaagccatatggcaggaagatgggggcgtcgggttcaccttaacaacagcgctggtagcggcaactgcaatcacattggcttccattatcttcttgatgctcatcatggcctctatcattgtggccatttgctctttcatggcctctgtcacaacctacccttcggcgggagggcgacgcatcactcgcgggtgcgtcttccaagaaaggaatacgtgcggagtcgccaccaacgtttatttgaggaaaacatcagaaaaaccggaaaagacgtggtcaacgaattttaagcgaaaggttcgggagttgtatttacgcacgaggaaggtattagaaccccacacgtccatcacaagggatggcagcctttaa

SEQ ID NO: 82771 - DNA, 351 bp, Glycine max
  Peptide Sequence Number=SeqID_174456
atggaaaaatccgacaagatgaatttcaaagagaagaaagaaaagaaaggatatatcacttgggaagataatgtcataaattattcaagtgattcagagaagaaaatcataagtctggatatcatgatgaaagactatgaaaatggagaagagcaaagtcgatacattgatagcaatttctccaaacacatggcatgcatcgaagtttattcatatttctccccaagaaaattggaagtggaagttactggaagttggaagttggaagtggagatgaaagttattggaagttggaagttggaagttgagaatggaggttggaagttggaaggggaagttactaaaaattga

SEQ ID NO: 82772 - DNA, 99 bp, Glycine max
  Peptide Sequence Number=SeqID_174457
atggacaaagatcaatggatgtatgacagtataatgtctgaagaagttgatatggatgatcaaaataaacaagaatgtggtgtttggtacccgagatga

SEQ ID NO: 82773 - DNA, 825 bp, Glycine max
  Peptide Sequence Number=SeqID_174458
atggcgagcctgttccttaccggttacgctctggaagaggtgctctctgtcgataacctgtttgtgatgatggcgatcttcgcctggttcggcgtgccggataagtatcgtcaccgcgtcctttactggggagtgctgggggcgattatcttccgcggtattttcgtggcgatcggcaccagcctgctgagcctggggccgtacgtggaggtgattttcgcgctggtcgtcggctggacggcagtgatgatgctcaagcgcaatgaagagagcgacgaggtggaggattactccgggcatctcgcgtatcgcctggtgaaacgcttctatcctgtctggccgaaaatcagcagcaatgcctttattctgacccagaaagaggtggatgcggagcttgaaaaaccggaaaaccaggacgtgatggtgggccgcgttaagaaggcgaagcgctatgcgacgccgctgctgctttgcgtggcggttgtcgaactctctgatgtgatgttcgcctttgactccgtgccggccattattgccgtgagccgcgaaccgctgattatttacagcgccatgatgttcgccattctcggtctgcgtacgctctacttcgtgctggaagcgctgaagcagtatctggtgcacctcgaaaaagccgtcgtgctgctgctgttcttcgtggcgttcaagttgggattaaatgctaccgatcacttctggcatcacggttacaacattggcgccacggcaagcctgtttgtcgtgctcggcgtgctggcgctggggattattgcgagcgtgatgttccctggaaaacgcgaggcctga

SEQ ID NO: 82774 - DNA, 384 bp, Glycine max
  Peptide Sequence Number=SeqID_174459
atgtgcagccagcttccgggttgggttgtcgcatcgcagccgctgggtaacgatcaggatacgctgaatgttacggtaacgggcttccatggccgttatgacggtgcggtggtgatcagcggggagtggttgctgaatcatcaggggcaactgatcaagcgtcctttccatctggagctgaaacagcagaaagatggttatgacgaaatggtgaaaagtcctggctcagggttgggcacaggagtcggccagtatcgccagggaaatttcccggctgccataaacaaaagaatgagggaaacgaggcatgaagagacagaaacgagatcgcctggaacgggctcatcaacgtggttatcaggccggcatcgctggacgttctaa

SEQ ID NO: 82775 - DNA, 1633 bp, Glycine max
  Peptide Sequence Number=SeqID_174460
atgtccactcaacaacctaacccctggggtttgtatgatccatcagcaggaagcgacagctgtggtgtaggttttattacccgcaaggacggcgagcagacccatgaaatcctgcagatggcgcatagcgccctgtgcacggtaccgcaccgtggcgggatgtctgcagagggtgtgggcgatggtgcaggcgttaacgttgacctctccctgaacttcttccgtaagctgaccggtcaggcgctggaagcgggccgctttggcgtgggcaacttctttgtgccaaaagatgcggcgctgcgcgcgaacgcagagcgtctggttgaagagacgctggccgcttacaacttcccggtgctgctgaagcgtgatatgccgctggacaacagcgtcacgcgcccggccgcacagcagttccagctgccgatcgtgcagtgggtgtttgccgcaccgcaggacgttaccgagcagagcgacttcgagcgccacatttaccgtgcgctgctggacatcgaagcacgcgcttttaccgaaagcgaattcggcggcctttatccgctgtcgctgtcgtcgcgtactcaggtgttcaaagcccgcctgaactccaacgaagtgattccctacttcaaagatctgaccgatcccgatcatcaggtgcgcggactgtttttccatacccgcttctccaccaataccgatccgcataccacaatggcgcagccgttccgtctgatggcgcacaacggtgagctgaacacggaccgtaaaaaccgcatcgcggaagcggcactgatgctggcgcgcggcaaaaagatcgtgcggccaaaaggccagtctgacagttcacgtctcgatcagagcatccacagccgtctgatggaagataacctcgatctgatcaacgccgtggtttcaatgatgccgccggcgtgggaaaacgacacctcgctgtcggctgaagtgcgcgccatgctcgaatacttctcgctgtatgaagagaagaacgacggccccgccgcgctgatcttcggtaacggcgaagtgattggcgcacggctggaccgtcttggtctgcgtccgctgcgctccgtagaaaccgctgaatacatcggtgcgatgtcagaagccggccagatcgccttcccaccggagagcgtgctgcgccgtggccgtatcgaagctggcggcatgctctattacgatcacaaagagaaacgctcttacaccaccgtgcaggcgctggaaaagctggcggcggaaaaagattatctctccctggtgcaggcggcacgcgttgaactgcagcagctgccggaagtgccggcagagaaactcggctcgccgctgcgctatcgcggcgacctgaaaacctatcagcgctttgtggcttactactacaaccaggaaagcttcaaattcatgatggacccgatgctgcaaaccggcgctgagaagatctccgcgatgggttacggcaacgccatcaatggcctgtccgatcatgaaggcggcatggcgcactacttctcgcagcgctttgcacaggtcaccaacccgccgctcgactccatccgtgaagcggacggcatgacgctgcgcgtggcgctcggcgccaaaccgcacctcggtcgca

SEQ ID NO: 82776 - DNA, 317 bp, Glycine max
  Peptide Sequence Number=SeqID_174461
atggtgaaagttggaacctcttacgtgccgatcaacgtctcattttcgccaaaagttggcccagggcttcccgggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 82777 - DNA, 917 bp, Glycine max
  Peptide Sequence Number=SeqID_174462
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgctgcagactcctcaactctcagaccctgccctcccctccctcaccttctctcttttccggaggaatttttccaacgcatgggctcaaaaacgttcaaaggctcgctagcctttgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 82778 - DNA, 634 bp, Glycine max
  Peptide Sequence Number=SeqID_174463
ttggcccagggcttcccggtatcaacagggacaccaggatttatttattctgcgaagtgatctccgtcacagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatcaaaaagtggagaggaaggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 82779 - DNA, 306 bp, Glycine max
  Peptide Sequence Number=SeqID_174464
atgtcaaatttattgtctgtgttttcaaatgtaaatggctcaccacctagctcccctcgtccttctcctccgactgattcgacatcacattccccttctaccttgaataggacaagaaaagtgacccggctgagatcattggctactagaccagttggggcagagagacccctagtccatgtggatcctaaaactgggaaagccgacagtccccacagaaagaagttaagaatatatttggggatcgccgctcgtgataaggtggatgtgacatacgagaattggaaacaagtccctactgcctag

SEQ ID NO: 82780 - DNA, 449 bp, Glycine max
  Peptide Sequence Number=SeqID_174465
ggaccgaaaaatccagggctagaagatctgaggccccatcttcatcagctgcccctgctccctctacatcaactccctctacttctgctctttccttaccactagcagctccaattcttccaggtccctctactcagagcttagagccttccttgtctatgctacatagcctgcatcagggccagctcctgatcatgcagagtttgcaggatgtggtccagcaatggccagttatgagtgtggaggaatttcttcagaaggtggcctggccaggagtccagccttctcatttgggaggggagccttccactacagtgctggacatgtcttcttctcagcctgagtcatctgcaccagtgccagatcttcctctttctcaggattcactatcaggcactcctgcactagatctgaatgagcatgccattgactctgcacaagaccattga

SEQ ID NO: 82781 - DNA, 267 bp, Glycine max
  Peptide Sequence Number=SeqID_174466
atgtcgaccttcgagcatttcgtttctaaacgaccatatagaggaaacactaggtccaacaaagataggagagaatcactcaaagtgtatcaatctcacacagggcaaggattgacattctcaccctgggtcaaggtttatgataagttgggattttggctcaaggcttttagaacggctggtcatgatatatgccagggtttggccagcggttcggggataaaggggatgtcctacattatttccatgatacacatgcaacaatga

SEQ ID NO: 82782 - DNA, 483 bp, Glycine max
  Peptide Sequence Number=SeqID_174467
atggaggccatgaaagagcaaataaccacaatgatggaagccatgataagtatgagaaaaatgatggaggtctacacggctacagttgttcccgcaagtaccaccatagaagtgggcccgactcacccatctagccttaatcaagtaaatcatccaacctcggatatggtaggtcagggtggcaaagcattaggaagtacaggcagcctccattttgtgcaggttcaaaacaaacattccttcccaccatatggcttgcctcccaactatacaccacccaatattgctgatgaggacatgaccaagagcaagggcaaggatccacttgaaggacttggaggacctatgacaagggctagagcaaggaaagccaaggaagctcttcaacaagtgctgtccatactatttgaatacaagcccaagtttcaaggagaaaagtccaaggttgtgagttatatcatggcccaaatggaggaggactaa

SEQ ID NO: 82783 - DNA, 840 bp, Glycine max
  Peptide Sequence Number=SeqID_174468
atggttaggaccagaggattaggttgtgccttaggtcaggttactggcagaggtgtcggtagaggagatcgtgatgattccgatgatgctccgcaacgtcgacggcctactgcatccgcacggaggcagcgagtcgctgtgactgtggatcacgtcgatgagccagtcatccctgcgccagatgttcaggatgactcgatagaggcaccagctgctgtagaggaatttcctgcggacacaggcgcagagcctgctgaggacgcgcatgagggattttcgggtggtctgagcgatccatccgtgttgaccctgtatgcgaatcacgttgcttgcagcgtatggacgggagagttatcctctcatgggaggaaggtccacagtttaggcaggcctgtctatgccattgagggacttgttgttggtacaagactaagtcctctaatcgcgtgttcggtagacacaggtgatcggggacttttgtccgcgtttgtggagcggtggcaccgggagacgtctagtttccatctcccggtgggagagctcaccatcacattggacaacgtctcctctcttctccatcttcccgttattggcgacttacacacatttgagcccttgcacgtggacgatgcagttcagatgctggcggacttgttgatggtctctccagagtctgctagggctgagacagtccagtgtcgcggaccgtacccgcggctcattggacagccgcggctcgcgcatatcttcttcaccttctgggttgcactctgtttgctaacaagagtgcaaccaatgtccatgttgtctacttggaggcccttcgtgacctcagtatga

SEQ ID NO: 82784 - DNA, 761 bp, Glycine max
  misc_feature (5)..(5): n is a, c, g, or t
  Peptide Sequence Number=SeqID_174469
ggggncggagcctatggaaaaacgccagcaacgcggcctttttacggttcctggccttttgctggcctttggctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatgttgcgagtgcagcttggagtgaacatgccagctcaagctactcggaaggttgaggaggaggtggaggcaaaagaagtagagctttttgaggtatatgatgttgtcctctacatgggcgtaattgatatattgcagaactataatctgagaaagaaaattgagcatgcatacaaatcgctgcaatttgaccctatgacaatatcagtagttgaacccaagatggatcctctagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcgccccgacacccgccaacacccgctgacgcgccctgacgggcttgtctgctcccggcatccgcttacagacaagctgtga

SEQ ID NO: 82785 - DNA, 303 bp, Glycine max
  Peptide Sequence Number=SeqID_174470
atgaccgaccctctcgatgagtcgatctcttgctttctcataagggtgaacccttgggtactagtaccctcacctccagaggactacatgtcctcgccttcagagggccgcacgccctcgccttcagagggccgcacgccctcgccttcagaggactacacgtcctcaccttcagaggacttcacgtcctcacctttagaggactacacgtcctcaccttcagaggactacacgtcctcgccttcaaagggtcatgtaccttcaacttcagaggactacacgtcctcgccgtcaaagggtcat

SEQ ID NO: 82786 - DNA, 410 bp, Glycine max
  Peptide Sequence Number=SeqID_174471
atggctgctactgttaaccaagcagctagaatcacttacagaaacactcagcaaattgccaacacagttacaagttaccagcaaggagggaatttcaatcaaaatcaagggcaaggatggaggtcacatcaagggaatcaattcaacaaagatcaaggaggaccttccaacagacctcctaatcaagggcctaacttgtctcaatgtctaattataagagcactgagtcagccatcaagaacctggagatccaagtgggacaatttggccaagcaaataaccaagagttcttctggaggttttggagctaacactgagaaaaatcctaaggaagaatgccaggctgttatgaccagaagtaaacgagagattgtcgtggagaatgagagtaggattagtgaggagaagga

SEQ ID NO: 82787 - DNA, 638 bp, Glycine max
  Peptide Sequence Number=SeqID_174472
atgaggttcaataagaccaatgtggagacacttcagaaggttcacaaggcatgggaggtggtgcaaaagaaggacaaagaactcaagggcagtaacaatgggcccatcggtggctaccgtaagtggttgaaagcccacctgcaaggtttggattggctcccgagtttgagaatcgctataagggaggaagttgaggcactagaggaagacgaagaggtacagacccttaggacaaaactcgagcaaacccaaatagtcaaagaaaggttcaaatcagcaactcttaaaatccgaaaggagaatgccgaactgagagatataaatatagctaccaccaaggccttggaacaagagaccaagtgggctcgtagggaagagcacgaccggaacaagttccgaggggctctgtggggcagcaacagcgagcttaagctccggggagaggaaagagaccaatcacgagtagacaatttgatcttgaaagatgagttgaaggtttgctcgaggtccaaaaaaaacctgtctcagtggttatgcgagacagagaccaacatgttagccatcatcagcaagtaccaagaagaactaaatctagccatggcccacgagcatagagtggcggacgagtatgcccaagt

SEQ ID NO: 82788 - DNA, 276 bp, Glycine max
  Peptide Sequence Number=SeqID_174473
atgaaaaatcctacattactagggtaccctcctgtcgcaacgtgcccttttgcgggcgagcgaggcgaggctcacaggtgtgctttccaaatgaggaaagatgcgcggagtcgccaccaacgtttatttgtggaaaacgtcggaaaaaaccgaaggaaaccggtcaaaacaaaaattctaagttcgggagttgtatttacatttgaggaaggtcgacaaaagcggggctcttgctcctacataccctccatcgaagaggaaatcagacctacgtag

SEQ ID NO: 82789 - DNA, 1494 bp, Glycine max
  Peptide Sequence Number=SeqID_174474
atggcatgcaatggattctgcctcagactcattgctttagttcttgtgattagcatatcaagtgttaattgcatagaaactgatgcagttgaacccattattgatattgcttcgctgaatcgagatagtttcccaccagacttcatctttggggctgggtcgtcatcataccagtttgaaggtgcagcaaatgagggtggtaggggactaagtatatgggataccttcacccataaatatccagaaaagatacaggacaaaagcaatggagatgttgccattgatgcttatcatcgttacaaggaagatgttaagattgtgaaggatatgaacttggattcatatagattctcgatttcttggtccagaatactaccaagtatacaaccattggtaacgctttttcattgggatcttcctcaatctttagaagatgaatatggtggcttcttaagtcctcgcatagttaaagattttcgagattacgcggaactttgcttcaaggaatttggagatagagttaagtattgggttactttaaacgagccatggagttatagtcagcatggttatgcaaatgggggaatggcaccgggtcgttgttctgcttgggtaaatccaaattgcactgggggtgattctggtacggagccttatttagttacgcactaccagttacttgctcatgcagctgctgttcgtgtatacaagaccaagtatcaggtatcacaaaagggtttgataggcattaccttagtagctaattggtacctaccattctcgaataccaaagctgatcaaaaggcgactgaaagagcaattgacttcatgtttggatggtttatggatccactaacatctggagactatccaaaaatcatgcgatctcttgtgagaacacgattgccaaagtttactacagagcaatctaaactacttattggctcatttgattttattggcctaaattactattcttcaacctatgcctctgatgcacctcatctaagtaatgctagacctaactatgtaacagattctttggtcacccctgaatttgagcgtgatgggaaacccataggtataaagattgcttctgattggttgtatgtttgtccaagaggaattcttgatcttctattatatacgaaggaaaagtataataatcctttgatttacattactgaaaatggtataaatgaatttagagacgaaacactatcattagaggaatctcttttagatacatttagaattgattatcattatcgtcatcttttttatcttcgatcagcaattaggcatggtgtgaatgtgaagggatattacatatggtctttattcgacaattttgagtggtcttccggttatacggtgcgatttggaatgattttggtggattacaaaaataatttgaaaagatatcataaactctctgcaatatggatcaagaattttttgaagaaaactagcctttatgattctagcatatga

SEQ ID NO: 82790 - DNA, 1542 bp, Glycine max
  Peptide Sequence Number=SeqID_174475
atgtcgaccacaactgtatccggcggcgaccctccttctcgcggttttgatacgccgacgctggaccgggaggcggcggcgctgctccacgcgatctccgagcatggcgggtacgcgtacgtgagcatggcggtgctggcttccggcggcgacattcgcgcggcggaggcggctcgggagatggcgtgggagcagctgcactcgggtccgtggcactcggtgctgccggtgtggcgcgacgcctactccatggcgtgcctccacgtggcgcgccaccactacggcaacggtgagttcttggacgcacttagggttttggatttgggaatcatcatgggaggcacgctcctccgcaaggatttggactccgccatcgagaaagtgtcggaacaaacacggaggagcgttagggtttctgatttggggaactccgaacaccgactcgtcgatcgcgaatttgatatggcagaggtgctccaacttttacctgtgaagtctctttctacgaaacttgtggtgaagaaatcggcgctgtccttggagaaattcctgaaggatcattacctgtctggctgcccggttattatcagtgattgtatgtctcactggccagccaagatgaaatggaatgacgaagattacttgctgagagttgccggagaccgtacagttccagttgaggagtttgggaagcttattgggcagtgtcagtgggaagaaaggtcgagatgcctaaaaatgccctatgtagaaatcctagaaccttttacctgtcatgcatctaacaacctttttctgtcatggcaaggctgttggaagttgtttagcagtatacagaaaatcccttcacacacactcacagggaaaacagggtggagtggaactttgtatgttgggaaaaactatttatgtactgagtggaagcaagagctaattactttttcagagtttcttcagcggataaagtctgatagctgttctcctggtggtcctacatatcttgctcagcatccattatttgatcaggacttgtactgctttcagtttctgatattattgagatggcagataaatgagcttcggaaagatatctttattcctgactattgttttactggtggaggggagctacgatctctcaatgcttggtttggtccagcaggaacagtaacaccgttacaccatgatccacatcataacatactagctcagtcctattaccgagccaatagctggcatggcactgttggtggtattcgagttgttggaaagaaatacattaggctatactcttcgtctttatctgaggaactttccccccactctggtaccatgctccacaactccagccaggttgatttagatgatatggatgaaaagaagtttccgaaggtgcaagacttggaatttgtagactgtattttagaggaaggcgaaatgttatatatcccgccaaaatggtggcactatgtgcggtctttgactaccagtttttcggttagcttttggtggagtgagggtgaaagttcggatgcatcctaa

SEQ ID NO: 82791 - DNA, 1464 bp, Glycine max
  Peptide Sequence Number=SeqID_174476
atgaccatggaccggttatcacaaagcagttcggactcacccacacgaggagaccccaaagtgttatccatagagtgtctcaagggaagttccaaagcccacgagtggaccggagacatgcttcaaaccggagacatcgtcgaagagcttcgaatcggagcttctcctaacgcgcttatcagcttcagatcgccttttaaaaacggcaagagtggcgttaatagaatcctgcaagactcctacaagaagaaagacacctctatccttgttctggttcgccgaggaccccacgagttcgccgagctgcaggcgtgtattgtccccaacgattcctccgggaagaagcactatgtcctccgctccatcactgatcctaactacgtcgttgccttcctggatcgaactgaaaccgagtgcttccaactccaagcttcaaggaccactaggatggtaaatgcactaactaggacgcggttacaagatggatatgtctcgtatccatgggagaggaggatgcaggagttgctatcagttcccaattctagcaattttctttcaatattacttcttcccaaagtttcagataggatagctgctcgctacaatgatgtggaggatacactagccagggcaaatacgtggctgaatgcagctcaagcttcaggtgtccctattgtctttatgaatgtccaaaccgagtccctacttactaagatctctggagagacagcttcttccactgtaaatgcaggatcattatccgacttatctaaccttgcaaatgcaagcctttatggctttgaggattaccatggagtagacattggtgttgttagagcagttcggctctggtatgctccaatcggaggagagatctcaattgagataaaactaaaagaggacgacgcaaagcttggctttgccattagtcgtacagaagagggttttattttcatccaaacagttattgaggataaccaagaaaatgtaccagccacacgttcaggactcagcaatctgtataaagcagcaaaagatacttcaaagttgttggtagtatctaggctttcaaatcagagagtcctcccatggatggtctcttcaacaggagccattaggtgttatgacactgtttcattgagccagaaactctccttgcatagacacaccaaagttcctattctccttcatgtcttcctttgggatagaacattggcttcaagtttagaaagtacaagattgagttcattatctccttcagtgttgccattaccattatcacaagaagttcaattggcaccccatccaaatgagaaccaaatacagccattgccccatgaagggtctgatgcaggtggtggtgtcagcagtgttggttctcagccaatgcagctcgagagagacacagctggggatctctcattcagattccacaacttctcagtgtccaactgctggttatga

SEQ ID NO: 82792 - DNA, 4206 bp, Glycine max
  Peptide Sequence Number=SeqID_174477
atggatgcaagtgaccttgaaaaggatttgttcagcaaagtagagacaaatgactactacaccactgttttaaagattaaagggctagaacatttgcctgttggattctattattttagtgaatatatggaagatcctagcacaatgggacatccagttgcaatgcagagattttattctgacactaatatattcttattatggtcctacggcaactctgttgatattaaggaaccgacagtcatggagcttgtaatcaagacaatagaagccattgggggagaggttgagcatgtcattcttcagcgtgctttatgtattttcctcatgttggcagccaagttggaatctgagcttcaaggttcaaggaatacttattatgtaggcggacttatggcatttgagctcacagagagaaattcatcttatgccatggctttgatctgcaagaactttgcatataggaatgattttccaatatttccttacaccaagaatttgtttcccttgcaagctttgtgccagaaaaagaatcgtagagaattaggtgaattgccagaagtgcaatttcctaatttgcctactttgaatagctacttaacgcactggggaactcatccaatcactcaaaacagggctctttatacttggattaatgaagaagggactccagtatgccaaaggacctatggagaactatattttaattcttcttgcattgctcataagctcctaacaagccaaaagccagttatcaagcccggtgacaaggttctcctgatctatgtccctggtttggattttattgatgccttctttggatgcctaagagctaaagtcataccagtccccattcttcctccagatcccatgcaaagaaatggacaagcactaattcgaattgaaaacgttgccaagtcatgtaacattgtggcaattttatcaactgtagcttatcactcagcagtccgtgcaggttcgttgaaaaatttaatctcattaactgaaaaaaatgggaaatcctcagctcggtggccgaatcttccatggttgcacactggtacatgggtcaagaactccaaaagtatgattctggaacatcttgacaaacaatgtgaacctcagccaggtgatatatgtttcttgcaatttacctcaggttcaactagtgatgccaaaggagtcatgattactcatggtgggctaattcacaatgtaaagttcatgcgaacaagatacaagagcacctcaaggacaacgctagtaagctggctccctcagtatcatgacatggggctgattgggggactttttacatctcttgttagtggtggatctgcagttttattttcaccgatgacatttatcaagaaaccactcttatggcttgaaactattagcaagtatcaagcaactcatagcgctggacccaactttgcctttgagttactgattcaaagattggagtctgacaaggataagcttcagaatttagacctctcatccttgacttttcttatggttgctgctgaaccagtgagacagaagaccatgaaaagatttattgagctaaccagtccttttggcttatctgaaaaggtgatggctcctggatatggcttagcagaaaattgtgtgtttgtcagctgtgcatttggagaaggtaagccaatcattgttgattggcagggaagaatttgttgtggatatgttaatcacaaggatgcggatgttgacattagaatagttgatccagagacttgtgaagagcttcaagaagatggaaaggagggagagatctggattagtagtccaagtgcaggcataggatactggggaagggaagaattgagtcaaaaaactttcaggaatgaacttcataatcatcctggacgtagctacacaagaactggagacttgggacgaataatagatcagaagttattcatcactggaaggatcaaggatcttatcattgttgctggaagaaatatttactcggcagatgttgaaaagacagttgagacttcatcagaatttcttcgtcctggttgctgtgctgtcattggagtccctgaggaaattttatcagcaaaggggatttccactccagatggctctgatcaggttggcttggttgtgattgcagaagtaagggatggaaagccagtcagcaaagatttgattgagaaaattaagactcgtgtggtagaagaacatggagtcaatgttgcttctgtcaagttgatcaagcctagaaccatcagcaaaacaacatcaggaaaaatcaagagatttgaatgtgtcaaacagttcacagatgaaacactgaacttggtaccacaaggttcaaaaactattttgacaaagaagtctttgttaaggccattcactacaggagcatggggagaagaaaaaagaccagggacacagcaagtaagaagtatacttgcacctaggaaaaggatcagtaagaatgaaattgtagagttcttgaaagggcttatttctgagcagacgggaatcccaatcaacgacatctcagtcacagacaacctgacatcctatggaattgactcaattggtgtggttaaagcaactcaaaaactgtcagatttcttaggaactccagttgcagctatagatgatctcctatcaaagtctcagcctcaactttcaagcaatctgcccaacattccagaagctgagagtgattctactgaattcattgtggaggcccaagaaatttcttctaaaattctggctatacacctcagaggaacagtgcttctaaattactggtttgagatgctgggtgcaaggattggatcctcagttttacttgatacagttgacatcactgacccatctatggtgtcaattggagatgaagttgtcatttctgaaggtgttttggttcaaagccacgaggtaaagaatggaattttaagtttccatcctattaggattggcaaatgttcttccattggaccttatgctgttatccaaaaaggaagtgttattggagaaggtgttgaggtacaggccctgcggaaggttggacaagaccaacatgtgttcaaacctgcaaagcttaataatgataacaagaaatgttatgtacaacattgttccattagagccatcaaccgagtttcaaatccagagttaatgtctattggtgatggtgtccatcttggagattttagctgtgtaattacaggctttcattcttcaagtggatatgttagtggagaagttgaggttcaggacaattcggttattggtagtcaaagtctaatcctccctggttctctagtccaaaagaatgtgattcttggtgcactttcagttgctccaatgaattctacacttcaagagggtggtgtctacattggatcacagtcccaagttgtcataaggaactcagtgaagaatgcttatgatgaagggatagaagagatggacatggtaagcaagaaaagagttggtaatttggctgcagcactgcacaaaaatgactcacagaaagtgaccttgaccagaacatggtatcagaccttctccgcactcttcactcagccactgctacaaacagtgttacctcatatggtgttaggtttagcagtttttgctcccttgaactgtgttgtttacctaaagagtgccaagaatcttccaatatactggttgcttcccttgttttggattcactcgggagccttagccgcattggcgtgtgtgatagcaaaatggattcttgcaggaaagaaaaaggcaggtgaagcagtgcctatatggagtcaaaggatcacattggacagcacatggcaggccattagaaccttagttggagactattttatggacatgacaagtggatcattttggtttgtgctgtggatgaagttgatgggtgcaaaagtggatatggaacatgcagtttatgtagatagcatgggggccttattgaaccctgaaatggtgaagattgagagagggggttgtgtggggagagaagccttgctctttggacatgtatatgaaggggaaggaggaatggtgaagtttggagagatcaaaattggagaatatgggtttgcagggagtagagctgtggcgatgccaggtgtgcaaatagagagtgagggcaatcttagtgctttgtcacttgccatgaaggaagaaatcattagatcaaggtga

SEQ ID NO: 82793 - DNA, 414 bp, Glycine max
  Peptide Sequence Number=SeqID_174478
atgaagttccggagttgggttccaattctagctggttgtagacttttaacgctactcgaactgagattgtctgttagtaatgaggagaatggaggtttttttgtgtttgtgacccttgtgttgtgcggttgtgctgctgatttgcagccgaggaagttcttgacggaacaacaccaacacgattgggcagttatgtataagaatattaagaacatgggtgtgttcaagtcacctgaaggattctcaaagaagtgcctcttcaaggatgtgaggttgcataaggattccatccttggtggagcacagcagacaaatttggagtatctgttgatttggagctttaggaagacggttggtctatccactcctgggactccttatggagggtgggaagttgttggagtacaagtgtga

SEQ ID NO: 82794 - DNA, 285 bp, Glycine max
  Peptide Sequence Number=SeqID_174479
atgggggattccatcagcagactctccatccctgcatgtttgcattctagtggagaaaacaccgagactttttcaagtctcacaagttatccagaactacgtaggtctgagttcctcattggaggatacgtaggagcaaaagcctcgcttttgtcgaccacactgctttctgttaccatgacccaagagctggtagcccgcggagacaccttacggttattcgcacctcgagtgagattgatacgcggaggccaatatgctcctctgcgccctttccggagatga

SEQ ID NO: 82795 - DNA, 570 bp, Glycine max
  Peptide Sequence Number=SeqID_174480
atgtgtggtgaagcttatgagacaggccaatgcattcccactgacgataacactcaagaaattcatttcatggggaatcagcagaggcaagggtacactcaaggaggatttttaggcttccagcaaggtccttataatcagcaaggacagtggaggacacaccctggcaaccaattcaataaagaccaaggtggatcctcaaacaggccaattcaacaagggcctaacatctttcagaggacaactaagttggaagagaccttgactgaatttatgcaggtaacgatgtcaaatcataaaagtactaagtcagcactaaagaaccttgaagtacagatgggacaactggccaagcagatagttgacaagtcatcaaacagctttggagcaaatacggaaaataatcctaaggaggaatgcaaggctgtgataaccaggagtaaaaggtttatggaagctgaggatgaagaaaatgtggtagacaaggagaaaaagggtgaaaagaaaggtgttgaggttaagaaaaataatgtgaaaagcaaagagaatcaggaaaagggaagaaaataa

SEQ ID NO: 82796 - DNA, 284 bp, Glycine max
  Peptide Sequence Number=SeqID_174481
ctttatctgaagaactcgccaagcgcacttactgcgctaagcgagttcatcctttgaggataaacattcatcctcttgctgaactacctatggctaagcaagggaatcttgatttctttttagttatagatggaatcaagaaaaagagctataacagaagacatcccttcatcatccactccagctcctccgtcagtaactgtaggacaagatgtgcaaagttcaccaactttagttcctatgctacaaagcttattccgaggatagttcattatcatgcatag

SEQ ID NO: 82797 - DNA, 420 bp, Glycine max
  Peptide Sequence Number=SeqID_174482
atgtttgctcttaaaaccaaggccatatatgtctctaggaatgtgatcttctatgagaattgttttccattcattggccaagacaaacctgatcatgtcactgtccttcctattcctccttctcattccattaatcaatctgatggtgtctcatcagaattaccaattgatcatatcatgcctgtgccaaataatactaattttgatcccttgaatttagagcagtcctctaatataaccaaaagatctctgagacagacacacagactaagcaagtataaggacttccatgtttcatacccatctttaactgtagccaattattctgtagtcttgaatctcaatcctataatgaaagcttctaaggatcctatctggatagaggcaatgaatgcagagattaagccttttagaacttaa

SEQ ID NO: 82798 - DNA, 201 bp, Glycine max
  Peptide Sequence Number=SeqID_174483
atgtccaccgcaagctgtgtggtagacatggggaagaggaaagtacaaatggccatagaagaccagcaaatcagtttcgatatgtttcatgaagagaaagctttgcctgaccaaaatgtctgtttgaaggtgaatgtgatggaggaaaagagactacagaagaaggttctggaagttggaaccttgttggacccaagataa

SEQ ID NO: 82799 - DNA, 408 bp, Glycine max
  Peptide Sequence Number=SeqID_174484
atggttatgggggattccatcagcggactctccttccctgcatgtgctgctctaatcggtcggaatattggtctctttgctaaagcatgtttgcattttagtggagaaaacaccgagactttttcaagtctcacaagttatccagaactacgtaggtctgagttcctcattggaggatacgtaggagcaagagcctcgcttttgtcgaccgcaccgctttttgttaccatgacccaagagctggtagcccgcggagacaccttacggttatccgcacctcgtcattcagtgaccccaagtgtgattgatgagcagaggccaatgtggtcatctgcgccctttccggagatgtcagcatcttccggtggagactttttcaagtctcacaagttatctagaactacgtag

SEQ ID NO: 82800 - DNA, 186 bp, Glycine max
  Peptide Sequence Number=SeqID_174485
atgtcagtgaaaaacctcgtcgggtgcctagaagtaaatgacaagacaaaccacacactagcaagtcaagtcactctcactaggcttaaagaacactcaaaccgggtgacccccaaggcctacactccgaagagtccgttaaggcctctccctcctgattcaggtccaacccagaaaacattttag

SEQ ID NO: 82801 - DNA, 1224 bp, Glycine max
  Peptide Sequence Number=SeqID_174486
atgggctaccaggagcaggactacaacctggataccctgtacgccgccttcctgaagctggccgacaaaaagggccaggtgttcgactatgacctggaggcgctggccttcatcaataaacagcaggaagagccggagcacttcagcttgggctacttcagcgtgcagtccggcagcagcatcatggctaccgcctcggtgaaactgatctgcggcggcgaagagaaagccgaggccgccaccggcaatggcccggtcgatgcggtttatcaggcaatcaaccgcatcaccgactacccgatcgagctggtgaaataccagctgaccgccaagggccatggccgcgacgcgctgggccaggtggatatcgtggtctcttacaacggccgccgcttccacggcgtaggtctggcgaccgacatcgtcgaatcttccgccaaggcgatggtgcacgtgttgaacaatatttggcgctcacagcagacttatcacattgccgtcttgcccggagacggcatcggcccggaagtaatggctcaggcgcgcaaagtgttggacgcggtgcgtcaacgctttgacattcgcatcaccactgccgaatacgacgtcggcggcatcgccatcgatcgccacggcagcccgctgccgccggcgaccgtcgccggctgcgagcaggccgacgccatcctgttcggatcggtaggcggcccgaaatgggaacacctgccgccggccgagcagccggaacgcggcgcgctgttgccgctgcgcaagcacttcaaactgttcagcaacctgcgcccggcgcgcctgtatcaagggctggaggcattctgcccgctgcgcgccgacatcgccgcccgcggcttcgacattctgtgcgtgcgcgaactgaccggcggcatctacttcggccagccgaagggccgcgaaggccagggcatgcaggagcgcgctttcgataccgaggtgtatcaccgtttcaagattgaacgcatcgcgcgcatcgccttcaaatccgcccgcaagcgccgccacaaggtgacgtcgatcgacaaggccaacgtgctgcaaagctccatcctgtggcgtgaagtggtcaatcaggtcgccaaggattacccggacgtgtcgctgtcgcacatgtatatcgacaacgctaccatgcagctgatcaaggatccgtcccaattcgacgtgctgctgtgctctaacctgttctga

SEQ ID NO: 82802 - DNA, 786 bp, Glycine max
  Peptide Sequence Number=SeqID_174487
atgctgccggtcatcattatgaccgcgcattcggacctcgacgcggcggtcagcgcttatcagcagggcgcgtttgattacctgccaaagccgtttgatattgatgaagcggtcgcgctggtagagcgcgccatcagtcactatcaggagcagcaacagccgcgcaatcagccggtaagcggcccgaccaccgacatcatcggcgaagcgccggcgatgcaggatgtcttccgcatcatcgggcgcctgtcgcgttcgtcgatcagcgtgctgatcaacggcgagtccggtaccggtaaagagctggtcgcgcatgcgctgcatcgccacagcccgcgcgccaaatccccgtttatcgcgctgaatatggcggcgatcccgaaggatttgatcgaatcggagctgtttggccacgagaaaggcgcgtttaccggcgcgaaccagattcgtcagggccgctttgagcaggccgatggcggcacgctgtttctcgacgaaatcggcgatatgccgcttgatgtacagacgcgcctgctgcgcgtgctggccgatggtcagttctatcgtgttggtggctatgcgccggtcaaagtggatgtgcgcatcatcgccgctacccaccagaatctggagctgcgcgtgcaggagggcaagttccgtgaggacctgttccatcgcctcaacgtgattctcgtgcatctgccgccactgcgtgaacgtcgtgaggatatcccgcgtctggcgcgctacttcctgctggtcgcaccgcgtgagctgggcgtataa

SEQ ID NO: 82803 - DNA, 174 bp, Glycine max
  Peptide Sequence Number=SeqID_174488
atgtcagtgaaaaacctcatcgggcgcctagaagtacatgacaaaacaaaccacacgctaggagaccagtcagggttacgctgttttgcgagaatgctccaaccatgtgggatcagcacaggcttaaaggagcactcaaattgggtgtatttacccccaaggcctagactctga

SEQ ID NO: 82804 - DNA, 534 bp, Glycine max
  Peptide Sequence Number=SeqID_174489
atgatggtgacccgggtgatgttggggtacagctacgagcccggaatgggtttgggcaagaacaacggtggcagaaccagcctggtaagcactagaggaaaccgcaggaagtttgggttaggctataaatctacgcaagctgacataaggaaaaatatctcggaaaggaagaacaaaggccagggcctgcgatcgggacagcaagccaaagaggccccaccctgccacatcagtagaagctttacaagtgcgggtttaagaatcgaaggccaagtcaccgcgatatacgaggatgactccccaaggagatcggatttggtacagctatgtcctcccgatttccgactaggaaattggcgagtggaggaactcccggacgtttacgcgacaagcataatatccgatgacgagtccctcgaaggtactaatacccgggacccagccgtcaatttcgagcaagaagcgggtcggatggagagtgaagaggacgaggatgtggggcttcccctagagctggagaagataatcgcttag

SEQ ID NO: 82805 - DNA, 384 bp, Glycine max
  Peptide Sequence Number=SeqID_174490
atgtcaggtgacacacttcttattcaagaagccctgggagagaagtgtgtggcatgttttttaggacgtttagtcatagcattcatcaagggttggcttctaacccttgtccttctatgttgtattccacctcttgtaatctctggttccatgatgagctttacttttgcaaagttgccatcccatggacaagcagcttattctgaagcagcaactgtagtagagcgcacaattgattcaattcgacaagttgcatcatttacaggcgagagtcaagctatagctcaatacaatcaatccttaaccaaagcttacaggactgcagtgcaagatggagtggttgctggtttaggcctggggtcaatccttaaccaaagcttatag

SEQ ID NO: 82806 - DNA, 648 bp, Glycine max
  Peptide Sequence Number=SeqID_174491
atgctagccgacctatatgacacctttgaccgaagatgtgagaagagcagtacgaggattgtctgctgtactcccgctctttatgtatggttggtttcacacttttttcgccaagaggtaaggcatgcttgcccattagaaggtcaccgttcatgcacagagaaaggaggcgcaaattgggaccaactcttatctaacaaagaaggagcgtctgtcaactggttccctcgatggaaagaaggaagaaccagagttcttgtctcgtgcggaggatttccgaatgttcctttgatggggaaaaggggttgcattagttacaatctcattcttactataagacaacttggctaccctatgagaggggcaccactagaggaagagctcgcacctgtcatttcacgagggttcagtgagaccaacgtggagacatatcggaaggcccgcaaagcatgggaagtggtacaaaagaaggacaaagagctcagaggcagcaacaatgggcccattggtggctaccgtaagtggatccgaaaggagaatgccgaactgagggatgtaaatatagctaccaccaaggccttggaacaagagaccaagagtgctcgtagggaagagcacggccggaacaagttccgtggggctctgtag

SEQ ID NO: 82807 - DNA, 767 bp, Glycine max
  Peptide Sequence Number=SeqID_174492
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggaacgcgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 82808 - DNA, 417 bp, Glycine max
  Peptide Sequence Number=SeqID_174493
atgaagcacttcactgacaccctcatcagtgccaacataggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 82809 - DNA, 762 bp, Glycine max
  Peptide Sequence Number=SeqID_174494
gatttcgcccggaccactgccgggaggtgggtgcagatcatgcgcaccagcatgaccaccttgacccggatgtggatgacgttgttgctcagcaatgtcttgcctagtgatcataacttcgatctccctctgccgaagtgtcagctggtgtatgccatcctgacacggatgagcgttcacgtggctcagatgattgctgacaccatctatttatttgcaggtatgccacccaccaggaaccctctagacccggataagtctaacagggccctagggtttccaacattgatcacgggcctctgccagtcattcggggttcccgtcacccctagtaaggtgattcgaccgccgatcacccgggccttcattgagaagtattgcacgcctagacaggtgcagggggatgcacctcaggatgcagacgcaccactaccacctcatcaggtcgatcccgctgggtcactaggcatggagcattatctacagcacttggttcgccagcaggcgaccaaccaccgggggcaggtacagatacatgagtgtctctaccgcttcagccttagtcagcaagggcagggtttcgctccttttgcatgccctactctagagcagtttagggctgaggttgcgtggcccggagattggcccgaggcccaggcaggggaggcgcctgcaggatccccgggcgatgcagaggaggcccgcatggatgaggagatgacggatttgctcggtttcttgggagggagcggagccacatga

SEQ ID NO: 82810 - DNA, 388 bp, Glycine max
  Peptide Sequence Number=SeqID_174495
ggatcgcgcccacaagacacccagtgggcccgaagaagtccaacagggccctagggtttccagctctggttacgggcctctgtcagtcctaccgggtgcccgtacccccagcaaggaatggcacccacaaagacacccagtggacccggagaagtccaacaaggccctggggtttccagctctggttacgggcctctatagtcctacagggtgcccgtttcccccggcaaggtcatgccatcatgacatagagatcgtgcccgcaagacacccagtggacccgaagaagtccaacaggatcttgaagttttcaagctctaattacgggtctctgtcagttctacggagtgcctgtcacctccagcaagggcatcaggccccctactaa

SEQ ID NO: 82811 - DNA, 383 bp, Glycine max
  Peptide Sequence Number=SeqID_174496
atggttgaggattcacaagaaacaacgcattttggctttcaaacggtagccaaagagcagaaggcggacatggtggcgcatgtattccattctgtcgctgcaaaatatgatgtgatgaacgacttaatgtcgttcgggattcatcgcttgtggaagcgcttcaccatcgactgcagcggcgtgcgtcgcgggcaaactgtgctggacttagcgggtggcaccggtgacctgacggcgaagttttcccgtctggtgggcgaaaccggccgcgtgatgctcgccgatatcaatgattcgatgctcaaaatgggccgcgaaaaactgcgcaacatcggtattgtcggtaacgtcgagtatgttcaggccaacgctgaagcgctgcc

SEQ ID NO: 82812 - DNA, 399 bp, Glycine max
  Peptide Sequence Number=SeqID_174497
atgggtatggttaagagtatgttaatcaatttgactatacccgtatctttgtggatgtatgctttgaaaattgccatgtatttgttgaatagggttcctaaaaaatcaaagggatatatgttttattatcctaatcatagtatgagaattgtcgaaactggaaatccaaggttcattgaaaatggtgaaatcagtgggagtgcagttccacgagaagtggaaattaaagaagttagagtgcaagtccttttagtttatgcctctagcagtaaggtgattgctcctccttttagttgttgttacaaaattaatgaaaaggagcaacacaataatgaatccatgatgcataatgaacctattatggaagaaccgctagaagtagcattaaggaggtcttaa

SEQ ID NO: 82813 - DNA, 360 bp, Glycine max
  Peptide Sequence Number=SeqID_174498
atgccaagcacctcacaaggaccaaagaaaggtcacatgtcatcaagcaaaggtccccggacgaaattagggtatgacaaatatgtttatagatgggctgagaccacaaaccaagtgtcgcaacgtgccccttcgcgggcgagcgaaggcgaggctcacgggtgcgctttccaaaggaggaaagatgcgcggagtcgccaccaatgtttatttgtgggaaacgtcggaaaaaaccgaaggaaactggtcaaaatgaaaattctaagttcgggagttgtatttacgtttgaggaaggtcgacaaaagcgaggcttttgctcctacgtaccctccatcgaagaggaaatcagacctacgtag

SEQ ID NO: 82814 - DNA, 748 bp, Glycine max
  Peptide Sequence Number=SeqID_174499
atggcagacattcatcagctatgggtagctgcaatcctgggggttgtggaaggccttacggagttcctgccggtctcatccacaggccacatgattattgttggccatttgctggggttcgagggtgagaaggcggaaacctttgaagtggtgatccaactgggctcaatcctcgccgtagtcgtgatgttctggcgccggctgtttggcctgatcggcattcacttcggccaggagcgccacgaaggcgtcggcagcggaaaactgacgctgattcacatcctgctgggtatggtgccggcggtggtgattggcctggtgctgcatgaccagattaaaaccctgtttaacccgatcaacgtgatgtacgccctggtggtgggcggtgtgctgctgctggcggcggaatatctcaagccaaagcagccgaaagcggtgggcattgatgacatcacctatcgccaggcatttataattggctgcttccagtgtctggcgctgtggccgggcttctcgcgttccggcgccaccatctccggcggtatgctgatgggcgtcagccgctatgcggcgtccgagttttccttcatcctcgcggtaccgatgatgatcggtgctaccggactcgatctctacaagagcatgggcttcctgacgatgcaggatttcccgatgtttgccgtgggcttcgtgaccgcctttattgtcgcgctgctggcgatcaaagtgttccttgagctgatcaaac

SEQ ID NO: 82815 - DNA, 240 bp, Glycine max
  Peptide Sequence Number=SeqID_174500
atggccaaggagggccggacaccttcaagtccagttttgttttcaaacttgaaaaagaaaagtttggacagaggaatgaaaaaggatttgcagaagaaagtagatgataggcctttaatgtggtatttaatatttgcttctttccaatgtcgcacggttgtgaataaatgtgatatcaataactgtgaattgaagaagtacgaagtagatgaagagtttttgttcgaatttgaagcctaa

SEQ ID NO: 82816 - DNA, 261 bp, Glycine max
  Peptide Sequence Number=SeqID_174501
atggggggtgcagtgaccttgttggatatccttggtgggggaatagagtgggctcacaggtgcgtcttccatgggaggaaaatgtgtggagtcgccaccaatgtttattcgaggaaaacgtcggaaaaaccagaaagaatgttgcagaacttcacggattacctaaccatgagtgttaagtacctcgaggcggtcaagcgaagtgcagtgaccttgttggatatccctggtgggggtaatagagtggttaaagagctttaa

SEQ ID NO: 82817 - DNA, 453 bp, Glycine max
  Peptide Sequence Number=SeqID_174502
atgaaggattcgggaattttctccaccgaatccttgaggaggattttgaggattccgctcggattaaaacattcttcttggtgtggaggttcgacggcaagcaacaacgactcgtggaggccaccggtggtcgtgggtggtggagaaggaggtgttagggtttgggtggtgtttggagaggaggagggggggggggggaatcgtgtttttcacgctgaagaacgtatttataatctcgcaattccttctcgggttggaattgggcttagcgcgctaattctcgctcagtgcaattccctctgggttggaattgcgcttagtgcgcccctcgtgcttagcgagacatcaaaagttgttattttcgaaatcccaacggtcagactggagaattgtcttaggaagctccagccaaaatttgaagacaatccaacggttaacgaatcgggatcatga

SEQ ID NO: 82818 - DNA, 246 bp, Glycine max
  Peptide Sequence Number=SeqID_174503
atggcatttttccaaagctacttggactgcaaggctcaaaacgcacaagtgactaatgctctcagaaatggaaacgtcgcgcacactccagaggtcttctcaaatatcccaatgggtgttacacacaccgttaaacggcttacaaatcccaggttttcacaaaagaagaaattgaaacggcggcagagccgcacaggatcgacaaagagggagaagggagatgaatcgaaactcaaaatttattaa

SEQ ID NO: 82819 - DNA, 765 bp, Glycine max
  Peptide Sequence Number=SeqID_174504
atggttggtcttcatgctgattcacttcttgattggcggccttatgcttcaacctttacgataatttcttacgctggtgatgcctctgagtaccaaaactcaatccccaaggttgacaccattactattcacactgaggatgaactaactattcagaaagagaatttcttcgacatcccttctctagagagcatgggtctaaacctaaacgaaaccttgttttgttatgccaacatgtggcaaaatgtagttaacaacaacttcttacaccagttcatgcttttccacctaatggagtgcattccttttgattttccttacaccatctacctcaacatcttgttcattacaaagacgttaggaggtaatgatgacatctactatgttgccctactcaataaaattctatgggggcaaggtgcttatcttgccttcaacgcagtagacgattctaactcaaagaccttagtgaaccagaggaagaagaggttgctccactctaaaggaaagaaaggtaactgctcaacctccaagtcctcttatgcaagcatccaagggctactcaatcaaaaaggagtccccaagaagcaagttgaggaggaaaggaaggtaactgctcaacctccaactcctcttgctcccaaaaaggacaaggtaattaaggcacatcctactagaaagaaacatgtgcttgcacccaacatggtcaagaagttgaagacaatgacaataagagttgcatccaccctctcttcacttggatag

SEQ ID NO: 82820 - DNA, 264 bp, Glycine max
  Peptide Sequence Number=SeqID_174505
atgcctcccaagagcctccttaagggttcgaaatcggcaacgactaccaaagacatggagggcctaaggggtgatggcgtgagtaggtggaatcccaaggttgggctgctactcatgtattgggataagtggtgccagcatgcacatcccgaaaaatgcccaacatttgtgatgaagtggaggaattgcattaggaagtaccatgctgatgaggatcaagggtatacttactatccatcgcttcccaaggatgatttctggtga

SEQ ID NO: 82821 - DNA, 363 bp, Glycine max
  Peptide Sequence Number=SeqID_174506
atggaggtgagtatggcaggtataagagtacctcgtattatatgcctattagttgaaggtcacgacccacgaagtacggaagccgacgatggagtccacgacggccgcacggtggaggggagtggtccacaaacgaccgatgtcgtgttgcagtcgcaattgcttgtttttctagtagtgtatcccgacttggtgactgataaaccctcttttaaggaggtttgtgatgcagttcttgcctccaatggtgagggggctccaagcccggatggattcaatgcatggctaggaaacctcctcgctgacgatgtgaaacctaaggaagcagtgggtattcgaagggaaggaagaaggagagtatag

SEQ ID NO: 82822 - DNA, 333 bp, Glycine max
  Peptide Sequence Number=SeqID_174507
atgtatcctctcttgttcttagttacaacaacccaagtagatgtaccctctacttgtaccacaaaggatgtaccctccaatgtgttaagaaaaagttctcaggcggttagtcctttgaaactttgtgaaggggagaagggagacacaaaagaattcaggcggttagtcctttgttcttttggaaaagggagaagaaagacacaaaaagaattcaggcggttagtccttgtcgaattctttttggcaaagggagaagatagatacaaaagaattcaggcggttagttcttcgttcttttggaaaagggagaagagagacacaaaaagaatttag

SEQ ID NO: 82823 - DNA, 687 bp, Glycine max
  Peptide Sequence Number=SeqID_174508
atgatgagtaccgagttagcggcattattgtcaacaaaagcttcgaagaaaacaagcagctgtatggttggagctttgtgttgtctagttgacaagttccagattagcctatgcagactaaaatggattttattttgttttggagttggtcccaactcttggcaactcttcctcttccaaatagcattgcatggtatgaactcatcatcactgaacttgaaggagacagagctgaggcttggcctccctggttgcgagtctccagagacaaaatcaggacttcagcaaaacaatcttttcaaggctcgggaagaaaaataccaatcgagaataagagtactcgaggcacttgcatctggaactatagataagagtgagggtgagaagatcaaagagaaagtaaagaaggtagatgagaatgaagttgttaggttgataaaagagcaggaggacaaaaatttggaaatttcagctttgaaggtagaactggaaacaaccaaaagaacatatgaagtacaattctcacagatggaagaagaagctaatagttttaaagcagcattgacacggaaggtccaagaatatgagcatcaattggaagaattaagaaatgaggctgaaaagatcaacgaggaagtaaaaacgacagatgaagaggaatctaataaattcatgaaagaacagtag

SEQ ID NO: 82824 - DNA, 216 bp, Glycine max
  Peptide Sequence Number=SeqID_174509
atggcaagagtgagaggactaaaggaaaagttaggaaccaaaggttctatgccatttgtgggtgactatcataagaaaattgatatgagattattgagcggaaaccagtttggcccattaggggataatggaaaccttaataggtttaaaaccggaggcacagttatggtccctaagacaccaaatcaagaacaattttctcctctctccatctga

SEQ ID NO: 82825 - DNA, 540 bp, Glycine max
  Peptide Sequence Number=SeqID_174510
atggcgcctactagacaccctctggacctagagaagtccaacagggccctggggtttccagctctgatcacgggcctctgccagtcctacggagttcctgtcacccccagcaaggtaatccgaccgtcgatcacccaagccttcatcgagaagtactgcacgcctaggcaggcgcagagtgatgcacatcaggccgcgggcgcaccgccaccacctcggcaggccgatccagctgggtcactgggcgtggagcgttatctacagcatttggttcaccagcaggcgaccaaccaccatgggcaggtgcagatacatgagtgtctctatcggttcagcctcagtcagcaggggcagggttccgccccttttgtatgccctaccccgaagcagtttggggctgaggtcgcatggcctggagattggcccgatgcccaggcaggggaggagcctgcaggatcccccggtgaggcggatgaatcccatatggatgaggatatgagtgaccttctcggtttcttgggagggagcggagccacatga

SEQ ID NO: 82826 - DNA, 192 bp, Glycine max
  Peptide Sequence Number=SeqID_174511
atggcagcgctccggcggcaaaccgatggcgaatgtggctccctcttctaccaacaccacgtcattctggcggtacaccaggttctgacggatggcggggatctggatatgaatttgcgtttcgtgaccaagctgttcgaccacctgcacttcgccctcaagggtgacatcggcgatgtcgctcggcagcag

SEQ ID NO: 82827 - DNA, 782 bp, Glycine max
  Peptide Sequence Number=SeqID_174512
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 82828 - DNA, 249 bp, Glycine max
  Peptide Sequence Number=SeqID_174513
atggcaccgttgccaggaaattctcatttagatcctatcgaagaccacatcatggctgaagagccaagaaaagtcaccctggaagattattcaagttctaatgtgccacaatttttcaccagcattgcacaaccagaagttcaagcccaaaccattacatatccaccatcattgattcagaataatttgtttcatggattaccaaatgaagacccatatgcacacttagccacctacatagaaatatga

SEQ ID NO: 82829 - DNA, 462 bp, Glycine max
  Peptide Sequence Number=SeqID_174514
atggaaggaaggaagaaccgggattcttatttcgtgttggaaatttccaaatgttcccttgatggggacgaggggttgcatcaattacaatcccgtcctcgctataagacaacttggttaccctatgagagaggtgccatcagaggaaggcctcataccttttattatacaaggttcaatagcaccaatgcgggggtgtttcagagggtccacaaggcatgggaaatgtcgcaaagaaaggacaaggaacttaggggaagtagcaacgggcccatcggcggttaccgtaggtggttgaaagcctacgcaaaagatatggattggctcccgagtttgaggatcactaagggggtggaagttgaaactccagaagaagatgaagaggtacaggccctcaagacaaaacttgagaaagcccaaacagtcaaagaaaagttcaagtcagcagctattaggatctga

SEQ ID NO: 82830 - DNA, 417 bp, Glycine max
  Peptide Sequence Number=SeqID_174515
tgtgcatcctgatcattatgtgcattttgagcattctgagcattttgtgcattctgttgttgttgattttgaacattctgattttgagcattcggctgctaattttcatactgagaacatggctcaatctccatctcatgagaggactcttagggagatggctgcacctgactacacttatgaaagcttgtgcattcaatatcctgatgaggatgttccatatgttctcaagactggactaatacatttgctgcccaagtttcatggtcttgcagttgaagatcctcataagcatcttaaggagttccatattgtctgttccaccatgaaaccccctgatgtccaggaagatcatatctttctaaaggcttttcctcattctctgaagggagtggcaaaagattggttgtactacct

SEQ ID NO: 82831 - DNA, 210 bp, Glycine max
  Peptide Sequence Number=SeqID_174516
atgaaccgccaccacctcatcaggcggatccagctgggtcatttggcatggagcgatcagtttagggctgaggtcgcatggcctggagattggcccgaggaccagacagaggaggcgcccgcagaggctcccggcgatggagaagaggcccgcatggatgaggagatgacgaatttgctcgacttcttgggaggaagcggagccatgtga

SEQ ID NO: 82832 - DNA, 141 bp, Glycine max
  Peptide Sequence Number=SeqID_174517
atggtggaggagaagaagaaggagaaaatggtggaggatgacaaacaacagctgatgaatggcaacggaatggagaaggaagagagagaggagacgccacttcaaggagaagatgagtctagaagaagctcaccaccatag

SEQ ID NO: 82833 - DNA, 150 bp, Glycine max
  Peptide Sequence Number=SeqID_174518
atggaagacgcacccgtgagcctcacctcgctcgcccgcaaaagggtagcacccactggtttgagtataaaggggccctacgaccgggttcatggaaatctaaggagtggaggtggatctatggtcatgctaggtctccgacttgcttga

SEQ ID NO: 82834 - DNA, 639 bp, Glycine max
  Peptide Sequence Number=SeqID_174519
ccgcatgacattggcgtcggctcccagatactggttccaggggcccgcgccggtcacgggggtgcgcaggatggcctgcgagaagatcggcagcaccgatccgtcgtcgtccaggaagcggcaatgccagggatcttcgagccggcgcggcgcctcggcgatgaagctgcccaggccgtgcatgcgcaccaccaggccctgctcgaccaggtcgcgcagcgcgcgttgcaccgtgcccaggctgaacggcgtgagctgcgccagttcctcctcggccggcaactggtcgcccggctgccagatgccgcgccggatcgcgtcgatcagcacctcgaccagccgctggtacttgggccggcgggtcggatcgggtgcgtgcaacgtctcgaaaacttccagacgacgttccaaggtactcatgagattttctccctgtcttccataatcatgtcggcgcctttctcgccgatcacgatgctaccagcgttggtattgccggaaagcagcaggggcatgatcgaggcatcgaccacgcgcaggcggtcgacgccgcggacccgcagccggttgtcgaccaccgaagcggtgtcggggcccatgcggcaggtgcccaccgggtggaagatggtggtggcgtag

SEQ ID NO: 82835 - DNA, 183 bp, Glycine max
  Peptide Sequence Number=SeqID_174520
atgacgctgctactcaaaaatgtcttgcctagcaaccacaactccgacctccctctgcctaagtgccagttggtgtatgccatcctgacacggatgagtgtccacgtggcccaagtatggtgcctaccatgcaccctctggacccggagaagtccaacagggccctggggtttccggctctga

SEQ ID NO: 82836 - DNA, 201 bp, Glycine max
  Peptide Sequence Number=SeqID_174521
atggaagaagtacgacaaggactcggatttcctcttgcacgaaggtggtctcgtccaaggaccgaaccaaatattccaaccaattcattcttgtgggctccttatgacacaccagaaataaggccattaattaatgatgtagaggtatcaatgattgttcgagcaaaagtccctcttatatgttttgcaattgtcgaatga

SEQ ID NO: 82837 - DNA, 492 bp, Glycine max
  Peptide Sequence Number=SeqID_174522
atggagcaatgtttttgcttgagggagggggtaatggtttgggaatggaaagtgggagagtgtgcagtcggagtcggagtgaggttagtggagtcagtcggagtgaggctggatggacatgtgcccctaaaagacgacgttttggaaaaggaagtggttttcgagcagtgcgtgacgcggactctgtctccggcgttgacattggaggagggacttgagaaactgaaggaggctctccaaatcttgaattctccttccccttcttcccctactgtcctaagaccttcactttgttttgctcccaaccccactcctcctcgaaagaaaggttctttttggttttccatacctcagattgagttagatgagctggaaagtgtttccattctgtcaatgacccttgcatgggatgaattttccttctctacttttcaagaagcccattattcgcttcaagattctctagaccaggtgcctgacatgcctttttga

SEQ ID NO: 82838 - DNA, 1327 bp, Glycine max
  Peptide Sequence Number=SeqID_174523
atgacggagacctacctcgcctggttccaggcggcctggcgcgacgcgcgagacgccaaccgggaggtgcgtggctttctgtccgttcacgacaccatctggcgcacggacctggatacgggagaagcattccgcgaggacgcgggccgggtcaagccagccggctcagaccaccacggtctggggcatgccttcggtctgcgcgacgatctcgcccagcttgctgacggtttcgccctgctcgcgcagcgtggcggcgatggcgtcggcctgggccggatccaccaccaacaccatgccgatgccgcagttgaagacgcggtacatctcggtgtcctcgacgccgccctgctcctgcagccactggaacagcttgggcatttcccagctgtcgcgccgcaggcgggccgacaggccgtcctgcaggatgcgcggcacgttgtcgagcaggccgccgccggtgatatgggccaggcccttgatggcggtgccgtgcttggccagcgcggccagcacctgcttgacgtagatgcgggtcggggccatgaccacgtcgaccagcggctggccgtggaagtcgtcgtcgggcttggcgccggcgcgttccaggatcttgcgcagcagcgaatagccgttggagtgggcgccgctggacgccaggcccagcaccacgtcgccgaccttgatcgacttgccgtcgatgatggccgacttctcgaccgcgcccacggcgaagccggccaggtcgtattcgccatcggggtacatgcccggcatttcggcggtttcgccgccgatcagggcgcagcccgacagttcgcagcccttggcgatgccgcccaccaccgacgccgccgtgtccaccgaaagcttgccgcaaccgaagtaatccaggaagaacagcggctcggcgccctgcaccaggatgtcgttgacgctcatcgccaccaggtcgatgccgacggtgtcgtggcggttccagtcgaacgccaggcgcagcttggtgccgacgccgtcggtgcccgagaccagcacgggctccttgtagttcttgggcacttcgaacaggccgccaaagccgccgataccggccagcaccccggggcgcatggtgcgcgccgcaagcggtttgatacggtcgaccagggcgtcgcccgcgtcgatgtcgacaccggcgtcacggtaggtcaggggagctttgggttgattcgtcatgagaaatgccgtgggatatgtaacaattgctgggaattggggtggaacgccctgcattttacgatgttgcggcccgatcctggccggcgtccggtgaaactcgccagcggcg

SEQ ID NO: 82839 - DNA, 303 bp, Glycine max
  Peptide Sequence Number=SeqID_174524
atggagttgtatcaactcaaaatggagatgggaagaaatctccatgaccacatcaacaatttcaatcacttagtaagtcaattggtgaatgcatatgataaactctctaacgaggagtgggcattgttgttgttggcctcactaccaaggtccttcaaagctttggttcaaacgttgcttgtggaaagatcaactttgaatttggatgaggtgatcgccgctcttagagaaaatgagataatgatgagaactaaaaatgttgatgatgaacacaatacaatagttgtggtggagtttgagtga

SEQ ID NO: 82840 - DNA, 336 bp, Glycine max
  Peptide Sequence Number=SeqID_174525
atgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcggtgttggcggtgtcgggctggcttaactatcgcatcagacagattgtactga

SEQ ID NO: 82841 - DNA, 216 bp, Glycine max
  Peptide Sequence Number=SeqID_174526
acttatcaaggtaatccttgtggcgtctaccctgacttatcttccttcaccggaagtggcgtctacccagacttatcttccttcaccggaagtggtgtctaccctgacttatcttccttccccggaagtggcgtcatccaaacctttgtagcctgtatcaaacgatccgctcctactcaggttcacatcatctggtatcagagcttcggctcttga

SEQ ID NO: 82842 - DNA, 201 bp, Glycine max
  Peptide Sequence Number=SeqID_174527
atgtcaaaagttcacccatacctgaaattcgaagccccacaacgtagaggtgtgcttcacgactccgaaaatggcttcttgcaatttggagtagaaatgagaaggaattttggagcttcaaaggacaacaatggtggagaagaaggaagaagaaaagcaacgtggaaggagaggaagaagcttgtgaaattttctgaatga

SEQ ID NO: 82843 - DNA, 129 bp, Glycine max
  Peptide Sequence Number=SeqID_174528
atgatgatgattcactcattgatacttatgttagtccttagtccacagaaatcttgcctaacatcgttggacaagaagaagctaacgatgttcacgcaaatcgtaatgatcatgatgaaggataattaa

SEQ ID NO: 82844 - DNA, 48 bp, Glycine max
  Peptide Sequence Number=SeqID_174529
atggtgattttccaccatggaaatgcagcggaagacaaaggagaagag

SEQ ID NO: 82845 - DNA, 651 bp, Glycine max
  Peptide Sequence Number=SeqID_174530
atggttgaaaccaagaataagaggataaagagcattgggcatagactaactgccaccaaaacaaaatctaagaaggagaaggagtctgcaaatggtggctcttcaaacaatgggtttatccttcttgaacttcttgagtgccataggttgaagaagttagtagagatgaaggacacattctacctagagttggtttgggaagacattgttggtttgtctttaaaatggatgatggtcaatgataaaggtctccaagatgctagtgtgaaattcaacaaggtcaccaaatacaatgccttgatgaaggattcctctacattcattgttattgtttccaaaggcaagggaaaggaaatatttggcataagccccttggggagtaatgatgcacaactgatagatgaggatcttcttgtcatttgcctaatgcaagggaagatgaagcttaactgggtcaacattgtggtggacaacatgttgaaggccaagagaattgatgagatatttgagattgtggagccagagtttgaggtgaagtccaagatggatgagctcatgaggatacacaagggagactatttagagccaaatgagtgttttaaaaaatatatcaaagaggctggatgctttgggatcacaacatgtggatga

SEQ ID NO: 82846 - DNA, 1044 bp, Glycine max
  Peptide Sequence Number=SeqID_174531
atgggtcacaaagttctccttcaacacttggtgaagaccaaaggggatgctggagttgtctttgaacacgacattagacgctgggtcaacagtggaaagggatggatgctgatagcatctgcacataggcaaagagcaactgtagctattcctgaggatgttgagcatgtggataatctagctgacgaggttcataagcaacctcaggagccagttactgatgatgtacttgctaatgcccagggttttccaggcaggccccataatacatcagttttgatatattatgtatatcatgtggcagccatagtttgggagtgtcctaagttgaagttgtcctctcatgggagaaagagatggcacaaagaaactagtagtttccatcttccggtaggaaaggtcactatcaccctcgatgatgtggccttcttgctacatctgcccattataggcgtcttccataactttgatgctcctgacgcagaacatgttgtggagctgctagttgagttgctcgaaggtgcgacacacatgcatgtggtattcttggacgcatttcgtgacttcagccaatttggaagctattcatggggagctgctgcattggtccatatgtatgataatttgaatgatgcatcaaagaaatccactaggcaacttgcaggatatatcacattgtgcagtgttgggatctatgagcattttcttactcttgcttcatgtgttgttgatgaggattatcatgagagaaaactacgtgtttgccgatggaagtctgagaaggcattactgacctttcatccacaccctaatgctccatctttatctatagaggagattgacaatagatggattcggttttctgaataccttgcaccggtgggtcaaatttgtgttgcttttagacaatgtgcagcaaactacatggagtggttctacatgatatctcaccccttcatgagtctgacacagcttggggatcctcctaaacattcactcgtggtgcatgatgagacatttattgtaccaaatcctcctcagtag

SEQ ID NO: 82847 - DNA, 285 bp, Glycine max
  Peptide Sequence Number=SeqID_174532
atgcctcactgtcacatcctatcagagcattgtgtcccgacgtccttcagcacaaggttccttaaagcacttcacctagccatctgctcccctgaacacaagattcaagatcatcacaggatccaaacacaaacaacacacagagaagggagaccagtcagggtcacagtgttttgcgagaatgctccaaccatatgggatcaacataagcttaaaggagcactcaaaccgggtgacccccaaggcctacactctgaagagtccatcagggcctctccctcctga

SEQ ID NO: 82848 - DNA, 225 bp, Glycine max
  Peptide Sequence Number=SeqID_174533
atgtgtggggtagagggtgtcacaaaaatgaggcttaagaatcaaggaagtcattcagtccattatgtaagccaccaagggaatcaaggagctggaaagaaatttgtgaagaatcatgataaaggaaaagggccattaaagatcaacgatgactctgtgcaaatccagaagaaggcatcaaagagcaataattgtcatttctgtgggaaatttggacacttctag

SEQ ID NO: 82849 - DNA, 240 bp, Glycine max
  Peptide Sequence Number=SeqID_174534
atgggtcgcttagcaggcttcacattttactacactgggcttagtgacacaggagtgtcgcttagcggagaatgctatgttacagtgtctgcaaagttggttaagctggcaacgagcccgctaagcctaagggattcaagctcgcttagccacatgcagtttagcaagaggatgagtgttcatcctcaaaatatgaactcgcttagcgcagtaagtgagcttagcaagttcttcagataa

SEQ ID NO: 82850 - DNA, 729 bp, Glycine max
  Peptide Sequence Number=SeqID_174535
atggttaaaatcagaggtttgggtcgggctttaggcagggttttccgggcgggtcagattgaaggcttagttgctgccacaggattaagtcttctaatcacatgttccttggacactggcaattggaaacttatatcggcttttgcgaagaggtggcacaaggaaacgtgcaatttccatcttcttgtaggagaggcgactatcaccctcaatgatgtggcctctttgctccatctgcccatcacaggggccttctatagctttgagactcttcatgttgacaaaacggtgttgttgttagtggaattacttgaagtgagtgtagatgaagccagagctgagacagtacaatgtcatgaggcatatgtacgactatcatggctacgagacatttatcgtagcaaatgtgatatcgcacattggactgtagcagctcaagcttatctattgcatttgctaggttgcactctttttgctaacaagagtgcaacacccgtgcatctggaaaccacatgcttagaagatattgacgatagatggatgcatttctctgagtaccttgcactggtgggtgagatttgtgttgtgcctggacagtgtgcaccagactacatcgacttgttctacatgatttctcatcccttcataaggccaacacagcccggggatccaattagacatccacctgtcgttcaagatgacacatatgtggaaccagatatttcttag

SEQ ID NO: 82851 - DNA, 327 bp, Glycine max
  Peptide Sequence Number=SeqID_174536
atgggccccgacgggtgcagagaaacgcgaggaactggaaccagagaggcggcatgcaaaccgaggcaggatttcagcatccaaaaagaaaatttcagaagcttctccctctttccacgttgctttttgcttttcttcttctccaccattgtagcctccattaaagctccaaaattcctcttcctttctaccccaaattgcaaggagaagccattttcagagtcttggagcacacctctacttcgtggggcttcaaatttcaggaaagcttgggcagagcaaatgagaaaaaggagtgacaaatgtgaaagcaagagccatttatag

SEQ ID NO: 82852 - DNA, 90 bp, Glycine max
  Peptide Sequence Number=SeqID_174537
atggggcaagccacattgcctccatccccttgctatttgtacccaaaagtgcgcccacttgcagaagttagggtaaattccaaaacatga

SEQ ID NO: 82853 - DNA, 735 bp, Glycine max
  Peptide Sequence Number=SeqID_174538
gaagacataggtcacgtcttagacctcactcccataggagagaaaaggaaagaaagcctcaagaggctaacattaacctcccatacttccatgggaaggacgatgtagaggcttacttagattgggaaataagtgtagagcaacaacttaaaaggaagtctacttcaaaatcttatggctctcactcttatccaaagaaagaccaaggtaaaggaatcttaggggtgacaccttctaaacccaaagatgataaggggaagacaatagaaaagcaaccccttaaggctagtatgcaagagaagactagctctataatatgctttaaatgttttggaagaggacacattacttctcaatgccccactaagaaaaccatgattatgaggggccaagacatttatagtagccaagatgaggctactacttcaccttcctctagtgaaagtgaagaaacacttgttagcactgtcacacctcttgggcttgacgttattcctcaagtaaaggagttgttggatgagggggttctcacggaccctaagagaataaaggtcattcctgaatggcctactccaccaacaccacttattgagttggtgaggaaccatgttccttcatgggaagatctccatgaaaagggtgtcgagggaaggagcccagagtatgaagaacctcgggatttgacgtcaaatcctttccaaggtggaggggatgatgcaatcctaccccccaagg

SEQ ID NO: 82854 - DNA, 680 bp, Glycine max
  Peptide Sequence Number=SeqID_174539
gtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggtgaggcttgggacggttggtgtggaggaagttctgggcttggggcacctctcagattttgagcaacaaggcctcgaaagccttaagcctgaactcaaatcatcaattgagaagggaatcaaatttgccaaccagtatacgccatggtttaataattatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcagagaaaaaaggctgcaccgg

SEQ ID NO: 82855 - DNA, 1215 bp, Glycine max
  Peptide Sequence Number=SeqID_174540
atggttgaatttgccagcggtgtgaaaggaatagcgttgaatcttgagaatgagaatgtcggaattgttgtctttggtagtgataccgctataaaagaaggagatcttgtcaaacgaactggatctattgtggatgttcctgcgggaaaggctatgctagggcgtgtggtcgacgcgttgggagtacctattgatggaagaggggctctaagcgatcacgagcgaagacgtgtcgaagtgaaagcccctgggattattgaacgtaaatctgtgcacgagcctatgcaaacagggttaaaagcagtagatagcctggttcctataggccgtggtcaacgagaacttataatcggggaccgacaaactggaaaaacagctattgctatcgataccatattaaaccaaaagcaaatgaactcaagggccacctcagagagtgagacattgtattgtgtctatgtagcgataggacagaaacgctcaactgtggcacttagatatgggttacaatttcttctctttttcgcggtcttctatttaattagtactaatattaatatggcttcggtggacacattcgagagtctggtcaggagacttgctttctacctcggcaatcaagccttatctaggctattgcttcagaggggatgctccgtaggtctgaccgtggccattgctgtgctttttggggacacgccatcagtagggaataacatgatggacccctcggggtcttccggttcgtcaggagggggtgggtctgaatcctcgtggacggcccgcggagggaatgcctgttcctcccgcaaatccggtcgtggagcaagccggtccggcaatccggaagataccactgaaatcataggtggagactctattgactcgataaggaaccgcctcttacagtcatacgggaatccttcggcggagcaaatctctcgcgcctcgtatgacgccgatgatctctttcaggttaaagtggagatcataagggggatgactccacttgatcctgaaggggattggccggggcggggggctcgggcactcgataaccctcgaacgagcacgggcgaggattccctcgagaacctctatcgactaaaggacgacctgaatgagaatgggcgggactccgagacctttaaaagattgaaagacaaagtttttcgaagacctcgacctttagaagatgcaaattctactacttaa

SEQ ID NO: 82856 - DNA, 273 bp, Glycine max
  Peptide Sequence Number=SeqID_174541
atgtcttcatttacatttcaaaaacttcaatgtcttcagtcatttacgctttcaaaagactacaatgtcttcatttacatttcgaagacttcaatgtctttagtcatttacgctttcaaaagactacaatgtcttcatttacattttaaagacttcaatgtcttcagtcatttacgctttcaaaagattacaatgcttcctagaggtgctttaaagggttccaaggttcagaagctgagggaattgagagaaaagagaaagaagaggaaatga

SEQ ID NO: 82857 - DNA, 927 bp, Glycine max
  Peptide Sequence Number=SeqID_174542
atgcataaaaaaccggagggccgtatgagccgaagccagaatctgcgccagaacgtcatcaatcaaatgctggaagccattgcccgccgccatgtgcgctcgccgttgcctccgcaggcggcgctggccgagatgtttaatatcagccgcaccacggtgcgccacacgctgcagcatctgcatcagcgcggcgtgctggaaaaagtggctgagacctacgtgatcgtgcgcgatccctgcgaggaggatggttttagcgtactcagcccaccgatcgaccaacaggcggtacagtttgagcaggcgttttttaacctgattaaccagcgcttgctgatgccaggcgacagtttcaccgaactgcagctggcgcagcaggtgcgggtcagcccggtggtggtgcgcgagttcctgctgcgctttatgcgttataacctgctggaaccggttaagcgcggccactggcggatgaagaaattcgatcaggagtacgccgaaaagctgtttgaactgcgcgaaatgctggaaacgcacgcgctgacccgctttcttaacctcgccgccggtgatgaacgctgggtgcaggcgcgcgatctgctggatcgccatcgcgcgctgcgcgacaccatcgccagcaactaccgccagtttgccgcgctggataaagagatgcatacgctgattctctccgccgccaacaacccgtttttcaaccagtcactggaaattatctctgtgatttttcactcgcattatcagtgggatgaaagcgacctcaagcagcgcaacatcgtcgcgctggaggagcatatggcgatcctcaccgcgctcatcagccgccaggatgtggacgcactgtgcgcgctgcatgcgcatctcagaaccgccaaacactcaatgatccgctctatccggcagtacaattaa

SEQ ID NO: 82858 - DNA, 525 bp, Glycine max
  Peptide Sequence Number=SeqID_174543
atgaggggttgcattaactataatcccgcacttgctataagagagttagggtaccccatgaagggagcaccgatagaagaaagcctctctcctttccttgtgagagatttcggtgcacaaagtttcaagattatacaaagagtccataaggcgtgggaaagcccgttaaggaaagataaagaacttaggggcatttgtaatggcatcatcggtggttatcatgaatggatgaaagttcatacacgagggttagattggctctccaagttaaagattatcaacgaagagaacttcgaagctccggaagaggatgaagaagtccgagctctaaaccgaactaggaaaagtgagacttgccaaggaaaaattcaattaccgcaagagcccttgaacaagaaaccaagagggctcgcaaggaagagcatggtcgtgacaaatttcgtggagctttataaggcagcaacaatgagctcaagcttcgaagggaagagagagaccaatcacgagcacatagcatggtcttga

SEQ ID NO: 82859 - DNA, 468 bp, Glycine max
  Peptide Sequence Number=SeqID_174544
atgatgagcatgaaaaagataagggaagtcgatatgggtgcagttgccgctaccaacgttgttgctaaggatgtcaataactccactcccatactcattaagagccaacaacctcaatctgatcatgcacatgtctctcaaaccatgggggagacacatgaaattccccaccacaatctagccgacttcgagccttgcctcggatatgccactgaagggcaagcagttggtggcatacccctgcaaaacactttggagggccctcagtgtcacccacaaccacaaccctcacattccacagcggttaaaaaccctcatgctatggcagaaatgggaaagaggaaaggcttagggccattgaaggaggtgctggactttgacaagtacaaggggactacttgccccaagaaccatccaaagatgtattgtcggaagataagggcatacgcaaagatgaggaactgctaa

SEQ ID NO: 82860 - DNA, 1350 bp, Glycine max
  Peptide Sequence Number=SeqID_174545
cggacatcggcccgggacaaggtgaaggtggatgcgctgcagcagcgcatgaccgtcgccgagaagcgttacagcgacgccctgctgctggtcgccaacgccgacccgaagggcagcaacgaagccgatgccgcgctggaagacatggaagatgtcctcaacgactgcgtgaagcagaagggctgccagatgggcaccctgcttgccagctacaagcgcctgctcaagcacgacgctgatgccgcggccagcgatgatgtggcggacgaagacggcgaccgcctggaagccgaccccgaccatatcggcccgctcaccgccgacgtgccggaggccgcgcgcgctgccgcgctgctcaacgacaagcggcacgccttcgacagcatggtcgaatacaacccgacggtgcaggccggcatccgccgctggctgaccgacatgcgcccggcgctgctgaccagctatgagaactaccagaacctgcgcgcggtgatgtggccggagtgggagaagcgtggcctgcccgaggcactgctattcatgccggccaccggccgccgcttcggcctcggtccggatggcaccggcttcgatacccgtttcgatgcgcgcagtgctgctgaagccagcgccagttacctcaacgagcgtctacgcgagctgaacaacaacgtggaaatgtcggtggccgcctacaacggtggtgaaggccgtgccgcgcgcgtgttcaagcagagcgccggccagagcttctggaccgacagcgtctacaaccagttccccggcgagaccaaggactatgtgccgatggtgatcgcggcggcctggatcttcctgcacccgcagcagtacggcgtggaattcccgaagatcagcgcgcagccggccacgctgcgcctggccaagtccaccaccatctacgaactgaccatctgcctgggcagccacggcacccgcgatggctacatgcgcgcgctgcgcaacctcaacccgcgctatgaagccgacggctggattccggccggcacgctgatcaacgccaccacccgcatcgccggcctgtaccagcgcaactgcgtcagcggcccgcgtgccgacctggcccgtaccctgatcaccgccgatctgaacgcagcgatcaagcgtccgaccgctgccagctacaccggcagcgtggccgtgggcggtgtggtgccggtggccgatgcggccgcgtccaccagcgtgccgaccaccccggtggcgccggtggcggccccgcgcccggcggcgcgcccgaagccggtgcgcagccacaaggtgggcaagggcgagaccttgggcgccatcgccgcgaaattccagtgcgac

SEQ ID NO: 82861 - DNA, 141 bp, Glycine max
  Peptide Sequence Number=SeqID_174546
atggataagagcttgaaggtaggaaaagatgagtggagggagaaggagagaaggagcacgaattttgtgcctcaaatgaggtctgactttgagcccactaatccaagatcaagtccaagattttccactaagtgtgcttag

SEQ ID NO: 82862 - DNA, 210 bp, Glycine max
  Peptide Sequence Number=SeqID_174547
atggttacaattttctatgggtactacgcctacaagattctccaatctgcacttaggtggctcataacacaaagaatgaattgtactagtgcttgcaagtataatcgagttgacttcaacatgcaacacaagaaaatgggttgtactagaactggaaggtacggtcaacggagtattccttatgaaatctatcttgatacatgtcattga

SEQ ID NO: 82863 - DNA, 369 bp, Glycine max
  Peptide Sequence Number=SeqID_174548
atggtgggttacacaccttcaagttttacagatttggtcttcgccagcaaaaggatcgaagtgggtctgaaaagaggcaaatttggtcatcctgctttgataaaaactggggcaaatgaagaggatgagaatgagggagaaacccatgctgtgactgccattcctatacggccaagtttcccaccaatccaacaatgtcattactcagccaataacaaacctcctccttacccaccgcccagttatccacaaaggccatccctaaatcaaccacaaagcctgtctaccgcacttccaatgacgaagaccacctttagcacaaaccaaaaaacaccaacaaaaaggaattttgcagcaaaaagcctgtag

SEQ ID NO: 82864 - DNA, 264 bp, Glycine max
  Peptide Sequence Number=SeqID_174549
atgaggaaaacaaaaacttttaacaaggatgagttcctgcgttgcacgagatgcgggaaagagcgcaggttcctctcaagagcagacccagacattaagaactaccatgatgctttaaacaacaaatgctggacttgttctcttttggccttatcaaaatctgtacttagtcttgcaaaacacattatatgttggaaaaagatactggggactcacgatgtgtcaataagaggtacaaacacagaaaggatgagtgataagtga

SEQ ID NO: 82865 - DNA, 627 bp, Glycine max
  Peptide Sequence Number=SeqID_174550
atgacgcttctcctcagcaacatccttcctagcgaccataattctgatctcccgctgcctaaatgccagctggtctacgctatcctgacccagatcaatgtttatgtagcccagcttatcttggatgtcatttatcagtttataggtatcacacctccaagacacccagtggacccagaaaagtccaacagagcactgggatttccagctttgatcacaagtctctaccagttctatggggcacagcaaccggggcaggaccagcagcaacaaccaaccacagacgcaccaccgccacctctaccgcaaccaccatctctagagtccatctcagctcacatgcaaaggatggagctctacatgcagcatttggctgaccagcaggcgtctaaccataggggccaggtgcagttgaacgacagcttctacaagtataccctgcaccagcagcaccaggaccccagcccttacccatggcctactcccgagcagttcaggaccactattgcatggcctagggacaggcctaattttcaggcgagggcaggtcccacagaggccctaggagatgaagacggagctgaggaagatggtgacatggcaaatgtgatggatttcttcctttga

SEQ ID NO: 82866 - DNA, 483 bp, Glycine max
  Peptide Sequence Number=SeqID_174551
ccgccgttgggtgctggaagacgaagggcggatcatcggcagcaacaatctgccgttgccgttgttcaacggcatgcagcaggcgccggtggcggtgatcgacgatccgttcgatattcgtctggcgcgcttgcaggccgaatatatcgacggtatgcgcgaacagttcgaacaggcctatggcatggaagagggctggcggcagtacgacgactatttgcatcatggcctgttcgctattcgccgccgtttgggcctggagcgcttccagcagttgacgcagcggctggaggcggcgctgcgggcgcagcgcctcagcggccagagcgacgcgcaccgcgagtggttggcgcctctgttgcagcagtactacgatccgatgtattgctatcagttggaaaagaaagcccagcggatcgtcttccgcgggaactatgcagaagtaagagaattcttgatgacgttcagccagaaaaacggtga

SEQ ID NO: 82867 - DNA, 126 bp, Glycine max
  Peptide Sequence Number=SeqID_174552
atggagaaaggcatgcacgaagagaaagaggaagatggaagaagaaaacggagattgttactgttactattactggcacgtgactctaccaaactgaacgagacatcgcacgtgcagctagcctag

SEQ ID NO: 82868 - DNA, 1158 bp, Glycine max
  Peptide Sequence Number=SeqID_174553
atgatgaaatcctacatctggcttcaaactgtggatggttctattcagcaagtagaggaagaggtagccatgttttgccccatgatatgccaggaagtacttcaaacaggcatgggatcttccaaaaactatgctatatctcttccacaacgtgtcaatcctgcaatcttgggattgatacttgactactgtcggtttcaccaagtaccaggacattctaacaaggagcgcaaaacttttgatgagaagtttattcggatggatacaaagaagttatgtgagttgacatctgctgccgacagcctccaactgaagcctttggttgacctgaccagccgagcacttgctcggattatagaaggaaaaactcctgaggagattcgtgaaacatttcatttgcctgatgatctcactgaggaggagaagctggagcctctgagaaacataactgatgatccacgaattcgacttctaaacagattatatgctagaaagaggaaagaactaaaagagaggaagaaactgaaggatgttgaggttgaggaggaaccaaaagatgagcgttcagttgaagatcttctatcatttattaatggtgcagatggagatatgaagggaactagaacaaataaaaataaaaagaagaataggagaaggaaagaccatgcaaaggatctttcttcaaaaaatgaaaatgaaaatgataaggacttgaatcctctcccttctgcatatcacaatgtctattttgacaatgccttggaggcctctgcaagtaaacactcaaggatgcaaaaccttcctgctattagtttttctccaaaatttgaatttattgatggagatgttgacgatgatttagatcctgcaatgaaagaggagcttgacagggaagtggaagattttgcacgaaggttaaattctgattggcctgaaaggatgcaaattttatctttgggccaagacagaagactagtaccaatttctataaatagcaatggttcaacgcacctgtatacagcatctgaaaattttgctcagagtctgttagttctaagatatgattatggactgagggctagactagcagtgacggttttgataaaaggtagtgcagcactggcaggtaattcaatttccaaggtgagtggaagttaa

SEQ ID NO: 82869 - DNA, 768 bp, Glycine max
  Peptide Sequence Number=SeqID_174554
atgtctgacttcatcgatcaacatcagaggggaaccttggcggaatcatcagattcactacgaaacgttgaagctggtgtgatttcatcactgtttgccacactagctcgtatgcttcaagctgatccacctccaaaagctgtcaaagtcgttgtgtccaagcgtgttgctttggttggtgaagagctaatagcctatgaagaagagcaaaatcgaataaaaaaagaagctttaaaagctagtcttatgaaggaggaagaatttaaaacatctcatggggctgataataatactagtgattcaatggtcattgattctggcaataatcatgtaccacctgaagtgtctggtcccagaggcggaggataccgggacatatttattgatggatttgttccccctttgacaagtgttgctccaatgtttccctgttatgagaatacatcagagtgggatgattttggagaggtcataaatccagatgattatgtaattaaggatgaagacatggaccagacagcaatgcatggaggtgatataaatggaaaactagatgaaggtgctgcaagtttgatactcgatacaaagccatcaaaagttgtatctgacgaaaggactaaattgattagaggaaccaaggtgcaagtcaggtgctcattggtttacatggattttgaaggacgttcagatggaagatccattaaaaatattctatctcatgtggctcccttgaagctggtatggatctcattggtgcttttcagttaa

SEQ ID NO: 82870 - DNA, 2091 bp, Glycine max
  Peptide Sequence Number=SeqID_174555
atgccaattgcaaaactcaaagcctctggcactccagatgtgatgaaaaccgaagacagaatagataccttaatcagacaggcaattggcaaagaacctttcattccttttccaagggccagtgaaagccctgtacagtggattcaattactccatgctttagatccgcaaggtgtcagcaatactttttcagaatttcctgggtggcctttgttctctcctctgaaggttcagttgcagaagtgtgacaaatgttctcgagagttttgctcccccgttaactatagaagacatatacgtgtacatcatcggttgaaaaagcttgataaggattttacaaaaactaaggatcttttaggagcatattgggataagctctccgtagaagaggcaaaggaagttgtatcattcgaaaatgtgctgctggaggaagttccagcttcttcaattttaaaatctctgacaacttttattcaaaaccaaggattttattcttttcctcagtattatctgatggctggtgctgcccttttggatattgttcaatctaaaccttcctgctttcctatatcttcccaggagttgttcagtatccttgatgatgctagtgaaaatacttgtttatgtgggacagcagaatcaatgcaaagatatgtatttgatggagaggctggaaaaattggtcttgaaccaaaaaacctagttgcttgcacaagtttcttgctagaacagaaattggtaattgtctttcttatggtgaaggcatggcttgctgacaaggatgctgaagcactaaggtgccaaaagcaattggtggaggaggaagaagctgctcagaaaagacaagctgagattttggagaggaaacgccagaagaagcttagacaaaaagagcagaaagctagggaacaaagacaccaagctgaggcagaaattaaaggcgatattgacagtactgtaaaggctttatcaccggcagaagcatctttagatacatacaattttgaagctcataatccaagtacattttcagataacgcagcttcacctgtacctttccaatgtcctgacaccagtgaagaaataaatggggatattcattcagagtctgaaactatcactgatcaggatattgtgagacagtcagcacatggacataaacataagcgccaagcagttgccagacaacaggggctgccaaaattacaatgggctgtagccaatggtttgcatacaaagcagaattctccagtgtcaaaacttgaaatcaatcagaaatatggaacccactgtgatcaaaaggcatcttctatagttaatggtagcaaagtatggactcggaagtctaaaacagaaattgacaaggtggttttaaaaaccataaaagagaaggaaccagaccaagttaagaatcaagaagtcttaataggatctatatctgttaatcttagcaattgcagccaatcagagggtaatatggtggcttctcaaaaggacttcattgttgagaatatgggaaagcagaatatttctcgggataagccaatgaaaactgatcttgccatgggtgacaacaatcgctcaacagtcaagttttggaggccagttagccggcttgaaactaaagatccacttccagttcaaagtggcgggacaaaagttgatgcagttcatgaaaatggtcaaaacttgtcaggtccaagttctttaagggtgtgtactgctgccggtggtgatattggttttgctaagtatttctcccatacagaggataaagcagatccaggaagcttctggttcgacatccaggctgcaaaagctttccttgcacaaaggtggaaggaagctatctcatcagaacatgtgacattggttatttgccccgactcggaacctcctgggtgcgaggagatacaggatttgaaaacagcagcatgtcaatcttctgatatggatggatgtgacattgtggcaaatgcagataaaagattgcctgcaacctccaaagttgcgaaatccaaacccaggttgaagaagtctgaaaagggaaccaagataaagtatattccaaaacagaagacaaatacctag

SEQ ID NO: 82871 - DNA, 561 bp, Glycine max
  Peptide Sequence Number=SeqID_174556
gcacataaaattgatcttcctcctcaccataacatccactatttccatagattttccactgaagctacagagcatctgaagcagcactgcctgaagcatgtttgtccacatgtttatgctccccaattggaagagacaattgatgtcacctctgatttatgtgcttacaaggttctactgtccgagaagctcatgagtaatgtactcttcaaaaagctaggagattatgaattagcttgggttgatgctgtagtagggaagacagaaaatgacccgctttcgctgctccctgtttctggagccgctcctccgcataaatctgttcttgttggtgatttgaaattggcggatatcaaacagtttctctccagcaagggtgttcaggtggaatttgctggtggggctttgcgttgtggtgaatatgtaactctacggaaagttggggatgcaagtcagaagggtggtggttctggtgctcaacaaatagttattgagggtcctctgtgtgaagattactataaaattcgtgactatctgtattcgcagttttatttgctttag

SEQ ID NO: 82872 - DNA, 534 bp, Glycine max
  Peptide Sequence Number=SeqID_174557
atgcctaaaacaacattagacaaattgtcgttcgacgtctcgtacatgaggccaagctctatggtggtcagagccttcgatggcagttgtcgtgatcttgttgttgcttcaggtgaggaggacatactagtaagttgtccatcttttatgccttatgttgaagcagcggaggagtcactagaaatgtcatttcaagcattggaaattatgaatagtgcttatatggagtctccttcgatacaaccacgtttgtctgatacctctttgatggtagctcgagttatgctaaaggatgagtatgagcctgaaatgggtttgggccggaatggtggtggcgcgcctacaagttctgacaaaaggaggattgctttggaaaggaaaaagaaaagcttagctcatttacaagggcaaggacctcaagtggaaaggatccttatttgtcacatcaacgagagctttgtgagtgcaaggtggatgcatgaaggccaggttgctatgctggatgaagagaccaatcaagatcagccaaactag

SEQ ID NO: 82873 - DNA, 300 bp, Glycine max
  Peptide Sequence Number=SeqID_174558
atgcataaggcattgcgattgaatgctccattgccatatcctcatctagtcacccttttccttcaacagtttaacatccctcttgattatgaaccctatgttccaatcaagagatccttccttataggcgcttcagtcattgcatcctttggttatcaaaaagagcatgatggttcttgggtgaaaaaggtggatatgcgcttcaatgagatggagtcaagaatcaccaaggttgaagaagatatgtcttacattcgttcaagctttgatctaccaccatcgccgccaccatcatcttag

SEQ ID NO: 82874 - DNA, 204 bp, Glycine max
  Peptide Sequence Number=SeqID_174559
atgctcttgggtctgaaaagaggcaaatttaatcatcctgcttggacgaatgagaaaactggggcaaatgaagagggtgagattgaaggagaaacccatgctgcgactgccattcctacacgtggactttcaaaagccttaaatggtcctctttgcggttattggctaaacgtggactttcaaaagcctaaaatccacacataa

SEQ ID NO: 82875 - DNA, 210 bp, Glycine max
  Peptide Sequence Number=SeqID_174560
atgtatagggagagaagaagtcatagaagatatggagataggcaaagagaggaagggattgatggagtaaagggagatccaagacattgtagagttgcaccactatgcctctttgaaggatctcattcatcacgctatcaaggtggaacaacaagtaaagaggaaacaaacatacaagaaggagagaggatcttcattgaaatctcatga

SEQ ID NO: 82876 - DNA, 336 bp, Glycine max
  Peptide Sequence Number=SeqID_174561
atgaagtacctaagtgtagtttacaaaagcaaaggtgaaacgaaagacattgagctggtagaggaggaacatgcacggattggtgctgatccttctattgaaccactagaacatacgaagaaaagagatacaggccatcaaagtgtgtcattggagaataagacaggagattcaactgtgctgaagataggaaattcgggtaaagttgtgataaaacaagacatgaagggaagaaggcataaatatgggtttaacaacaacaaacgtgagaaggcagagaacaaaagggtggtggatgatgaaactggcaacaacatcagcaggatgaagtcctaa

SEQ ID NO: 82877 - DNA, 734 bp, Glycine max
  Peptide Sequence Number=SeqID_174562
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccaggcattacggtcattaccagtgagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 82878 - DNA, 252 bp, Glycine max
  Peptide Sequence Number=SeqID_174563
atgttggcaacccattccaggtaccgagaaatagccaagaagtcagcgccgaattgtcgctttacttcttcttttatcttcagggacatctcgggcttcatccttctcagcttttgctttaccggggaacactcaggatttagagacaaaggcgtcttggtagtccctaagcagggccagcaattcttcacggatgagggcggtcatacccgtgcctacttttgcttccttcttttcactgccggtacttaa

SEQ ID NO: 82879 - DNA, 558 bp, Glycine max
  Peptide Sequence Number=SeqID_174564
atgacgaaagccatgatgagtatgataaaaatgatggaggtcaacacagctacaatttttgccgcaagtaccaccactgaggtggacccaactcacccatctggcctcaatcaaaacaagcattccttcccaccatatggcttacctcccaactatacaccacccaatgttgcacacgctcccgatgagaatgacaataactccactcccatactcattgagagccagcaacccctatctggtcaggcacaggtctctcaacccatgggggagacacatgaagtaccccgagaccacactctagccgactccgagctttgcctcggatatgctactgaggggcaagcatttggtggcgtaccccttccaaacactttggggggccctcagtattacccacaaccacaacccttgcattttgcggtggaaagagtcccttctgctatggtggaaagggagaaagaggctaagggatctagcagctcaagtagcacccccaatgatgaagagggagatgataataatgatagtagacacgttaccggcgttctactatga

SEQ ID NO: 82880 - DNA, 282 bp, Glycine max
  Peptide Sequence Number=SeqID_174565
atggtgaaagttggaacttcttacgtgccgatcaacgtctcattttcgccaaaagttggcccagggcttcccggtgctccagtggcttctgtttcttcagctgtccctcctgttcagctactgacgggtgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 82881 - DNA, 437 bp, Glycine max
  Peptide Sequence Number=SeqID_174566
atggtgaaagttggaacctcttacgtgccgatcaacgtctcattttcgccaaaagttggcccagggcttgcccgggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggaatttcctggaagattaccaccgccaggaagatacttaacagggaa

SEQ ID NO: 82882 - DNA, 1044 bp, Glycine max
  Peptide Sequence Number=SeqID_174567
cgccagcagatgctcactgtcgtacttcagctgcagatattcgaggatggcgcccgattccgcgatcacccgattgccatcgctcttccagcagccacagcacccgatgagaacgggagttttccagatggtgaacgcggattaacgctgcggctcgtcctgttgcggatcgagcagcaccgctccggagccctgctgtcccagacggtcacccggattgcgcagcgggcagtcgcgcatcgacaggcagccgcaaccaatgcagccgtcaagatcgttgcgcagacgcgtcagggtttcgatgcgtttatccagctcttcgcgccagtgctgcgtcagcgcgtcccactcctgcgtcgacatgcgcttattcgccggcacgtgcatcaggctgtcgctgaccgtcgccagcggaatcccgatgcgctgggcaattttgataatcgccacgcggcgcagcacatcacggctgtagcggcgctgattaccgccattgcgcgtgctgctgatcaagcctttgctttcataaaagtgcagtgccgataccgccacgccgctgcgtttcgccacttcgcccggcgtcagcaccggtttcgggcgataaccttgcagaaggaacaggctatgatgcaacaggaaatcatccattcactgactaactggatcgatcagaatctggataaaacattgtcgattgatgaagtggcggcaaaatcgggttactcgaaatggcacctgcagcgtatgttccgtacggttacgaaacaaacgctgggtggttatattcgtgaacgccgtctcacgctggccgccgaagccttgcgtcagacgcagcgtccggtattcgacattgcgatgcagtacggctatgactcgcagcagacgttttcacgcgtgttccgccgtcagttctcgcaaacccctaccgcttatcgtcacagcatgcgtcgccaggcaatggtgcagcgtccgcgtctggtcaactttgactgcagcgagggcatgaacagctttgcccagcgcaccaccggcgagtgctgcccg

SEQ ID NO: 82883 - DNA, 370 bp, Glycine max
  Peptide Sequence Number=SeqID_174568
cactaacaccgtgattgatcctccatctcccatcagacgacacgtgaagtggaagatgacccacactaaggaaattggtcaaatgacgtctgaggcagcaaaggaaattactgacaagattggttcctttgtcgcccatggacgtcaggttgtatcgaatgctgccattgggcgactagaacaccctagtcgtgtgtatgttgctggagccggtgtcatgatcaaacaatactttggaccggctccaaggacctcctgtacttcttcgtccatggctctcgaagacctggagcagctgatgcaaaagattagggaccagctggaggagtcgatcataaaaagtgactcaacaaatgatgttgttctttag

SEQ ID NO: 82884 - DNA, 288 bp, Glycine max
  Peptide Sequence Number=SeqID_174569
atgttacatttgaaaggacttgatgatactccacaacctaaatccaaggctgctgctaggtggattgttgttaagtgtaatagacaaaaaggaagcactgagtacggctattacgtcatgcactggatgtccacgataatcttaggaactttcaggaataattgggaaacgtattttcatgatgttagaccattggaagcagagagattgaaagcgcttcgcatccagtgggcacagtattatctaaaagttagaaatcaaatatacgatgttagagaactatgttaa

SEQ ID NO: 82885 - DNA, 66 bp, Glycine max
  Peptide Sequence Number=SeqID_174570
atggaagtgagatttggttgcgtcaaatccaatggtgctcctaggatggttaacctccaagactaa

SEQ ID NO: 82886 - DNA, 724 bp, Glycine max
  misc_feature (619)..(619): n is a, c, g, or t
  Peptide Sequence Number=SeqID_174571
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggactataaagataccaggcgtttccccctggaagctccctcgtgcgctctcctgttccgaccctgccgcttaccggatacctgtcgttcgctccaagctgggctgtgtgcacgaaccccccgttcagcccgaccgctgcgccttatccggtaactatcgtcttgagtccaacccggtaagacacgacttatcgncactggcagcagccactggtaacaggattagcagagcgaggtatgtaggccgtgctacagagttcttgaagtggtggcctaactacggctacactagaagaacag

SEQ ID NO: 82887 - DNA, 441 bp, Glycine max
  Peptide Sequence Number=SeqID_174572
atggcttctccacctgcctcgcctcctcctcctccttcagacgcatcaacttcgccaccacctggtgctgagagaccattggtccacgttgatcctgctaccggcaaggccgacagtccccacaagaagaaattaagaacatatttggggattgtggattcctttgaggagcaggtgacacagggatccttcatctcctatggatgtcaggatgttctcactactgctattagacgtctagtgcaccctagacgtgtccatgcagctggagccggtgtcaccatcaagcaatactttggatcggctctagggacgtcccgtagctcttcctcactgcctcctgaagaattgcagcagctgacccaacaaatcagggaccagctagagtcgatcacaaaaaaagtgactcggcagctcatggcaacctttagccagatatag

SEQ ID NO: 82888 - DNA, 231 bp, Glycine max
  Peptide Sequence Number=SeqID_174573
atgaagtatggctccaaactctttgggtggaggacgcatgaacgacaacgcaattcatggggctctgaaaaaaaagggcgaggatggaggattgcactagagggtcctcacaagtcaatcatgaagcatgactccaaactctttggtggaggatgcatgaacgaaaacacaattcatggggctccgaaaaaaaggggaggatggaggattgcactagagggtcctcactag

SEQ ID NO: 82889 - DNA, 831 bp, Glycine max
  Peptide Sequence Number=SeqID_174574
atggatagagctaggttggtctatggcttggtgactaacatggacatgaacatcagagcccttatcttaggtcaaatttcttctattgctcagagtaactcctctaggcttggatttccagccttgatcattgccctatgcagagctagaggagttacctctgacagtttgacttatgagagcctaagcctgaccattaacttggcctacattaagaaaaactgttggaatatggatgatctaacagttaacttcagaggggcaaggaaggtaagggctcgaatagctgatgttccttcttcttctactccaccagctccatctacttctactactcctacaccagctcctccaggcccatctgctcaagactctcagcgctttgaatccatgcttcagagtcttcatcaaggacaaattttgttaatgcagagcttgcaggttgtagctcctctaggatccattctgacagtggaacaattcatggataaggtatcttggccaggaaccctgccttctcttgagagagaaggtgggggtcccagtgctcaggtaaggcaggaggctgctactccagagaggtcaccacagatttcaccagatccaccctctctagtggtggatcaatcttctcttcaacagccagcagacccttctacaccagtgcatgagatgccaacagacttgtctacaccattacttgatcttccagaggacccttctacaccagtcttgggattgactaccactcccccgaccactcctatgctacatcttacagatgaggaggacactcaggatgaggatactcagtcacaagacctgtcatag

SEQ ID NO: 82890 - DNA, 459 bp, Glycine max
  Peptide Sequence Number=SeqID_174575
atggatagccctaggcctatccttgatcctatagcaatggctccaaaaaagcttctctctaagagggcaaggaaggatgtcatgggagaaggatccaatgcggctcctcaagcaaacatagaatttgacgaacaccattttcgaagtgaggaacatcaacgctgccatgaagcgatcaagggttggtctttccttaaagagagatgggtgcaacagagagagagggaatacacagagttccaggaggaagttgtcaggaggcaatggactcaactcaaagagcccatggttaaatatgacccagaaatagtcatggaattctacgcgaatgcatggcccactaaggaaggagtcaaggataagtgctcctgggtgcaaggccaatggttcccctatgatgaagatgtcatcaaccaattcttggggcattcgttggtcctggatttgcgagttcagtga

SEQ ID NO: 82891 - DNA, 186 bp, Glycine max
  Peptide Sequence Number=SeqID_174576
atgcgtggagtcgccaccaacgtttattcgaggaaaacgtcggaaaaaccagaaaggtgtggtctacgaactttaagtgtgaaaggtccgggagttgtttttatgcacggggaagcaagatatattttaaccgaacaaaaggtcattttaaggcgttggaccattaagcgatctttagatttttga

SEQ ID NO: 82892 - DNA, 228 bp, Glycine max
  Peptide Sequence Number=SeqID_174577
atggatccccctccccgcaggaattcgatccatgaatattattgcctagcgttgttcatgtgtcctccaccttcgagtttgcagctatgtttcatgattgccgaagtgcggaccctcaagccgctgttcgtgtcctccaccctcgagtttggagctatgtttcatgattgcctaaatgtggaccctcaaggcaatcctccattctccccctttttcggagccccatga

SEQ ID NO: 82893 - DNA, 372 bp, Glycine max
  Peptide Sequence Number=SeqID_174578
atggctatttatagaaaaagcaattttgggcaatggcagctcgccttagcaagctggtttcttaaggctgaaggacctagctcacctaggcgagctagttgcttaggcctgaaggcttttggtggctcaggaaagccagatgttagccggggcgagttggggagggcaaggcaaaataggaaagtgcatcttctcatgaagaagatgcgcgggagtcgccaccaacgtttatttgaggaaaacattagaaaaaccaaaaaggggtctatggattttgaaaataagggttcgggagttgtttacacatggggaagggtgttgcccttgctcctacgtatcctcgggtgtgatgaggaattcagacctaaataa

SEQ ID NO: 82894 - DNA, 204 bp, Glycine max
  Peptide Sequence Number=SeqID_174579
atggctaccaaaggttggagctttgttggagcttcaatggtggagaaagaagaagagaatggcaattccctcgcgtttctttgcacccgtcggggccagttttcgaaagtaggcaatatatatatatatcaaaacgctcagaatgaaaccccgagcgtggttcagagccattcaaaatgcaccgtttacaaaaattccgggtag

SEQ ID NO: 82895 - DNA, 66 bp, Glycine max
  Peptide Sequence Number=SeqID_174580
atggatgggaaggctacggatatttggatgacgccacttccggtgaaggaagataagtcaggatag

SEQ ID NO: 82896 - DNA, 449 bp, Glycine max
  Peptide Sequence Number=SeqID_174581
ggtacatcctttgtggtacaagtagagggtacatctacttgggttgttgtaactgagaacaagagagggtacatctcttgtggatcagttctagtggagggtacatccactaggttgttcaaagagaacaagggagggtacattccttgtggatctttgcttgtaaaggactttacaaggttgaaaagaaatctcaaggaccgcaggtcgcttggggactggatgaataggttattccaagatcatgatgaagaccaagccaacttgtgtctcatgacaaaatcctatgacaacaacaaagaagaatctgtaaggaagaagtggtggtacatcgaaagtggatgttccaagcatatgatgggagatgtatccaaatttacaagcatttccccaagaaaagtggacatggtacatacggcgacgacaatatcagtaaaatctcaaaagag

SEQ ID NO: 82897 - DNA, 372 bp, Glycine max
  Peptide Sequence Number=SeqID_174582
atgcattcatcgtacctcctctatgatagggtgttgaagtattggtcatcaaaattttcattctatcaaacatggggtcaaacaaagcaccctctttcaaaaaaatggttctatcatgtcaaagtcaagaacctagaactagacagcttgcgagagctagggcagcgaatggatcaagatcgacatcaagcctttagcaaggtgtatgggaaaattagggatttggccatgatagaagtgtccgttgaagccattgcatccctcgctcaatactatgaccagttgtcataccctaattttgtccggggaccattgtttgatggcatgcaaccttcgcttgaccgcttcgaggaacttgacacccatcgttaa

SEQ ID NO: 82898 - DNA, 327 bp, Glycine max
  Peptide Sequence Number=SeqID_174583
atggtttatgaatggccatcaaaggtctatttatatgttgtcgcaacctacccttcggcgggagggcgacgcgtgactcgcgggatgcgtgctccacgaaaggaatacgcgcggagtcgccaccaacgtttatttgaggaaaacgtcggaaaaaccggaaaagacgcgatctacgaacttttaagtgaaaggttcgggagttgtatttacgcacggggaaggagagaaacgttaaggcattggaccattaacgatctcttggggtggtcgacaaaagcggggcttttgctcctacgtatcctcaatgaggaactcagacctacgtag

SEQ ID NO: 82899 - DNA, 138 bp, Glycine max
  Peptide Sequence Number=SeqID_174584
atggcacatcaccctccaatgtgttgggacaaagaattctcaggcggggaagggaagaatcaaaagaattctcaagcggttagtcctttgaattctcttggagagagaagagagacacaaaagaattcagacgattag

SEQ ID NO: 82900 - DNA, 398 bp, Glycine max
  Peptide Sequence Number=SeqID_174585
atggatacctcagagccctacactggggcaatgaaaggcaccatgcataaacctaaggcgaacctaggggcagatcagaagttctcacccaataggttccctactacaagatttcctacatctaatgtccaattttttgaatttggggtgagaggccctctcgatgagtcaatctcttgctttctcataagggtggacccttgggtactagtacctatcgccttccgagggctacacacccttgcctttaaagggctgcatgccctcaccttcaaagggttgcacgccctcgccttcagagggctacacgtcctcacctttagagggatacacaccctcaacttcagagagctgcacgccttcaccttcaaagggttgcacatcctcgccttcagagg

SEQ ID NO: 82901 - DNA, 261 bp, Glycine max
  Peptide Sequence Number=SeqID_174586
atggtgaaagttggaacctcttacgtgccgatcaacgtctcattttcgccaaaagttggcccagggcattcggtatcaacagaaatttaccaggataagtgcgttaggcgcccgttccattcgaaaccatgtcaggctgcgcaactgcttaagaggaaccgggcgatcgagtgcgggcctcttcgctattacccagcggcgaaagggcggatgtgtgcaacggcgattactatgttggcacgtaacgcagggtgtcagtga

SEQ ID NO: 82902 - DNA, 636 bp, Glycine max
  Peptide Sequence Number=SeqID_174587
atgcatactaggtcaggattttgcccggaccgctgccgggatacgggtgcggatcatgcgcaccaacatgactaccttgacccagacttgacgttgctgctcagcaacatcctgcccagcgatcataattccgacctccctctgccaaagtgtcagctggtgtatgtcatcctgacacggatgagtgttcatgtggctcagttgattgctgatgccatttatctatttgcaggtatgccacctaccaggcaccctctagacccagataagtctaacagggccctgggttttccggcattgatcacgggtctctgccagtcgtttggggttcctgtcacacctagtaaggtgattcaaccgccgatcacccgatctttcatagagaagtactgcatagctagacaagcacagggtggcgacccgcaggccccagacgcactgccgccacctcctcaggctgatccagctgggtcatttgacacggagcggtatttacggcaattggttcgccagcaggcggccaaccacagggcgcacgtgcagacccatggctgcctctaccagctcagccttagcctgcagagccagggtttccctccttttccatgccctactccggatcagttcagggcagag

SEQ ID NO: 82903 - DNA, 193 bp, Glycine max
  Peptide Sequence Number=SeqID_174588
atgtcctctaatattgttatctctgcgcaaaatctgcgtaaagtttatcagatttattccagcccgatgcagcgcctgggagccttactggggtatcggggggctaagggtagggagtttgtcgctctggattccgttaatttcgagattagaaaagtgaaacagtcggtattattggtgtcaatggttcccg

SEQ ID NO: 82904 - DNA, 774 bp, Glycine max
  Peptide Sequence Number=SeqID_174589
atggccaagtttgatccagatatagtcctcgaattttatgccaatgcttggccaacagaggagggcgtgcgtgatatgaggtcctgggtgaggggtcagtggatcccgttcgatgcagatgctatcggccagctccagggatatcctttagtgttggaagacggccaggagtgcgagtatggccagaggaggaaccggtccgatgggttcgatgaggaggccatcgcccagttgctatgtataccggggcaagattttgcccggactgctgtcgggagatgggtgcggatcatgcgcaccaacatgacaaccctgactcagatatggatgactttgctgctcagcaacatcctgcccagcgatcataattccgacctccccctgccgaagtgtcagctggtgtacgccatcctgacgcggatgagcattcatgtggctcagttaatcgctgatgccatctatatatttgcaggtatggcgcctaccaggcaccctctggacccagataagtccaacagggccctgggatttcccgctttgatcacaggactctgccagtcgtttggcgtccccgtcacacctagcaaggtgattcggccacccatcacccgagcttttattgagaagtactgcacgcagaggcaggtccagggtaatgcaccacaggctgcggacgtgccgccacctcatcaggctggtccagccggattgtttgatacggagcagtatttgcggcatttggttcgccagcaggtggccaaccaccgggcacat

SEQ ID NO: 82905 - DNA, 246 bp, Glycine max
  Peptide Sequence Number=SeqID_174590
atgttgcctgatgttgagacatgttcaaagattgaagctacaacatcgtttgattccaatgatcctgtccacgatgaatgtcaattcatttctataacagcagaccatgatccacttattggacttcccttgacaccaacaaaacgacaaccatttaatgaatgtgatgatgaagcaagaagctcccagatttcaccagctcagctatcgtccaacaaattagcaaaacatgagaagatagaatag

SEQ ID NO: 82906 - DNA, 270 bp, Glycine max
  Peptide Sequence Number=SeqID_174591
gtggacgtcacctacgagaactggaaggaggtcccgactgctcaaaaggacctgatttgggaggatattcaggcggaatttgatatcccagaggcttctgacagtaggacgaaaaggaagttactacagaccgtgggggagagatggaggcagtttaaattagacctcacgaggaaatgggcccttgcagccgatcatgacggtgtcgaggacactgtctgtgagaaatacgtgtcgcaacctacccttcggcgggagggcgacgcgtga

SEQ ID NO: 82907 - DNA, 514 bp, Glycine max
  Peptide Sequence Number=SeqID_174592
atgagccagacccaagacactgcggccccggccgcctccaaccgccgcggcaacctgctgcgcggcctgttcgtgatcgtcgtgctgctgcttgccgcactggcgctgtggtacttcatgttcggccgttggttcgaagagaccgacgacgcctacgtgcagggcaaccaggtacagatcaccccgctggtggccggtaccgtggtcgccatcaacgccgatgacggcatgcgcgtggagcgcggccagctgctggtgcagctggacccgtccgacacgtcggtggcgctgcagcaggccgaagccaacctggccaagaccgtgcgccagacccgtggcctgtaccgcagcgtggaaggtgcgcaggcggacctgaacgcgcgccaggtgaccctgaagcgcgtgcgcgaagatgtcgctcgccgcaaggatctggccgccaccggcgccatttccaatgaagaactggcccatgcccgtgacgagctggccgctgccgaagccgccgtggccg

SEQ ID NO: 82908 - DNA, 423 bp, Glycine max
  Peptide Sequence Number=SeqID_174593
atgcagtcggaagagaagaaggtacctctaacccccaaggccctagtaatatgttttactaggaaagggaccggctccacacctatatacccccggacggcacctaagccaacaccatttgcatatcaaagtaataaggccgttccgtggaagtatacccctcccgtgtccagtgaaagagttgcaaccgaaattgactccctatcagctaaggtaaccaacatcaccggcctcagtggcgtaactcgcagtggtcgggtgttcacttcccctcacccggtggaattgccctccaaagggaaagcgcccatggtccaagagcccacagacatagccaccccctcgaaagaagtagatcctccagtggtaagaggggtcgaaaagaaagaaggacttcaaggaaaaacagtgactttggaatag

SEQ ID NO: 82909 - DNA, 231 bp, Glycine max
  Peptide Sequence Number=SeqID_174594
atgacgaagttcatggtgaagccaagaaatattttgttgatgttgaaggagcacaatgacaacaattatacaacaatcaaacaaatttacaatgcgagacatgcttatcgttcttccataagagggatgaaaaatgtattctcgaatgctacgaacttgctgtgtcggttccacattgacaagaatgtcaaggaaaagtgcaaaactctagttgctcaaacgaatgcatag

SEQ ID NO: 82910 - DNA, 524 bp, Glycine max
  Peptide Sequence Number=SeqID_174595
ggtactccaaggagttcgcaaggcatgggatgcggcgtgaagaaaggacagagagcttaggggaagcagtaatgggatcatcagcggctatcactgtgagagacgatgaggttaaagcttcggaagaaagtgatgaggtacaagccctaaaggcagagcttgaaagagcccgggtagtcgaagagaagttcaaggcagcaatagtgagctcaagctccgaagaggtgaaaggaatcatcacgggtcaaaggcatgatcttgaaggacgagctaaagggaatatgtgggccatcatcgataagtgcaaagagaagctaaatctagcggcgactcacgagcaaaggctagaggatgagtacgccaagatatcagcagaaagggaagcaatggaaagggagtcaagaacttccctgattgctagccaaggccaaagcaatggcggacacctactcctcccccaagaagatccacagacttctcagctattgtcaacatatgatagacttaatggaccatatgattag

SEQ ID NO: 82911 - DNA, 996 bp, Glycine max
  Peptide Sequence Number=SeqID_174596
atggttaatggctcgacttcttatggacgtgggggcaattcagtgaataataggaagaatgaccctaaagactactcaaagaaaggggtgcaaaatgctcgaggaggaaaaaacccacaaggggccaaaggaggggaattgcgcatcggggtgaagtcgagctttaagaagcataaccaaccagtgattaagcacaaagaacaaattggaaatgaattgattccaaaggttaatagtactggaggaatggaaaataaaaatgtgacaaaaccttatgatgagagtttacatcttttgaaattccatgaattaaggaataatcatatgaatgtgcctatgataccggtgcatatggatgaagatgccatcaaatttgtcaatggatataagcagaaaatggtgaaaggaggtgctgcaaatacactagtcaatggtaacgatgagaacaatggccttttgaagggcatgtacgatacttctaaggaatatgagacttccttaatgttcttgttagagactcattcctataaagattcaacaaataggattattcctaagctaggattcaataaccacttcatacaggatggtcaaggttggttggaggaaacaagcgcattggttcgatcagaggaggttggtcagtcattggaggttttaatactatccaccagcctcatgatcgtagtggaggtactgccaaaccgtcttggagaggtcccaaccaccatccttccaacaatctgcaacactgagattggtatcttagatgtgaacataaggaactttgttgcacaggaagaaggagctgcaaccagaattgcaaccaaactcaaggaagagacccaagaggaagcggcaagcaatggcggctcgtggtggccactgatggtcataggtggtggaggagaagtttctagggtggagcccacttttggtgctaagcataacttttcgagcttagcggaattcctcttgggttgggatttgcattga

SEQ ID NO: 82912 - DNA, 561 bp, Glycine max
  Peptide Sequence Number=SeqID_174597
atgaatttggcctcaatcctgtgtgggccatgggtcccaatctccctacgcggtcatgagatccacaacataatcattgtctgccttgaaatttgcagcatctccagtgccagaggtgtcacccccccatcaggagaaggttggacttttggccaggccgactcgttgaaggaagtcctctggcgtcatgagtggtggttggagagaaagctggattgggagctgatgaaggctctggatgatgaggcactggccgtggaagaaggagattggctggtggtagcaggagggaatactggtggcgaaattggtggtggagggactagtggtgcgtctggaacggctcggggtctgaccttccttggcccagggaaggccaagttgatcatggggctcagcgactcaaaggtcagggtgtcaaaagtgaccccctgtgcgttgcaaaaagccatgatcaatgcgggaaaattgagccaagaggtgttggactgggtgatctgtgtgatctgtcttgatatcatgctgcccaggtctatgtccatctatgtcaccaacccgtaa

SEQ ID NO: 82913 - DNA, 501 bp, Glycine max
  Peptide Sequence Number=SeqID_174598
atgttggatagtctgttggttgctaacgaggtgttggatgatgctagaaggagaaagaaacatagcttgatattcaaggtagactttggaaaggcgtacaattgtgttaactgtgagttcttgttttacatgaggaggatgattgtgagagtcatcgagaagtcgacattcaggggaattacatttaatggtatcagagcaaatctctctcctagtgcggtgtggttcaaggacaatccaagcaaaagctgcatgaaagccgccaaaaagtcaacattcaggggcatcacacttggggagggaggtttgggtttgggcgaaatcgaaggatacaaggttgttgaggttggttgcagaaagaggtttggagtggaggagggttgggatgacatagaggggttcaacatagggaggagggaggttaagggtttgatgaagggtcaccatgaaggggttctcgaggaaggggaaagggggaagagagaaaagggggtggaatag

SEQ ID NO: 82914 - DNA, 123 bp, Glycine max
  Peptide Sequence Number=SeqID_174599
atggaaacgtcttcaatgttgacaacagaaggagtcaatggtggtggcacgaaaaaggaaccaagaaaaacaaagaagaagaaggcgcaaggtgaagaagaggaaccaagaagacaaatctga

SEQ ID NO: 82915 - DNA, 315 bp, Glycine max
  Peptide Sequence Number=SeqID_174600
atggagttccccaaaaaaacatttgaaggacaactcagggatgttgacaaagtcgagaaatattgcttgaaaaagagagagctggaaaacacatcagcctcagaagacgagtccggtggtgctagcagtgacaacttctgcatagcgaaatatggctcaccggataagaacactcaccggaaaagttgttggaaaacagaaacagttcgccagaaaaagggcaacgagttgaatggtacaccaaaaattggaaaaagaatgatagaagaaaggcaggagcaaaagggctcaccgaggaccgttggtccccaatga

SEQ ID NO: 82916 - DNA, 335 bp, Glycine max
  Peptide Sequence Number=SeqID_174601
atgctggttgttccaacagaattagcagagccgaaaagctttctaccaaaggccaacacaacaactagggttggtgctaacggcggtgctgaaggtcacgacgctttgtccatgcaagggccttctttgtttggtttttgggacaggctaacggcggttctaaaggctaacggcggggctgaaggaaaaagctgtgacctttgtctaattccgactaggttccacggaaaaaaggctaacagcagtgctgaaggtgacggcgctttgccatgcaagggctttctttgttcgatttttttcgccttggttttaatattgctttggacggtaaagag

SEQ ID NO: 82917 - DNA, 333 bp, Glycine max
  Peptide Sequence Number=SeqID_174602
atggaggaaggctctccatcttcaaatcttggcacagaggaagcgacatggcgtgggatgacaacgaccatggcacccattgcaacaacgacaacggtcaacaactgcatgaaaatgatgatgatcatgctaccgactacaacaagaacgaaaattagcacctatgtgtgtaacgacgatgaccatgccacccatgcgcgtaacattgtatgtcgagatctgtgtcatgtcagtcatccctgtcaattgtcgaatatgttgatttgtgttattgttgttgaatatgggtcctgcaatgttgagtctgtgtcgagttcttgtttgggatgttaa

SEQ ID NO: 82918 - DNA, 54 bp, Glycine max
  Peptide Sequence Number=SeqID_174603
atggtcttggtcaacttcggggtactggtgtttggtggaggtgcaaaagaataa

SEQ ID NO: 82919 - DNA, 300 bp, Glycine max
  Peptide Sequence Number=SeqID_174604
atgaggattagatccgtacattgtaggaaaattggccttatatatgagtatttttggtacaaaagctgttacatctttatgatgcaagtggcctacatggaaccttgtaaaagatcacaaaggatatctaatgatgtaaaagttggcctatcaacctatgaaggtcagcttgaaaggattcaaaagaaggaaattacaagtgctttggaggaaaaattgatgcaaaaacttgaagaaaaatccttgaagaaaaagttgagcatgaagaaggcccacaaaggagcccaaaggcgcacttag

SEQ ID NO: 82920 - DNA, 258 bp, Glycine max
  Peptide Sequence Number=SeqID_174605
atgttggaattcacaggcgaaggcagctcttcatcatccatgttcatgagcaacaacgctccttttgagaaagtcttcaccacaaatggcaatctcttaccctcgataagattcaattggtcaaaacatgcctgggctcctgactctactgagattcttaaagaaggaatctccacctcaaatgggagcacaacttccatctcatacaccaaagagaatggggttgccctagtagatgtgcgtacaaaagtccgataa

SEQ ID NO: 82921 - DNA, 471 bp, Glycine max
  Peptide Sequence Number=SeqID_174606
atggaggccatgaaagaccaaatgacccccatgatggaggccatgatgagtatgagaaaaatgatggaagtcaacacggctgcaaccgctgccacaagtgtcgccactgaggtggacccgactcagccatttggtatcaatcaagcaagtcatccagtcttggatatgttaggtcagggtggcgaagcattaggaagtacgggtggcccccattttgtgcaggtccagagcaagcatcccttcccaccatatggcttgcctcccaactatgcatcacccaatgttgtacatgcgcctgatgagaatgtcgaccactctgctcccatacccattgagagccaacaaccccagtttggccatgcacatgtctctcaacccatgggagagacacctaaagtaccccgagaccacactcttgttgacttcgagcctctccttggatatgccaccaaggggcaagcatttggtggc

SEQ ID NO: 82922 - DNA, 213 bp, Glycine max
  Peptide Sequence Number=SeqID_174607
atggactcaggaaggttccaagttagtgtaccaggtaatagctactccagtaaggttttcttggaagaaatgtatcaacagttcctcatcttttgcgtatgcccccatcttccgacaatacatctttggatggttcttggggcaaatagtccccttgtacttgtcaaagtccgacaccttgaacttgggaggggtgatgatattgggtactag

SEQ ID NO: 82923 - DNA, 884 bp, Glycine max
  Peptide Sequence Number=SeqID_174608
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccaggcgaattggagctccaccgcggtggcggccgctctagaactagtggatcccccgggctgcaggaattcgatactcctaagagagttctagataagagtgtggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 82924 - DNA, 556 bp, Glycine max
  Peptide Sequence Number=SeqID_174609
ggcgcgtcccattcgccattcaggctgcgcaactgttgggaagggcaatcggtgcgggcctatttgctattacgccagctggcgaaagggggatgtgctgcaaggcgattaagttggtgcttatagctgctgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 82925 - DNA, 354 bp, Glycine max
  Peptide Sequence Number=SeqID_174610
atgtggctaccaccaaagccttggaacgagaaaccaagagggcttgtagggaagaacatggccgaaacaagttccgaggggctctgtggggtagcaacagcgagcttaaactccgatgagaggaaagggaccaatcacgcttgctcgaggtccaaaagaagtttgtctcagcggttatgcgagacagagacaaacatgctagccatcgtcagcaagtaccaacaagagctaaatctagccacggtccacgagaataaagtggcggacgaatatgcccaagtatacgcagaaaaggaggctagaggaagggtgatcgactcattacatcaagaggcaacaatgtggatggactga

SEQ ID NO: 82926 - DNA, 387 bp, Glycine max
  Peptide Sequence Number=SeqID_174611
atggctccaaagaagtttctgctaaaagggctaggaaggccaccacaggggagggatctagtgcagcctcgcaagcgaaaattgaggcatccattgatcttagaagaaggacaacattgtgaatacgttgaaagaataagccaagcctcaggttttgatgaagaggccataagccagctactgtgctccccgggacatgattgtgcacagagcatagcagggaggcgggtacggatcatgcgcactagcatgaccactttcactcagatctgtatgacgcttctgctcagcaacatccttcccagtgaccataattctaatctcccgcttcctaaatgccagttggtctacgctatcctgacccagatcagtgttcatgtagcatag

SEQ ID NO: 82927 - DNA, 1167 bp, Glycine max
  Peptide Sequence Number=SeqID_174612
atgagcaatgttacgcaccagccgaaaatcggcttcgtctccctgggctgcccgaaaaacctggtggattcagaacgcatcctgaccgaactgcgcaccgagggctatgacgtggtgccaagctacgacaacgccgatatggtgatcgttaacacctgcgggtttatcgacagcgcggttcaggagtcactggaagccatcggtgaagccctgaccgaaaacggcaaagtgatcgtgacgggctgtctgggcgcgaaagaagaccagatccgcgaagtgcacccaaaggtgctggagatcaccggcccgcacagctacgagcaggtgctgcaacatgttcatcactacgtgccaaaacccaagcacaacccgttcctgagcctcgtgccggagcagggcgtgaagctgacgccgcgccactacgcgtacctgaaaatttccgaaggctgcaaccatcgctgcaccttctgcatcatcccgtcaatgcgtggcgatctggtgagccgtccgattggcgaagtgctggcggaagcgaaacgtctggccgacgcgggcgtgaaggagctgctggtcatctcccaggatacctcggcttacggtgtggacgtcaaacaccgctccggtttccacaacggcgagccggtgaaaaccagcatggtgggcctgtgcgagcagctgtctaaactcggtatctggacgcgcttgcactacgtctacccgtacccgcacgtggacgaagtgatcccgctgatggccgaaggcaagatcctgccctatctggacatcccgttccagcacgccagcccgcgcatcctcaaggccatgaagcgcccggcgttcgaggacaagacgctggcgcgcatcaagcagtggcgcgagacctgtcccgacctgaccatccgctcgaccttcatcgtcggcttccccggcgagaccgaggaagacttccagtacctgctggactggatgcaggaagcccagctcgaccgagtcggctgcttccagtattcgccggtggaaggcgcgcccgccaacctgctcgacaacccggtgccggacgaggtcaagcaggaacgctgggaacgcttcatggaaatgcagcagtcgatttccaccgcgcgactggcgcgcaaagtcggccgcgagatcgaggtgctgatcgacgag

SEQ ID NO: 82928 - DNA, 696 bp, Glycine max
  Peptide Sequence Number=SeqID_174613
atggcactacgatatgtaattgttcagcaaccggataacgccgcgcagctgtttttgctgtatcacggcgtgaacgacaaccccgattcgatggcgcagattggcagctggttcgggcaggcgtttccgcaggcgcaggtggtgtcggtgggcgcaccttatccggccagcgcgccgcagggccgccagtggtatgccgagataccggaacacgaccgctcgcagcagcagggcgtggacgcggtgatgccgtcctttgtcgagtcggtgcgtcactggcagcagcagagcggcgtgcggccggaagccaccgcgctggtcggtttttcgcagggcggcaccatggtgctggaaggcgtaaaagcccagccggatctggcgggacgcgtggtggcctttagcggccgctatgtcacgctaccggagcaggccagtacgcgcaacactatccacctgattcacggcgattatgacgagcaggtgccgatgcagcatgcggaagcggcgatgcagcgcttaactgcgctgggcggtgatgtgacgctggatatcgttgacgatctgccgcacgcgattgatgaacgcagcatgcagctggcgctgaatcacctgcgctataccgtgccgcgccgctatttcgatgaggcgctgagcggggcgaagccgggcgacgacgatgtggtgatgatggtgtga

SEQ ID NO: 82929 - DNA, 357 bp, Glycine max
  Peptide Sequence Number=SeqID_174614
atgtttaagcagggaatgacaaccaaaggacatctcagagttgattgcccaagtttcaagaaaagaatagaaagatctgaaaagaaaaccttcaatgataagaaagcaaagaaggcttacatcacttgggaagacaacgatatggattcatccgaagacttagaaaatgaagttgtgaatctaagtctgatgggcaaaaaatatgaaagcgatgaagaggtaacatcttctaacaataactcatctatttcctttgatgaacttcaagatgcattcactcatttacataaagaatcagtcaaacttgcaaaactagtttcattttctaagaaaactatttcaaacttagaaaaataa

SEQ ID NO: 82930 - DNA, 327 bp, Glycine max
  Peptide Sequence Number=SeqID_174615
atgccatgcactgttcggttgcgtcagggttataccactttgggaaaggaggctggtaaatctttccgagagatatcacaaccatctggttggcgacgaggtaagaggtcttcatacgtcatggggatcatggtgaagtcttggattcgccttggaggaaagttccttatcgcgttggaactgacgccaaagtgggcattgccagccgggcgagtcggggttagagctgtagcttggggggtctccctctggatgggtgcaggcgccctagcttgtacgggtgccgaattggacgggtccccggcgcgagctgagaagcttgggtga

SEQ ID NO: 82931 - DNA, 300 bp, Glycine max
  Peptide Sequence Number=SeqID_174616
atgggggaactacttcacgctcaggagaagacagtggattcaccactggagatggtgggtcagctggttctggatcaacctgcaaaggtgtgggctcaggtggagcagcctcgttgggtctcaccaatggaagttaagcttcaggccaggctacttgctcaagaaaatgctccatacaaaaggactaaagtttgtgagccttggacctcctgtcctacaattactgacgaaggagctggagtggatgatgaagggatgtcctccgttctagctctttttctcaattccatctgtaactaa

SEQ ID NO: 82932 - DNA, 762 bp, Glycine max
  Peptide Sequence Number=SeqID_174617
atgggaaatcaacagcgacaagggtatactcaaggaggattttcaggctttcagcagggtccctataatcaacaaggacagtggaggacacaccctggcaatcagttcaacaaagaccagagtggaccttcaaacaggacaatccaacaaagacctaacatattacagagaactactaagctggaggagaccatgactcagtttatgcaggtaacaatgtcaaatcataaaagcactgagtcagcactaaagaaccttgaggtccaagtgggacaactggccaagcagaatcccaaggaggaatgcaaaactgtgatgacaaggagtaaaaggtttgtggaggttgaggatgaggatagtgttgtgcataagaagaaaactgctgacaaaaaaagtactggtggcaagaaaaataaggaaaacatcatagtgaaaggaaattgtagtgttgtgatccagaagatccttccacccaagcataaagatcctgggagtgtaactattccttgttcaattggagaagtcaatagtaaaaaattttgggtaatggatatctttgaagacacagacatccctgtaattttgggaaggccattcatgttgaccgcaagctgcatagttgatatggggaagaggaagctagagctaggttttgaaaatcagaaaattgattttgatttttttgttgaagacaagcctgctccaaaacacaatgtttgcttacaggtaatggaaggaggtcaagaggttctgaaagtatga

SEQ ID NO: 82933 - DNA, 417 bp, Glycine max
  Peptide Sequence Number=SeqID_174618
atggcttctagaaaacgtaaaagtattggtttaagacccacaacacagtatgacacaaggagattctcttccttagatgcttggactagatacacagataatgttctagggagaaacatttctcctgagaggaaggtagagctctatcgcactgagctagatgactttaaggctgaattggagaggtgtaatttacataaacgcctcaccaatttagtcgatgggagtatagacctggctttggtgaaagagttctatgcaaatttatacagttctgaggaccgtccaccaaaatactacaggttgcctataaacttcagagagatagaggctgccttatgcatacctggccgagggttcatcttgaactctgagggccatcctgggaagattctcatgaaggatttgaaacactag

SEQ ID NO: 82934 - DNA, 356 bp, Glycine max
  Peptide Sequence Number=SeqID_174619
cgcaatgttcatgtgtcctccaccttcgagtttggagctatgtttcacgatggcctaagtgcggaccttcaaggcaatcctccattctcccccatttttcggagacccatgaatgttattgtctagccgttcatgtgtactccaccttcgagtttggagctatgtttcctgattgcctaagtgtggacgctcaaggcactcctccattcttcccctttttcggagccccaagaaagttattgtctagcgctgttcatgtgtcctccaccttcgacattggagcaatgtttcacgattgcctaagtgcggaccttcaaggcaatcctccattctccccctttttcggagatccatga

SEQ ID NO: 82935 - DNA, 898 bp, Glycine max
  Peptide Sequence Number=SeqID_174620
atgcagacccgacacctgacgatcgccgtggcgatcgcgctctccgccgccgccagcgcccatgccgccaccgccgccgataccggcgccagcaccgatgccgcgctgagcgcgcagacgctggataccgtctccgtgatcggccagggcgagacccgccaagtgcagcgcatcaccaccgtcgacaagcaggtgctgccgccgggcaccagcggccagaagatcctcgaccgcctgccgggcgtgtcggtgcagtccaacgacgccttcggtgccaacgaagaatcgcagaccatcagcctgcgcggcttcgacaagagccgcctcggctatacgctggacggcattccgctgggtgacaacagctacggcaactacaacggcctgagcattgcccgcgcgatcatcgccgagaacctggccggcgcagagttgtcgcagggcatcggctcgctgggcgtggcttcgaccgagcaacctcgggcggcaccctccagtacttctcgatggacccgtccaccgaattcggtggacgcgccagcgtcaccgtgggtgacaacaaccagcgtcgcggctacctgcgcgtggatacaggcgacatcaatggtttctcggcctacgtgtccggcgtgcaccaggaccaggacatgtgggccgcgccgtaccagaaccagaccacccgccagttcaacgccaaggccgtgtggaacgtcggcgaccaccgcttcggtgcgttcgtggccacctcgcgcgccagccaggccaactatgcctacctgtccaaggacatgctggcacgcggactggggtatgactggaacatctacgcgccggactgggatcgcgccgtcgccgccgcgtactgcgcgccgggcacctacaacaaggcgcgctgcaa

SEQ ID NO: 82936 - DNA, 673 bp, Glycine max
  Peptide Sequence Number=SeqID_174621
ttacaatcccggtcttgctataagacaacttggttaccctatgagaggggcaccactagaggaagaaatcgcgcctgtccgcaaggcatgggaggtggtgcgaaagaaggacaaagaacttaggggcagtaagaatgggcccatccgtggctatagtaagtggttgagagcccacgtgcaaggtttggattggctcccgagtttgagaaccgcaaaaagggaggaagttgaggcaccggaggaagacgaagaggtgcaggcccttagagcagaactcgagcaagcccaaatagtcaaagaaaggttcaaatcagtagctctgaagatccgaaaggagaatgccgaactaagagatataaatatagctaccaccaaggccttggaacaagagatcaagagggctcgtagggaagagcacggccggaacaagtttcgaggggctctgtggggcagcaacagcgagcttaagctccggagagaggaaagggaccaatcccgagtagacagtttgatcttaaaagatgagttgaagaccaacatgttagctatcatcagcaagtaccaagaagaactaaatctagccacggcccacgagcatagagtggcggacgagtatgcccaggtgtacgcggaaaaggaggctagaggatggaccaatttgctcttaccttga

SEQ ID NO: 82937 - DNA, 312 bp, Glycine max
  Peptide Sequence Number=SeqID_174622
atgtatactactacaataacccatattcgtctccaatgtagtggacactggcaaatggttgtcattctgcctaaggaaaacgttgttgtctggttttgttccttgcataacagaccagacaactaccttaagggaataattaacattgctttgaaaggacttgatgatactctacagcctaaatccaaggctggtgctaggtggattgttgttaagtattttaatgatgttataccattggaagcagagagattgaatgtgcttcgcatccagtgggctaaattttatctcaaagttagaaatgaaagttaa

SEQ ID NO: 82938 - DNA, 525 bp, Glycine max
  Peptide Sequence Number=SeqID_174623
atgcataaggcattgcgattaaatgctcctttgccctatcctcacttagttaccttgttccttcaacattttaacatcccttttgattctaaaccttatgttccaatcaagagatctttcttgatcggtgctgttatggttgcctcctttggttaccgcaaagaacgtgatgactcttgggtaaaaaagggtgctcaaccaaatgatgatgaaggacacttactggctgaagaggactcttctctccttcagagtattttggacaggtttgatggacttcaaacctatgttggtgagaggtttgtcaccatcaaaaaaggggagattgtagaagcaagcttcatgatgatgaaacaagaaattttgaagatgccaaaagcccaagtgattgattcaagacttcaagatcaagcatcaagaatccaatccaagattcaagattcaagagaagaaatcaagaagcaacaagtcaagacttcatataggataagtattaaaaggaattttcaaaaaccaaatagcaca

SEQ ID NO: 82939 - DNA, 207 bp, Glycine max
  Peptide Sequence Number=SeqID_174624
atgccctcctgggttcgagttgggaaactagcaaattatcgaacaaccggaattttcctagcaaacataatatctgaaaaggagtcctgtgaaggtactaatattgaggacccagacgtcgattttgagaggctagtgaaaaacgttgaggatgaagaagatgaggattgggggcttcccccagaactccaaagaatggttgaatag

SEQ ID NO: 82940 - DNA, 219 bp, Glycine max
  Peptide Sequence Number=SeqID_174625
atggctacttaccaacagaggatagcgaggtactacaaggccagagtaaggcttcattcccgagtggacgagaagaaggagcaagccctattaagtgaagggaagagaatcaaggctattttactttactttactagactagctaccgagctgactcaactcaaggaagccggaaagaaagggcttcaagacagcttcggcaacagaaactcgagctga

SEQ ID NO: 82941 - DNA, 399 bp, Glycine max
  Peptide Sequence Number=SeqID_174626
atgggtgaagtagaggaggtgcaagagcagatgaaggccgacacagaggccttgaaagagcaaatggccacaatgatggaggccatgatgagcataaaggagataatggaggtcaatgcggttgcaatagccgctacctgcaccattactgagacacatgaaattccccaccacaatctagccaacttcgagccttgcctcggatatgccactgaagggcaagcagttggtgatatacccctgcaaaatattctggaggggcctcaatttcgcccccaaccacaacccttctatggaaaaatggtgggttacacaccttcaagctttgcggatttgatcttcgccggtgaaaagatcaaagtgggtctggaaagaggtaaatctgatcatccaccttag

SEQ ID NO: 82942 - DNA, 118 bp, Glycine max
  Peptide Sequence Number=SeqID_174627
gtcgactctagaggatcccccatttcatgtcgatccatacgagggacgtcaatatcttactcgcgctcgtactcgaggaggtaatagtttctctaggagggctaaggataattccaag

SEQ ID NO: 82943 - DNA, 390 bp, Glycine max
  Peptide Sequence Number=SeqID_174628
atgcataaggcattacgggccaatgcacctttcccttaccctcaattggtcactctctttctctgtcattttcaaattcctcttgatgatgaaccttttgttcaagtcaagcgttcctttgctataggtgctggtgcagtcacttcttttggttaccataaggattgtaatggtcaatggctgaaaaaagatgcacttcctccacaagatgagtgcactccttctccttctcctcagcgagatgattcagcccttatgactgaagttctttcagagttacggggtcttcgcacttatgttggaatggatattcgtctcacacagcttgaagaagatgtgggatatattcgtcagagcttcgatcttccaccaccaccaccaccttcttag

SEQ ID NO: 82944 - DNA, 279 bp, Glycine max
  Peptide Sequence Number=SeqID_174629
atgaagacgaaagccaacaaaacaagaaatgaattgaaagcctgggattcaaaaacttaccgatttactcagggaaacatcttggaagcgttatggaagcacctcgacttggattttcttcacagaaatacattttttcacccaaaacagctgaaatgcatagccaagggggttagggacccttttgaacagccccccttcgcctatttaaaggaaaagtggggaggaggttggcgcccaactcgcccaggcgagctgggttgcttcctccttaagtaa

SEQ ID NO: 82945 - DNA, 87 bp, Glycine max
  Peptide Sequence Number=SeqID_174630
atggaaggtggtggcatggtcttccttgactcggattcaatggttgttagaggttatttcatttgtttcttctatttctatggatga

SEQ ID NO: 82946 - DNA, 1149 bp, Glycine max
  Peptide Sequence Number=SeqID_174631
atggacacatttaaaggacaaatacaacaagctatcaagttggagttgtcacaaattgcatcacaacattcagccccacttcagccacatgatatacaactattagcagcaagggtaagcacgaagggaagctgtgcagcagcagagacaaatgcattagctaaaaaaccctctcagttgaatggtgacagcgtcgggctacatgtaactgccgagaactccaacaaattagtggcagtaggcaaacagtgcgacaattttggcaccatccataacgtgccctatgttgatgatgctgttcgggtgagtgtggtggaagttattttcggtgatgcgaaggttccaatccctacatcagaaataaagtttgtgaaagaagctttaaggagttttgttccatggccaagacatttggtcaaacccatgttgcctgaggaagcaaagaaggatgtcagctcaccattaaagactgttgaggaggaaaagccagctgaggttattgatccattgggagagttggtgaagaacttgttcgacatttaccataggcctgttcaggtgtcatgggacggtgctaaatttgggatcaataatgtccaagatggcttcttcatcacacacgctgatgtgagcgagataattttaggagacaagtttattcatgattggagtgcgagcattggttatggagcattgtatgggttccttgaacctcagtgtatccacaatgcaaacactagacgtcaagagtgtgaaaattacattggaaggtggttgaaggaagcaggaaaacaaatttacatagaaccttatttaaatcaggcccattggcagctccttgtattgtccccaggtcacaatctagtggtttggttttgttctttgcgaaagaagtcggatgctgccatcaagggtgcagtaaacaatgcaatgaaatcagtcaccaaaattacagagggaaagccacctcagcatgggcctcagtggattgaagcaaaggtaacttctgctcagggtggtggtgacaaggactacaaggaggtgagctcaaatcatggtccttctacagagctggaattgctaaggggacacatcaaccaagctgtgaccttcaacagatcttcttacaaggatcatgttcatcactga

SEQ ID NO: 82947 - DNA, 2364 bp, Glycine max
  Peptide Sequence Number=SeqID_174632
atgttgaggattcaaaattttgagggtgatgtgctcttcctagacaacaaagagcaaagagttggagcagaaacaatggtggggactccaattaatggaagaaccaggcaagctttcacagttgtcaatggcggtggccacgatctttgccccagtagtactcctccaagcaatgctggatcggactatggtgtcatagagttcaccagagaggatgtggaggcattgctaaatgaaaaagccaagagaaaggacagatttaattataaggaacgatgtgaaaatatgatggattatataaaaaggcttaaggtttgtatcagatggttccaagaccttgagatgtactactctctagagcaggagaagttaaagaattcactggaaatgacccagaaaaaatgcatagaaattgagttgctgcttaaaatcaaggaagaagaattaaattcaattatcacagaaatgagaaggaattgcacttccttacaagaaaaattgatcaaggaagaaatggaaaagtcggctgcagtggagtctcttgttaaagagagagaagctaggcttgacattgagaggtcacatagtactctgtcagaggaccttggaagagcacaacgagagatgcaaagtgcaaatcagaagatagcatcactcaatgaaatgtataagcggttacaggattacattacaagcttacaacagtacaatggaaaacttcactctgagctttcgtcggttgaggatgaacttaaacgcgtagaaaaggagaaggtttcggtagtggagaacatcaccttgttaaggggtcaacttactgtatccgtttcttctcaagaggaggccataaaacagaaggatgtcttggctacagaagtttcctctcttagaggagagttgcaacaagtaagagatgagcgagaccggcaattatctcaagtacaaattttaagttctgaattagagaaagttaaagaatctacaaaacattcctccactgaattggacagcttgacgtttaaagctaatgatctggaggatgagcttccttccctccaggaaaaatgttctctgaaagataatcaaataaaggcattggaagagcagctagcaactgcagagaagaaactgcaggtgtctgatatatctgcatatgagacaaggacagaatatgagggacaacagatatttgtgaatgagttacaaagacgcttagcagatgcagaatataaacttatagaaggggagaggctgcggaaaaaattacataataccattttggaattaaaagggaacattcgtgtattttgtcgtgtgaggcctttattagctgatgaaagttgtagcacagaaggcaggattttcagttatccaacatcaatggaaacttctggacgagccattgacctagcccaaaatggccaaaaacatgcttttacatttgataaagtttttacaccagaggcatcacaagaagaagtttttgtggaaatttcacagcttgtgcaaagtgctcttgatggttacaaggtttgcatctttgcctatggtcagacagggtcagggaagacctatacaatgatgggaaggcctggacatccagaggagaagggcttgatacctcgttcattagaacaaatatttcaaactaagcagtctcagcaacctcagggctggaaatatgaaatgcaggtgtcaatgttggaaatatacaacgaaacgatccgtgatctgatatctacaacaacacgtgtggaaaatggtactcctggaaaacaatatacaatcaaacatgacgtaaatggaaatacacaagtttctgatctcacagtagtggatgttcatagtgctaaagaggttgcatttcttttaaatcaagctgcaaatagcagatctgtgggaaaaacccagatgaatgaacaatcatcaagaagtcattttgtattcactcttcgaatatacggtgtaaatgagagcactgaccaacaagtacaaggtgttctgaaccttattgatcttgctggtagcgagcggctttcaaagagtggatcaactggggaccggttgaaagaaactcaagcaatcaacaaaagtttatcatcactgagtgatgttatatttgccttagccaagaaggaggaccatgtgccattcagaaactcaaagcttacatatctgcttcagccttgtctaggtggagactccaagacactaatgtttgtgaacatatcacctgatccttcttcagttggtgagtcactatgctcactcaggtttgcatcaagagtcaatgcttgtgagattggaacacctcggcgtcaaaccaatggacgttcaatagagtctcgcttgagctatttctaa

SEQ ID NO: 82948 - DNA, 339 bp, Glycine max
  Peptide Sequence Number=SeqID_174633
atgactattgtgactcgttatgtgatgatgggtaatgaattattttatgagggatccactcttgttcataacactcctttgttgcctggccaagtaaaggtaagtgtggacgaggttaaagatgcagatgctgcagttcctgtacccactgctgaggtttccttagtggggcagacacttcacaccttccttgcttggccgacacatctgatcaagtctttatcaaaccaggtagctatgtctccgccaaaaccaccaccgaagcccgattcggaggtcgatgatccgctttatctgataacattgaccatcccaaagcttttcttgaggccttatcag

SEQ ID NO: 82949 - DNA, 159 bp, Glycine max
  Peptide Sequence Number=SeqID_174634
atgtgcgctagaagttggttgtggagtgctgaaaatacgggttctacgagctataaagttgttgctgaatgtgctaatgtaatgaatgaaatggtttcagatgatgaagcgggggcggggcggggcggggaaacccaacctccaacggggacggggtgg

SEQ ID NO: 82950 - DNA, 282 bp, Glycine max
  Peptide Sequence Number=SeqID_174635
atggagatgaaaaacctcatcaggcgcttaggagtacatgacaagacaaaccacacattgagagaccagttagggtcatgctgttttgcaagaatgctccaaccatgtgagatcgacacgagtttaaaggagcattcaaaccgggtgtacttacccccaaggcctagattccaaacagttcgtcagggtcttcctcctgatttaggtccaacccagaatgtgatgccctttatccctcacatatatgtattaataataaaagaagtaagaaatcaaaattaa

SEQ ID NO: 82951 - DNA, 897 bp, Glycine max
  Peptide Sequence Number=SeqID_174636
atggtttactatgatgtcataattcgtcttcatggccctgacgcattaacaaacttcacgccgccacaaagagattctccgtctccatcttcactgtcggcggtggcggaggttattgctatattagataaattaaagaatcacaagagccaaaacaaggagctgttggattcatcaccaaatgaggatgacgatgattgggatggtgaagatcctgaagaaggcatcatttatagtgttgaaaaggaagagtcattgaggaaaagggcatgggaagaaagcaagaagatgtgggtggtagcaggccctgccatattcacaaggttttcaacgtttagaatcatggtggttagtcaatccttcattgggcatattgggtcaactgaactagtagcctatgccattgttatgactgtcctagtcaggtttgtaaatggtgcattgttcaagtttgggctcaacggtgcaatgacatcaacacttttagcatattggattccaaacattggccaacttctgtttataatgactaagtgccctgacataaactatggttccttttacaatcttgagatctggtacaacactgttttgattcttgttacaggcaacatgaaaaatgctgaagtgtcaattaatgctcttgccatatgtattgaagaattcataccactgctgagggagcgcatgaatgtgttgaatccatatgttcgtcagtttttggtaggatggattactgtattggatagtgtcccatatattgatatgctggggtttcttcctgattttcttgatgtgctactcttgaagtttttagattatggtcgcatggctgaaatcctggtacagagggcagtttctccagatgaattcactaggctaacagctatcacatgg

SEQ ID NO: 82952 - DNA, 360 bp, Glycine max
  Peptide Sequence Number=SeqID_174637
atgcggaacaagtctgaatgtacacctcacgaatcaagggaaccttctggacatgatcaagagactaatgacaaagctgatactaaggtgcacaaatatgagattatgaatacaatctacgttgtacaaattcttttaccattcacttggaagggcaaatccttgtattcatgctctcatcacagtactaggttttgcacatctttgaaaggtacaccttctaagacgatgcttacatcagcacgtcttagaagatcgttgaaaactgcgacttctaagatggtcattgttgcaccgtcgttgaaggtttcgacattccacgatgttgaaatctacgacggtcatccaccgtcattgtag

SEQ ID NO: 82953 - DNA, 990 bp, Glycine max
  Peptide Sequence Number=SeqID_174638
atggcactatgtttcatggtaatggggtcatccattgaaagaaattgtgttaaggtattccggcatctgattgaaaaagttaactgtcgcatgctatttgccacacactaccattcacagtctaaggagtttgcttcccattcacgcgtcataatgcaacatatggcttgtgctttcaagtcaaaatctgatacccattccatgcacgatcaggaactagcaagtagagatgtggggtgcgatagaagatcaagagattggctgcaaacttgcaagcttcatcttgacctccttcactccgccgtgagggtcatactgtgccgcaagctcggttgccgttgccagtcctccactgtggcgtgttctgcacctggcagtgactgcactgccgctgaatctggactccaatgggctggacttgggcctcaacccgcttcttctgcttcttcgcgggcggcgaagacgggagcaagagcaatgtgctgcccaatgaccacacgcgagtgttgggatttcctattccaaaatgaggcattttcttcaccgagggttccgattcaacaaaccggttcacttcctctaaacgaaccgggtataaaagtgatagccccgggagtgaatcatccttttccctcttggatttgtagacaaaccaaaatagaagggactgaggatggtgatttacttgcttgcattcaatgtgaacataaatatcatgttggatgcttgaaagatagagaaaaatctgagtcacgaagatatatgaaaaattggttgtgtggaaaagagtgtgaacggatatatgaaggactccaaagtctattaggaaagccacttatagtgggtgcgaacaatctaacatggacatcggtgaagtttatcaactctgagagttgtgatgttggtagtactaagaatgacttattggctgagaaatacagcaaacacagtgttgcacttttggtgatttcacaatttacagttaattga

SEQ ID NO: 82954 - DNA, 327 bp, Glycine max
  Peptide Sequence Number=SeqID_174639
atggaaaactgggagcagcagtacatgggttttggggaggaagaccctagttttgtggcttttagtgtgtgtgagtgtgctgattacaattacctcatcaagcttcttattggcgacagcgcctcagataccagcactcatgggtggttctctgtccctcgcagagctgctaagactgttttcctcgtttggtgtgacacctcacatgattataagcagcaaagaccttctcaagagcttgttgccaaagatttgcatggtgtggagtggaaatttcgacatatttacagaggtcagccaaggtggcatctgctcactactggctag

SEQ ID NO: 82955 - DNA, 81 bp, Glycine max
  Peptide Sequence Number=SeqID_174640
atggatccttactgggggcaagagatcgactgggagaggagttcccatcaatcttctattcaggtcagccttttgctatag

SEQ ID NO: 82956 - DNA, 3801 bp, Glycine max
  Peptide Sequence Number=SeqID_174641
atggcttctaaggccatcatccaatacagctcttcttcttcttcttctcatgcgatcatcactacatatgatgtgtttgtcagcttccgcggtgaagacacgcgcaacaacttcactgcttttctctttgatgctctctttgaaaatggcatccatgccttcaaagatgatacacatcttcagaaaggcgaatccatagcacccgagctgctactggccattcaggggtctcgccttttcgttgtggtcttctcaaagaactatgcttcctcaacttggtgcttgcgtgaacttgcacacatctgcaactgcactattgaagcatccccgagtcgtgttcttccaattttctatgatgttgatccatcagaggtgcggaaacagagtggttattatgggattgcctttgcagaacacgaagaaagattcagagaagataaagtgaagatggaggaagtgcagagatggagagaagctctgacacaaatggccaacctctctggctgggatatccgaaataagtcacaacctgcaatgattaaagaaattgttcaaaaaataaattatatattgggtcccaaatttcaaaatcttccaagtggtaatctggttgggatggaatcccgtgttgaagaattagaaaagtgtttagcattggagtcggtcactgacgttcgagttgtcggaattagtggaatggggggaataggaaaaacgactcttgcccttgctttatacgaaaagattgcttatcaatatgatgatgtaaacaaaatttatcaacattatggttcattaggtgtacaaaaacaattacttgatcagtgtctaaatgatgaaaatctagagatttgtaatgtttctaggggaacatatttgatagggactaggctacgcaataaacgaggacttatagttcttgataatgttagtcaggttgaacaactacacatgtttacagggagtagagagactctattacgtgagtgcctaggtggagggagcaggatcatcataatttctagggatgaacacatattaaggacacatggagtaaatcatgtttacagagttaggccattgaatcaagacaatgctgttcagttattttgcaataatgctttcaaatgtgactatattatgagtgattataaaatgttgacacatgatgcactatggcatgctcaaggccatcccttggcaattaaagtaataggcaaatccttgtttggtctagatgtttcgcagtgggaaggtacattggttaggctaagtgaaaataaaagtaagaatattatggacgtgatacgaataagttatgatgctctggaagaaaaagacaaggaaatatttttagatattgcttgcttttccggtcagcattattttgaggataatgtgaaggaaatcctaaattttcgtggatttaattctgaaattggcctccaaattcttgttgataaatcactcataaccattagttacgggaagatttatatgcatgacttgttgagagatttaggcaagtgtattgttagagaaaaatcacctaaagagccaagaaagtggagtagactatgggattgtgaagatctctacaaatttatgtcgagcaataaggaagcaaaaaatctggaagccatagttgttgaagatgaaccagggatgttttctgaaacaacaatgagatttgatgctctatcaaaaatgaaaaatcttaagttgcttatacttcccaggtattatgagaaggggctttccacaattgaggaggagaaattttcaggaagccttaattatctttccaatgaattaggatatcttatttggcatttttatccctttaactttctacccaagtgttttcagccacacaatcttgttgagttgaatctttctgggagtaacatccaacatttatgggacagcacacagcctatacccaatttgagacgtttgaatgtctctgactgcgataatctaatcgaggtgcaagattttggtgaggccctaaatctcgagagactagatctcagtggatgtggacaactcagtcggttccatccatccattggttttcctagaaatcttacctatttgaatttaagtgactgcaaaagtcttgtcgagttaccacattttgaacaggccctaaatcttgaaaagttaaatctgggaggatgtgaactactaaaacagctacccccattcattggtcatctaagaaagattacatttttattagatttgcaagagtgtaaaagtctcactgacttgccacattttgtagaggacctaaattttgaagagttaaatctctatggatgtgacctaaatcttgaagagttaaatctccaaggatgtgtacaactaaggcagatacatccatccattggtcatctaaaaaagcttactcatttaaatttgaaatattgcaaaagtctcgtaaacttgccacattttgtagaggacctaaatcttgaagagttaaatctccaaggatgtgtacaactaaggcagatacatccatccattggtcatccaaaaaagcttactcatttaaatttgaaatattgcaaaagtctcgtaaacttgccacattttgtaggagacctaaatcttaaagagttaaatctcgaaggatgtgtacaactaaggcagatacatccatccattggtcatctaagaaagcttactgttttaaatttgaaagattgcaaaagtctaataagctttcctagtaacatattgggactcagttctctcacatacctaagtcttttcggatgttcaaacctacacactatcgatttatcagaggattcagttagatgtttgttgccttcctatactattttctcatgtatgcgtcaacttgatctaagtttctgtaatttacttaaaatccctgatgcttttggaaatttgcattccttagaaaagctatgtttaaggggaaacaattttgaaacactacccagcctcgaggagctttccaaactgttacttttaaacttacaacactgcaagagattgaaatatttgcctgagctcccttcagcaactgattggcctatgaagaaatggggaactgttgaagaagatgaatatggattgggattaaatattttcaactgcccagaattagttgatagagattgctgcaccgacaagtgtttcttttggatgatgcaaatggttcagctcttcactatttcacttaattgccatccttccggggattcaatggcatggcgggttccattgatttcaagtattattccaggaagtgaaataccaagctggttcgacgaacagcatttgggcatgggtaatgtcataaacatagacatatctcactttatgcagcttgacaaatattggataggcattgcgttgagtgtaatcttcgtggtacacaaagaaagaagaatgccccctccagacatggaacaaagaaagaaagaacgtccatctctttatattccggttcttttccgtgaagatctagtcacggatgaatcggatcacttgtggctattctattaccctcgatcacattttgatgtctctaattttgatgagttgaaagtggtatgtagacccagagatcttgattatcaagatttggatgttgaagtgaagaaatatgggtattgttgggtatatgaacatgatctagatttatcaaacttaacaacgatgcgcaataaaaattcgtcgcctcggaagcgcaaatattttacaattgaagaattggagacattgttgaatatggatgcacagtggaagcagcagtag

SEQ ID NO: 82957 - DNA, 837 bp, Glycine max
  Peptide Sequence Number=SeqID_174642
atgatgaatagtaactgtgacattctaataactgtttgggaggactatgctattcagctacatgatgctattgacaaaaaccttctgcttcaagaaccattggttgttatgttgaccctaggtaaaatcaaggatgctataggtggttctggtgttgacaagtatcccctgagcgtgcaaaatatcaaatttggatctaaattgtatgtcaacgctgacattacagagatacaccaatttcgtcaaagtttgtctgtcccattttattctggtgggataatccatgataaagatggttctcagtcccaatctagccagagtaatgtggtagaaaattttttgcagaatgctcaggattgttactgcttaactgttggaacagttgacgaaatcatcattgatgctccatggagttatgacagttgtcctaactgtacaaccacatttgatccatcaaaaggtggcccagcttgtcgttcttgccataccagtgtgatcgatacagttccacagatggagcataatagggacaaaggaaacttccttctctgggatgcaacatgtatcaagctatttggtaagactgctggagaatgtcgagatgagttgatagcggctgtcagatttaagtttcgttcacaattacgccaatcatctgtgttggatgtgagtgaagaactccatcatattcaatcattgatagccacccttgggttgaagccatcgttgtcacagtcttctgattacgatcccggaaactccacctgtttaactccaaccaaaaggattaattgtcagcaaaccagttctaattttgattctgatgagcatacatag

SEQ ID NO: 82958 - DNA, 793 bp, Glycine max
  Peptide Sequence Number=SeqID_174643
cctcaaggagctttccaaactgttacatttaaacttacaacactgcaagagattgagatatttgcctgagctcccttcacgaactgattggcctgggagctggacacctgttaaacatgaagaatatggattgggattaaatattttcaactgcccagaattagttgagagagattgctgcaccaacaattgtttctcatggatgatacaaatacttcagtgcctcagtctttccggctttagtgggctgttcagctttccattattttcaagtattattccaggaagtgaaataccaaggtggttcaagaaagagcatgtgggcacgggcaatgtcataaacatagacagatctcactttacgcagcattacaaaaataggataggcattgcgttgggtgtaatcttcgtggtacacaaagaaagaagaatgccccctccagacatggaacaaccttcaattcttagtattacatgtggcccttctattccaccccaacaaagagagggagtacgtgaagatcttcatattccggttcattaccgtgaacatcttcatattccggttcttttccgtgaagatctagtcacggaggaatcggatcacgtggggctattctttttcaaacgtccatattttgatgagttgaaagtggaaagtagattcagagatcttcatgatgaagatttgtatgttgaagtgaagaaatattggtatcgttggctaggcttgcttcatagtgaagaattggagacatatttgaatatggatgcagagttgaagcagcagtag

SEQ ID NO: 82959 - DNA, 2874 bp, Glycine max
  Peptide Sequence Number=SeqID_174644
atggcttctaaggccatcatccaatacagctcttcttcttcttcatctcatgcgatcatcactacatatgatgtgtttgtcagcttccgcggtgaagacacgcgcaacaacttcactgcttttctctttgatgctctctttgaaaatggcatccatgccttcaaagatgatacacatcttcagaaaggcgaatccatagcacccgagctgctactggccattcaagagtctcgccttttccttgtggtcttctctaagaactatgcttcctcaacttggtgcttgcgtgaacttgcacacatctgcaactgcactattgaaccatcctcgagtcgtgttcttccaattttctatgatgttgatccatcagaggtgcggaaacagagtggttattatgggattgcctttgcagaacacgaacgaagattcagagaagatatagagaagatggaggaagtgcagagatggagagaagctctgatacaagtggccaatatctctggctgggatatccaaaatgagtcacaacctgcaatgattaaagaaattgttcaaaaaataaaatgtagattgggttccaaatttcaaaatcttccaaatggtaatctagttgggatggaatcccgtgttaaagaattagagaagtgtttaaaattggagtcggttagtgatgttcgagttgtcggaattagtggaatggggggaataggaaaaacgactcttgcaagtgctttatatgaaaagattgcttatcaatttgattttcattgttttgttgatgatgtaaactatatttatcgacgttctggttcactaggtgtacaaaaacagttactttctcagtgcctaaatgataaaaatctagagatttgcaatgcttctgtgggaacatatttgatagggacaaggctacgcaataaacgaggacttatagtttttgataatgttaatcaggttgaacaactacgcatgtttacagggagtagagagactctattacttgaatgcctaggtggagggagcagaatcattataatttctagggatgaacacatattaaggacacatggagtacatcatgtttacgaagtccagccattggaagatgacaatgctgttcagttattttgcaaaaatgcttttaaatgtgactatattatgagtgattataaaatgttgacatatgatgtactatcacatgctgatggccatcccttggcaattgaagtaataggcaaatctttgcatggtcgaaatgtttcgcagtggagaggtatattggttaggctaagtgataataaaagtaaggatataatggatgtgttgcgaataagttatgatgatctggaagaaaatgacagggaaatatttttagatattgcttgtttcttcgatcaggattattttgagcattgtgaggaggaaatcttggattttcgtggatttaatcctgaaattggcctccaaattcttgttgataaatcactcataaccatttttgatgggaggatttatatgcatagcttgctcagagatttaggcaagtgtattgttcgagaaaaatcacctaaagagccaagaaagtggagtagactctgggagtgtgaagatctctacaaagttatgtcgaacaatatggaagcaaaaaatctggaagccatagttgttgatgataaatcatggatgttttttaatacaataatgagagttgatgctctatcaaaaatgaaaaaccttaagttgcttaagcttcccgagtatgatagtttgtatggggatgaggaagaggagctttgcacatatacgaagaaggattttttttcaggaaacctgaattatctttccaatgaattaggatatcttatttggcaatgctatccctttaactctctacctcaatgttttcaaccacacaatctttttgagttggatctttcttggagtagcatccaacatttatgggacagcacacagccgatacccaatttgagacgtttgaatgtctcttactgcaaatatctaatcgaggtgcccaattttggtgaggccctaaatctttattggctaaatctcgaaagatgtgaacgactcaagcggttccatccatccgttggttttcctagaaatcttacctatctgaatttaagaggctgcaacagtcttgtcgagttaccacattttgaacaggccctaaagcttgaaattttagatctgagacgatgtgaactactaaaacagctaccctcatccattggtcgtctaagaaagcttactccttcattagaattgggagggtgtaaaagtctcactgacttgccacattttgtagaggacctaaatcttttgaagaagttaaatctcgaaagatgtgaacaactaaggcagatagatccatccattggtcgtctaagaaagcttactgctttaaatttgacagattgcaaaagtctagtaaacttgccacattttgtagaggacctaaatcttcaagagttaaatctgaaaggatgtgtacaactaaggcagatacattcatccattggtcatctaagaaagcttactgctttaaatttgatagattgcaaaagtctagtaaacttgccacattttgtagaggacctaaatcttgaagagttaaatctcaaaggatgtgaagaactaaggcagatacatccatccattggtcatctaagaaaacttactgttttaaatttgagagattgcaaacgtctcgtaaacttgccacattttgtagaggaactaaatcttgaagagttaaatctggaaggatgtgtacaactaaggcagatacatccatccattggtcatctaaggaagcttactattttaaatttgaaagattgcaaaagtcta

SEQ ID NO: 82960 - DNA, 204 bp, Glycine max
  Peptide Sequence Number=SeqID_174645
atgcagcatgaagggaaactgatgcaaattctttataacctcgctaacaaaattatttttattggttatcataagatccttgtgccgagaagtgggtttggtgatacaaaactgagagcaccccatcctatttatagagtctgtccatcacagagctctctcaacttgttatcagaacgtgagatagggagttatcagacgtga

SEQ ID NO: 82961 - DNA, 231 bp, Glycine max
  Peptide Sequence Number=SeqID_174646
atgactatgttagactgggagaaagggaagttggaaaataagaagcacttatccctgcttccttcaacttctggaattgctttggcttctagcaccatcatccatgcaataagaacatatgacgtgtttgtgagcttgctcggtttagacgcacgcaaaaatttcgctactctccttcttcaagctctccatagaaatgacatcgatgccttcaaagataatgtacattga

SEQ ID NO: 82962 - DNA, 540 bp, Glycine max
  Peptide Sequence Number=SeqID_174647
atgcagatagaagaagaagaagaagaagaagaagaagaattgatagagcaggaaaaggggttaatagacacagaaagagagtttcctctattagagatacttagacttaagatgcattcattagagagtcttgagtctccagggtggtttagggactgcaagtcaaaactgctcaacccaaacaaattgcttagcttaggaagctacattggaagacaattgtcacgagaaagcgcgcatagtgcgcatcctgcacttagcatgtggtcacttgatctagtaggacatgcatgcttagtgcaagtatcgtgttcaacgcacaagaaagttcagattggaggtcagttgctgaagcatataaaaagaaaggaaacaattgtttctttaacatcgaagaaaccaacaagaagcaggggagcagaggagcaaggaagcaaagaagccattgctgaaggaaatcagttcctggagcgctggttgatctgtctgaatccatttctctttcatttcttccctttcatctcacatttatatttgtaa

SEQ ID NO: 82963 - DNA, 3204 bp, Glycine max
  Peptide Sequence Number=SeqID_174648
atggcttctaacaccatcatccaatgcggctcttcttcttcatctcatgcgatcatcactgcatatgatgtgtttgtcagcttccgcggtgaagacacgcgcaacaacttcactgcttttctctttgattctctctctcaaaatggcatccatgccttcaaagatgatacgcattttccgaaaggcgagtccatagcacccgagctgctacaggccattgaagagtctcgccttttccttgtggtcttctctaagaactatgcttcctcaacttggtgcttgcgtgaacttgcacacatctgcaactgcactattgaagcatccccgagtcgtgttcttccaattttctatgatgttgatccatcagaggtgcggaaacagagtggttattttgggatagactttgcagaacacgaagaaagattcagagaagataaagaggagatggaggaagtgcagagatggagagaagctctcacacaagtggcccatctctctggctgggatatccgaaataagtcacaacctgcaatgattaaagaaattgttcaaaaactaaaatatatattgggtcccaaatttcaaaatcttccaaatggtaatttagttgggatggaatcccgtattgaagaatttgaaaagtgtttagcactggagttggttagtgacgttcgagttgttggaattagtggaatgggaggaataggaaaaacgactattgcccttgctttatacaaaaagattgctcatcagtatgatgttcattgttttgttgatgttgagaacagttatgggcccgggagacaatctaattcactaggtgtacagaaagaattacttcatcagtgtctaaattgtgaaaatctacagatttctgatgtttttaggggatactatatggtatcatctagactacacaataaacgaggacttatagttcttgataatgttagtcgagatgaacaactatgtatgtttacagagaatatagagactatattatatgaatgtcttggtgaagggagtagaatcatcataatttctaggaatgaacacatattaagggcacatggagtaaattatgtttatcaagcccaaccgttgaatcacgacaatgctgttcagttattttgcaaaaatgctttcaaatgtgactatattatgagtgattataaaatgttgacatatcgtgtactttcatatgttcaaggccatcccttggcaattaaagtaataggcaaatctttgtttggtctaaatgattcacagtggagaggcaagtgcattgttagagaaaaatcacccaaagagccaagaaagtggagtagactttgggattgtgaagatctctacaaagttatgtcagacaatatggaagcaaaaaatttggaagccatagttgttgaagatgaatcatggatgttttttgaaacaacaatgagagttgatgctctatcaaaaattaaaaaccttaaattgcttatgcttcccacgtataagaagaagagattttcaggaaacctcaattatctttcgaataaattaggatatcttatttgggaatactatccctttaactttctacctcaatgtgttcagccacacaaattttttgagttgaatctttctcggagtaacatgcaacatttatggcacaacacacagccgataccgaatttgagacgattgaatgtctcttactgcgaaaatctaatcgaggccctaagtcttaaagtgataaacctcaaaggatgtggaaaactaaggcggctacatctatccgttggctttcctagaaatcttacctatttgaaattaagtggctgcaacagtcttgttgagttaccacattttgaacaggccctaaatcttgaacggttaaatctcgaaggatgtggaaaactaagacagctacactcatccatgggtcttctaagaaagattactgttttaaatttgagagattgcagaagtctcgtaaatttgccacattttgtagaggacctaaatcttaaagagttaaatctcgaaggatgtatagaactaaggcagatacatccatccattggtcatctaagaaagcttactgttttaaatttgaaagattgccaaagtctagtaagcttacctagtaccatattgggactcagttctctcagatacctaagtcttttcggatgttcaaacctacaaaatatccatttatcagaagattcagttagatgtttgttgccttcctttcctgttttctcatatatgcgtgaacttgatctaagtttctgcaatttacttaaaatccctgatgcttttggaaatttgcattgcttagaaaagctatgtttaaggggaaacaattttgaaacactacccagcctcaaggagctttgcaacctgttacatttaaacttgcaacactgcagaagattgaaatatttgcctgagctcccttcacgaactgatttgtgtatgccagaatggagaactgttgaatatgaagaatatggattgggattaaatattttcaactgcccagaattagttgagagagatcgctgcaccgaaatgtgtttcccatggatgatgcaaatagttcaactcttaactctttcctttcttgatcattcttccagctatttaatgccgtggtgggttccattcatttcaagtattattccaggaagtgaaatgccaaggtggttcgacgaacagcatttgggcatgggcaatgtcataaacatagacagatctcactttatgcagcttgacgataattggataggaattgtgtgtggtgtaatcttcgtggtacacaaagaaagaagaatgccccctccagacatggaacaacgttcaattcttagtattacatgtggcccttctattccacctgaacaaagaaagaaagaacgtccatctctttatattccggttcttttccgtgaagatctagtcacggatgaatcggatcacttgtggctattctattacactagatcacgttttgatgtctctaattttgatcagttaaaagtggaaagtagattcagtgatcttcatgatcaagatttggatgttgaggtgaagaaatatggctatcgttgggtatataaacatgaactagaattatcaaacttaacagcaatgcacagtaaaaatttgtcgtctcggaagcgcaaatttttggcaattgaagaaaccaagtag

SEQ ID NO: 82964 - DNA, 558 bp, Glycine max
  Peptide Sequence Number=SeqID_174649
atgtgtgtcttctttgaaggcatcaatccaatttctacggagagcttgaaagagaaaagcagtgaagttgttgcacgtgtcttcactgcggaagctgacaaacacgctatatgtcgttcaggtcgcatgagatacagaagaactgcaccggatgatgaatatataaaccattgcaaaagctgtgaaggtgcaaaggaaggtcaatggtttcctcccactttccatttgttggggtccactgaaactctatcacttattaaatatgtaacttggctgttagctcatcggagttgtcgtgagatacgcatcaaggttcattatcatcaattaaagttgtcaaagaaagttcatagattattagaaggatcaagtcaaaagttaagaatgtggacaatacctcggcaggagcggaagatgatgcttgttgcattgaggaactaccacggtgtacaaaaagtacatatcaatgctcgcctcaaaggtataaatcctggacacccattttcaatatctgctcttgttcctcgaaaaacaaaactcatggctctctatatttga

SEQ ID NO: 82965 - DNA, 1932 bp, Glycine max
  Peptide Sequence Number=SeqID_174650
cctatacccaaactgagacgtttgaatctctctttctgcgtcaatctaattgaggtgccagattttagtgaggccctaaatctcgagagtctagatctcagtggatgtacacgactcagtcggttccatccatccattggttttcctagaaatcttaccaatttgagattatgggactgcaaaagtcttgtcgagttaccacattttgaacaggccctaaatcttgaatacttagatctgacaggatgtgaacaactaaaacagctaccctcatccattggtcgtctaagaaagcttaaattttcattagatttggaagagtgtaaaagtctcactgacttgccacattttgcagaggacctaaatttttcctggttaaatctcagaggatgtatagaactaaggcagatacatccatccattggtcacctaagaaagctttctggtttagttttgcaaaattgcaaaagtctcgtaaagttgccagattttgcagaggacctaaatcttagacagttaaatctcgaaggatgtgaacaactaaggcagatacatccatccattggtcatctaacaaagcttgaggttttaaatttgaaagattgcaaaagtctcgtaaagttgccagattttgcagaggacctaaatcttagagagttaaatctcgaaggatgtgaacaactaaggcagatacatccatccattggtcatctaacaaagcttgttaaattaaatttgaaagattgcaaaagtctcgaaagcttacccaacaacatattgagactcagttctctccaatacctaagtcttttcggctgttcaaaactatataatatccgttcatcagaagaacaaaggggtgcagggcatttgaagaagcttcgtataggtgaagctcccagtcgttcccaatcaatattctcattcttcaaaaaggggcttccatggccttctgtggccttcgacaaaagcctggaggatgcacacaaagattcagttagatgtttgttgccttccttgcctattttcccatgtatgcgtgaacttgatttaagtttctgcaatttacttaaaatccctgatgcttttgttaatttccaatgcttagaagagctatatttaatgggaaacaattttgaaacactacccagcctcaaggagctttccaaactgttacatttaaacttacaacactgcaagagattgaaatatttgcctgagctcccttcacgaactgatctgttttggtggaattggacaactgttgatgattatgaatatggattgggattaaatattttcaactgcccagaattagctgagagagatcgctgccccaacaattgtttctcatggatgatgcaaatagctcatcccgatttacttcctttggttccaccgatttcaagtattattccaggaagtgaaataccaagctggttcgagaaacagcatttgggcatgggcaatgtcataaacataggcagatctcactttatgcagcattacaaaaattggataggccttgcgttgagtgtaatcttcgtggtacacaaagaaagaagaattccccctccagacatggaacaaccttcaattcttagtattacatgtggcccttctattccaccccaacaaagaaagaaagaacgtccatctccttatattccggttcttttccgtgaagatctagtcactgatgaatcggatcacttgtggctattctatttcactctagatctttttgatgatcgtaattttgatgagttggaagtgaaatgtagatccagagatcttcttcatgatcaagatttggttgttgaagtgaagaaatatggaaaactagtagcaattgcaattcggcaaggcttgcttcatagtgaagaattgaagacagatttgaatatggatgcagagttgaagcagcagtag

SEQ ID NO: 82966 - DNA, 630 bp, Glycine max
  Peptide Sequence Number=SeqID_174651
atgacgggatctttacttgacgtgatccgcacgccaatgacacgtgcccgattagtcctcgctgttgttatcaacttcttatgctccgttgtgtactatggattaagcctcaacgtggtgaacctcgagaccaacctctacctcacggtgatcctcaacgctgtcgcggagatgccggcgtttatgataacggcgatgttactcgaccggtgggggaggaagccgttaaccataggaaccttatggttcagcggtgcattttgctttgcggggagcttggtgaacaacgttggggtgtggaaaggtgtgagagtggtgtgtgggattttggggatttttgggatggcggggacttataatttgttgtttatttacacggcggagctgttcccgacggtggtgaggaacgccgcgctcggctgcgccacgcaggcggcgcagatgggtgccatactggcgccgctggttgtcgttttgggtgggtcgttgccgtttttggtgttcgctttgtgcggaatagttgggggcgttttcgcgttttatctgccagagaccctgaaccaacctctctatgatacgttaactggaatggaggccaaggaaaatactgctatctcaaccaaagtatga

SEQ ID NO: 82967 - DNA, 3432 bp, Glycine max
  Peptide Sequence Number=SeqID_174652
atggcttctaacaccatcatccaatacagctcttcttcatctcattcgatcatcactacatatgacgtgtttgtcagcttccgtggtgaagacacgcgcaacaacttcactgcttttctctttgatgctctctctcaaaattgcatcaatgccttcaaagatgatgcagatctcaagaaaggcgaatccatagcacctgagctgctacaggccattgaagggtctcgccttttcgttgtggtcttctctaagaactatgcttcctcaacttggtgcttgcgtgaacttgcacacatctgcaactgcactattgaagcatccccgggtcgtgttcttccaattttctatgatgttgatccatcagaggtgcggaaacagagtgcttattatgggatagcctttgaagaacacgaaggaagattcagagaagataaagagaagatggaggaagtactgagatggagagaagctctgacacaagtggccaatctctctggctgggatatccgaaataagtcacaacctgcaatgattaaagaaattgttcaaaacataaaatatatattgggtcccaaatttcaaaatcctccaaatggtaatctagttggtatggaatccagtgttgaagaattagaaaagtgtttagcattggagtcggttagtgacgttcgggttgtcggaattagtggaatgggaggaataggaaagacaactcttgcccgtgctttatacgaaaagattgctgatcaatatgattttcattgttttgttgatgatgtaaacaatatttatcgacattctagttcactaggtgtacaaaaacagttactttctcagtgcctaaatgatgaaaatctagagatttgcaatgtttctaagggaacatatttggtatcgactatgctacgcaataaaagaggacttatagttcttgataatgttggtcaggttgaacaattacatatgtttacacagagtagagagactctattacgtgaatgcctaggtggagggagtagaatcatcataacttctagggatgaacacatattaaggacacatggagtaaatcatgtttaccaagtccaaccattgagttgggacaatgctgttaagttattttgcataaatgctttcaaatgtacctacattatgagtgattatgaaatgttgacacatggtgtactatcacatgctcaaggccatcccttggcaattgaagtaataggcaaatctttgtttggtcgaaatgtttcacagtggacaagtacattggataggctaagagataataaaagtaggaatattatggatgtgttgcgaataagttatgatgatctagaagaaaaagatagggaaatatttcttgatattgcttgtttcttcaatgatgatcatgagcaacatgtgaaggaaatcctaaattttcgtggatttgatcctgaaattggcctaccaattcttgttgaaaaatcactcataaccattagtgatggcttgattcatatgcatgacttgctgagagatttaggtaagtgtattgttcgagaaaaatcacctaaagagccaagaaagtggagtagattgtgggattttgaagatatctacaaagttatgtcagacaatatggaagcaaaaaatcttgaagccatagttgttaaatatatttcatggagggttctaggaacaacaatgagagttgatgctctatctaaaatgagaaaccttaagttgcttatgtttcccattgcttggacattttcaggaaacctcaattatctttccaatgaattaggatatctttattggaaacgatatccctttaacttgctgcctccatgttttcagccacacaaacttgttgagttgaatttttgtgggagtaaaatcaaacaattatgggaaggcagaaagcctctacccaatttgagacttttggatgtctctaactgcaaaaatctaatcgaggttccaaattttggtgaggccccaaatcttgcgagtctaaatctctgtggatgtatacgactcaggcagctacactcatccattggtcttctgagaaagcttactattttaaatttgaaagagtgcagaagtctcactgacttgccacattttgtacagggcctaaatcttgaagagttaaatctggaaggatgtgtacaactaaggcagatacatccatccattggtcacctaagaaagcttactgttttaaatttgaaagattgcataagtctcgtaagcatacccaacaccatattgggactcaattctcttgaatgcctaagtctttccggctgttcaaaactatataatatccatttatcagaagaactaagggatgcaaggtatttgaagaagcttcgtatgggtgaagctcccagttgctcccaatcaatattctcattcctcaaaaagtggcttccatggccttctatggccttcgacaaaagcctggaggatgcacataaagattcagttagatgtttgttgccttccttgcctattttatcatgtatgcgtgaacttgatctaagtttctgcaatttacttaaaatccctgatgcttttggaaatttgcattgcttagaaaagctatgtttaaggggaaacaattttgaaacactacccagcctcaaggagctttccaaactgttacatttaaacttacaacactgcaagagattgaaatatttgcctgagctcccttcacgaactgatgtcccatcaccatcaagtaacaagctgcggtggacaagtgttgaaaatgaggaaatagtattgggattaaatattttcaactgcccagaattagttgagagggattgctgcaccagcatgtgtttgtcatggatgatgcaaatggttcaggcattcagtaaacctaagagcccgtggtggattccattcatttcaagtattattccaggaagtaaaataccaaggtggttcgacgaacagcatttgggcatgggcaatgtcataaagatagaacacgcatctgatcactttatgcagcatcacaataattggataggcattgcgtgtagtgtaatattcgtgccacacaaagaaagaacaatgcgccatcctgaaagtttcactgatgaatcggatgaacgtccatgtttttatattccgcttcttttccgtaaagatctagtcacggatgaatcggatcacatgttgctattctattacacccgagaaagtttcacttttcttacttcgttcgaacatcatgatgagttgaaagtggtatgtgcatccagtgatcctgatcaatattttgatgttgaggtgaagaaatatgggtatcgtagagtatatagacatgatctagaattatcaaacttaacaacgatgcaccgcaaaaatttgctgcctcggaaacgcaaatttttggcaattgaagaaaacaagtag

SEQ ID NO: 82968 - DNA, 450 bp, Glycine max
  Peptide Sequence Number=SeqID_174653
atgaccccggagtatgctgttgatgggcaattttcaatcaaatctgatgttttcaactttggtatattgttgttggagattgtatgtggaataaaaacaaatctctgtcacaaataccaaactcttaaccttgttggttatgcatggacactttggaaagagcataatgctttacagctgattgactcaagcataaaggactcatctgttatcccagaagtactgcgatgcatccatgttagtctcttatgcgtgcaacaatacccggaggataggccaaccatgacttcagtaattcaaatgttgggggggtgtgagatggatgtggttgtgccaaaagagcctggtttctttccacggcagattttgaaagaaagaaatcaaggcacaaatctaaagcaaatgacttcaaatgatgaattaaccgttacctcattaagtggtcggtga

SEQ ID NO: 82969 - DNA, 1641 bp, Glycine max
  Peptide Sequence Number=SeqID_174654
atgaagtttattcttactgtgacgagtttcatactttatatactgtttgtctcttcccttgtagtttccatagcagcagacacatcatccatttcacaatcccaatccctcagttttggaagaaccatagtttctccaaatggagtctttgaacttggattcttcaatcttggaaatccaaacaaaagttacctcgggatttggttcaagaatattccgtctcaaaacattgtttgggttgcaaacggtggcaacccaataaatgattcctttgccctcttgagcctaaacagttctggccatttggtccttacacacaacaacactgttgtttggtccacaagttctctaagagaaacacagaatccagtggcaaagctcttggattctgggaatcttgtgataagggatgaaaatgaagtgattcaagaggcatatctgtggcaaagttttgattatccttctaatacagggttatcaggaatgaagattggatggtacctcaaaagaaatctcagtattcaccttacagcttggaagagtgatgatgatccaaccccaggagacttcacttggggtattattctgcacccttatcctgaaatctatttgatgaagggaaccaaaaagtactacagagtcggaccatggaatggcagtccaggacttatcaattccatttactatcacgagtttgtctctgacgaggaagaactttctttcacgtggaacctgaagaatgcaagctttttatcaaaagtggtagttaaccaaaccacacaagaacgtcctcgttatgtatggtcagagactgagtcatggatgctttattcaacaaggcctgaagactattgtgaccattatggggtttgtggagccaatgcatattgcagcagtactgcatcaccaatctgtgagtgtttaaaagggtacacgcctaagtctcctgaaaaatggaaatcaatggacaggacccaaggatgtgtcctcaaacatccattgagttgcaagtatgatggttttgcccaggttgatggcttgaaagtgcctgatactaaaagaacacatgtggatcagactcttgatatagagaaatgcagaaccaagtgcttgaatgattgttcctgcatggcatataccaattataatataagtggagcaggaagtggatgtgtcatgtggtttggtgatttattagacatcaaattgtattctgttgcagaaagtgggcggcgtctacatataaggttgcctccttctgaattagaatctatcaagagcaagaagaactccaaaataattattggaacctcagttgctgcagctttaggagtagtacttgctatttgtttcattcacagaagaaacattgccgagcatccattgaaatattggttatgtggccgtatagcatggaagagggtagtgtcaggggcatttgaagctatggaggacaaggttaggaagaggcacaatatagtggtagatgcatatgtattgtatttgggaggagtgaatatcattctagaggttgagttgttagagaccttatgcaagactacaaaaattggagaaagaagaggacaagttttcaggataacggtcacagtacttttacacttaaggggtattaagttctag

SEQ ID NO: 82970 - DNA, 1464 bp, Glycine max
  Peptide Sequence Number=SeqID_174655
atgaccaaactccttgtgggggcagaatcaataagcagagcagattttccagaagggtttgtctttggaactgcttcttcagctcaccagtttgagggagctactgatgaaggaaacaaaggagatagcatatgggatactttctcaagaataccagggagaattgtggacttcagcaatgcagacaaggcagtggatcaataccaccgatttcaggatttgggaatggattcttacagattttccatatcatggccgagaatttttccaaatggaacaggggaacccaataaagagggaataaaatattacaacagcctcattgattctttacttgtaaaaggaatccagccttttgtaacactatatcattgggatcttccacagatgctagaagataaatatgaaggatggttaagctcacaaatcataaaagattatgagcattatgccaatacatgcttcaaagcttttggagacagagttaagcactggattaccttcaatgagcctcataactttgcactccatggttatgatttaggcattcaagcaccaggaagatgttcccttttgggtcatcttctatgtaagaaaggaaaatcatccactgagccatacattgttgctcataacattctcttgtcacatgctgctgcctatagaagctaccaactacatttcaaggaacaacaaggaggtcaaataggaatagcactagatgtcatttggtatgaacctataacagaacttgatgaagacaaagacgcagcagcaagagctatggacttttcacttggatggttccttgacccacttttctttggaaaatatcctctctcaatggagaaacttgtagctaagagattgccggagatttctgatacagcctcaaaatttcttgtgggatctttggattttattggcataaatcactacacctcagtctatactcgtaacgacaggactcggattcgtaaactagttatgcaagatgctgctactgatgctgctgtcattacaaccgcataccgaagaggatctgcaattggagaaaaggcagcttcaagttggctgcacattgttccatggggcatccgaaagttggtaaaacatgtgaaagacaaatatggggacacgccagtaattataacggagaatggaatggatgacccaagtggaccctttaggaccttagaaaaggccttgaatgatgacaagaggataagataccatagagactatctctcaaacctatctgctgctataagggaagatggttgcaatgtacgtggttactttgtatggtcattgcttgacaattgggagtggaacatgggatacaccgtacggtttggactctactatgtggatttcaggaacaatcttactaggataccaaaagattcggtgcaatggttcaaaaacatgctcagaatagagacagaacatagtgaaatttga

SEQ ID NO: 82971 - DNA, 615 bp, Glycine max
  Peptide Sequence Number=SeqID_174656
atggcagcaagagcaaaaactccccttaacactctctcctctttcacattcacactctttctctcattctctctcctccaactttctctctcctcccccaccaccatccacgaccttctccgctccaaaggcttaccaccggggctcctcccggaggaggtgaaatcctacaccttctctgaaactgggcacttggaagtgttcctggacgcaccatgcctcacaaaatacgagaacagagtcctcttcgaacaagtcgtcactgctaacctcacctacggaagcctcataggagtggagggtctccagcaagaagaactcttcgtgtggctacctgtcaaggacattatcgtaaatgacccctcttccgggttgatactctttgacattggcctcgcccacaaacagctctcgctgtccctctttgaagatccacctcactgcaaaaatcaagggggaaaaaagtacaatattctacgcaatatgtcagttcctgaggctccttattctgcatctcacagtaacatttttaggccagatcagtgcaggtgggttgaggaatcatgtgaggaaggaaaaaggtttcttcgaggccctgaggtgcttgtagcgtag

SEQ ID NO: 82972 - DNA, 516 bp, Glycine max
  Peptide Sequence Number=SeqID_174657
atgaacacatttatcctatgtgatctggtgcaagcatgtaagaagtatagcaggataggagattgtttttggttgactgataaggacttagattttaatcacgggttaaggagctatacaacatatagggatatattatacttagtgaaggctgctttggaaaatgagaatgagataaatgtttattttcatcatgaagtagatccaattccagaagaagtcccactgatgttggacttgaaatggatgtcatgcagacatgccattgtagcaataagtcacaaaggaggcaaacctggggacttgtgtcatgactggctgtccatagaggcttataataagacatatcaccattttattcagttagtccaaggaccaaaatattgggcccatgcacagtatggacaacctgttctaccacataaaaaggttcaaagaggaaggcctaagaaaaatagaaggagagatgcaaatgaagacaatgtcataggacataggagttttggtggagattaa

SEQ ID NO: 82973 - DNA, 1812 bp, Glycine max
  Peptide Sequence Number=SeqID_174658
atggctccggagtatgctgttgatgggcaattttcaatcaaatctgatgttttcagctttggcattttgttgttggagattgtatgtggaaaccaaaataaagctcttagtcacgaaaaccaagctcttaatattgttggttatgcatggacactttggaaagagcaaaatgctttacaacttattgactcgagcataaaggactcatgtgttatctcagaagtactgctatgcatccatgttagtctcttgtgtgtgcaacaatacccggaggataggccaaccatgacttcagtaattcaaatgttagggagtgagatggatatggttgagccaaaagaacctgcagacacatcatccatttcacaatcccaatccctcagttttggaagaaccatagtttctccaaatggagtctttgaacttggattcttcaatcttggaaatccaaacaaaagctacctcgggatttggttcaagaatattccgtctcaaaacattgtttgggttgcaaacggtggcaacccaattaatgattcctttgccatcttgagcctaaacagttctggccatttggtccttacacacaacaacactgttgtttggtccacaagttctctaagagaaacacagaatccagtggcaaagctcttggattctgggaatcttgtgataagggatgaaaatgaagtgattcaagaggcatatctgtggcaaagttttgattatccttctaatacagggttatcaggaatgaagattggatggtacctcaaaagaaatctcagtattcaccttacagcttggaagagtgatgatgatccaaccccgggagacttcacttggggtattgttctgcacccttatcctgaaatctatttgatgaagggaaccaaaaagtactacagagtcggaccatggaatggtttgagtttcggtaatggcagtccagaacttaacaattcaatttactatcacgagtttgtctctgacgaggaagaagtttcttacacgtggaacctgaagaatgcaagctttttatccaaagtggtagttaaccaaaccacagaagaacgtcctcgttatgtatggtcagagacagagtcatggatgctttattcaactaggcctgaagactattgtgaccattatggggtttgtggagccaatgcatattgcagcactactgcatcaccaatctgtgagtgtttaaaagggtacacgcctaagtctcctgaaaaatggaaatcaatggacaggacccaaggatgtgtcctcaaacatccattgagttgcaagtatgatggttttgcccaggttgatgacttgaaagtgcctgatactaaaagaacacatgtggatcagactcttgatatagagcaatgcagaaccaagtgcttgaatgattgttcctgtatggcatataccaattctaatataagtggagctggaagtggctgtgtcatgtggtttggtgatttattagacatcaaattgtattctgttgcagaaagtgggcggcgtctacatataaggttgcctccttctgaattagaatctatcaagagcaagaagagctccaaaataattattggaacctccgttgctgcacctttaggagttgtacttgctatttgtttcatctacagaaggaacattgccgagagaataaggaagagggtagtgtcaggggtatttgaagctattgaggacaagactttatgcaagactacaaaaattggagaaagaagaggacaagttttcaggataatggttgcagtactgttacacttaaggggtattaagttctag

SEQ ID NO: 82974 - DNA, 1920 bp, Glycine max
  Peptide Sequence Number=SeqID_174659
atggcttctacttctaatgccatcatccaatgcacctcttcttcttcgtttgagtatgacgtgtttgtgagcttccgcggtgaagacacacgcaacagcttcaccgcttttctttttggagctctgaaaaaacaaggcatcgaggccttcaaagatgataaagacatcaggaaaggcgaatccatagcaccagagctaatacgagccattgaagggtctcatgtttttggtgttgtcttagcaaaggactatgcttcctcaacttggtgcctgcgtgaactagcacatatctgggattgcattcaaacatcacacagacctcttctgcctattttttatgatgttgatccatcacaagtgcgaaatcagagtggagactatgagaaagcctttgcccaacaccaacaaagttccaggttccaagagaaggaaattaaaacatggagagaagttctggaacaagtagccagtctctctggttgggatatcagaaataagcaacaacatcctgtgattgaagaaattgttcagcagataaaaaatatcttgggttgcaaattttctattcttccatatgattatctagttgggatggaatctcattttgctaaattatcaaagctaatatgtccggggccggttaatgatgatgttcgagttgttggaattactgggatgggtggaataggaaagtccactcttggtcgagctttatatgaaagaatctctcatcaatttaattctcgttgttatattgatgatgtaagtaaactttatcaaggttatggtacattaggtgtacaaaaagagttactttctcagtctctaaatgaaaaaaatctaaagatttgcaatgtatctaatggaacacttctggtatgggagaggctatccaatgcaaaggcacttataattcttgacaatgttgatcaagataaacagcttgatatgtttacagggggtagaaatgatctgttaggtaaatgcctaggtaaagggagcatagtcattataatttctagggatcaacaaatattgaaggcacatggagtagatgttatttaccgagtggagccattgaatgacaatgatgctcttggattgttttgcaaaaaagcattcaaaaataattatatgatgagtgattttaaaaagttgacttctgatgtattatcacattgtcaaggtcatcccttagcaattgaagtgctaggctcatctttgtttggtaaagatgtctctcattgggggagtgcattggtttcgttaagagaaaaaaaaagtaaaagtattatggatgtgttgcgaataagttttgatcaattagaggatacacacaaggaaatatttctagatattgcatgtttcttcaaccattatcctgtgaaatatgtgaaggaagttctagattttcgtggatttaatcccgaatatggcctacaagttctcgttgataaatcactcataaccatggattcgaggtggattcaaatgcatgagttgttgtgcgatttgggcaagtatattgttagagaaaaatcacctaggaagccatggaagtggagcaggttgtgggattttaaagatttccttaaagttatgtcagataataaggcagcagacaatgtggaggccatatttcttatagaaaaatctgacattcttcgaacaatttcaacaatgagggtcgatgttctatcaacaatgagttgccttaagcttctcaaacttgaccatttggactttaacgtcaaaatcaattttttttcaggaacacttgttaagctttccaatgaattaggatatcttcgttgggaaaagtatccttttgagtgtttgccaccaagttttgagcccgacaaacttgttgagttgattctacctaaaagcaacatcaaacaactttgggaaggcacaaag

SEQ ID NO: 82975 - DNA, 1587 bp, Glycine max
  Peptide Sequence Number=SeqID_174660
atgggctttcctctcacaccactcactccccacaaggaaccttcacttcactcgcttcctctcacagtcacttcaggaatgtttgaaacttatgataagtgtatttcagaagtgaagcgggacggagaaaatcgtcccccgtcggagacaggaacaggggacaaatttctgacctcgtcattttcagggacaggggcaaatttctgcccctgttgccatgcttacttgggaaaaaagctaatatatgtcatagtagggctcctcactctccctgcaaactccatcaatatcctcagattctttaatgcctacatatttgacaaaggcatacgtgtagctgtcattgcagcagtgcaactcaatatggtttattccggacgcatccttgactcgaattctgtggaatgtcctgagttgaagttatcctcccatggaagaaaggtgcataacttaggcaggcttgttcctgcaattgaggacatggttgctgggacaagattaagtcctttgatcgcgtgttctattaacactggcgatcggggacttatatcctcctttttcgagaagtggcactggaagacttctagttttcaccttcctgtgggggagatttcgatcacgctagacgacgttgcggctcttctccatctgtcgatcgttggcgcactgcatgacttccagcctctacgcagcgatgaggcggtgctactcttggttgagttacttatggtctcaccagaggtggccatggccgagacaggccaatgtggtggaccatacgccctgcatgacctcactcttgctgagcggtatgcatggggagctgttgggctcgtccatatgtacgatcagcttaatgatgccagtctcagcaccagccgacagcttgctggttacatcaccttgttacagtattggatatacgagcactttctgtcagttgcggagtgcaatggtgatccagactacgacgaggtgtcaccacatgcgtgtaggtggattgcgacaaagaagactgtgaagaaggactttcatccgatttcgtgcttctcgagacagctctgttgggggcctgttgttgttaggtacagaccggagagggttatgcgccagtttggctacgtccagtgcattcctgcacaccctgtccatccatggatgtcatatgatgacatagacgatacgtggacgcactactcagaccatctggcgacagtaggtaatccatgtgttgtgccaggtcagggtgcacctgactacatagactggttcttccgtatttctcatccattcatgaccacgacacaaccatcagatcctccggcagatgcacctgctgcgcaacccagacatgtcccccaagtcctagagttagatatccctcaggtcccggatgatccagccaggtctgatgtcgacgagcccagacatatagtggaggcttacgatgcgatggccgagaggttggagcgtcacctcagcttagggatagtcatgccaggcacatcgacacatgaagtaatcaaagaatgccttaaggttgctaggagtgtcacccaaggccgcattgtgtacgtgaggtcttga

SEQ ID NO: 82976 - DNA, 918 bp, Glycine max
  Peptide Sequence Number=SeqID_174661
atgccttcctccccaatatttccatgtatgcgtgaacttgatctaagtttctgtaatttagttgaaatccctgatgctattggaattatgtgttgcttacaaaggctagatttaagtggtaacaattttgctacactgcccaacctcaagaagctttccaaactggtctgtttaaagttacaacattgcaagcagttgaaatctttgcctgagctcccttcacggatttacaattttgatagactaagacaagcaggattatacatttttaactgcccagaattagttgatagggaacgctgcactgacatggctttttcgtggacgatgcaatcgtgtcaggaatcaggaaataacatagagatgtctctgctgtaccaggtgttatacatatatccgttctgccatgttagtggaggtgttagtccaggaagtgaaataccaaggtggttcaataatgagcatgagggaaattgtgtaagcttagacgcatgtcctgttatgcatgaccataattggattggcgttgcgttttgtgcaatattcgtcgtacctcatgaaacactctcagcaatgtgtttttcagagacagaaaggatctaccctgattttggtgatattctagtggatttttatggagatgtagatctagaacttgttttagacaaatcagatcacatgtgcctattccttgttaaacgaatggatttcatttatcattttcatctcaagcacaaatatcttggcagattggttttggaatgtgatgatgagtggaaagagtcatatgcggaggtgaagaaatacggatatcgctggctatatgaagaggatatagaagggccatcaaatccgttggctaggaagagcaaatttgggggaaatgaagaaaaagtgagcagaagggagaaaagatga

SEQ ID NO: 82977 - DNA, 744 bp, Glycine max
  Peptide Sequence Number=SeqID_174662
ggttgtgatggatcaatcttattggacgacactgccacattcactggcgagaaaaatgcaggaccaaacagaaattcagcgaggggcttcgaagttattgataccattaaaaccaacgttgaagcttcttgcaatgccaccgtgtcgtgtgctgatattctagcacttgccacaagagacggaattgtgctgctaggaggaccctcatggacagttcctctaggaagaagagatgcaagaacagcaagccagagtgcagccaacaaccaaatcccaggaccctcctctgacctctcaaccctaatctctatgtttgcatccaaaggcctaacagcaagtgacctaaccgttctttcaggtgcccacacaataggccaagcacagtgccagttctttagaactcgcatatacaacgaaaccaacatcgacaccaacttcgccgccaccagaaaaacaacttgccccgccaccggagggaacaccaacctggcccctctggaaaccctaaccccgacacgattcgacaacaattactacgccgacctcgtcaaccgccgtggccttctccactccgaccaggtgcttttcaatggtgggtctcaggattcccttgtgcggagctacagtggcaacagtgctgcattttctaaggactttgctgctgccatggtgaagttgggcaatattagtcccctcactgggtccagtggggagatcagaaggaattgcagggttgtgaattaa

SEQ ID NO: 82978 - DNA, 1059 bp, Glycine max
  Peptide Sequence Number=SeqID_174663
atggctgcagaacatgttctgaggttgctagattccttctggtttgaggcttcaattctctctaacaaaaccctttcaaattcaatctctcatgatcacaataaggtggtggaggaagtgcttcctcttgatgatgcaaagcttctactagttccaactcctacccttgaagttaggtcctatagtgaccaaaacttggactccacaacatgtcttttgtgtgattattcccaatcaccaaattctgtgctcaccccacaaaggcttaggacaatcccttctgagagggaaatcagagaattctctagtggaaatcatggaaaagaagggatgagcattaagagaaaacaaaaaagctttggtcatggaagaagggcaaggaaagtgagaaccagcaggagcctatcagagcttgagtttaaggagctaaaagggtttatggatttggggtttgtgttctctgaggaggacaaggactcaaaattggcctctttgatacctggcttgcagagactgggaagagaagaagatgaagaagggcagggtgatgatcaaagtgtggtttctgataataataataagccttatttgtctgaggcttgggatgttttggaccaaagggagatgggaaatcctttgttgaattggagggtaccagctaggggtaatgaaattgacatgaaagacaatcttaggttctgggctcacactgtggcatccattagaggtgtcgcttcggtcgaggtgaaagtgttatggattggtggtgattgttgcggtggttggttcagttgtgacatcgtcgaagatacgccgattttatacggattagatgatacatataactcatacggatcatgtggtccgtatgcattatatggaccaaccacgatgctccactctgcagcagccattaacgaaggaggagaagcttacctcgatggtagaagtggtggagacgtctcaacggaagcagccaatgcgcgaaaaatgaaccaacaagtagcggagatgtcctccaatgctcacgctcaagaagagaagaagccaataggttga

SEQ ID NO: 82979 - DNA, 231 bp, Glycine max
  Peptide Sequence Number=SeqID_174664
atggattacccgtggaaacaagatatcatcagtgatccaacaaccaaggttattaccaattggcaaatcaaagatggtgagttaatccaatcgaacttacctcccacaacacaatacccactgccaaaggtcaaggatagtcatgataaacctgtcatggccactccattcaagacagaaaatgtcaatgaagaagtaacttccaaagacatcaaaagcctaatggaatag

SEQ ID NO: 82980 - DNA, 375 bp, Glycine max
  Peptide Sequence Number=SeqID_174665
atgacaacgtccagaatgtccgctccgtacagattgactgtttgctctcttttcaacagtttaacatcaactgattgtgctcttctctcgcaggcatcacttctaggggtggaaatagggagaggaagggaaggagtaagaattgaagaaggcgaagaaggagcgggaccaggagggtgtgtcgacggcgaagtcatcagcagccagcttggcgaaggcgttgagggtgaagagggagaggaaggtcaagaggcgggagaagagggtggaggcggcggaggagggagcgggggagggagcgagggaggtggctgcggcggaggaggaagtgcggtggtcgaggactttgaggaagccggtgtcgcggagccatga

SEQ ID NO: 82981 - DNA, 270 bp, Glycine max
  Peptide Sequence Number=SeqID_174666
atggggttccctcctcgtgaaaaaattatcactcctgtagacttatctttaggagataacataaaatccaaagggaaaaggaagtattgtgatgtagctccatgtggagctcgaaggccttggatcttcttcatcaatggagtcctttgcttcttgaagtttgatggcagcagaatggagaaggagaaatatgattggagacgccacttcaagaagaagatgagtctagaagaagttcaccaccataggaagccatggataagagcttga

SEQ ID NO: 82982 - DNA, 294 bp, Glycine max
  Peptide Sequence Number=SeqID_174667
atggttcaaaggtacactttaaatgagattgctgctgagttggaccgcatacagtattgtggcaatgatccctcttcttgtggttgttctatgagatcgacgcacggttttccttgtgcatgtatgggtgaagaatcttggccgatggtccgcaacgaattgatcaaagaacttggcaaatggtcacatgactacatcaacctcttcagtggcacagagagattagaacaattaaggatgtcgctacatgttgatgggttctcccaagttagtgtggaaaagtggatggattaa

SEQ ID NO: 82983 - DNA, 399 bp, Glycine max
  Peptide Sequence Number=SeqID_174668
atggaggaggagattccttctaaacaccttagaagaccgatatgtgctaggtcgtgtcaaggttccttatcaatatatacaactgcagagtttcaaatggagttgtataaactcaaaatggagatgagaggagacctccatgaccacatcaacaagttcaatcggctagtaagtcaattgttgaatacagatgataaactctctgatgagaagcactccttgttgttgttggcctcactaccaaggttcttcaaagctttggttcaaacgttgcttgtgggaagatcaactttgaatttggatgaggtgactgtcgctcttagagaaaatgagataatgataagaactgaaaatgttgataatgaacacaatgcaatagttgtggtggagtcagagtag

SEQ ID NO: 82984 - DNA, 2121 bp, Glycine max
  Peptide Sequence Number=SeqID_174669
atggaagaaaagcagttagattttaatcagcctcttttatcggtaaggcgaatctcatcaacggcggcctctgaaaatgacaataaaagaaaagctgataaatcagtgcggaaacgacctcctcttccgttttacaaatcagagttaaaatcaggtccagtgactaaccctggaactgttccttttgtatgggagaagactcctggaagacctaagaatgaaagcaaactacaaacaagggctgtcgaacggccttccgttgctccaaagcttccacccgggagggttttgaaagttgaacagcaatgttctgataaagttcctaaaggtgcatcagttactcaatccagaacaggaagcagtgtttcagattctccgcgtactgcatctctagataataaagtgacaaaacatgaaagcccccaagaagtaattgaggaaaaggaaagttctggttcagatgatgaggatgagaactatctagatgctcttgatacactttctagaactgaatcattcttcatgagctgtagtgtgagtggtttgagtgaatgggatgatcaagaggtccaactatcaggaaatttttcaacagatcaacaggcacgtgatttcatgattggcaggttcttgcctgcagcaaaggcaatggcttctgaaacacctcaaattcagcacaactctaggaagccacttgttacacaagaacaaccaaaacaggcatggaaggtagttagtggagcgaattcccgtccccttaatccaaaatggcaaaaggttttgccgcattatgctcaagatattggtagggaagagagcgaagatgaaagtgatgataatgatggatatgaaaacaatgcacccaaagtttgtgggctatttcctcggttctgccttttgaatccagttccaggattaagaatggagggtaggattcgaagttctacatttcatggagtgcagagtaaatcaattacttctcacagaagaactgcaaaagagcatggtagaactgctactaatgggaaaaagtcagtaaactcccagtctggttatacagaagagagagattttctgagtactgcagaaaaatctaagcatgatattgatccacatcgtagagcttgcagcaaatcatcagcctctgagagcaccgaatttgaatcaagttgtgatagccctgttgttgagaaaactctatatgtagattctgtacataaggtcaaatcttcagacaccaatatcagaggggatgattttgatactctaagaaaagacactgaccttgataaaagcctttctatagattcttcaattgaggatagcaaacccttgggtattgtggatgagaaggaagtatcagaacctaaaagttcagcttctcttgattcatctctccccgtttgttctgataattcaaatgacaatatgcaaatggaaatgaaaaatcattccaacaaaatatgcccagaaaagcaagagttgacaaagcctgattaccaaggaagtaacttagatcgcgatttggttgcaatctcaagtccagatatggttgcatgcaagaaaatagagtctgaaagcaaagattttagcactaaggaaagttctaatggcctaattaagaatcctgtttcaatgagaaacaggaaatttgccagtgatgtgaaatttgattcaaagtgccaacaagctaccaaagtggttgatcaagaatgcactcttggatctagtgaggatcctagtaatttggctagctcaaaggtggtgggtgacacaaagatcaacttagaaagtcaattgcggatgaagttgagccatggaaagacttcaaatgcaagctcttcaaagcttcctcttgcccttccttcaccaaaagctccttcagagtcttggcttaagcgcacattaccaacagttccctcgaagagtatatctttacggtctaatcttgctacctacttccatgcacctgttaaaacttctgaagttaatcatgggcatcttcagtttgctcagggacctaaaaatttctttttttggggccttaagctgatgcctaatttgtcttgcatcttgcaaggccgtgatttggaactactcccacccattccagaagcatga

SEQ ID NO: 82985 - DNA, 417 bp, Glycine max
  Peptide Sequence Number=SeqID_174670
atgcagtcaacggcggtctcccggcgaaacggcgtagtagccagcattccacgacattcctctcccagacacgacgtcgaggccatggattcaacgacgttcctccccggaaacgaggttcctttcgacgtcattgctttcagcagcaacgacgtagaagaccttacctttcaagcattggttgttacacgctacgtcggtgccgccatacccgaccttaaaagcttacctttcaacgtcgttcctcatgccggcaacatcttcgaaggcaaacctacaactacgggcctccagtcatccccgtcgcaggaatcgtgtgtttctaaaacggtggaaggagatcgtcgtagacttgccggaggcctacgacgacgtctcattcaaagacggccttgcaccgtcgttgaactccgataa

SEQ ID NO: 82986 - DNA, 90 bp, Glycine max
  Peptide Sequence Number=SeqID_174671
atggaaaggaacagagggttcagaagaatggagaggaaggaaaatgggaaacggagagttgagaagcaatgggaaacagagagggcttaa

SEQ ID NO: 82987 - DNA, 225 bp, Glycine max
  Peptide Sequence Number=SeqID_174672
atgggtgaaaattgcaaatcattcaaggaatcttcccacattttcgtggaaagtaagcaagggccgctgcatcgccgcccggatgtagtgaaaagtaagcaagggttcccacattttcgtgaacgggtgtgggtaaagaagctagttcatgacaggaggattcgctttggtacatggaatataggcacacttactggaaaatctatggaaatagtagatgttatg

SEQ ID NO: 82988 - DNA, 1683 bp, Glycine max
  Peptide Sequence Number=SeqID_174673
atgggatcaagtcaaacgcctccgctcaagaaaaggttctaccaagtcaagatcaagagcctaaaggtcaccagtttacaagaattaaggggattgatagggcaactccagcagcaagccttccacaaaacttacggtaagatctgggacttggctacaatagaagtctctgcaaaggcaatcgcttccctcacccagtattatgaccaatccttgagatgtttcacctttgaagatttccagctagtgccgactgtagaagagttcgaagaaattcttggatgccctctagaagggaggaagccttatctcttatctgggttctacccctccatgcctagaatcgccaaaatagtcaggatttcggcacaggaattagatcgagtgaagcaaaatagaaatggagtgatcggtataccaagaaagtatctagaagaaagagcaagggccttggcaggtcaaaacgagtggcttctcttcattgatgtcctggcgctgttaatcttcagagtggtcctctttccaaacatggatggtttggtggacctagcagcaatcgacgctttcctcgccttccaccacagcaaggaaagcccgatcgtcaccattttggctgacatatatgacacattcgaccggaggtgtgaaaggagtaacacaagaattgtctgctgcacaacggccctctatgtatggttggtttctaaccttttccgccaagatgcgagacacacctgtccactacaaagtcactgttcgtgcaccgaaaatagggaagcaaattgggaccagctcttggcaaacatagaaagggtgtcgatcaactggttccctcgctggaaggaaagaagatcgagaatcctagtttcatgcggagaatttccaaatgttcccttgatgggaacaaggggttgtatcaactataatcacgtcctcgcgataagacagcttggctaccccatgaggggggcgccatcagtggagagcctcacacctttcatcacacggggtttcagtgaccccaacgcaagagtgcttcaaggagtccgcaaggcgtgggaagtggtgcagagaaaagacaaagaacttaggggaagtaacaacgggaacgtcagcggctatcataggtggttgagagcctacacacaaggtctggattggctcccgaagctaagagctgctaaagaagaggaggctgaagcctcggaagaaagcgagggggtgcaagccctcaaagcggagctcgagaaagcccaagtggtcaaggaaaaattcaagacaacaaccagagaagaaagagaccagtcacgagtggaaggcatgattctgaaagacgaattgaagacttgtcggaggtccaagaggagtttgtctcagcaactgagcgagaccgaggcaaacatgctagccatcatcagcaagtacaaagaggaattggagttggcaacggcccacgagcataaggtggcagatgagtacgcccaactgtacgcaaaaaaagaggcaaagggaatggtgattggctcattacaccaagaagcgactatgtggatggatcgattcgcccttactttgaacaggagtcaaaagcttccccgattattagcaaaggccaaggcgatggcggacgtgcactcagcccccaaggaaatccatggctccttagctattgtcagcatatga

SEQ ID NO: 82989 - DNA, 1020 bp, Glycine max
  Peptide Sequence Number=SeqID_174674
atggctccgaagaagctcaccacaaagaggcctagaaaggacacccttggggaaggctcctgtgccatccaggattttgatattcaccgattccggagcgccgagcaccaacagcgtttcgaggccatcaaaggatggtcattcctcagagagaggcaggaggtagctcggaggcgacggactcagctcatatcacctatggctaagttcaatcccgaaatagtcatggaattctacaccaacgactggcccaccgaagaaggtatccgtgacatgcactcgtgggtaaggggccaatgggttccttttgacacagatgccatcaaccagttcttggaccacccgctgatcctagaagagggtcagcaatacgagtataggcagtggagggaccaggctaacggattcaacgaggaggccatcgcccaattgctgtgtacaccagggcaggatttcgctcgaactgccgcagggaggcgggtgcggatcatgtgcacgagcatgaccaccctgacccagatgtggatgacgttgctgctcaacaatgtcctccctagtgaccataactctaaccttcccctgccgaagtatcaactagtgtatgccatccttgcagggattagcgttcatgtggctcagctgatcgtagacgccatttatatttttgcaggtatggctcccacgagatatcccttggacccggagaagtccaacagggccctggggtttccggccctcatcacgggcctcttccagttctacggagtgcccgttacacctagcaaggccactgagcgaggagcattacctacatcatgtggtccgccagcaagcggccaaccaccatggacaggtgcagttacacgagtgcctctaccacctcatcctcagccagcagggtcagggttccaccccatttatatgccttaccccggagtagttcagagctgcggtcgcctggcccggagattagcccgacgctcagataggagtaggacccgcaggggcccccgaagttga

SEQ ID NO: 82990 - DNA, 294 bp, Glycine max
  Peptide Sequence Number=SeqID_174675
atgcgtcaggtggcaggcggatatacccaagtgattatccgtacaaagacaacatatgttgatcctgacccatgcgtcaagtggcagacggatatgcccaaatatacgcaagtgattatccgtacaaagacaacatctgttgatcctgacccatgcatcaggtggcaggcggaaatagcccgagtggttatccgtacaaacgcaacatctgttaatcctgacccatgcgttaggtggcaggcggatatacccagtgttaactcattggcaagtgtaccaaatcgtcacaagtag

SEQ ID NO: 82991 - DNA, 103 bp, Glycine max
  Peptide Sequence Number=SeqID_174676
ctcacttcaaacatcaaaggcaaagttgctattgacattgttgatttaaagatggctaagatttctttcacaatcatttttgcttttgctcttatctttacag

SEQ ID NO: 82992 - DNA, 585 bp, Glycine max
  Peptide Sequence Number=SeqID_174677
atgtcagagcgagacatagcttgggatttccatctccgtaagctctctgctagcggcagagactccaacaccgccaacgatcctgcttccgattcatctcttcttccttcggtgaagaagcttcatgaaatatgcaagaacgagtactccgaggacttggtagctagggtttatccatccattaacaagattttccagcgcgctgtcgcttccctctctcaatctcgaacctccaatggccttcttttactcgaaattcttcagttttacctggactttggggaggttgttcttcatgatgcggatcctagtctcaggacattttttcgtttgtgcttgagcagggaatttgctgatcctgttgttgcagaagcaacgcttgaatttctcatcatcaacaagaagaagcttctaacttccttccctaacttattgcctcagtctaacctgaagcatgagatcatgatctatgaagcaccgacactgacacgaataccggacacggacacgtggacacctgtcaaacacatcaaactcaacttgaacacgggcgtcggtgtcgtgtcaaacactagacacgacaag

SEQ ID NO: 82993 - DNA, 231 bp, Glycine max
  Peptide Sequence Number=SeqID_174678
atggaaccacgacgagagtgtgacgggcttcaacaatggaaccagttgatcaacgaagagattgcaacgacaacaattgaaacgcaggatcaacgatgtgacagaagtggtgagaacaaagcgtcgtggagggaaagaagattttatttggtggagagtgtctatgataagcttgtagaccttaattgcatccactgccttaaaaaacttgtccacaatggaccaccttga

SEQ ID NO: 82994 - DNA, 390 bp, Glycine max
  Peptide Sequence Number=SeqID_174679
atgagttccacaaccaaagcccctccttcctctaatgatgctatgtcaactgaggagagtggttggacgacatactttgatgacttcttcaacaaccatgttgtggataacaacaagtgttccatgcctttatccggtggtgttgctagctcctcccttgtctccgatgcagcttcttcggcagagaagaaaaaagtggcaaatagtaaacaagttgaggagtttaattatgtgaatagatatgtcaagagatcaagtttcaagaagaggaaggatgtcataacggctttgattgatgactctttggaagatacggcaacttctcctcttaatagtcccaaggttttgtatgcgaatcagaagattgacaaggcaaacagacggaagtag

SEQ ID NO: 82995 - DNA, 1707 bp, Glycine max
  Peptide Sequence Number=SeqID_174680
atggaaacttctaagaagaaagcgattacgatgaagaagagtttcgatccctgggcttttctggagcatattgaagcacctatgtgggtggatttgactcttgaagttaaatctggatgtgtagacacaggtgatgatgaatggttcaacacaagtcacccgttccaccagatgtctgctagagagttaaaatctaggttttctcacggcgaggagatattgacatcaggggttgattcgccagagcttccttcttcggtctcgagatctagaggcaaacactacaacaacaagaagtgggaaggtattgatctgaatagtttgttagataaacagaagggtttaagtaggagaggtttccaacaaggttccagctttggccaggaagtgaaacccaaaccaaattcaaatgttaacaagccaaaaggtgggaagctggggttggcttttgaacggaagtccagaggaaaaactgactctatggtcaattgcagcaatccaccgagtagttcaagttctaaccacaagtgtgaaggaagcactgcaaggagcacaattacatctgaaaacactcagaagtatagggaggtatctagcaaaccatttgatcagaaaagaagttcatcaattaggagggttagtcttgggaaaagttgtgttacgagaaaagtctcaagcattctgccacagaaggaatgtttggaggtgtctagtcaaccgtgtgatcagaaaagtagaagttcatcggttattagtgttaggagaagttatgtttcaggaaaagcttcgaaagtggagattggtggtgatagcactgcaaggagcatgattacatctgagaacactcggaagtatagggaggtatctagcaaaccatgtgctcagcaaagttcatcagttgggagggttagtcttgggaaaagttgtgttacaagaaaagtctcaagcattcagccacagaagaagtgtttagaggtgtctagtcaaccatgtgatcagaaaagtagaagttcatcagttattagtgttagaagaagttatgttttgggggaagcttcaaaagtggagagtggtggtgatagcatgcgatcaaggggtcgtaaatcatcttctgggaagtctagtattggttcatgttcaaaccctggttatgaagttaagtttgtgtcaaggcagcagagagagaaaatcaccattgataaaggtgaggtcactatgaatcttgcagttaagaaccgttgcaagcccagtgaaagatcaaagacatctaccatttcagttgaggaagcaaaatctggtaacagaaagagaaatagcatcaattttgcaaagccagcataccatcgaacagcaaagtcattggtccaatattcctctgcaagttcaaaggctttgttacaacacacagtcaataaagaaaacacttgtattggtggtgctaaggagaaactaagaactaccaaggttaagagtttgacagccaagggaaaagagaatgtttcaaggaatgtggcggtaaatcagaaatgcatttcaagaggtgcttctgcagggggccttgttagaagtcatagaactacagaacacaatcatccacagaagggtgacaaagcaggatcaactgctttgacaattgtgtgcatagagaaactcattaccaaaaatccaaaatcatcgcaaaactcatgcgagctattggattattaa

SEQ ID NO: 82996 - DNA, 634 bp, Glycine max
  Peptide Sequence Number=SeqID_174681
atggctactaccataacagagcaagaagcctcatcacgtgccccgcacgtgctcgactacgccaccactacatccgacgacgacacggaaaaggaggaggaggagctggtacacgagcaaaacgaatcctccggcggagggcggtggtttccggcggcgtgcggtggcggcacgcggcggagcgggggaggcgcgttagggcgagttcttgacccaagggcgaagtgggtccaggaatggaacagggtgttcctgctagtgtgcgccgcggggttgttcgttgaccctctcttcttctacgcgctctccgtcagcgactcgtgcatgtgcgtcttcgttgacgggtggctcgccgtcaccgtcacggtgctgcggtgcatgaccgacgcactgcacgtgtggaacatggttataaggtgcaagatggcgaaacgcaccttcggactcggcgcctccaccacttcttccggcagaggaacatcctcgtcctctgtcggactcagagatacccgaccgcgttccgtcgcgatgggatatctcatgtcacggaccggattcttttttgatctgttcgttattcttcctctaccacagtgggtagtgagtagtgatgaattggagacgatggcgacag

SEQ ID NO: 82997 - DNA, 273 bp, Glycine max
  Peptide Sequence Number=SeqID_174682
atgtggcgaggtgtatcagtggcatacaccatagttatcatttgctatctttcagttgcagtgtttggcttttggggatacggaaatgttgttgatgatgatatcctcatcacactcgaacatcccaattggcttattgctattgctaacttcatggttttcgttcatgtcttaggaagctttcagattcctggtatactatggcttaaggcaaaaagtccacaaagatggagtttccattggattgcatcatgggtatactttttatattaa

SEQ ID NO: 82998 - DNA, 366 bp, Glycine max
  Peptide Sequence Number=SeqID_174683
atgaagacgaaggaccaacaaccaccaccaacaacaaccactagcacagaggaagacgaaggaccaacaatcaccaacaacaaccaaccattagcatggaggaagacgaacgatgagcagaagtggaacaagcaccaacaccaaagggtgaaagatatttttgccttttcaccacgactgctgggtgccccagcaaaaatgctgggtgcaccaacttttgatctagataatttaatttttgtggaacctaatgatgatgcacaatctgaggaagaccttgatgatgatgatggagatggagatgatgatgaaaatgatgatattcatggagatgatcctattagaggattggacatgcttctttga

SEQ ID NO: 82999 - DNA, 117 bp, Glycine max
  Peptide Sequence Number=SeqID_174684
atgcagctgcaagatattgaacaagtattatcatataatgcatgcagtgtgagggtgagcaatgaattaggagcaagaagtccaaaatcagcatcgttatcatgtgtcttggtctaa

SEQ ID NO: 83000 - DNA, 408 bp, Glycine max
  Peptide Sequence Number=SeqID_174685
atggtggttgctgaaatgaaggaggggttctctcgggatcgaacaagctcagcaaccgttggcgggtactctcaaaatcaatcccaagggattgagctgggtgtacaaagggatgaagggtgtgcggcaatgaagaggggacaagtcccgacaagcaaaaacggaaaagataaaagcaatccgaaatatcctaacagtaaatatgcctttattccactacctacgcatcttctagaagacacgatgctatcacacgggtttgcgcttttcctacgtacggtgcatgtatgcatgatgccagccatgctgtatgttccttcctcttgggcctttggtgcttacttcctgcagacccatcttactattcctatcaaacatcaaggcactacactcaacaaagctacctga

SEQ ID NO: 83001 - DNA, 261 bp, Glycine max
  Peptide Sequence Number=SeqID_174686
atgccaccgtcattgctggttgaggtatttaaagatgtcattgtcgctgctggtgaagaagacaagtgtgatagcactcagaacccagggaagatttctggcccaaaaggatcagcaaaaggccaaagggatgggaagaattcatccactaatgtccctacttattctgttatttctgttttatctgtttctgaaatcgtcttaattatatcaaatttccatttacgagaagagattgtatatgcacaaggtatcaactga

SEQ ID NO: 83002 - DNA, 273 bp, Glycine max
  Peptide Sequence Number=SeqID_174687
atgacaatgtcatcaacatggaccaaaatggctatgaatgatgaacatgttcctttggtgaacaagttgagtgatggtccaagtgttgttgagatccatggctgtaagttcatcttgaatggcttgtttctagtgaggaaaattgatggcttgcttgttaggatcatcacaagtgcttggagtaatgtgagggctgagaggattagtggaccttgttgtaaattctttgtctttgaaaggaaagatgtgttcatagaacttcacgtcccttga

SEQ ID NO: 83003 - DNA, 1323 bp, Glycine max
  Peptide Sequence Number=SeqID_174688
atgaattgggtattattaacgtggacaaaagcacttaataggatccattcttctaacagcagatcaggcgtagatggaagtatcacatttgtcactgtcttcaccatttataattcttctctcaatgatgtagacgataaatcatcaaatacagttgttggcaatgcttcatataataagtttggcaggtccacggctttgttgaatgtcttcattaacttcattcagacttttggagtttttcaacatgaaatagtagaatattcttgtcttcacgagtttttcaccttttttcctaccttgacactagtttttctaccaatgtacccaaatgtcatacatccttgtctacatttggctaatgataaatttcaactggttagaaaggtgacaactgaagtgtggatgccaattagggggttaaggatgttactgaaagaggaagagggtataactagggaaatagacatcttttggatgttagatgatgtacaattaccctatattacaaataattcatattgcttttgtcctagagctcgttttctgacaataataccacacaggcatcattcatttaacaacatgagcaaagtgattattctgactgatccagtgtctgacctttcagtgctacgaaatggagtatctctgtaccctatagaaggtgaatattcacgagacaagttgatgctccaaaggatcaggtcttacattacctttttagaaacaaggctccagaatctttctcagaagaagccaaaaaatatcactcattacatcttcactgattctgatatagcagtggttgatgatttagggcagatttttcgtgaccatcctaattttcatgtggctctgacctttaggaacaataaggctcaacctttgaattcaggattcattgcagtaaggggtaccccggaagcaattttaagggcaaagcttttcctacaagaggtcttgaaagtttacagcacaaaatatagaaatgcttcccgcatgctgggtgatcaattagctcttgcttgggttgtgaagtcaaaacctcattttgatgccagcaggtttggcaaagcacttgctttctctgaagatattgggggtacctcagtagtgttcttaccttgttctttgtacaattggactccacctgagggtgctggtcaatttcatggcatgccattggatgctaaggttgttcattttaaaggatcaagaaaacgtctaatgctcgaatcttggaacttttattcctcatctcttgagcagcttgtggcattaacggctccagatcttagtacagaaaagactcagccataa

SEQ ID NO: 83004 - DNA, 744 bp, Glycine max
  Peptide Sequence Number=SeqID_174689
atggtggtttcgtgggtcctcgaaggactcgtcagtgacgaacttgaaagggtagagctagatgtgaggttcaagtgtatggttgttggttatagctccaatgaggtcttgaaggacaacaatgccgtcgatgcaacttccgttaccactctttacctcactcacaaagctctttccgatataacgtgcttgaccgtgaacttggaaaagcttgacctcaagctcaacaatctcacttcacttgagatgtgttgggttgggcttgaagccagtgtttccactgtcttgagtctcttgtcagctactggttacatagggaactttggtgtaggttatatctttttggcacaccaagtttttgatcgcgttgccaagaaggatgttgtcttgtggaactatttaatagggaattatgcaagaaatggaatggttggagaagcactggcttcatttgagcaaatgagtaaactaaaactggatgcggttcttggaacgactcttgttgatgtgtgtgctaaatgtggctttctagatgaggctatggacatatttgataggatggaagataaagatgtgaaatcttggactgccatgatttcgggcctcggagttcatgggcagccaaataatgccattaggcttttcaataggatggaaaaggaggggtttaaaccaaatgaactcacgtttttggcaattctgactgcttgtagtcatggagggcttgtggttgaggggatgtaa

SEQ ID NO: 83005 - DNA, 1107 bp, Glycine max
  Peptide Sequence Number=SeqID_174690
atggctctttcctccaaacatccacacctgttcaaccatattaggacttttgtgaatgcgaaggtcaaatgggtccgagatccatatcttgataatgcagtcctgaaagagaaagatcttaaacagacaatttccctcaagaaccaaatcatttcatctccttccaaatccctctccatctatgctgcttctcaacttaaagcttctctctaccttcccactacaactaccaaattcattgacaaatatcattgcattttcacacaattccaacctggtcctggtcttcctccagttgtcaagctcactcctcaagccttgtccctccacaaagaagaaatggctgtttataaaactcccattaatcgtgaagacactgttcagaggctcgcaaggcttctaatgcttgctggcatggaaaaattgcctctttatgtaattgagaagctaaaatgggatatgggacttcctcatgattatgtgacaacccttttggctgattaccctgattattttgatctttgtgttgtggaagatccatcatctggaaaagaaatgcttgctttagagcttgtttcgtggagaaaagagctttctgtgtctgagttagaaaagagggcgatgagcttgggctatagtggagataaaagaaggcatgatattgcatttcccatatttttgccaaaaggttttgatttagagaagagggtgaagacttgggttgagaattggcaaaagttgccttatgtttctccatatgaagatgcttttcatcttgactcaaatagtgaccaagcagagaagtggacagtggcaattttgcatgagttgctttctcttcttgtgtcaaagaagacagagagagacaatttgctctgttttggagagtgtttggggttggccttgagatttaagaaggctttggttcatcatcctggtatattttacctttccaataagattagaactcagactgttgtacttagagaggcttatagaaaggattttttggttaagaatcatccattggtggtagttggtagtggcactaatgctactggagttatcaatcagacaatcgcaggagagtggagtggacatctgtga

SEQ ID NO: 83006 - DNA, 678 bp, Glycine max
  Peptide Sequence Number=SeqID_174691
atgtcgacttcgggactcatgctgaccccgccacctatgtcgacttcgtcacccatgccgactgtgcctccatgtcctacaaccgtgcaaccattccctgcacccttgctgactccatgtcccatacctgttgcctacctccccgatctccgccacactcgcgccattgtttcatgcaacaagctcttcgatactgttgcttcgtatagccgtgcaacaactcctaatgacaaagctctcgaagggagaaacatgacgttgtttgagataggaattgaataccatggacctaccatggttgcatgcaagcaccaaccaactgtatttgcattatggacgccccaacaccttgaggacaaggtgtttttgatgggccagggaaaaatgttaggtgcagtgaatcaagataatctggttttcgaggaaccagtgcctccagaggaaaataaggagaagagaatgaaaggtattttggccttgtgctctttctgttgggccttgccattggcaccccctctttctccttcttcgtatcattccctaacattggtgcagaacaacgagagaaaatgggaaaatactaagagaaagaaagggagtgttatcgtcatccaccggaaatcacctccggcaacgatgatcgatggcagatcagagaactgcaaagatggttactag

SEQ ID NO: 83007 - DNA, 546 bp, Glycine max
  Peptide Sequence Number=SeqID_174692
atgcaagccgtttcgccatacacgctggcgataccacctgggacggccacatggctttccgccactgccactggcgaaatagccagtggttatcgccaccagtgctggcaagttagggacaactctttacgccagtttgactggcgagttacatgcaacgggggtaggcacagggaaggcttgcagagcagcgcgcagaggtgcaaaggggtaggcttttttcagaggtgcaaagggtatcgccattcgtattggcgagaagcttttcggaggggggtatcaccattcgtactggcgagaagccttcagagttattctgatacgtggcgaaaagctttgctcccttcctgtgcctccctcctgtatgaaagacatcttcctcgtcatgttcatcaaatatacaaattaagtctggtccaattgatgatgacgctttatggatgcaagctaagcatgtttcagaacatatttagaatgtggaagaagacagaaaattattcatcagacgagttatccccacgtatcaaggtcaagaagaaatattag

SEQ ID NO: 83008 - DNA, 1275 bp, Glycine max
  Peptide Sequence Number=SeqID_174693
atggcgactcgtgcgttgctcggagcaatcaagaaacgcaccgtttcgttccccgcattccgcggccattccatttatcgacacggtagcacgcttgtggtggcggaacacgaaggtggttttatcaaacccccttctctctcagcactggctgctgccacgtgtcttcccgatcctgactcttccgtttctgtgctcttggccggttcgggtccttctcttcatcaagctgcttcacatgctgcttcgtgccacccttcaatctccaaggtgcttgtggcagattcagataaattcaagaaccctctggcagagccctgggctaaattagtccatttggttcaccagagtggtggttactctcatataattgctgctgcaagttcttttgggaaaaatgtcgtgccacgtgcggctgcccttttagatgtttctccaattactgacgttactggaatttctgattccaatacttttgtgagtccagagttgaaaactgaaaaacctgtaaacctgaattatcttgggacttttgaactacgggaaggtattgctatcagagcatatttgccatacatagatatcttctgggtctggataataagacatcagaatagatatgaatcgatgatgatcctgactcagttgaggactgagatagtgattcatgcatataggggaaggccaatatatgctggaaatgcactctgtactgtccgatatactggtgccaatccttgtatattaacgattagatccacatcttttcctgttcctcagaattcagttgactcaaaatctaatgaggctccaatatctcaggttgacctttcaacctttgatgaagatctggacaagtctagatatatatctcagacttcccaggatgatgaacgaccagatcttgggaatgcacgaattgtagttactgggggccgagccctaaagagtgctgagaactttaaattgatagaagatctagccaataaacttggtgctgcggttggtgcgactcgtgctgctgttgatgcaggatatgttcctaatgatctccaggtagggcaaactggaaagatcgttgctcctgaactctatatggcttttggtgtatctggagctattcaacacttggcagggatgagggattccaaggtcattgttgctgtgaacaatgatgctgatgctcctatatttcaggtagctgattatggacttgtaggagatctgtttgaggtgataccagagctaatggagaagctccctgagaaaaaataa

SEQ ID NO: 83009 - DNA, 309 bp, Glycine max
  Peptide Sequence Number=SeqID_174694
atgggttctccacctgcctccactcttcttcctcctcctccttcacctcctcctcctcctccttcggacgcatcggcttcaccgtcttccgtgaagcggacacgcaaagcctcacgtctacgatcattgtccactagaccacctggtgctgagagaccagtggtacatgttgatcctgctaccgggaaggccgacggtccccacaggaagaaattaagaacatatttggggattgtggcgcgtgataaggtggacatcacctacgagaactggaaggaggtccctactgctcagaaggacctgatttag

SEQ ID NO: 83010 - DNA, 654 bp, Glycine max
  Peptide Sequence Number=SeqID_174695
atgcctcccgtcgctcctcgatccggcgatgccatattcgccaacgtcgaacgcgtcgtaagcaacccatacccaaaagctaaaccctcgttatgccttaatgcggagctgtttactttgacgtatggcgcaattgtgcgtcaattgctcacggatctggaagaggttgaggagggaagagagaatagaaatggaaaaatgaagaagattgaatgtaaaagatgtgatcaaaccagaagaaaaatggggggttacaatattggaatccgattgattgatgagtttttagctaagtctaatgtctcaagatgcaacgatttcagagagactactgatgtaattgcaaaggttggttttaaaatgttccttggtgttactgcatctgtgaccaattgggatgctgatggaacatgttgtagtattgttttggaggataatccattggtagattttgttgagcttcctgacaactgccaaggtttgtactattgcaacatcttaagtggagtcatcagaggagccttagatatggtgtcaatgaaaactgaggtaacttggcttcgtgatgtacttcgtggtgatgatgtgtttgagttgcaggtaaaacttctcaagcatgttcctgaagagtatccatacaaggatgatgagtga

SEQ ID NO: 83011 - DNA, 360 bp, Glycine max
  Peptide Sequence Number=SeqID_174696
atgctgcttgtgccacatagattggatgtagtgcgtgtttggtttgaaggggcatacaggatgattgctgacttagaggatatgaatttcaagcctacaacaaacatgtacaatgctataatggcaggatattttcgagagaagaacatcagaggagggttgagggtcctcaatcaaatgcgaggtgccaatgtaaaacctgattctcatactttctactatttgattcagaattgtgaaacggaagaggatataatcaagttgtgcatcaatcttctcccatttggcactatcgactactgtcatagaattggtggtagtggtgaggtggtccttgtaccttttgccactaatccatag

SEQ ID NO: 83012 - DNA, 1701 bp, Glycine max
  Peptide Sequence Number=SeqID_174697
atgtctgctagccagatatacctaaactctcatgaggtcattgagagagaacgagtgagactgagagtggattctcgacggactcacgtcgggaacagggatggacaacagcaatgctacaatcaaacaaattggagggatcaaaacgaaatatcctccttctacttcacgcgattctccgacaatgtcaccaagaaggaactatggtatcaattcaaaaaatggggcgatgtgagggagatattcatatccaagcaaaggaataaggatggtaggaggtacgggtttattagattcaaaggtgttcatgacatgcacatactcgaaaggcaactggacagtattgttatcagaggtatgaagctatacgtcaatattccaaaatatgggagagaaaggggtagaaagacaaattcagaagataaacagaaggggcaagagcaaaggaatgagaacgaagcatctcgttctacacaaagatgcacaagaacgaaccaggcatcgtatgcggaggtggttgcgaggaaagcgcacatctcacccaaatacatgggggatgacatggttctattacttggtcttactgacacaaaagcagaacaactgattcaagaagaaatccatgaaacgcctcccctgttctacacgctgcagaaatggaatccgagcctatgtccgggatatgggttgacctgggtccagtgctggggcatcccgcttctagcctgggacacgatgcaaatcaagaagatcgtggtagaggtcgacgatgatgttgatgaacgtcggcgtttggacagagcacgggtgctcattaaaacaccgtggaaacccgcgattcagcatacgttaaatgtctacatagattcagaggtctatgaagtgcgtatattggaggaatgcggatatagcaccgacatctgccattgtagaagaagcagcgttatggtgtcgccagaggagattgactctgacggaagtttcatgggatcaccgattaaggagaggacccatgcgtcagagaaagacgacgccgcgcgggacacggagacaccggcaacgacgagggcccactacggagcaattgcagaaccgatagcggaggttaggcagaaaggaaacaaagaggactccacaatgggtatggtcgcagaatgggcggcacgccaatcgatgtggactgagatcaaccatttagatgttgaaatctacaaggggcatgaggtaggagaactcagctggaaggagaaagaggcacgtgaccccatgtggaagaggaaactagttcaaatgagttgggcttttctattcacacccctgttaaagccccaacaccccatggtgggatgtgcaaattctgaagcccacaacacagaatcaagattaaacataacaagcacacagcagcaacaaaataaaataagcgcacagcagcaacaagtaacggacagagacaagggaggaaagggctacaaccataatcttgtccacagagaagtattatcagttcaggatgcagtggaggatgcaagcttaggggaaaataacatgcaacatgcaacaaagatatgggaaatagcaaaacatttgggggcaacgggagctgcagatcaggggagaattattgggaaaatcatgacaatggaggaaagagataggaaagaggcaaagagattggggaatagaagtgataacccataa

SEQ ID NO: 83013 - DNA, 2367 bp, Glycine max
  Peptide Sequence Number=SeqID_174698
atggagagagagagtagaaagagaaacagcgggtgggagagagttaggtctagaagagagaagagagagagcgccagagcacgaacgacggagggttccggtctgaccattgaagggagaacaacaggacaagatcatagctacatgcgagcgaattggagagaccatagggacattacctcgttctatttcaccaggttcccagaagacgcaactgcagaagatttatggcatcatttcaagcagacaggagacgtacgagaggtgttcatacctcggaaaagaaacagacagggaaggagatatgggttcgtgaggtttaaaggggtgcgagacatacagcagattcaaaagaaactggacagcatgatttttggaggaatgaagatgtatgttaatgtacctaaatatgggagagcaaagaaagaagagccacaaacagaagaagggggaagaacagaagctagacaacagcaacaggggaaaaaagacatgtacctgagcaggaatgcagaaacgaaggtgggagtccaaagagggtcgtatgcagacatggttactcgaaataaccaaagagcagaacagaggagagtaccagtcaaagtcagcgataatagtcacaattcgacatccgaagtaattcttgatataccgctaacgggccagcagtggcttaaggaagcatgggtgggcaggctgcaaaatctagcaagctttgaaagcttagaagatgaaatatggtgggacagcggacaaaacatttcactaaaatacatcggaggtgatatggttttgatccttggtctcacagtagagaaagctgaacgaatgctgaacaataaagatgaaggatggggcgagttattttactccatagagaaatggaatcccaaactatggcctggattcagattgacatggcttcaatgctggggaatacctctggtagcatgggatagacaccacattcaacaaatagttttgggtattggcgatgtggtggatgttgaagactgcgtagaggaacgaagaagcttagaggtggcgcggatcctagtcaaaacgacgtggaagccgctgatacaacacacagtgaatgtcaacatacagggggagaaattccaggtgcatgtggcggaagagtgtgggtactcaggagataggaggcagcaaaggagaggaagtgacttcagctcatctgaggagattatctccgaggaaggagaagacgaagtgtcgattggaggagtgtttcagtcacggtggcacagattccgagtaacggactcggcggcgggcagaaaaacagtagatgaggacgggggcgtagaagcaatagggacggaggaagacaccacgacgggagccaaggaacaagaagatgacgcccgccatcggagggacaatgaggacccagcaaagtccgagacgggagctcgaggaatgagggatatgactggcggcgcagtgacggattccgtcgaagaggagatgacggcgcgcggcgaggaatgtcgacgaccgttgccgtcaaaccctttagaaccactaccgtcgggaacggatagtgcggaccagaataatggggtgtctggtcaaagcagcggaccagtggataatgctaatgtccaatgggtcagcaaaggcacggacactgtgcagaccaaagctctgcatgcacaaagttgtagcgcagtggcggcagaagtccaagggaaaggtgtgcacgaaacaggggatgaacagaatctcggcaactgtgacagcactgtcattacacacagtttgcatgaaaatggaaaaagggaggagacagtgaacgttggaggagaagagtttgaggaaggtcaatgtaattttaaatcagcaatccaaaggtcacgtgacttggagataaaagggccaatggacctgggccttgctattcacactccctcaaaagttgtttccattcataataaaagcccagcttcaagagaagctagattttctactccgtggctagtgtattctcgaaaaaagggaaaagacaaaaacacagcccacacagcaactggtgcaatcatgaatcaaattaatataagcctagtatttttcgataatgaaccaagtcagcaaaaaaatgatgaaagtggacttcagcatcaacaactgaacatggatcagtcattaacacagcaaaggcttaacatacaaaaccaagcggaaaatcaagaccattatgcagagagtgtgtggaatatggttactgaactggggctgacaacaggaacttcaaaaagaaattatgttcaaatgctggaggaaatggaggaaagagatggagaagaggcagctagcttgggaattaagagatggactccatga

SEQ ID NO: 83014 - DNA, 4209 bp, Glycine max
  Peptide Sequence Number=SeqID_174699
atggcttctaacgccatcatccaatacggctcttcttcttcttcttcatctcatgcgatcatcactgcatctgatgtgtttgtcagcttccgcggtgaagacacgctcaacaacttcactgtttttctctttgatgctctctctcaaaatggcatcgatgccttcaaagatgatacacatcttcagaaaggcgaatccatagcacccgaggtgctacaggccattgaagagtctctccttttccttgtggtcttctctaagaactatgcttcctcaactcggtgcttgcgtgaacttgcacacatctgcaactgcaccgatgaagcatccccgagtcgtgttcttccagttttctatgatgttgatccatcagaggtgcggaaacagagtggttattatgggattgcctttgcagaacacgaacgaagattcagagaagatatagagaagatggaggaagtgctgagatggagagaagctctgacacaagtggccaatatctctggctgggatatccgaaataagtcacatcctgcaatgattaaagaaattgttcaaaaaataaaatatatattgggtcccaaatttcaaaattttccaaatggtaatctggttgggatggaatcccgtgttgaagaattagaaaagtgtttagcactggagttggttggtgacgttcgagttgtcagaattagtggaattggtgggataggaaaaacgactcttgcccttgcgtttacagggggtacagatactctattaagtgaatgtcttggtgaagggagcagaatcgttataatttgtaaggatgaacaactattaaggacacatgaagtatatcatgtttaccgagtgcaaccgttgaatcgacacatcgctgttcagttattttgcaaaaatgctttcaaatgtgactatattatgagtgattatgaaacattgacacatgatgtactatcacatgctcaaggccatcccttggcaattgaagtaataagcaaatctttgcattgtcgaaatgtttcgcagtggagaggtagattggttaggctaagtgataaggtaagtaagcatactttgaaggtgttgggaataagaagcttctgcaatccagttagatgtttgtttccttccttttctattttctcatgtatccgtgaacttgatctaagtttctgcaatttacttaaaatccctgatgcttttggaaatttgcattgcttagaaaggataagtttaagtggaaacaattttgaaacactacccagcctcaaggagctttccaaactgttaagattagacttacgacactgcaagagattgaaatatttgcctgagctcccttcacaaactgattggcggccttcggatattcgcctgagctcccttcaagatgatgaatcggatgatgaatcggatcacttgcggctattctattacactcgatcacattttgatgtctctaattttgatgagttgaaagtggaaagtagattcagagatctttatgatcaagatttggatgttgaggtgaagaaatgtgggtatgatcgggtatatgtacgggatttagaaccatcactcaacacaggaatcgggaaaagaaaaaggggatttgattatgaagacttgattaaagatgtgccatcatcatcttccttcaccaatgatgtgttcctcagcttcagaggagaagatactcgttacagtttcactggcaatctctgcagagcccttcgtgacagtggaattcacaccttcgttgatgacgatgagctccagagaggggacgaaataacgtcagaacttgagaaggaaattgaagactccagatttttcatcatcgttctctctcagaactatgcatcttcctcattttgcttaaacgtacttgcttacattcttgagtgcgttaagagaaaacgtttgttggttttgccaattttttacaaggtggatccttctagtattcgattccatggaggtagttttggagaagcattggctaatcatgaaatgaagttcaaagctaaaatggacgggttggagcataacatggagaaactggagaaatggaagatggctctgcacgaaacagctaacttctcaggctatcatttcaaacaaggggatggatatgaatacgagtttattaccaggatagttgaattggtctctagcaagattaaacagtatcctttccatgttggggattatcgagttggactagagtcatattcagaagcattcaactatgatgtgttcctcagcttcagaggctcagacacactccatggttttactggctatctctacaaagctcttcatgacagaggaatccacactttcattgatgaagatcttaagagaggagaagaaataacaccggaaattgtgaaggcaattgaagagtccaggattgctatcattgtgctctctataaactatgcttcttcctccttttgtttagacgaacttgcaaccatccttgactgccttgagagaaaaagactattggttttaccagtcttttataatgtggatcattatcaggtgctgggaggtagttatgtagaagccttggtgaaacatgggaagagtttaaagcatagcatggagaagttggagaaatgggagatggctctgtatgaagtagctgacttgtccgactttaaaatcaaacatggagctcgatatgaatacgactttattggggagatagttgagtgggtctccagtaagattaatcctgctcattacccggttggattagggtcaaaagtgctggaagtaaggaaacttttggatgttggacgtgatgatggtgtccacatgttagggatccatggaattgatggtgtagggaaatcaacacttgcacgagaagtttataataaactgatttctgaccattttgatgcttcctgttttattgaaaacgtgagagaaaaatctaaaaaacatgggttacatcacctccaaaacatccttctttcgaaaatacttggagagaaggacatcaacctcacaagtgcccaacaagagatttcaatgatgcaacggcataggctccagcaaaagaaggttctcatggttctagatgatgttgacaggcctgagcaattgcaagcagttactggaaaacctgcttggtttggtcctggcagcaaagtcataatcacaacacaagacaaacaactgctaacatcttatgacattaatagaacatatgaggtgaagaaattgaataaggatgatgctcttcaattacttaaatggaaagcttttaagatgcattacttcgatccaaggtataagatgctcttaaatcgtgcagtaacttttgcttctagtcttccattgactttggaaatattagcttcctacctatttggaaaaagtgtaaaagaatggaaatttactttccaccaatttgtaagaagtccgaataatccaatggaaatgatacttaaagtaatctttgattctttgaaggaaaaagaaaagagtgttctacttgacattgcttgttatttcaaaggatatgaattgacagaggttcaagatatacttcatgctcattatggtcagtgcatgaagtattatattgacgttttggttgacaaatctctagtatacattactcatggtacagagccttgtaacgatacaattacaatgcatgaattgattgctaaagagattgtccgactggaatcaatgatgacaaagccaggtgagtgcaggagattatggtcatgggaagatgtaagggaagtttttttaggatacaagacggcaactagcaaaattgaaattatatgtctggattaccccatatttgatgaagaagaaatagtacaatgggatggaacaactttccaaaatatgcaaaacctcaaaacacttattattagaaatggtaatttttccaaaggtccggaatatcttccaaatagtttgagagtatttgaatggtggggatatccgtcacattgtttaccatctgattttcatccaaaggaacttgccatatgcaagttaccctgcagtcgtatttctacaactgagttgaccaacttattgacgaagttcgtgaatgtgaagcgtttgaaattttcaagcgaaaagcaatggctaaaacaggaagatggtgaagaaaaagcgggttcaatagtatcttcaaaggtagaacggctttgtgcctaa

SEQ ID NO: 83015 - DNA, 725 bp, Glycine max
  Peptide Sequence Number=SeqID_174700
tgaatgaaactgctaagaattttggtgatgaaaagcaaaacccttcagatgaggatgatgttgctgcagatggaaacaaggaaaatcctactaatgaagctgaacaaaaagagcctgagaataaggagatgactctcgaggaatatgaaaaagtactagaagagagaaggaaggctttccacgcacttaagactgaggagagaaaggtagatactaaagttttcgaatccttgcagcatctctcgaacaagaaagacaatgatgacatctttattaagctggttgagttggttcttgcccagttcagaagagctaaagggagggttgatgaaccagctgtcaggttgtatgaggatatgttgtctgtttacaacaacagcagtgatgcagctacagaattaatgaacgaccctgtcattgtttcaacgggacaggaaaatggagaggagagctttgaggagttgcaacagctttttgaagacatgtttcaagcggatattggattggatggaggcccttctcttgcttcttctgattcctcaacttcatctgcttacatgacttatagtgaaagttctagttcaaataaacgcaattcctctgagatgaatttcgggaaggcagagaattcttctgtctttgatgccaaaagcgcatcttactacatcagtgcctacgtcaccactgatgtagaagtttccatgttcaacatcgttgctttctga

SEQ ID NO: 83016 - DNA, 345 bp, Glycine max
  Peptide Sequence Number=SeqID_174701
atggtgctgagtaatagtgttcctcacaaggcaccgacgacaatgaggatgacaaagaattggtccaggctaaattccgaaaaagttattgctgttggccctggctttcacagtaagaatgggaagctaattcctgtggctgttaaggaaggtgatactgttcttttgcctgaatatgggggaactgaggtgaagcttgataacaaagatttattttataccctcattcaattcttcaacttcatcctgaagtttaatatgcaaattaagagaaagatgaaaggaagagaaagccttaccataagggcatgcaagaaagatatgaaatggagagaaagaaactga

SEQ ID NO: 83017 - DNA, 138 bp, Glycine max
  Peptide Sequence Number=SeqID_174702
atgtcatttttgaccgatgtaaaaagcacgctttgtagtagtgaggaagaaggtgaagaaaaagcgggttcaacagtatcttcaaaggatctgcatgaggctggaaacactctatcatttgccaggagtaatatatag

SEQ ID NO: 83018 - DNA, 441 bp, Glycine max
  Peptide Sequence Number=SeqID_174703
atggatagaacgggccaggttatcgtatgtctggacacggagtgcgatttcgcatccaaaataacaagtagtacagggatccgaacaagtttttggtgccattgccggggaggtgaggcctccgcagcccatgagcctcagccggagccaaaggcagttgctcaggaggctgatccagatgcttatccagaggccacaccagatattccaaagggtgatccggagaccgatctagctgctcaggaaaacactatagaggctactccaaagatgactctacaggcatcaccggtgactacacatgggctagagttgtcttctccgcaggcatcaccggtggctgcacatgtgctggagctgtctgaggaggaggatgaggccacatatatggattatgcagcagcccaggatgacccctctccaggaccacaggacccatga

SEQ ID NO: 83019 - DNA, 1173 bp, Glycine max
  Peptide Sequence Number=SeqID_174704
atggagaaatggaggacggctctgcacgaagtaacatatttggctgggtttcctttcaaagatggtcttcgatatgtcgcggatcacccggtaggattagactcacaagtgccaacaataaggatgtttgtgaaggctgaatctagtaatgctatctccatgatagggatccacggaatgggcggggtaggaaaatcaacacttgctggagcagtttataatttgcatacggatgattttgatgattcgtgtttcatacaaaacgacatcaacttagcaagtgagcaacaaggaactttgatgataaaaaataagctcagaggaaagaaggttctcttagttctagatgatgttgatgagcacaagcaattacaggcaattgttggaaattctgattgggagtctaagtctggcaccagagtggttctgatcatcaccactcgggacaaacaactcctaacatcttatggggtcaaaataacacatgaggtgaaagaattggatacggatgatgctattcaattgcttaaatggaaagcttttaaaacatatgatgaagttgatcaaagttacaagcaggtcttgaatgatgtagtaacttggacttctggccttccattggctttggaagtgataggttcgaacctgtttggaaaaagtattaaagtatgggaatcagctatcaaacaatatcaaagaattcccaatcaggaaatcttcaagatacttaaggtaagctttgatgctttggaggaagaagaaaaaagtgtttttcttgacattacttgttgcgtgaaaggccataaacgcacagagattgaagatatacttcacagtctctatgataactgcatgaaataccatattgaggtgcttgttgacaagtctctcatgcagattagtgacaacgatagagttacattccatgacctgattgagaacatgggtaaagagattgacaggcagaaatcaccgaaagagataggcaagcggaggagattatggttactagaagatataattcaagtcttagaagacaacccgggaaccagtgaagttaaaatcattcgtctggatttccccatatctgacaaacaagaaacatcaatagaatggaatgccttcaacgatatggaaaaccttaaagcacttattatcagaaacgatatttaa

SEQ ID NO: 83020 - DNA, 396 bp, Glycine max
  Peptide Sequence Number=SeqID_174705
atggttgagattatatatgatgcaaatctcaaggatgaagggaacattgtgtctgatccttcacgcaagactgcaatacttgaggccaaatccaaggaatttcaaggattaagtcctagccatttcatcacggttcttcgccacacggtccggtccattatcaactttgtgaggctcattgttgatgacatgagatatgcaggttgggacattgatgccacggttgatgccatcgagcagaatgtagtttatatggcagaagatcacaagtgtttcaccaagatggcgaagagggtgtggcttctacactgcttggccttctcctatgagcctcaggcttcaatcttccaagtagggaaatggtgcatattctctgatgtgtacatggaagtgtga

SEQ ID NO: 83021 - DNA, 1020 bp, Glycine max
  Peptide Sequence Number=SeqID_174706
atggcggaaccatcgaagaagaaaaaggggattgtgacttcattcgcagttactggaacacgaagccacggaacatccaaggcgcagacatctcaaattcttccctccatatcatctcctacgttgttttcctcggaagaacaacgtatccggtacaattctcttttctcttctcgttccattatcgaccctaagttcgtagacttagctttctctaatgatgaagtgtttgattgctttcaagcatttcaaaattctggtttaattcagtttatctccatgaaacttcctttttaccctaaattggttaaagctttttattcaaacctagaaattcaagaagattccttgatttccgaagtgtatgggattaagatggtcatagaccagtccctcttctttgatctcactcaattatcaagtgacagtgtaccatttgagggttcacttgatgatgagttgaagtttgatttttctgtgtctgatgcctgccggatggtttgcaccaaccaagcggatatgactggaaggcttcttgctgattcattggcattcgaatgccgcatcatgcactacttgattgtgcatatcctactccctagatcttccaaccttgcacaggtttctgaggaagatttgataatcatgtgggttttcttaactggtcgtcaaatcaactgggcccttcttagatccttctctataggtgcaaatgtagtgtcttccttcggttaccgcaaagagaaggatggctcttgggtaaagaaggatgctccagtacaggccgctgaagaccgctgtccatcaccacattctcatagagatgactcttcatctcttatgcacaacattcttgaaaggtttgatgaacttcaaacctatgttggtgagagatttgatgctttggaacgacaagtggacacgcgattcgacaaaatggactcaaggatcacaaaggttgaagaagatgtcaccatcattcgcgactgccttgatttacctccaccaccatcagtttag

SEQ ID NO: 83022 - DNA, 366 bp, Glycine max
  Peptide Sequence Number=SeqID_174707
atgttatcaagaaatcgagtaagacaatatctactttgtagtgatcctgttgctgtcacaggagacactgaaccaatcagaatggaaagtatatcaacagataaaatgaaaaataactatcatatggctgctgctgtcaaccaaacaaaagctgaaagaaatgttatcaagagttggccatcaaaggagaagaggaaggaattgaaaagcttattgttgcatccctctgtttgggagagtgagtccctgccggaggaagtttgttttttattggcaaatgtccctgccgaaatctttgagcttgaaaagagtgagaaggcaagaatggtccactcgcatggaaaaactgaaaaaaaaagtacctaa

SEQ ID NO: 83023 - DNA, 3684 bp, Glycine max
  Peptide Sequence Number=SeqID_174708
atggctgcgacaacacgttcccttgcatcctacgatgtgttcctcagcttcagtggtttagacacactctatggtttcactggcaacctctacaatgctctttatgacaggggaatctacactttcattgatgatcaggagcgttcgagaggagacgaaatagcacctgcactttccaaggcaattcaagagtccaggattgctattactgtgctttctgaaaactatgctttttcctcatttcgtttaaatgaacttgtaaccatccttgactgcaagagtgaagggctgttggttataccggtcttttacaacgtagatccttctgatgtcagacaccagaaaggtagttatggagaagcaatgacttaccatcagaagaggttcaaagctaacaaggagaagctgcagaaatggaggatggctttgcatcaagtagctgacttgtctggctatcatttcaaagatggagattcatatgaatacaagtttattgggagtattgttgaggaggtctctaggaagattagtcgtccttctttagttggtctagagtcacaagtgacagaggtaatgaagcttttggatgttggatcccatgatgttgtccacatcatagggatccatggaatgggcgggtcaggaaaaacaacacttgctcgggaagtttataatttgattgctctccattttgatgaatcctgttttcttcaaaacgttagagaagaatcaaataaacacgggttaagacaccttcaaagcatccttcttttagaattacttggtgagaagaacatcaccttaacaagttggagagaaggagcttcaatgatacgacataggctccgacaaaagaaggttctcttgattttagacgatgttgacaagcacaaacaattaagggctatggttggaagatctggttggtttggtgccggtagcagagtcatcattaccactcgggacaaacatctactaaaatatcatggcgttgaaagaacttatgaggtggaggttttgaatcacaataccgctcttcaattgcttacttggaatgcttttaaaagagaaaaaattgatccaagttatgaggacgtggaatctgctcttgaacattataagagaagtcccggtaatgaaatcatcctagagattctaaaagtaagctttgatgctttgggggaagaacaaaagaatgctttgaaacatgtgccatcatcatcttccttcaccaatgatgtgttcctcagcttcagaggagaagatactcgttacagtttcactggcaatctctgcagagcccttcatgacagtggaattcacaccttcgttgatgacgaggagctccagagaggggacgaaataacgtcagaacttgagaaggaaattgaagactccagatttttcatcattgttctctctcagaactatgcatcttcctcattttgcttaaacgtacttgcttacatccttgagtgcgttaagagaaaacgtttgttggttttgccaattttttacaaggtggatccttctaatattggataccatagaggtagttttggagaagcattggctaatcatgaaatgaagttcaaagctaaaatggatgggttagagcataacatggagaaactggagaaatggaagatggctctgcatgaaacagctaacttctcaggctatcattttaaacaaggggatggatacgaatacgagtttattaccaggatagttaaattggtctctagcaagattgaacaggatcctttccatgttggggattatccagttggactagagtcatattcagacgcattcaactatgatgtgttcctcagcttcagaggctcagacacactccatggttttactggctatctctacgaagctcttcatgacagtggaatccacactttcattgatgaagatcttaagagaggagaagaaataacaccggcaattgtgaaggcaattgaagagtccaggattgccatcattgtgctctctataaactatgcttcttcctcctcttgtttagacgaacttgcaaccatccttgactgccttaagagaaaaagactgttggttttaccagtcttttataatgtggatcattctcaggtgcgactgcaggaaggtagttatggagaagccttggtgaaacatgaggagagtttaaagcatagcatggagaagttggagaaatggaagatggctctgcatcaagtagctaacttgtctgacattaaaatcaaacatggagctcgatatgaatacgactttattggggagatagttgagtgggtctccagtaagattaatcctgctcattacccggttggattacggtcaaaagtgctggaagttaggaaacttttggatgttggacgtgatgatggtgtccacatgttagggatccatggaattgatggtgtagggaaatcaacacttgcacgagaagtttataataaactgatttctgaccattttgatgcttcctgttttattgaaaacgtgagagaaaaatctaaaaaacatgggttacatcacctccaaaacatccttctttcgaaaatacttggagagaaggacatcaacctcacaagtgcccaacaagtgatttcaatgatgcaacggcataggctccagcaaaagaaggttctcatggttctagatgatgttgacaggcctgagcaattgcaagcagttactggaaaacctgcttggtttggtcctggcagcaaagtcataattacaacacaagacaaacaactgttaacatcttatgacattaatagaacatatgaggtgaagaaattgaataaggatgatgctcttcaattacttaaatggaaagcttttaagatgcattacttcgatccaaggtatgaggagctcttaaatcatgcagtaacttatgcttctagtcttccattgactttggaaatattagcttccaacctatttggaaaaagtgaaaaagaaaagagtgttcttcttgacattgcttgttgcttcaaaggatatgaattgacagaggttcaagatatacttcatgctcattatggtcaatgcataaagtattatattgacgttttggttgacaaatctctagtatacattagtcatggtacagagccttgtaatgatacaattacaatgcatgacttgattgctgaagagattgtccgacaggaatcaatgacaaagccaggtgagcgcaggagattatggtcattggaagatgtaagggaagttttaggatacaacacggcaactagcaaaattgaaatcatatgtctggattaccccatatttgatgaagaagaaatagtacaatgggatggaacagctttccaaaatatgcaaaacctcaaaacacttattattagaaatggtaatttttccaaaggtccggaatatcttccaaatagtttgagagtatttgaatggtggggatatccgtcacattgtttaccatctgattttcatccaaaggaacttgccatatgcaagttaccctgcagtcatatttctacaactgagttgaccaacttattgacgaagttcgtgaatgtgaaacttttgaaattttcaagcgaaaagcaatggctaaatcaggaagatggtgaagaaaaagcgggttcaatagtatcttcaaaggtagaacggctttgtgcctaa

SEQ ID NO: 83024 - DNA, 219 bp, Glycine max
  Peptide Sequence Number=SeqID_174709
atgaggtccttcaatggtgattttccaccatggaggtgcaacgaaagacaaaggagaagaggtgagaggaagcgccaaccactagggaataagccttggaagaaggagcttcaccaccaagaatgtgccttggacaagaagcttggagaggatgtttcaatgaaggaaaagaaagagacagagaaagagaggggggggagggggggggcacaaaattga

SEQ ID NO: 83025 - DNA, 315 bp, Glycine max
  Peptide Sequence Number=SeqID_174710
atggccaaaaatacatcatccaatgaaacatacccccctacacttattcccaaaacaattccaaagctccaaaattccttaagggtaggaaagtggaacataggctcaaaggggctatcaaaggaattaattcaaggtaggctcatttggctagaggcttataagaacaaaatccctaaatcatttctcaacatgcatgtgaaccaagaagtatctacaagagtcaagccaaggctattgtgcaagcaatcaatggggcaaaatacaccgaataaaatagatgatgatgatggctcaaaatctcaccaagggtaa

SEQ ID NO: 83026 - DNA, 222 bp, Glycine max
  Peptide Sequence Number=SeqID_174711
atggaatgtgatgcaatcctacccccaagggtattggatagaagactccaagaggattgggctagagttgctaaagaaggccctggtgttctcatgaacctcgggctaagctctagcttctctaggaatcttctcaaggaagcttctcaaggaagtttctcaaggaagcttctcaaggaggtgagcttagttattagaggggtgtatgtagctaagctctag

SEQ ID NO: 83027 - DNA, 165 bp, Glycine max
  Peptide Sequence Number=SeqID_174712
atggctccgcctaaagaaattgcgaccgtcatttaccacaatggtcacattgtagacaacccagttcagggatcggtggtcaaacacattatatttcaacacaactacttgataatgatgatctcagaggcgcaatggaaacaattgtccaaaatccacaattaa

SEQ ID NO: 83028 - DNA, 132 bp, Glycine max
  Peptide Sequence Number=SeqID_174713
atgatagctcgcccaggtgagctgttacttcatcttgaagcaaccttgcttgcccaagcgagctcagctcgcccagcaactggtgtcaagcatctcaattcagctagcaagaatcaaaatgttagcaaatga

SEQ ID NO: 83029 - DNA, 1458 bp, Glycine max
  Peptide Sequence Number=SeqID_174714
atggcgtcaggacacatggaagctctggttgggtatccgggcaagctcacccttagggtggtcctaacatgtgtcatggcagccactggtggattaatttttggttatgatcatggggtttcaggtggagttacctccatggattctttcttgaaggaattctttccttctgtctatgaacaagagtctaccatgaaagcttcaacagatagttactgcaaattcaacagtcagatattgactttattcacttcatctttgtatctaactgctcttgtggctggtctagtggcatccagcataacacgattgatggggaggcgtgcaactatgattataggtggcatattctttgtgttaggtgcattactcaatggattagctacaggtttatggatgcttattgttgggagaatgttgcttggttttggtattggatgtgccaatcagtcggtaccaatctatgtctcagagatggccccttataagtacagaggaggtctcaacatatgcttccaattatcaatcaccataggcatcttcatagccaatctcttcaactactactttgcccatatacttgatggccaaggatggcgcttaagtttagggcttggggcagtccctgctgtcatttttgttgtaggctcaatttgtcttcctgactcgccgaactccctcgttgagcgtgaccgtcttgaggaagcaaggaaagaactccaaaaactccgtggtaccactgaagttgatgccgagttaaatgatatagttgctgctagtgaggcctccaaaaagcaattcactggcctaaatgtcatcacattctatgctcctatactattcagatcaattggctttggaagcacggcttctctcatgtctgcggttatcattggctcctttaaaccaatttcaacccttatttcaattcttgttgtagataaatttggaaggcgtagccttttccttgagggcggtgctcaaatgttgatttgtcagattactatggcaatagcaattgctgttgcatttggcactagtgggaaccctgggacgttgccaaagtggtatgcaagtgtagttgttggtgtcatatgtgtatatgtttctggttatgcttggtcttggggtccacttggatggttggtaccaagtgaaatttttcctctggagattcgacctgcagctcaaagtgtcactgtttgtgtcaacatgatcagcacttttattgtagcacaattcttcaccacaatgctttgtcacatgaagtttggcttgttcatcttctttggttgttttgtggtgataatgaccatatttatctacaaattattacctgaaacaaagggtatcccaattgaagaaatgactatggtgtggcagaaacaccccatctggagcaaatttttggattctaacaaaagtgttcaaatcagcaaccaagattccaaatgttga

SEQ ID NO: 83030 - DNA, 503 bp, Glycine max
  Peptide Sequence Number=SeqID_174715
atggtagtgggaaatgcaactatagaaaaacctagagaagaatgggatgatgatgaaagaagaaagcttcaagaacatgaaatgggacttatgagactccatcaacatgaagagaatgataaaaagaggaaaggaatagcattcaaagcctcatcatcttctattcaagaagaaagtgacaaagaagacttgaatgaaatagaagaagatgatgatttcagattttttgtgaagagattcaataagtttctgagaaacaaaagaaaccaaagaaaattaaacaccaatccaaagaagaaaggagaagattcctccttagccccaaaatgttatgaatgcgatcaacctgggcacttgagattcgattgtcctactatgaaagcggagaagagttggcacattgatagtggttgctccaaacacatggcggtagatgcatcaaagattattcatatttctcccaaagatagtgaatatgtgatctatggagacaacaaacaaag

SEQ ID NO: 83031 - DNA, 822 bp, Glycine max
  Peptide Sequence Number=SeqID_174716
atgactgcatcaccatatcgggatgcaaatttggctaggcaacaacagcaacagtcgctagaggtacaggtagagccaaaggcacaacttgagataccacatgttgactgtatcatcggactcctatttggaggaggccctatggatttgtcggtgcttcagtcctatacggaccacatggttgggcatgtatggattgatcaacttagagaagagatgaagcttaagagtctattcgatgcgtggtacacattcgcgattaaaggcataatcaatgcctttattgagagatggttcagttatacctactctttccaccttctagttggagagatgaccatcaccttcaatgatgtgtcatgtcttttacatctgcctatctcaggcagatgttgcaacaagaaatggaaattgagtgtgtttgatttggctacgaaggcgtatttgctacgtttcctcgataataccatatttgccgacaagagcttgacacatcttatctttatgattagttgccgaatacgtgcttgtatggcagcaagtagtgggcagctatatgatgctactaatgcatgggtgtttaagcatcttcctaccattccttgccataagaaggtgttggattttgatcgcaagttacgcgagaagccgcttgcgacaaaatggttgcctttgaggggtaccggtaaagttgttgagaatagggagttgttggatctgttgcagatgactgatgttatgtcgtcccatatctggatcgcaaagacatcaaacctttggaggagtagacatatttctctagctacatcagaattgggataa

SEQ ID NO: 83032 - DNA, 327 bp, Glycine max
  Peptide Sequence Number=SeqID_174717
atgtggacgatcattgaccggtataaagagaagctaaatctagctgctagccatgagcaaagactagaggacgagcattcaaaagtatcggctctgcaagtggaaagggaagcaagagagagaatgatagattcattacatggagaagctatgacgtggatggacaggttcgttttcactctgaatgggagtcaagagcttccaaggctgttagccaaagccaaggcaatggcggacgtgtactcagctcccaaggaagttcgtgggcttttcaattattgtcaacatatgatcgatttgatgtctcacataattaggaaccgttga

SEQ ID NO: 83033 - DNA, 207 bp, Glycine max
  Peptide Sequence Number=SeqID_174718
atgcttccatttgatttccggtgtgccacggaaacttacggattgtgcatcaacatttttttggtttttcggcatgtcctggaatttcataaattgcctaatgatgggtgccaagcacctcacaaggaccaaagaatggtcgcatgtcatcaagcaaagtcctggccgagtttagtccaacaagaggaatctacggataatgcttga

SEQ ID NO: 83034 - DNA, 203 bp, Glycine max
  Peptide Sequence Number=SeqID_174719
atgacaggagagttaatacttgtcgcaacctgcccttcggcgggagggcgacgcgtgactcacgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcacggggaag

SEQ ID NO: 83035 - DNA, 448 bp, Glycine max
  Peptide Sequence Number=SeqID_174720
atggctactccacctgcctcgcctcctcctcctccttctgtagtagcattagtgtctccgtctaccttgaagtggaaatgcaaagtcacacgactacgatccttggccactagactacctggggtagaaagaccagtggtccacgtcgatcctgcaattgggaaggccaacggtccccacaagaagaaattaagaacatatttggggattattgctcgtgataaggtcgacgtgacatacgagacttggaaggaagtccctgctgctcagaaggatttgatatgggaggatattcaggacagtgtggacgacactgtttctgaaaaatacgacattagcaaggagaaatgggcccagttttgtcagacccacagagacccctcgtgggagaaaaaggcacaggccatccagaagcaaaacactgccctccacgtgttgtctcgtgggg

SEQ ID NO: 83036 - DNA, 300 bp, Glycine max
  Peptide Sequence Number=SeqID_174721
atggaggagtcattagaaacatccttccagtcttttgaggtagtaagcattgcctccgtagattccttcactgggcaaccttgccagtccgatacgacagtaatggtggcccgggtgatgttggggaatggctacgagcccggaatgggtttagacaagaacaacggcggtagaacctacctgataagcaccagaggaaaccgtgggaagtttgggttaggctataaacccacacaggcggacataagaaagagtgttgtgggaaggaagagcggaagccaaggctcgcaattgggatga

SEQ ID NO: 83037 - DNA, 225 bp, Glycine max
  Peptide Sequence Number=SeqID_174722
atgcttcgagtatgcatgaaatggccccgaggaagcttgcctcaaagaggtccaggaaggataaagcggccgaaggaaccagttccgctcccgagtatgacagccaccgctttaggagtgctgaacaccagcagcgcttcgaggccatcaggggttggtcatttctccgggagtgacgcatccagctcagggacgatgagtatgccgatttccagggggagatag

SEQ ID NO: 83038 - DNA, 1027 bp, Glycine max
  Peptide Sequence Number=SeqID_174723
ggccgcgtacagcagcgccttgacctctttgagttgctgcccagtggtggcttcgttcttctgcatgcgccccagggggccgggccaccacgatggcaaagggttgttcataggccttgaagcccagcgagatggacatcacgtcctcgacgttttcgccgagcgagcgttgccagccgcgctggatgccggcctgcaggtcgcgctcgaaggcggcctggctggtgagggtggtctcggtggccttgcccgagctggtggcgtgcaccgccttgaatccgcccgcctggtgcgagaagcggatggtctgcttggattcggcgacgatcagatagaccaccttgtcgtccgccagcttggccagcagggcggtttcgccggtcaggtcgcgcacccgcgccagcaccggctcgatcaccgcgttcagcgggtcgctgcggcagatcagggtggcgacgtggatcagcttctgcgtcgggtaatagccgtgtttcttgccgatctcgtagagatagccgcgcgccaccatggtcttgagcaggccatggcagctggacagcggaatctccatctgcgcggcgatttcgctgtacagcaatggcttctgcgcctcggcaaagaggagccgcgccatatgagatggaagaaccgtcccgagggatcgaactggggggacttcggccctgatgaccaacggggctgcctgaattacatcactcccgcgaacgtgatgaagggaatccaggaggttcgcgaaggtttgagcttctgcctgtcgctgccgctggactatcccggcggcaatggcgtcaacgtgcgccgccatccgcccaagctgcgccccaccgagcgcgacggcgaccagtacctgaacttccccttgggccgcctgcgcccgggatgcgtcgacgtgctgagcgacgacattgtcgagatgagcctgcagtattcgacccagtgggattcgctggcgcacgtgggcgcgttgttcgacgccaatggcgatggcctgccggggatcctctag

SEQ ID NO: 83039 - DNA, 465 bp, Glycine max
  Peptide Sequence Number=SeqID_174724
atggcatcaagaaagagggctagaaccgacgacatcccttcatcatccatcccagctcttcagtcaatcgccatagaaccagatgtccaacacccgcaaactttagtccctatgctacagagcctattcagaggacagctgattatcatgcacagcctgcgagagttggctcagaacaggccaattgtacctctggaatattttcttgagaaagtagcctggcctgaagctcaacttccattggtgagaaccgatgaggttgctccttcggagcccacactggcacgggttgaaccaatgccagccgagccacgaactctagtggtgaatccacctccttcttctgagcttgaagtagttcccccatctccacctctgattatcatctcttatgcatcatcagatgaagctgttgcccctactgattcaccagctgaagaaacagttgacccccttgcttcccta

SEQ ID NO: 83040 - DNA, 165 bp, Glycine max
  Peptide Sequence Number=SeqID_174725
atggataagagcttgaaggtaggagaagatgagtggaggaagaaggagagaaggagcacaaaattttgtgcctcaaatgagctatggttcagcctactaatccaagatcaagtccaagattctctaccaagtgtgcttaggtgtcatgaggcatgtaaagcatga

SEQ ID NO: 83041 - DNA, 441 bp, Glycine max
  Peptide Sequence Number=SeqID_174726
atgaacaagagaaagccaaagaagatcagcttcattccaatattggtatatggcagcaattgctttctaattcctcaacagaaagtggttttcgagcagtgcgtgacgcggactctgtctccggcgttgacattggaggagggacttgagaaactgaaggaggctctccaaatcttgaattatccttccccttcttcccctactgtcctaagaccttcactttgttttgctcccaaccccactcctcctcggtctttcctctcatttataaagaaaggttctttttggttttccatacctcagattgagttagatgagctggaaagtgtttccattctgtcaatgacccttgcatgggatgaattttccttctctacttttcaagaagcccattattcgcttcaagattctctagaccaggtgcctgacatgcctttttga

SEQ ID NO: 83042 - DNA, 966 bp, Glycine max
  Peptide Sequence Number=SeqID_174727
atggcgtccagcctctgcgggctctccggatgccaactgcccatttcatgcaagcggcatgccgggtgggtaagatacatggtctccataaggaagattatgttcatctgtcggcgattactgcaactcggcacgctttcggccctgctggccgggtgctccaccaccgctcccaccgcccccaatccagccgccggccagccgccggcggccaccaccggcaccacccccatccgcatcggacccagtacgccgacactcggctccgaacccgccgatgacggcccggcggccctgacgcccagcggcgccctgcggccggaggtgcgcgccttcgtcgaaggcctggccgccgaacgcgacctgccgctcaagcccatggtcgcggcgctcgaaagcgcgcgctacaacgccaccgtggcgcggctgatcgcgccctcgccgcccggcaagaaaatctggcgcagctggctgacctaccgctcgcgcttcgtcgagcccaagcgcatcggttggggcgtggagttctacaacgaacatcgcgaccagctcaaccaggcggcgcaacgcttcggcgtgccggccccgatcattgcgtcgatcatcggtgttgaaacactgtatggccgcaacatgggcaacttccgcgtgctggacgcgctcaccacgctggccttcgattatccggaccccgccaagcccgagcgcgccaccatgttccgcggccaattggccgacttcctgacgctggcgatgaaaggcaagctggacatggaaacccgcggctcgtatgccggcgccatcggcatgccgcaattcatgcccaccagcatcaagcactacgcggtggatggggacgacagcggccacatcgacctgaccaacaacacccgcgacgccatcatgtcggtgggcagtttcctgtcgcagcacggctggccacgcggcctgccggtgttcgcgccg

SEQ ID NO: 83043 - DNA, 576 bp, Glycine max
  Peptide Sequence Number=SeqID_174728
atgcccttgcggggtaggattgcatcaaataaggacactcttagaaaatacttctattctccaaagaatgaacctcagaggagatggttttttcaacattttaagagttcaaatagaaaacaaatccaagacaaattttatgaatttgttgaaggagtcaagatcaaagtcctttcctttgattggtttcatgcctataccattagagaaaacatagattacccgtggaaacaagataacataggtgattcaacaactaatgtcattaccaattggcaaatcaaggatggcgagttaatccaatcggaactacctcccacaacacaataccaactactaaaagtcaaagacagtaatgataaacctgtcatggccagtccgttcaaaacaaaagatgttaacaaagaaataacttccaaagacattaaatgcctaatggaacaagctaattacaccaataaatatctacaagttttaggggaatccattaaaacaaaggcaactcctaaacagaaaagtcatgaagaatcttcgtcatatatccctatagaaaaacccttattcaagccttttaag

SEQ ID NO: 83044 - DNA, 228 bp, Glycine max
  Peptide Sequence Number=SeqID_174729
atgcaagccttgtatttaaactgcccacaactcaatgatcttaatctaaattcttgtagaaatttgcatccaggtagtcattttacgccatgctctattgccattatcagccagaaatttgatgcaacattacagatcatccagatgtatggcctaggctttgtgagcactggtggatttggtatgccttcatactttcctttctttccttataccttgctatcatag

SEQ ID NO: 83045 - DNA, 434 bp, Glycine max
  Peptide Sequence Number=SeqID_174730
atgcatactatagagtttcaaaaacgaggactccctcacgtgcatttattactatttctacatccagacaataaatatccatcttcaactgacattgatcagataatatcagctgaaataccttcccatcaagatgacccagaactctacagattggtggagaagcatatgatacgtggcccatgcggaattttacaacccaactctccatgtatgaaagaaggcaaatgcagtcatttttatcctaaacaatttcagcctcagactcttttggattcaaacggttatccagtctatcgtagaagaaacaatggtcattcaatttcaaagaatggctatgacagggtgactgctgttatgttttctgatagcaataacgcagctcaaaatgtaaatattcaaaatgatgaacttaaagaatatctagattgcag

SEQ ID NO: 83046 - DNA, 157 bp, Glycine max
  Peptide Sequence Number=SeqID_174731
gtcgactctagaggatcccaccatcgtgactgccggtttgaaggatgattggcacaagtggttttctgatggatcaccgttagacgtggaggccatcacaacagttcggcagaaatgggcaacttactttttaacttttaggaaaagcagttgctaa

SEQ ID NO: 83047 - DNA, 869 bp, Glycine max
  Peptide Sequence Number=SeqID_174732
atgcatgcgcgtgtcgccactcggcgagctcagactcgccgccgcgaattcgagcaaatgttcgcgtcgacatataattgcatcgaacgcgtgcccatcacgcatatgtaccgcccagaattcggggcgtctaacgcgttcgcccgcgctcggacgtcgacgtccttgagaagtgatgcgcggttcgtcagcaattccgatcacccttctgcacttggatcggggggtgattgcggcgtacgcatccaagggtcattcaccggagcggccatttcggcgccattcgacagcgcggacgcgagctttacgttatgtgaaaattgcgctgcagcactagtgggcaaagcggcggctcagcatggtctttgctacggccacgtggatgctagcgtattgcgtcacgttgtttgtcgaactggggcaatagcgagcaaaaactcacggcctcggcatcaggcctcagatagactattttggcgccagtgtgtccgtctcggggaatacgctgtggttgggagcgtatggccgatgacgacacgggagtcaaagtgcgtgtccgtctccggggactacgccgtggttggagcaccgggtgataactctaacgcgggcagcgcgtacatttccgcgatcaaattcgaaaaccgtgccgctttgaaagccgcagtggacaattgtttggcggcagatgacacaggcaactgcgattgcagcagtgcttctgtggactgcggtgccgctggaagtcttcccatctcgcagtgggacacgagcttgatcacggatatgaatcacctgttctacgacgaaagttcattcgacgccaatatcagcgcgtggaatacggcgaaggtgacgaaaatggatag

SEQ ID NO: 83048 - DNA, 414 bp, Glycine max
  Peptide Sequence Number=SeqID_174733
atggccccaaaatgcaagagtagtgatgctggcaatttggagagaacaaagcacccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 83049 - DNA, 462 bp, Glycine max
  Peptide Sequence Number=SeqID_174734
atggcgaaaactaaaagccgtgagcgcagcccctatcaccgcgtagctaacgcactgcataaaaagggattggtagcattcgcgtttcctgttggctggaggaacccaatgaacaagttaaccgcagaaattgcactccgtaacatcaaccttctgaaggaaatgcaatccgcgccaaacatcggtttgagcatgcgctctgagctattcctgcaagcccttgagattgcactccccatactggagcagcaggagaaaggcgagatggcaatcttaatgaggggtggggctacccatccgtttggtcgaataaagaacactatttccttgatggtcaagttaagagcctatgtggcagaaggaattgggagcatgaatttcccagagatcgcacaggatgggaaggtgacgaaagaactgaatgctgcgaatgtatccgaagaatggaaaaaatgggattag

SEQ ID NO: 83050 - DNA, 150 bp, Glycine max
  Peptide Sequence Number=SeqID_174735
atggggaattacgctcagagctcatgttatggacctgcgcggcctacccgactcgacgacattaaccgctcctcctccatgattggcaagccatgcactgttcgattgagtggcctgggattttcccatggtacgcgcaagttgtgttag

SEQ ID NO: 83051 - DNA, 72 bp, Glycine max
  Peptide Sequence Number=SeqID_174736
atgaatgtggtttcactccttgtacgtggttcctattacgtgatttctgtgtttggtttagttagaatgtga

SEQ ID NO: 83052 - DNA, 423 bp, Glycine max
  Peptide Sequence Number=SeqID_174737
tgaggaaaggaaggttcctttggctacccttatcttccaactctattggtggaatttccttgttagggaaagaaggattcatggggatcctccagtagagtattggaatgacttgaaaagtgcccttaggaagaggcacgacacatccccttctactatgaaagggagcttatggacaagctctaaaggcttagacaagggactatgggtgttgaagaaagtgaaggacaaggttgagctctttccatatagggacctagatgacttagtccaactttgcataagggtagaacaacaacttaaaaggaagcctacttcaaaatcttatggctcttactcttatccagagaaagaccaaggtcaaggcatcttaggggctgcaccttctaagctcaaagatgataaggggaggacaatagaaaa

SEQ ID NO: 83053 - DNA, 340 bp, Glycine max
  Peptide Sequence Number=SeqID_174738
agctttgatcacaggactctgccagttgttcggagtccccgtcgcacctagtaaggtgattcggcaacccatcacccaagcttttattgagaagtattgcacgcagagacaggcacagggtggcgaccctcaggccccagatgcgccgcctccacctcctcaggctgacccagctgggtcatttgacacggagcgggaagaggtcgcatggcccggagattggcctgaggcccaggctgcagaggcatccgcagaggctcccggcgagccagatgaggcccgcgaggatgaggagatgtcagatttgctcggcttcttgggagggagtggagccacatga

SEQ ID NO: 83054 - DNA, 429 bp, Glycine max
  Peptide Sequence Number=SeqID_174739
atgcagaggactgacatcgtcttcggcaccttttgttcccgcgggaacaacaagtcatttgcatacggaaattttaatggtcacccgcgactctcgtcaaccgagaggaacgaaattagtgtcttatctttactttcctggtgcttggcacccatcattaggcaatttgtgaaattccgggacatgccaaaaaagaaaagaaaaattgatgcgcaatccgtaaggttccgtgacacaccagaaatcaaatggaagcatcgttgcacgattagtgaggggggtgtacttagtaaaaatgggggtgcaaatagcaaccaggcccacttgggccctccagaagattcctccagaaggctgttgcttctggaggaagcaaccctgctcgcctgggcgagctgggtggcaagcttctcccccaattttctataa

SEQ ID NO: 83055 - DNA, 546 bp, Glycine max
  Peptide Sequence Number=SeqID_174740
atgggtaaagcggaggaggtacaagagcagatgaaggccaacatggaggccatgaaagagaaaatggccacaatgatggaagccatgataagcatgaagaagataatggaagccaatgcggttgcagttgccgctaccagcactgttgctaaggtaaacccgatgcccccatctggcctcaaccaaatgaatcatccaacctcagctattgtaggcaaagatttgggaagtacgggcggcccccattatgtgcaaattcaaaacaagcatgccttcccaccatatggcttgcctcccaactatacaccacccaatgtagcgtacactcccagtgagaatgtcaataactccactccgatactcattgagagccgacaaccccaaactgatcatgcacatgtctctcaacccatgggtgagacacatgaaatgccccaccacaatctagccgacttcgagccttgcctcggatatgccactgaagggcaggcaattgatggtatacccctacaaaaccctttggagggccctcagtatcacccctag

SEQ ID NO: 83056 - DNA, 498 bp, Glycine max
  Peptide Sequence Number=SeqID_174741
atggggttgaatcaatttagatttttcaacatggtccatgatatcttggtcaaggtgaaactggaagtaacaaggacatcaatggtcctaaatgtgcttggcaatagacgaagcagtgataaatgggtttatgatcccaacatggttggctcatggtacctaacacatgcaactaagaatgcttttgtttttattttgcagaggaaaacatgcgcaaaagcgcaactgggggatgtacacaacatgacaatatccacaaataatcatacagcaaaggcatacacgacatttaggtctacatgcatggcagtgttaaaaatggcacgcaacgtgtttgctccgtgcccctattttagggacctacacgggaggaaactaaaagggcttttagtgataattcccaaggtggtcatatctctcttgatggtctctagaggtatcatccccttcgaagaacatattacggcagtagggactactagcaacaatatgttatga

SEQ ID NO: 83057 - DNA, 270 bp, Glycine max
  Peptide Sequence Number=SeqID_174742
atgggtactaatgccatcaaagaagaaaagagaatgatggatactgatgccagcagagtaaaagagaaatcaaatgatgtttctcagcaaaaagatatgcttggacttagtagagaattggtggaacacaaattgtctatctgtgaaggtaaaaaattagtgaagcaagcaccaagaagatttgctcttaatgtctcaaaggctatcaaagcagagatcaaaaggctactgaaggccaagtttattcgaactacaaggtatgttgattag

SEQ ID NO: 83058 - DNA, 411 bp, Glycine max
  Peptide Sequence Number=SeqID_174743
atgatgctctctcgcccatttattgaatactgtatatggggttgggacaacttacccagaatagtcttgatgtattacgccaactttctgtcttcccccgaagggtattttcacacagtcatctgcaatgccgaggagtttcgtaacactaccgttaatcatgacctccacttcatatcatgggacaaccctcctaaacaacacccacattttcttacagttaatgactaccagagaatggtggacagcaatgctccatttgctaggaaatttggcaggaatgaaccagtcttggacaagattgatactgaactcttgggacaaaatgcagatggcaaatcggtgtttttgacacctgagtttggaatgccaattatgctcattgctgcccttccatcatccaacagctga

SEQ ID NO: 83059 - DNA, 548 bp, Glycine max
  Peptide Sequence Number=SeqID_174744
agaagcttcaaaatggaggattgagggattttctccaccgaatccttgaggaggattatgagaattccgctctgattaaagtgttcctcttggtgtgggggttctgcggtaagcaatggtggctcgcggcagccaccagtggtcgtgggtggtggaaaatgagacttagtggtggtcaattgagatggagctcagtggcagcttgggttggccttatgaggaataatgttgttgattttatgggaggattagcttgtaacttgggtggtagttcagtccttcaacactacagagaagcaacatatttagtgattgaaggttgtgatgaactaaatgacaacttcttcatcgttcgagctatcaaggaggctattggtcctcaaatgcacatatcttttaaacacatttttagagaagggaatgtagtagctaatgttatggccaaatttggcctttccatgagccaggggattttgttctttgttgatccctcgataagaaataggcatggtaatgaggctcaggttcaggttttctccgacaactaa

SEQ ID NO: 83060 - DNA, 252 bp, Glycine max
  Peptide Sequence Number=SeqID_174745
atgcccttgcggggtaggattgcatcaaactctttcatggcaatggctggagtttgtaacatcacagtttcgcttgaaccccaaatccccctcccttcccgtaatttgccacttacggctgccccaagtgtgatgcaatcctaccccgcaagggcattggatagaagactccaagtagattgggccatagatccaagggaaggccctagggttctcatgagccttagggtagattttgagcccatgggctaa

SEQ ID NO: 83061 - DNA, 591 bp, Glycine max
  Peptide Sequence Number=SeqID_174746
atggacaaggtagaggcaactgaagctctgataccaaatgttagactaaaaattttaacctgtggtgttacaaactacaaaaagaaatacaggtgtatccaaatatacatggatctcttttactattttgttgaatcaaaaactgatccagcttcaaagcctcttattctctggctcaatggaggaccaggttgttcttctcttggaatgggtgcattctctaaaaatggaccttttagaccaaatggagaagttttgattaaaaatgagtacagttggaacaaagagttactttgtgatggagaaacaaacatgttgtatttggagacaccagttagagtgggattctcttatgctaaaggtggctcctcctatgacactgtgaatgatgagacaacagtggcatcaagcataggcacagtggtggccttgaaagacaaattaggtgtatgcagatggaactatgccttaaggtcactacaacatcatgcaaagaacaacatcggatcttatagccaagctaggaaattgtcctctacatcctctactgcggttttcaatagaatactcaacaaaagaaaggagatgtga

SEQ ID NO: 83062 - DNA, 249 bp, Glycine max
  Peptide Sequence Number=SeqID_174747
atggcggtgagaatgtcaacagccttaacggaaaccttgtggagggcgttgacggagaggtggccttggtccctctcgcgatgccgcaagatcacgatgaaccctagagatgggattcgaagagagacaactcaaagagtgagagtgcgagagagtgtgatgaaatcctaccccccccccccccaaggacattggatagaagactacaagaagattgggccagagatgcaggagaaggccctagggtag

SEQ ID NO: 83063 - DNA, 198 bp, Glycine max
  Peptide Sequence Number=SeqID_174748
atggttcagctaagcgcacatcgctgcgctaagcccaacatcttcactgtagtggcgctaagcctgaatcactcactgctaagtgcatattgcagaaagatttttggtgttgcagaaagcgctaagtgttgttgttgcgctaagccccaaatgcttactggaagttataacttcaggttgggcttagcgcgaggctag

SEQ ID NO: 83064 - DNA, 591 bp, Glycine max
  Peptide Sequence Number=SeqID_174749
atggatgaacaagatttaaggatagaccaagaagaaccctctgagtatcttttaaaattagaagcagaagctgtaatgcttggccagacctctgtggttttgaccattggagaagttattcccatgagcatggtcctaccgggtgtcgttgggttcaaattattaggcaaactacgagatggggaaggcatgaatgaactgtctttggcagatcatgccaccatagcaaacatgtctcctgagtatggtgtaaccatgggcttctttgatgtggatcgtgtcactttgcaatatttgagactaacaggcagaagtgatgagattgtttctaagatagaatcctacttacgagcaaataagatgtttgtggattacagcgagaaccctgtgtctcaggtccaaaaagttagcaattatgtgatgtctaacaacattgtggagtgtagaagcaatgtcttccaagattattttgatgatgccaaagaatcaagagtcaataaagtttctagaatcaagatcaagattcaagattcaagaatcaagactcaagattcaagaatcaagagaagacttaatcaagataagtattaa

SEQ ID NO: 83065 - DNA, 120 bp, Glycine max
  Peptide Sequence Number=SeqID_174750
atgtgtcgtgctgggcctataggcgctacgggtcgtgccctgcgtgcaagtgcgttgacccgcgcccttgtccaaggcgccttgggtcgcaccgtggtcccaggcgcccttaaaaacacg

SEQ ID NO: 83066 - DNA, 1851 bp, Glycine max
  Peptide Sequence Number=SeqID_174751
cctatccctcttaagttattgaggccgctggtccaacagtatctgcgtgaaggcaatgcctatcaggaggtatgggggaagaactatgattcccatgttacaaaggcggtttaccaggagaatgatgaaaagaacctcccctttgaccttccacacaccatctacatcaacatattgaggaacctgaagggtttagatggtctagacaacatctattattccactctcatcaacaagattttgtggaatcaaggagtgtaccacgtcttcaacaagatgtacgaagactctaaacacaccctaatatccaagggcttagttgttgctaaacaacaaaagttgagcaagactaacctaaatgttatgaagatagccttagaacaaagtctgaaggaggctcatttggtggacttggaagctatcaacaaaaggaagcaaaagatgctagccaaggccattattgatgaagaccaaggtcttaatagctttggtatcttccgaaagattcaaaagattatgcacaggacgaaaagaagacataagaccactacgtctgcccctgtgcatccaccgaccacaacctcagtcccacaaaggttgaaagacctaagtgagactgatgaagaagatgaaggtcttgtacaaacatatcaagaagagggcaaccaaggccaacctaagattggtgacaaggaatgggcagctgcctttactgggaacaaggaggactcagcctcatcatcatcatcatcatcatcaccatcatcatatagtgaggcaactcctagggaacctttaacaaatgctcagaggtttcgtttggcatttattaatgataatcctacacctgaaaccccatactctgagtctatactttatgaacctgttgcaagggaaacaatcattgtccaagcacctacctggacaaaacatgattgtgagcatactccaactgaggcctttaaggctctaccaataaatgtcataaagggacccttcgcaagaagtggaaccccaaagatcgagtttcagaaaaaggtgcatatgtggatgccaatcaccaaactcttactagtgcatcctgttgatctcaatctctctcaagaagaatgttcatcccttggcaaattgcatgaacaaatgtacttgaaagaccacgccattgcccaccctcttggtctacacatcttaagggccaccgatattaagatggttgctgataaagtaagtccatgcctacagaagttgattcgcactcctgatgtttatgatgccaggacattatggaatcaaattgtatggatggactctaaaaaagccttcactactggctatgatggaagtgataatactgagcatcacgatgtcattcaagtgctacgtcctgttaggaagtaccactttgatgatgcttgtgtctacttcaaaaaggataaggatgaggaagaagctgttgctattgtcgtgaaagaagatgttgcctcagtccaagctaaagtatctgctaaagttgtggatgacaccattgtacatggggttatcattgatcttaccaacactggtgtcatggacgaaactctggaggcatctaatgcaactataaatggcgaagttgaacgcaacgctcttgaacttgcatccaagcagtcaataaatgaggctacttctatagacaagggcgaaactaacactatcattgtctactccactaattctgaccccactcctctgaactatgcacaattcaccacagttactagagatcaagtgcaagatatgataaggcaagccatagaaacttttgccaaacaacaatgtcaagagaatgagcaattcaagctctcaatgtag

SEQ ID NO: 83067 - DNA, 258 bp, Glycine max
  Peptide Sequence Number=SeqID_174752
atgcaggtggaaatggtcgtgcagaagacaaaaacggagaagacgaaaggggagaagctacgaaagaagagaaacgagcaagaagatgcggaagaaggtagtggcactggaaatacaaatatgccaaagtttactgatcaaagacagaataaatcaccacaaggatttatagaagttaaatctctgctaatttataggaaacatgccctacttctcaagtctcatccttcccctggtacaacatcgacggggaattaa

SEQ ID NO: 83068 - DNA, 114 bp, Glycine max
  Peptide Sequence Number=SeqID_174753
atgagtgcgagagagaagatgcaagcagttcagcagtttctagcaaataggggtatgcgcttagcgaatgatggatcagttagagctgacattgtcgtagggatttgggcttag

SEQ ID NO: 83069 - DNA, 542 bp, Glycine max
  Peptide Sequence Number=SeqID_174754
tttctatccaaggggctaggagggagagggcgaggccaactgagcttccttccacatctgcagctcctactctagcatccacttcagcagctccttcagtcccagctcagagatccattccttctgttgagcagtttctggagagggtagcctggcttagggcccaaccttctctttacagggaagatgaaggtcccacagcccaggtaccacaacatgtagaggatgagtcatccgaggccaccattctaaagccattcattgtagaggaggaggcaggtgagacacaggttagacatgaagttgctgccactcctgagagatctcttaagggcacttcaaagccccctgcaccagtggtggacctatcctcgcctcagcatgcagtagacccctccactcctatactagagataccagaggacccaaccacaccaatcctgactctgaacacttctccttcagctactccagtacttcatctgacagatgaggaggatgttcagacacaggacactcaggaccagtcacaggaattctaa

SEQ ID NO: 83070 - DNA, 321 bp, Glycine max
  Peptide Sequence Number=SeqID_174755
atgtcgcggaacttcacggattgcttaacgatgggtgtcaagttcctcgaagcggtcaagagaaggttgcatgccatcaaacaatggtccccggacgaaattaggttatcttcgcatgcaacttactcgctgaccctggatgacaaaggcgcggaattcgtctatgcgcgtttaccacccaacttgctcctcttcaatgataagggtaaaaagtgcgggaccaaaatggttcccgcatgtcattgggcccgccgcctctggatgacaaaaggtgcagaagacgacgttagtctctgcgtgctatcatgttttgagtcttag

SEQ ID NO: 83071 - DNA, 836 bp, Glycine max
  Peptide Sequence Number=SeqID_174756
tgggaacctcttacgtgccgatcaacgtctcattttcgccaaaagttagcccagagcttcccgagtatcaacagagacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgataggagcactcaaaccgtgtgacccccaacccaagacctacactctgaagagtctgcagggcctctccctcctgattcagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccagaagatacttaa

SEQ ID NO: 83072 - DNA, 928 bp, Glycine max
  Peptide Sequence Number=SeqID_174757
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatgatgttgtatgatatattctatgtttgggttctgaagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccagcgtttccccctggcggctccctcgtgcgctctcctgttcctgcctttcggtttaccg

SEQ ID NO: 83073 - DNA, 207 bp, Glycine max
  Peptide Sequence Number=SeqID_174758
atgactaaagacatttttgtcttcgaaatattaccgtatagggcgtctctgcatgctaccggacacttgagtctgacgccagaaatgagactttttcgcgatctcggccagaagacgctgacatctctgggaagggtgcagatgaccacatgggtctctgcgtgtcaacgggctcgcttgcctctagctaacgaaaggtatggataa

SEQ ID NO: 83074 - DNA, 252 bp, Glycine max
  Peptide Sequence Number=SeqID_174759
atgcctttgttgaaaggtggaggccagagacacacatttcatttgacacatggggaggccaccatcacactacaagatgtgtctgtgttgctaggtcttcctgtggatgacaatcctttaattggcagcacaaatattgatgtgattgatatgtgtgaacaataccttggagtcaggccaaatgccaatgcattggctgacggaaacacattgaaattaagttggttggcttcagaattcgcaaatatctag

SEQ ID NO: 83075 - DNA, 731 bp, Glycine max
  Peptide Sequence Number=SeqID_174760
atggcacgcagagacaaattatggtcattctgcgccttttatcatccagaggcggcgtgcccgatgacatgcggagacaaattatggtcattccgcacaccttttcgccatccagaggcgatcgtgtccgatggcacgcagagacaaattatggtcattctgcgcctttccatccaggctcgatcgtgtccgatggcacgcaaagacaaattatggtcattcggcgcccttttgtcatccagaggcggcgggctcgatggcatatggagacaaattatggtcattatgcacaccttttcgccatccagaggcgatcgtgtccgatggcgcgcagagacaaattatgttcattctgcgcctttccatccaggctcgatcgtgtccgatggcgcgcagagacaaactatggtcattctgcgccctttgtcattcaagggcagcaagtcaagtgataaacgcgcagagacaatttatggtcattttgcaccctttgtcattcaagggcagcacatcaaggcagcaagtcgagtgatgaacgcgcagagacgaattatggtcattctgcgccctttgtcattcaaggacagcgagtcgagtgataaacgcgtagagacaaattatggtcattctgcatcctttgtcattcaggggcagcgagtcgaacacgatcgtgtccgatggcacgcagagacagattatggtcattctgcgccttttgtcatccagaggcg

SEQ ID NO: 83076 - DNA, 168 bp, Glycine max
  Peptide Sequence Number=SeqID_174761
atgaacaaagacttagaagtagcagcaactccagaagaagaacctcgatcttctgaggcgtcttctagctttcctattccagggcaatctcatacagatttaattgaagaagttattatggctgaagagccaagaaaagtgaccctggaagattactcaacttccact

SEQ ID NO: 83077 - DNA, 207 bp, Glycine max
  Peptide Sequence Number=SeqID_174762
atggtggaggcctctggtaatcgattaccagtctgtgtaatcgattacacagaggaatgggtcactggtaatcgattaccaaagggcgatgaggacccacttcctgaggtggattctcccgaggaagtcatgtcggcatctgaggcagactctacggaggatagtggcccgagagagatggcgaccaatggaggctcttcatcatag

SEQ ID NO: 83078 - DNA, 619 bp, Glycine max
  Peptide Sequence Number=SeqID_174763
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtacccatgattcttctttctgctttggtggtgagggtgtgggcagatcacctcttccacacaagaaaggacttgtttttcaatccgagcatgcaagcttggcactggccgtcgttttacaacgtcgtgactgggaaaaccctggcgttaccaacttaatcgccttgcagcacatccccctttcgccagctggcgtaatagcgaagaggcccgcaccgatcgcccttcccaacagttgcgcagcctga

SEQ ID NO: 83079 - DNA, 1080 bp, Glycine max
  Peptide Sequence Number=SeqID_174764
atgagtcagcaggatgccgccaaagagcaggccaacacccgcaaaaatgtgcgcattgtttccgttttcactgccgccgccatcggtatcgtcggcgtgctggtgatcctttacgcgtggcagcttccgccattcacccgccatgcccagtttaccgacaacgcttacgtgcgcggccagacgacgtttatcagcccgcaggtgaacggttatatcactgaggtgcacgttcaggactttgtacaggtcaaaaaaggcgacctgctgctgcagattgatgaccgtatttatcgtcagcgggtgcatcaggccgaggcccagctggcgatgaaaattgccgccctgaataacaatctgcagcagcgtaaaagcgctgaggccgtcatcgccaaaaatgacgccgcgctgaaaaatgcccgcgcccagagcctgaaaacccaggcggatttaaagcgggtgaaagagctgacggctgacggttcgctttccattcgtgaacgcgacgcggcgctggccagcgccgcccaggggagcgcggatatcgaccaggcgaaagccgcacttgagatgtcgcgtcaggatctgcagacggtgattgtgaaccgcggtgcgctggaagcggatgttgaaaacgcgaaagcggcgcttgagctggcgcagatcgatctgcaaaacacccgtattgtggccccgcgcgacggccagctcggtcagatcgccgtgcgtctcggggcgtatgtgaccgccgggacccacctcaccaccctggtgccgccgcagcactgggtcatcgccaatattaaagagacccagctcgcggagctgcgcgtcggccagccggtgaaattcaccgtcgatgccctcaataacaaagcctatcagggacgcgtggagagtatctctccggcaaccggcgtagaattcagcgccatcacgccggataacgccaccgggaactttgtcaaaattgcccagcgtattccggtgcgcattgaggtgctcggtaagccagaagattccgcgctgttgcgtccaggcatgtcagtacaggtgaccattgatacgcgggaggcgaagtaa

SEQ ID NO: 83080 - DNA, 47 bp, Glycine max
  Peptide Sequence Number=SeqID_174765
atggcttctatggatacctctgctaaggtcaactctaagatctttcc

SEQ ID NO: 83081 - DNA, 210 bp, Glycine max
  Peptide Sequence Number=SeqID_174766
atggaggagaatctaccatgcatctacgcgctcaacgcgtcatcagctcgctcaacgagtagtttgtcttttctcacgctaaaattggatagagcagggctagataactacattactggagttcgacgagacatccgagaacgaggtttaaatagagttagtccattcacgcgaggaatcggtgtttggtgtattggccctcagcattga

SEQ ID NO: 83082 - DNA, 96 bp, Glycine max
  Peptide Sequence Number=SeqID_174767
atggcctcgatcaaatttggcgccattgccggggagcagtgggccaaagagactgattctgcgttactgttcacgcagcattacattagcgactga

SEQ ID NO: 83083 - DNA, 519 bp, Glycine max
  Peptide Sequence Number=SeqID_174768
atggcgaggatgtgtggtcctctgaaggtgtgggtatgtgaccctctgatggcgacgacgtgtagtcctctaaaggtgagcacgtattgccctctgatggcgaggacatgtagtcctctgaaggcgagggcgagtagccctctaaagacgaggacgtgtagtcatctaaaggcgagtgcgtgtaggcctctgaaggtaagggtacgcgaccctctgatggcgaggatgtgtagtcctctgaaggtgtgggtacgcgaccctctgatggagacgacgtgtagtcctcttaaggtgagggcgtgtagccctctgattgcgaggacgtgtagtcctctgaaggcgagggcgagcaaccctctaaagacgaggacgtgtagtcatctgaaggcgagtgcatgcatccctttaaaagtgagggtacacgaccctattatggcgaggatgtgtagtcctcagaaggcgagggcgtgtagccctctgaaggtgaggacgtgtagtactctaaaggagagagcgtga

SEQ ID NO: 83084 - DNA, 402 bp, Glycine max
  Peptide Sequence Number=SeqID_174769
atggtgtaccatttaagggcaccattgatgaggactagaagtttgatttctccagtcatgatgcccgcagtcaagagatcattttctatcagagtgggaatagttacttccttcagataccgcaaagagcgtgatggctcttgggtgaagaaggacgttcctgcacatgcagtagatgaccgctctccatcaccacctcctcagagggatgactcttcatcccttatgaaaagcgttctcgatagactggatggactacacacgtatgtcggtgagcgttttgactccctggaaagccgcattgatacacgatttgcagacatggatactcgtattgatcggcttgaggaggatgtgagtttcatccgtcagtgcttcgaccttccaccaccgccttcatag

SEQ ID NO: 83085 - DNA, 246 bp, Glycine max
  Peptide Sequence Number=SeqID_174770
atgatgaaagagaagaaagaattgcctaagggagtgttcttaggctttaggtatgtattagagtgctctaatcctaaaactacccaaatacagggacctatgaccaagagtaggaccaaacagtcagtggataccctccaacaaatggtaacagacatacttaacacggctcaagtggagaaggatgaaggtccaaaggcagaggcactactaagaatattaattgttgttgaaggcccaaactaa

SEQ ID NO: 83086 - DNA, 950 bp, Glycine max
  Peptide Sequence Number=SeqID_174771
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcgagatctgattcaggaacatcgtcaaacatcatacataccaacagcaacattaaagctcacaataatgcaatatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccagcgtttccccctggcggctccctcgtgcgctctcctgttcctgcctttcggtttaccggtgtcattccgct

SEQ ID NO: 83087 - DNA, 570 bp, Glycine max
  Peptide Sequence Number=SeqID_174772
atgggttctccacctgcctccactcctcctcctcatcctcctccttctccttcttctcctcctcctcctcctcctcctacttcggacgcatcggcttcgacgtctgccgtgaagcggacacgcaaagcctcacgtctacgatcgttgtccactagaccacctggtgttgagagaccagtggtgcatgttgatcctgctatcgggaaggccgacggtccccacaggaagaaattaagaacatatttggggattgtggcacgtgataaggtggacatcacctacgagaactggaaggaggtccctactgctcagaaggacctgatttgggaggatattcagaggcttctgacagtaggacgaaaaaggaagttactacagaccgtgggggacagatggaggcagtttaaatcagacctcacgaggaaatgggcccttgcaaccgatcaggacggtatcgaggacactgtctgttacaaatacggcatcaacaaggaaaagtgggcccagttttgccagactcgcagagacccttcttgggaggatgtgcgcatgaaggcacagaccatctag

SEQ ID NO: 83088 - DNA, 450 bp, Glycine max
  Peptide Sequence Number=SeqID_174773
atgttgggtaggagtgtggagacccaaggtttagggcaacgtagggaaagtgtggatgcagaagcacatgttattcctgcgatgccagagcgccaacatggaatgtattacacacctgatcagttcacccaagagccgtctcaaatgtcatccctgtatccgtacccatatcaaagcggaacttcatcagatgcatatttcattggaacgcaacctccgctacaaccaggatatgttatggctgacttatttgggtctctttctcctgcgggaaccccttcatttgcacatggttgtcagatatcaacgcctaacgccccaatgggccctccatggactgtgtcgggaaacattcctaacattactgatttattaggaatagattttggtaatcaattttctgttaaggctgatgaaagaaaaggcgataggagaaggaatccagattga

SEQ ID NO: 83089 - DNA, 270 bp, Glycine max
  Peptide Sequence Number=SeqID_174774
atggtggaggatgcaggaatagcgctaggcaatcaattcatggggctccggataagatttgaggatttgaaggtggaggatagacgaacagcgctaggaatcacttcgtggggctccagactcgatggtggaggatgcatgaacagcgctaggcaatcaattctggaaatgggagaaagcacgcatcattcgtggggctccagattcgatggtggaggaatcatgaacaacgctaggcaatcaattcatgagactccgaataagatttga

SEQ ID NO: 83090 - DNA, 468 bp, Glycine max
  Peptide Sequence Number=SeqID_174775
atggctccaaagaaactctccgcgaagaggtctagaagagacgccacaggagaaggatccagtgctgcctcagagtttgatagtcatcgtttccggagtgtcaagcaccaacgacgcttcgaggccatcaagggatggtcattccatagggagaggcgtgtccagctcagggaggatgagtatacagactttcaggaggagatagctcgcaaacgttggacactgctagtgactcccacggccaagttcgactctgagatagtcctagagttctatgctaatgcctggcccacggaggagggagttcaggacatgcgctcgtgggtaaggggtcagcggattcccttcgacgcagatgtcctcagccagttgctgggcgacccgctagttttggaggaaggccggcagtgtaagttcagccagaggaggaacatggccgacggtttcgatgaggaagccatcacctag

SEQ ID NO: 83091 - DNA, 779 bp, Glycine max
  Peptide Sequence Number=SeqID_174776
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttctggagtgcaattgcacaatctcagctcactgcaacctccgcccccatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 83092 - DNA, 48 bp, Glycine max
  Peptide Sequence Number=SeqID_174777
atggggagtagaggatttctcattcacaaccaaagcagcaacgtccag

SEQ ID NO: 83093 - DNA, 696 bp, Glycine max
  Peptide Sequence Number=SeqID_174778
atgaagtataagcttaaggtatgggatattagagggcactcaaccagtcttgtatgggacattaaagagcacgagaagtctgtgacatgtttttcacttcatgagtcgtcagacagccttttaagaggttccactgataaaaccataaggtactgggagttcatccaaataccctcttggttaccattcacaaatcatccaaataccctcttgggtgatctatggtctaatcatttccctgatccatttcaagtgttagatcaaatcccatttggggttcatagagatgaaacaatcacatctctatcatcacatgcaagagtggattggaaggagacaccagaagggcgtgtcataatgctagatgtgccagggttgaagagagatgcgatcaagatagaagtggaagggaatagagtgttgagagtgagtggagaaaggaagaggaaagaggagaaggaaggagatcactggcatagagtggagagatcctatggcaaattctggaggcagttcaaggtgccagacaatgtggacttggattttgtcaaggctaagatggagaatagagtgcttactctcacaatgaataacttgtcacctaataaggtcaaaggtccaaggttggtcagcattgcaggggatgatgagcaagctcccaagctcaagggtaatgaagacaagcaggagctttga

SEQ ID NO: 83094 - DNA, 444 bp, Glycine max
  Peptide Sequence Number=SeqID_174779
atgggaaggcaaagaacaggtcgaaactacccgaaaagtggtaagaacatttggcgcccatcatggggccaaagtggaatttcctttggccataagatatatggtagcgaccaagagcttgacactacagtcaactaccatggaagagagttcaacaatataagggtcttccaaatttctttgaagggatttgctctatcatggtggcaccaactcccttctcggatgatcgatatgtttgacacactagtagcaccgataatcttaagacaagctgacaatgagtctctacgagacttcatgggaagattttcacaaattgcagtcatgatccatgaccttgaacttggggtagcccttcacgccatgatagcagcactcaagcctggagtgtttgcatatagcttgtgcaaaaaacaaccaatgagcatgaacaaaaaatga

SEQ ID NO: 83095 - DNA, 252 bp, Glycine max
  Peptide Sequence Number=SeqID_174780
atgttcatcatattcaacagtgctttgaaaggacttgatgatactccacagcctaaatccaaggctgctgcaaggtggattgtcgttaagtgtaatagacaaaaaggaagcactgagtgcggctattatgtcatgcactggatgtccaccatcatcttaggaagtttcaggaataactggaaagtgaccattggagctagagagattaaaggtgcttcgcatccagtgggcatgatattatctccgacttag

SEQ ID NO: 83096 - DNA, 630 bp, Glycine max
  Peptide Sequence Number=SeqID_174781
atggacctctctcaccctcagtctaacttgtccctcggattttcttcctcccacgcctcgccacctcctcgctccaacccgccagtgtcactgcagctcatggaaccgcagacggagaatggcaacttagatgttgaatcggacgacgatgaggacaaagaagtcgaggaatttcgcattctaggccactcaatatgcctcaagaggcgaagagattgtgactcctcatcctcctcctttgccaccaagagggtttccgtcgagcccgatcttgacacgcataatgtcgttgtgcgcgcgtggggttgccaacccctctacattggaattgttgatgacgatcatgccatgcctatggacatggtcattgggggtgatgagagaggctcttttgactttgtacacaaaagtgggaatgattctagaatcatttgtagtaaaaagggaaacatagaagatgttgctcttgtatttgctcaggacaaggacaggtctctgggtacatcttgttatctttttggtagcccttgcaacctgatgcatgacattcatgaatggggtgatcctagaaagaaggaattctacttctacatgaaatcatattcccccgttgataacgtgaaggcatag

SEQ ID NO: 83097 - DNA, 177 bp, Glycine max
  Peptide Sequence Number=SeqID_174782
atggcaacagaatggagaaggaagaaagatgattggagacgccacttcaaggagaagatgagtcaagaagaagctcaccaccataggaaaccatggataagaaagggcttgaaggtaggggaagatgagtggagggacagggagaaaaggagcacaaaattttgtgcctcaaatgag

SEQ ID NO: 83098 - DNA, 138 bp, Glycine max
  Peptide Sequence Number=SeqID_174783
atggtgatggagaagaaggggagaagaagaagaaaggggatgaacgacgctagggcttgtgtgcggaaggctgaggaaggtttgagccttatacctagtgtttatgaacttccaccaaagaaaaatgtagtgacttaa

SEQ ID NO: 83099 - DNA, 159 bp, Glycine max
  Peptide Sequence Number=SeqID_174784
atggagccaggtgataggcgggggtttttactctcgtcgtccggagacattcaagcccgacgacgcacgagattcttctctactgggcaggggcgatcgagtgcgatggcatggggaagtgtcgtggttgtcccattttatcgctttcaaagaaactga

SEQ ID NO: 83100 - DNA, 753 bp, Glycine max
  Peptide Sequence Number=SeqID_174785
agggctgcacgtcctcgccttgtgggggctacacgccctcaccttcagggggctacacgccttcaccttcagagggctacatgccctcgccttcaaaggactgcacgtcctcgccttcatagggctgcatgccctcgccttcagagggcttcacgtcctcaccttcgacggagtgtatgtcctcaccttcaaaggattgcacgtcctcatcatcagaggactgcacgtcctcaccgtcagagggctacacgtcctcaccttcagaggactgcacgtcctcaacttagatggctacacgcgctcgcctttagaggactttacctcctcaccttcagaggactgcaagtcctcgccttcagagggctacacgcccttgccttcagaggactgcacgtgctcgccttcagagggcttcacgtcctagccttcacagaactgcacgtccttgccttcagagggctacacgctctcgccttcagagggcttcacgtcctcgccttcggcggagtgcacgtcctcgccttcacaaatctacacgccctccccttcaaaggattgcacgtcctcgccttcagaggactgcacgccctcgccttcaaagggcgatgtcgcaacctacccttcgaagggagggcgacgcgtgactcgcgggatgcgtgttccacgaaaggaatacgcgcggagtcgccaccaacgtttattcgaggaaaacgtcggaaaaaccggaaaagacgcgatctacgaactttttag

SEQ ID NO: 83101 - DNA, 780 bp, Glycine max
  Peptide Sequence Number=SeqID_174786
atgggatcaagtcaaaagccttcgcttaaaaagaggttctatcaagtcaaaatcaagagcttagaggtcaccagtttacgaaagttggggcaattaatgggtcaacttcaacagcaagccttccgcaaagcctacggtaagatttgggacctagctagggtagaagtctccatggaaccgattgcatccctttcccagtattatgaccagcccctaaggtgcttcacattcgaggacttccagctagtgccgactgtgaaagagtttaaagaaatcttgggatgcccactgggcggaaggaagccatatctttttctctgggttctatccctccacgacaagagttgccaaggtagtgaaaatctcagcacaagagttgaaccaggtaaagcaaaacagaaatggagtagtcggagtaccaaggaagtgtttggagcaatcgacgtttttctcgcctatcataaccacaaggaaagtccggttgtcgctatgccagccgacctatatgacacctttgaccgaagatgtgaagaaagcaatgcaaggattgtttgttgtactccagctctctatgtggggctggtttcacacctttttctccaagaaggtaggcccgtctatccgctacaaggttaccgctcttgcgtcgaaaaaggaaaggcgaattgggaccaactcttggctagcatggaggggcgtctgttaatttgttccctcgctagaaggaaggaagaatcaggattctatcttcatgcgaaggatgtccaaatgttcccttga

SEQ ID NO: 83102 - DNA, 273 bp, Glycine max
  Peptide Sequence Number=SeqID_174787
atggccaccgctgatgccttggaacgagaaaccaagaaggcccaaaaggaagaacacgaatcatcacgggtcaaaggcatgatcttgaaggacgagctaaaggcttaccttaggtcgaaaagaaatttgtcccaacagttaagtgagactgaagggaatatgtgggccgtcatcgatgagtgcaaagagaagctaaatctagcggcgactcacgagcaaaggctagaggatgagtacgccaagatatcagcagaaagggaagcaagggaaagg

SEQ ID NO: 83103 - DNA, 195 bp, Glycine max
  Peptide Sequence Number=SeqID_174788
atggtgttgtggagaggaaaaatagatcccttgaagaagaataagaagatgaagcttttcaggaaaatgattatgctcttgaagatgatatcaaatctaaagaacttgaagaaagcaaagagatctcaagtagaacgcctaaagaatttcctagagaatggagaactcagaaagacctctctttggataacataa

SEQ ID NO: 83104 - DNA, 243 bp, Glycine max
  Peptide Sequence Number=SeqID_174789
atgcatgaatatgaggtatcatccccttcgaaaaaacatattgcggcagtaggggctaccagcaacaatatgttatcaaagagaaaaactctagatgagggttcactattatcaagcaagtcgaagacccagcatgaccacaaattcacctccactccttatgttcccatggacccgggtatagggccccttttcaactcaccgtgtgtgaaaaaaggtgttggtgttgtgtgcatcaaatga

SEQ ID NO: 83105 - DNA, 681 bp, Glycine max
  Peptide Sequence Number=SeqID_174790
atggctgacatttcaagaggatcggccaaacgtgaaaaccaacccgctcgccaatcatggagggaggcggttaatgccattgagtcagataggccgcccaggtctaagcctttaaagaacgtggcgacccctaggaggtttatctttgaggccctacaaaagggagagcagcatatatgtatgcagtccgcggatgagagaagttttggaaggcctaaacctttggtgatatatttcaccaaggacgcagcttcacaaaagtcccgatacccctcgacagctaaacctgttcctttcccataccaaaacagccacgcagtcccgtggaggtatacacctccgagtgaaaaggaagaagaagccaccaacatcagctcgttgtcggccaaggtaaccaacatcacggggcggagcggtgtgacccgcagcggtcgcgtgttttcaccctccaacctgccatcacaacctgcaaacgttaaaggaaaggccaagatggtggaagaacaaaatgacaagacgaccctcactccgaacgaggatattccagtgaagggtcttccagagaaaagggatggttgtggcatgaaggaagtgtcgctagaggaagcaagtgagtttctccgcattattcagcagagcgagttcaaggtcattgaacagctcaacaaaaccccggccagg

SEQ ID NO: 83106 - DNA, 300 bp, Glycine max
  Peptide Sequence Number=SeqID_174791
atggtccccagaaaggaagaatggggccaaaacaagttccgatgggcgttgtggggtagcaacaacgagcttaagcttcaaagggtcgagagagaccagtcaagagttgaaggcattatattggaagacgagttgaaggcttgtcaaaggtcaaagagatgtttgtctgaccaattgagcaagacggaagaaaacatgtgggccatcattgaccaatataaggagaagctaagtctagcggcaacccatgaacagaggctagaggacgagtatgcaaaggtgtcggtcctgcaagcataa

SEQ ID NO: 83107 - DNA, 183 bp, Glycine max
  Peptide Sequence Number=SeqID_174792
atgtgcacatgtgcaatttttggtaccccaaatgctttgagtatgcatgccatttttgttttaagagtagcatttcttggaaatggccccgaggaagcttgcctcaagaggtccaagaaggataacgcggttgaaggaactagttccgctcctgagtatgacagtcaccgttttaggagcgtg

SEQ ID NO: 83108 - DNA, 165 bp, Glycine max
  Peptide Sequence Number=SeqID_174793
gttaagagagacaaacttgataaaaaggcggaagcgggaatctttgtaggctatagctcaacatcaaaagcctatagaatattcttgccacaaaaagaaaaatggagcaaggaaagtgagaagcttcaagttcaggaggagagcgaagaagatgtggatgactag

SEQ ID NO: 83109 - DNA, 342 bp, Glycine max
  Peptide Sequence Number=SeqID_174794
atggatatctttgaagatactgacattcctataatattgggaaggccattcatgttgactgcaagctgcatagttgatatggggaagaggaagctggagctaggttttgaagatcagaaaattgattttaatttgtttgttgaagacaagcctgctccagaacacaatgtttgcttacagaaaaatatttttctgaaaaacaatcctttcgctaagcgcaagcctcgcgctaagcgcatctctgttcatgcactaagctgtgagtctcaagcgcttagctcccaacccttacatctgaggcagatttggtctgctaagctagccaaggttgagctaagctaa

SEQ ID NO: 83110 - DNA, 570 bp, Glycine max
  Peptide Sequence Number=SeqID_174795
ggattccctggtgggccctgtgacccatcagttccgacttcatttgcggagcatgtcgcacatgccatttggactggacaggagcgtcctgagctaaagttggtgtcgcacgggaggaagatggcgttaattgggaggccagtgcctgcgattgaagggctggttgtcgccacaggattaagtccattgatcgagtgttcagttgtaactggcgatcctagacttatatccgcatttgtggagaggtggcacagggagaccagcaccttccaccttccagtaggagagttgacgatcacactagatgatgtgtcgtcactcctccatctccctatcagtggcgccttccacagcttcgaggctttttccgtggacgaggcggtatttttgttgatggagttgcttgaggtgtctggtgaggaggctagagccgagacagcttttcgtgacctgggtcagagtaggggctatgcctggggagctgcggccctggttcatatgtatgaccagttagatgaagcttctaggaccacgacacgacagattggggggtaccttactttattacag

SEQ ID NO: 83111 - DNA, 95 bp, Glycine max
  Peptide Sequence Number=SeqID_174796
ctccaatgggagcttgcatcatgtggtatcaggagcatcttcatctaggtgttgagggaaaaaagcccagagtttcaagaacctcgggatttgag

SEQ ID NO: 83112 - DNA, 675 bp, Glycine max
  Peptide Sequence Number=SeqID_174797
atgggcatgctgccttcggccagcctgaatgaagagggattcggcctgttcgaaccggcgggcggttccgcaccggatatcgccggccagaacatcgccaacccgattgcgcagattctgtcgctggcgatgctgctgcgtttcagcctgaacgctgacgccgctgcggatagcattgaacgcgcggtaagccgtgcgctggaagcgggccatcgcacccgtgatttggccggtgacggccctgccgtgagcaccgatgaaatgggcagcatcattgccgacgaaacgccgttgctgtatatcgatcgtcacctgattcacgaagtcacctcgccgcaggcgtttgacggtctgcgtgcgcacggccgtaaagtgcgccagccgtcgaagacctttgccaccatggaccacaacgtttccacccagaccaaagacatcaacgcctcgggtgagatggcgcgtattcagatgcaggagctgatgaagaactgtgctgagttcggcattcagctgtatgacctgaaccacccgttccagggcattgtgcacgtgatcggtcccgagcagggcatgacgctgccaggcatgaccatcgtttgcggcgactcgcacaccgcaacgcacggcgccttcggttccctggcgttcggtatcggcacctccgaagtggagcac

SEQ ID NO: 83113 - DNA, 420 bp, Glycine max
  Peptide Sequence Number=SeqID_174798
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgcagacgaacatatgttgtcttcgcgtgtcattggacttgctgtctctggatga

SEQ ID NO: 83114 - DNA, 520 bp, Glycine max
  Peptide Sequence Number=SeqID_174799
atggggtcctttggagaagctggttgggagtgggaattctcatggagaagaaatcttttcgacaatgagttgggaagagcttcagcctttattgaacaggctacaacactaagccctaatgcagctttgaaggattattgggtgtggggagctgacccaaagggaatctttactactagaactgcctatctttgtattaaaggtgatcagccaattggctacctaaatcgtggcttcagtcagctgtgggaaatcaaagtacctcctagagccctatcctttgcttggagactactttgggataggttaccgactaaggaaaacttaactagaaggcaagttgtaattgaaaatgatctttgcaccttttgccaaagccaagttgaatgtgcctctcatctctttttcacttataaaaaagttatgccaacgtggtgggagtttaactcttgggtcaaggaagacagagttatgcactgtaggcctggggacaacttctctcagcacttctccttggctg

SEQ ID NO: 83115 - DNA, 270 bp, Glycine max
  Peptide Sequence Number=SeqID_174800
atgtacatgacacccattgttaggcaatccgtgaagttctgcgacatgtcgggagttgaagggaagtgtcaatgtgcaatctgtaaaaaaaagaatcagcaaaaaaagtggcagaggggggtgtatttagtaaacaggggtgtgcaaatagcaatcaggcccacttgggccttccaggatgttccaacagaaggcggtgccttctggtggaagcaacccagctcacctgggcgagctaggcggcaaccacctccctctcttcccctataa

SEQ ID NO: 83116 - DNA, 744 bp, Glycine max
  Peptide Sequence Number=SeqID_174801
atgaacgggctaagcgcacctgctgcgcttagcctgttcatcgcaactgttaaaattttggatttccagatgatcgcgctaagcggaccatcgctaagcctggcctgtcaagctaagcaccactttgcttctgtagtcagtcctttgaataaggctaagtgcagctactgcgctaagcccttgttgtgtgtcgaggaggctaagcacgccatgtgcgctaagcctgagtgtcattctggaggaactcgaaaaaagacactggatgaggagctgactagttttgctgacggcagcattgatgttgccattgtgaaggaattttatgcaaacctctacgacccgaaagacaagtcacctaagcaagtgaggggggagaatctttgttcttatttcaggtttgcactcctgaggcctgatcctcaggagttggctgttaagctttgtatcctagggaggggattcgagctaaacgttgatggtcagcctttgaagatattaaggaagaacatgaccactttagctcagacatggagtgttctttccttttctaacttaattcctacctcccacacatctgatgtcacattagacagagccaagttaatctatggaatcattatgaagatggatatgaatgtgggatacctcatctcccaccagatttctcttaccacacaacatgattcatccagacttggattccctgctttgatcacagctctgtgcaaggctagaggagtctaa

SEQ ID NO: 83117 - DNA, 312 bp, Glycine max
  Peptide Sequence Number=SeqID_174802
atgttgacaaagggagaagaaaagataaaagataaaatagtggttgtcatcatcaaaaagggggagaatgtaaatcatgaagcttttgatgatatcaagaagaatttgcttgagaaagagggagatgtaaatcatgcaagctttgatggtgtcgagaagaaatcacatgtttgtcatctcaaaaagggggagaatgtgaatttggaagttggaagtagttattggaagttgaaagttaaaaatggaagttggaagttggaagtggaagttactggaagttggaagttggaaatgaaagttattggaagttga

SEQ ID NO: 83118 - DNA, 363 bp, Glycine max
  Peptide Sequence Number=SeqID_174803
atgagtgtagagcagttcattgagaaagtggcctggcctggagcccgaccttcttttgtgggacataatgaaagttttacagcccaggcacctcaaaagcatgagccagaaccagaaaacgatcactcatctgaagccaccatccctggagctgttgattttgcaaaaagaagattagagacgagatctaatgaggctgctcatcctggactagtgccagcatcagctgatgcaccattttatctttttgtgaaaaatggatcacccaggcccatttgggccctccagaagattcctccagaaggcggttgcttctggaggaagcaaccctgctcgcctgggcgagctggtgggatcctctag

SEQ ID NO: 83119 - DNA, 697 bp, Glycine max
  Peptide Sequence Number=SeqID_174804
agggctacacgtcctcacctttagaggactacacgtcctcaccttcagagggctacacgcccttgccttcagaggactacacgtcctcacctttagagggccacacgccctcgccttcagaggactacacgtcctcacctttagagggccacacgccctcgcctttagaggactacacgtcctcacctttagagggctacacgtcctcacctttagagggctacacgccctcgccttcagagggctacacgtcctcgccttcagaggactacacgtcctcgccatcagaggactacacgtccttgccttcagaggactacacgtcctcgccttcagaggacttcacattctcaccttcagagggttgcatgccctcaccttaagaggactacacgtcctcaccttcagagggctgcacgccctcaccttaagaggactacatgtcctcgccttcagagggctacatgccctcgccatcagaggactacacatccttgccttcagagggctacaggcccttgccttcgtaggactacacgccctcacttttagagggttgcacgccctcgccttcaaaggactacacgtcctcgtcatcagagggctgcacgccctcgccttcagaggactgcacgtcctcgccttcataggactccatatctacgccttcagagatctcaaggtcctccgcccttaa

SEQ ID NO: 83120 - DNA, 784 bp, Glycine max
  Peptide Sequence Number=SeqID_174805
atggccagcagcgcaaggacggcaacctgcagcgggcgcaggcgggaggagggcgggatcatggcttggccttcgcggcggtgccggcttgcgtggcgagcgggtcggcggtcctgggcaggccggcgtagcgcgtggcgaccgccgccatcaagcccagcgggccgggcggacgttggttttcacgccagaggcgcagctgttcggcgaggtaggcggcgggctggcccgccaggcttgggaaatgatcgcccaccccgatgccgccggggccgtggcactggttgcaggcgggcgcccacgtcggcgggtttgggagactgcagcggtggcggccaggcggtcggtgtccaggggggagggcagcgcggcgtagaaccgcgccacggcctcgcgttgcgccggctccagtgtcttggcgatggctgtcatgacgggactgacgcgcgagccgttggcgatggcctcaagctgttcctgcagataggccgcgccagcgcctgccaatcgcggaaagccggagaccggattgccttctccttgggcgccgtggcagagcatacaggcgggcgcgccgttggcgccccgggtgctgatgagcagtgcgtcaggcgcgccatgaaccgtgccgggcactacggaaaacacactggcgaagaagatcgccacgctcgcccatcgggcgccgggcagaaggcgggaggacatgaggaggaacgctgccgaagattttggctcgactatatttccaaagacgacgacatagaaccgctatgcacgaaag

SEQ ID NO: 83121 - DNA, 366 bp, Glycine max
  Peptide Sequence Number=SeqID_174806
atggtgaaagttggaacgtattacgtgccgatcaacgtctcattttcgccaaaagttggcccagggctttcccggtatcaacagggacgccaggatttatttattctgcgaagtgatcttccgtcacagcaccgccggacatcagcgctggcaagtgtagcggtcacgctgcgcgtaaccaccacacccgccgcgcttaaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 83122 - DNA, 1353 bp, Glycine max
  Peptide Sequence Number=SeqID_174807
atggttagaacacgaggtttaggtcatgctttagctagggttataggcagaggtagacaagatgagcatgatgcagtcgatgtgactaaggatgttcctcatatggcggaggatgttcctcaggtgactgaggatttccctcatatggctaacgatgttgctcagaggagtgaagatgtgcctcagatgaccacggacgtagatgcgaatgttgcaaaggacttaggtcgtgatggtgctgaggggtcacatgctgatgagggattccctggtgggccccgtgacccatcagttttgacttcatttgcggagcatgtcgcacatgccatttggactggacatgagcgtcctgagctgaagttggtgtcgcacggaaggaaggtggcgttaattgggaggccagtgcctgcgattgaagggttggttgtcgccacgggattaagtccattgatcgagtgttcagttgtaaccgacgatcctggacttatatccgcatttgtggagaggtggcacagggagaccaacaccttccaccttccagtaggagacttggcgatcacactagatgatgtttcgtcactcctccatctccctatcagtggcgccttccacagctttgaggctctttccgtggacgaggtggtatttttgttgatggagtttctcgaggtgtctggtgaagaggctagagctgagacagcttttcgcgacctgggtcaaagtgggggctatgcttggggagctgtggccctggttcatatgtatgaccagttagatgaagcttcttggaccacgacacgacagattggggggtaccttactttattacagtgctggatctatgagcattttctgagtgtgcatcagtgtgtcaccgatgatgcgtatgaggagacgtcccctcatgcctcccggtggctaacgacgaaggctcatatgaagggaattacaggagctccgtaccgggcacattgtgatgctttcacggtcacagacgtgtgctggtttccttacagtgaccatcgaggggttagggggtttgagttgatttcatcgttccagggtcagctgagatggggtcctacggtggtcgcagttcgaccgaagagggtactatgccagtttgggtacattcagagcatccctccgtcgcctgtatctgcggattatatgaattggtttttccagatatctcacccattcatgataccgacccaggcaggtgatcagcccagacatgcacctgccccagaccatgaggactacatgcagccggacatcccacaggtttcagtggcatttgacccccccttgacatgcagtggcaagattgtttgcgggtttaatgtttga

SEQ ID NO: 83123 - DNA, 186 bp, Glycine max
  Peptide Sequence Number=SeqID_174808
atggcggatggcaggcacggaggaagagtaaacaaagcaagaagaaagaaggtagaaagcgattataactgcggtggtggcagtggcgctgcaactccagccacacacctttctcttaaatctctgaaattagtactagcaagaaaattggaaaaaagggtagaaggggataaagaaaaaaaataa

SEQ ID NO: 83124 - DNA, 306 bp, Glycine max
  Peptide Sequence Number=SeqID_174809
atggacgaagatcaatggaggtatgactatgcgatgtcacaagaagttcatatggattatgattatgataatgaagaagaatgtgtggtgaatgaaccacatgtggattgttcaaatgcttttaatacgtctcaggtattcggtactcgagatgatgttttgcaatgggctcaaacagttgcccatgaaaatggatttgttgcagtgattatgaggtctgacacaaagaccgatagtagaggaagaagttcatttgtcttaattgggtgtgaaaggagtggtgcgtacaagtgcaggaataaataa

SEQ ID NO: 83125 - DNA, 981 bp, Glycine max
  Peptide Sequence Number=SeqID_174810
atggttgttgtaccctttgtgcctttggcctttcttgatgacggttcttctcctcctccttcaccctcatcacctcctcaaaaatcttttgcaaaagttctctcaaatgcatgtgatataccattgagacaacttctggtcccttgcttgaaaggcgatgccttatccgttaagataccagaggatgaatacaaagcaagattggagggatgtaaaaacaatcttcatggaaggttgagtctttccaaaggggacactctactcaattatcaatatttgcacatcaaacttgagaagggttttggccatgggttcttggcctttaaaccttggatcactcaaactattctgtcatggttgtttcaccctttgtgccttcaacctttcttgatgacggcgatgccttatccgttaagataccagaggatgaatacaaagcatgattggagggatgtaaaaacaatcttcatggaaggcaaaaaggtctttgtggagaaacaaaaagagccaattattcaagatgatggagtaatcccaccgggtctaagctttgcacaaaagaatgatttagggggatccttgaagtataatcagggtgatgatgcacatatatcaaatcttgatgataattgtaaatcttcagttgagggaggtactcaatcttatgatgagtctttgcatctagacttgcctttagttgatagatttggagcagaaactccagagttgaaggataatcccattgtgcatcaatattttgggatcataacaagtaggtggggatatatagttgatgatgtttccttatgtgttgatgttaatgaaggaggcttatctctagatggtttcacaatggttcattcaaaatcccaacgcaagaagcttcatggcaacaaaaagaagatgcctcgacggtcgtattttctactaggttcaatgcatcatccaaaccagcgaccagggtggttgctactaacctag

SEQ ID NO: 83126 - DNA, 1050 bp, Glycine max
  Peptide Sequence Number=SeqID_174811
atgaagaaagccctatcggacagtgtggatttgatccaaaggagaacaaggtgtaggagaaaggatgaaagactcaagttcaaaggtctccagagcagaaattattgtggatctccacagcttaggttggaggtgttgttattagcaagtgtcaagagagaagagcttgagttggccatggatgaagatgaacttgctatggtagaatcaacccgttcaaaatctaatctagatagcattgaggaagctattgctaagcttgcctctaatcaactccatgtcaccttcaaattagacgagctactccagcaactgaccacccttagaggagacactacgaggaagctcgtagcaccactccaccctacattgcctcttgagaacggcaacaacatccatcgtggtacccgtcttcctcttaacgtgctcagtgtaggtaacaacgtactgcagaccatcctcaagaaagttcttaaggactctacgagccaaatagtgaatcctgagtttcataatgttctgcatgttgtcgcacagcaccaccttgtaccccttggctcctcccttgtctccctcctacgaccactgtatccaccgccgtcacctccaccaccaccaccgaagccaccgcctccaccacaaccacgattggtgtgggtttgcgcttcatggacagtgatgtttgaccgtcaaggggcctctatgacgatcgaaaatgttgatagttttttgtgtactgcagttacaaggggagattcagattatcttaaaagacttttatccaatgacatggatcctaacttcaaagattataattaccgaagtcctcttcgcattgctgcagctgaaggtttatattttatggcaaagttgctattagaaggaggaactagtgtttttaccaaagacagatggggaaatacgacacttgaagaagctcggatgtgtggaaataagaacctaatcaagcttctagaagatgcaaaatctgctcaacagtctcaacaccttgaggacaaggtgtttttgatgggtcagggaatgttatga

SEQ ID NO: 83127 - DNA, 606 bp, Glycine max
  Peptide Sequence Number=SeqID_174812
atggtgctcttttttatgggagctgcatgcaatctccaagcaaaccgcaacttgcaatggcgacttcgctgccatacgacacgtggaaggccaaaccgccagcggtgctggcgactttatgtggaagggcatctcgccagtgcaactggcgacttcgccattgctactgaaatcgcagctctgactggcgagtttcgggggtgcaggagacgtaaaagccgaaaaaaagaaggaaaattctcgcctctcgcactggcgagtttcggggggggatttaaggaagtgaaatcgctgctggggttgctactctgcgcgctgcaacttagtctgcaacctccctcggaaacggcttttgcgtctcctgcacccccgaaactcgccagtcagagctgcgatttcagcagtagtggcgaagtcgccagttgcactggcgagatgccctttcacatgaagtcgccagcaccgctgacggtttggccttccacgtgtcgtatggtagcgaagtcgcctttgcaagttgcggtttgcttggaaattgcatgcagctcccgtaaaaaagaacaccatgccggaaattgttccaaaaggaccccatttgaggaataa

SEQ ID NO: 83128 - DNA, 462 bp, Glycine max
  Peptide Sequence Number=SeqID_174813
atggagcagcctggggttgacggagggcacgatgtgacaatgtcacgggagacggaaactagggcgaagaggcgtcattgtcagagacaatttactcctcctctcgaaaatgttgaaaatgacaaagatgaagctctgccatggagagattctaggaaatcgcaacgacagaggaagaggaaatctaggcagtgctatagtaaccagttgaaatctggtttagggaagcataagaagattctgatgtgttcaaatcgaagtagtccagttcggaatgagagagtgaggaggaaaggaagcggaggacaaagaggaggaggagaggaagcggaggacaaagaggaggaggagagagaagggggtgagagggagaggaagcgaatgaaagagaaacaatgtaataaaaggactttgatggtgcagacaggtttgccagtgctagagaaaccaccagagatctag

SEQ ID NO: 83129 - DNA, 612 bp, Glycine max
  Peptide Sequence Number=SeqID_174814
atgtggggttgccttcccggacatgaccatgtcatctttgttcttttggaggatcctctcatgagtcagagaacaatccaaagaaggatcctctcatgctttggctcactggtggccctgagcgacgcaagtagtagaatggaaggctggttgtaccttatacgcttcaaccgtattggacttcagttctctcggaagcgttacttcgttctcgatggtaaccttctccgcagcttcaaatcagttcctgtttcaaataatcaggatcctgttagaagcacagacaaatttctgttttttttttatgcctttgaaataagaagtggtgcgcctgatggaggagatgatgttgtaggttgttctaagaggggatggcaatcctttagactcagtggatcttctagtggtataagtcacccaaattttgtagactggactctttcttctgctgatgtcattgccctttcaccatggacaatctttggctgccaaaatggtttacgactattcaaggaagcaaaagacagggattctaatgggaagaaatgggatgatcaccctgcaataatggttgttggtgtggttgatggaacttcagaagccatcttctag

SEQ ID NO: 83130 - DNA, 207 bp, Glycine max
  Peptide Sequence Number=SeqID_174815
atgcttgcttttcctttcggaatgttgcgaaactttacggattacgcaacaatgcttggtttgactgtcagaatgttgcgaaactttatggattacgcaacaattcttgttttgagggtctcgaagggaacaaacaagtggagtgggccactcaggagtgacctttattctcttagggttcgtgggaaccccttgatcactatttaa

SEQ ID NO: 83131 - DNA, 327 bp, Glycine max
  Peptide Sequence Number=SeqID_174816
atgaggaaaaggattcttccaagaagattgttaagaaggaaaatcattttgcaacaaaaggtgatattaaaagagtactccttcttaaacaatctttctaccttctcctatcaagggaaacatcccttagcaccgccatacctcttgagcttgagtgatcaagggcttcccatggaccctaagagaataaaggtcatttctgagtggcctactccaccaagtgttgaggaaaaaattaatgagtttcaagaacctctggatttgaggtcaaatccttttcaagggggagggaatgatgcaatcctaccccccaagggcattggatag

SEQ ID NO: 83132 - DNA, 890 bp, Glycine max
  Peptide Sequence Number=SeqID_174817
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcctctttttgcttatcactcatccagggattcctaatggtttctggtccatggaggttccttttcttgattttgaatgtagttatggttatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 83133 - DNA, 627 bp, Glycine max
  Peptide Sequence Number=SeqID_174818
atgaccacacttgctcagacttggagtgttctttcttactccaacttggtccctacctcccacacttctgacatcacactagatcgggccaagttgatctatggtattatcatgaagatggacatctcccaccagatttctatcattgcccaacatgactcctctaggcttggatttccagccttaatcacagctttgtgtaaaggtagaggagtcacattagattctagatccttggagagccttagccctgccattaacttggcatatataaagaagaattgttggaatctagatgatccaacaagtctccagagctcaggcctgcaatctattatgagcatagatgagttcctgactcaggtggcttggccaggagtccagccttcttcttctagagggggtgggacctccgcagcccaagtgcctgagcaggcaacagaggagctagttttagcagaggatgagctcacttctcttgagccctcttcagttgttgcagatacatctatggctcaggaggaggtatcttcaccaggtcccatgccagagccatcctctacacctatatctgaggacactatgccatcagtaccagctatagagccagagcaatccattctttag

SEQ ID NO: 83134 - DNA, 318 bp, Glycine max
  Peptide Sequence Number=SeqID_174819
atgacatcaagaagaatcaagattcaagagaagatgatctcacaagggaagactaaccgcctgagaattctttgtcttaacacattggagggtacatcctttgtggtacaagtagagggtacatctacttgggttgttgtacctgagaacaagagagggtacatctcttgtggatcagttcaagtggagggtacatccacttggttgttcaaagagaacaaggaagggtacatcccttgtggatctttgcttgtaaaggtttttacaaggttgaaaagaaatctcaaggaccgcagtttgcttggggattggatgtag

SEQ ID NO: 83135 - DNA, 283 bp, Glycine max
  Peptide Sequence Number=SeqID_174820
ttgggctaagctcaacagtttggctaagcgcataaccaccactaagcgcaacttcagtgcgcttagcgcaaaggaaaatctgacagagcatcagcatcaaagtcgcgctttgcgtgagatgaatgtgctaagcgcagcaagtgccttcaaccaggctaagctcgagactggcgctaagcccaatttcacttactcgccaaggcacagaatcacacaacagccacagtgcctaattagggaaaagagccctggaagcagcaaagaggagcaacttgtgcattga

SEQ ID NO: 83136 - DNA, 959 bp, Glycine max
  Peptide Sequence Number=SeqID_174821
accacagaaagcaagtcgaaaatggggtggttggagtatcgaggaaatgtttggaagcaaaagcaagagtcttggcaggtaaaggcgaatgggccctgttcatagacatccttgcacttttgatcttcgaaggggtcctctttccaaatgtggatgggttggtggaccagtacaaggattgtttgctatactccgaccctctacgtatggttggtttcgcaccttttccgccaagagcaagcaaagaaggagcgtctgtcaactggttcccccgatggaaagaaggaagaaccgggattcttttttcgtgcggaggatttccaaatgttcccttgatggggacaaggggttgcatcaattacaatcccgtcctccctataagacaacttggctaccctatgaggggggcaccactagaggaagacctcatgcctattattgcacgaggtttcaatagcactaacgcgaaggcaattcagaaggtccgcaaggcatgggagatggagcaaaaaaaggacaaagaactcagaggcagtagcaatgggcccatcagcggctaccataggtcgttgaaagcctacatgcaagctcttaggatccgaaaggagaatgccgaactgagagacgtaaatatagccaccaccaaggccatggaacaagagaccaaaagggcccgtagggaagaacatggccggaataaattccgaggggctctgtggggcagtaacagcgagcttaagctccggagagaggaaagggatcaatcacgagtagatagtttgatcttgaaggatgaattgaggatttgcctaaggtccaagagaagtttatctcagcagatatgcgagaccgagaccaacatgttagccatcatcagcaagtaccaagaagaattaaatctagccacggcccatgagcacaaagtggcggacgaatatgcccgagtgtacgcggaatag

SEQ ID NO: 83137 - DNA, 351 bp, Glycine max
  Peptide Sequence Number=SeqID_174822
atgtgggctctgtgcaaggctagaggagtccaatcagattctagatccctggagagcctgagccctgccattaacttagcatacattaagaagaactattggaatctagatgatccaacagcgacatttagagggccaaggaaggccaagggtaagagatcagaggtccctactacttcagcagcaccagagatagcaactccttcttcttccacagctccaacacctcccatttcgactccaacacagactccagctattcctgctccatctgctcagataccacttccagctcctttatcttttgtttacaccacagatgcttcattccatgctccagagcttacatag

SEQ ID NO: 83138 - DNA, 450 bp, Glycine max
  Peptide Sequence Number=SeqID_174823
atgacaagcagagaccaagtttggtcattctgcacccatgatacgcggagatgccttatggttattcgcacccgtttgtcatccagaggcggcgggcccgatgacaagcagagaccaaagaccaagtttggtcattctgcacccatgatacgcggagataccttgtggttattcgcacccttttgtcatccagaggcggcgggcccgatgacaagcagagaccaagtttggtcattctgcacccatgatacgcggagataccttatggttattcgcacccttttgtcatccagaggcggcgggcccgatgacaagcagagaccaaagaccaagtttggtcattctgcaaccttgtatcatccagaggcggcgggcccgatgatacgcggaaatacccgagtggttatccgtataaacattcttttgctatctgtaagacagaacgcttga

SEQ ID NO: 83139 - DNA, 294 bp, Glycine max
  Peptide Sequence Number=SeqID_174824
atggatgagtttgatgtgcaagtggcttggccagaagcccacccttctccttctggagggagttgggcctccgcagcccaggagcctgaaccagagcagccaggagcagaagcagcagaggaggaggatgagctcacccctcctgagcccttttattttgatgcaggtgtacacatggctcaggaggaggaggagacttctacagaccagatcccagagccatccctagcatccataccagatgatgccataccatctgcaccagcatctgagttagagcagcctatctcttag

SEQ ID NO: 83140 - DNA, 246 bp, Glycine max
  Peptide Sequence Number=SeqID_174825
ctttcatcaagaagtactgcgcccccaggcaggcatagggcgagacaccacaacagcctggggattgtcggcagcgggcaacagacgcaccgctgccacctccagagcccctcagctcctctacaaaagctggagcattgcctacgacctgtggttgaccagcaggtgaccaagtccaaagccaaaggtagtgaagataccttagatatgcatgtagcaagataccttggatgcgcatctatatag

SEQ ID NO: 83141 - DNA, 491 bp, Glycine max
  Peptide Sequence Number=SeqID_174826
tcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgactggcacgacaggtttcccgactggaaagcgggcagtgagcgcaacgcaattaatctatgaccatgattacgaattcgagctcggtaccaaggcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 83142 - DNA, 330 bp, Glycine max
  Peptide Sequence Number=SeqID_174827
atgaagaacggtgaagaacgatggaaaaccttcacagatttactcacaaaaacatctcggaagcgttacagatgcacctcggcttggattttcttcacgaaaacaattttttctcccaaaacagctgaaatgcatagccaaggagaactttatggattatataatgacacttattttctttccagaatgttgcgaaactttacggattacgcaacaatcccctttttgacttctggaatgttgcggaactttacggattgcgcaacaattattcctttcgacttccggcatgtcgcggaacttcacggattgtctaacgatgggtgttaa

SEQ ID NO: 83143 - DNA, 315 bp, Glycine max
  Peptide Sequence Number=SeqID_174828
gaagtgtttgataaagatcttctgaaggctgatgacaagatggggaatgctttcctgaaccttcaaccaatagtctctgcagccagattaagagacatcttaagagtgtcctctggtgagacgacattaaggaaggtcatacctgatggtgaaaactgtcttgtccgtgaaagcagtatcaactgtgtgaatggtgaggtggtgcagaatgtttggttaaggcttcgtggagttgagtctggggaactagaattgaccatcaatcgagtcttgcttttgattaactcctgcatagatgtttctacccaaaagtga

SEQ ID NO: 83144 - DNA, 594 bp, Glycine max
  Peptide Sequence Number=SeqID_174829
atggatgtgttgaagctgaaggcggtatcggaagagaaccctagcgagactgtgaaaagggaaacggaagcgacgtcgtttacattcagaggattgactgagttgacttacagtggatatcagcctcatgcatattcttgggatgattatccacgacttaaaaacatgttggatgctgtaagaatgattttaatcatcaattctgctaatgatgatgacaatgtctataaagctctccctgggagtagttttaatagcttactcttaaataggtacaattgtggtaatgactatgttggttggcattctgatgatgagaagctttatggacggacgcctgaaattgcatctctaacttttgttttgaagaagaagccatatggaagtggtgaacctgccagcaagagattaaagaagggtagccatgatgctgatcagcatacatttagacttaggcatggatcccttatggtgatgagaggatatacccaaagagattggattcactctgtgcctaagcgtgcaaaagctgaagctacactcattaaccttacctttaggctttatgtagatgctaatgttcatacaatctaa

SEQ ID NO: 83145 - DNA, 365 bp, Glycine max
  Peptide Sequence Number=SeqID_174830
tgaagcggattccggggattgataaatggataattgagaaggagaataggtcttacattgaagccttgagtaatcgtaaggaggatttggtttatctcacggcggattcggagactgttcttgaagagcttgatttgaagaaggcttatgttattggcgggttggtggataggaaccggtggaaggggataacgttgaagaaagctgaggagcaaggcatccaaacggctaaactccccataggaaatttcatgaagatgtctagttctcagaggaaaaaaatggaggagaaaaacagagataacaatacacaagagaggaaggaaatacaaggttggcttgatggttgggaagggggtgcttga

SEQ ID NO: 83146 - DNA, 182 bp, Glycine max
  Peptide Sequence Number=SeqID_174831
cacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatcaggggcaatag

SEQ ID NO: 83147 - DNA, 1917 bp, Glycine max
  Peptide Sequence Number=SeqID_174832
atggggagtccaataattgtcataactcttcggaagggtagaggtgtagatgcaaggcatggtgcaaaaacacaagatgaacaaggcaggctgaggtttcattttcagtcatttgtgtctttcaatgttgcacacagagggagaggaaaacagagggaaggggagagaccgagagtggatcccaaaacgaactacgacaacaacaagcttggtcaatttcagaggtatcaccaccataactggagggataaggatgacatcacaacgttttacttcacacgcttccacgaacacataactgaagaggatctctgggctcagttcaagaaatggggggacgtgagggacattttcatccacaaacacaggaacaaaggaggtagaagatatggttttgttaggttcaaaggggtactggacaaatacagactagaaaaacagcttgacaacatcatcttagaaggactcaagatgtatgttaatgttccaaaatacgggagaggaaaggcgagggtcaaggagtgtacctccaaacttggtatcctgaaggaaggccatagcagggaagtcgaggctgggcgacacagagcagtacagcataggaatccacagaagtcatatgccaaggtggtctccactatccaaacggatgacggtaagatgaagcaccccaaactcccacaactgagatatgttgagtcccactcctcagtacaccttcaattggcagtgggggaaaagaaatggttcacagatgcatgggtgggcaggcttaagaaattgcaggctctggaaaggatagaggatgacataccttgggagttaggtgtgaacgtcgtgctgaaatatctcggcgacgacatggtactccttcttgggttggcggacaacaaagcagagcatatcattgccgaagagactcagcatggcacatctccattccactcactagaaaggtggaacccaacgatgagactgggtcatagacttgtgtgggcccaatgttgggatatccccattgaagcatgggacttggggaacattcgtaaaatcgcggcggccattggagagcttgttaaggttgacgacgatgtcaaagagatgaggaggatggacagggccagaatcctcatcaggaccccgtggaaaccgttcttccatcacactgtttcacttgattccgatggtatcgacggagagtcaataatatctccgtactcgccccggtatgagatccggcgtcaaccaaacaacccacatgatgacccaaaagctgtcgtagatagcggtggcggtccccgcataggcaccggtatacccatcggaagagcaacagacccaccggaagcgaaccactccgacgaccccggcggcaaccctctgaacgtggctcatgtgcagtcgatctcgtgccgggggaggaaagcctcctccgacggagacacggttcctgtcgctaccgacaaaccgaggtcccctttacccaaaggacctacaacaatcgaaaacacagtggatattaaccagggaagctgggtaatactccccaacctcggaaatggctcgcgtatctcgtctgaaagggttatggagcaggaagacaaaggcaagggatcagagacaacaatcaacaatggagaaataaatgtaggtgaggcacaaaaaaggaaacagcaaggggaaattgaatcactgacagagacagttgttcacccagaagctacaataagggaaatagctgttgaggatgtccaatttcaaatgagagttgaccatgtaacttcctctgggccctcccactcacagctgccacctccaattgaaacattgggccctcctcaacattttcgatccagcccatcttatcaagttaaggaccatgaactgctaacaccatcaacaacaaggggaaattga

SEQ ID NO: 83148 - DNA, 900 bp, Glycine max
  Peptide Sequence Number=SeqID_174833
atgctctctgactttgacctctccctccgatgtgctgttagtccgaccctcgttaaaacctcgtccacagattctgagcctttaagaaagaatgctgtttactgtgtccaacctgcatgtattgagccaccttcctgcatccaaccatcctgtgttgctcctactacatgcttttcaccccggcttttctctagcaaatcaaagaaagacaggaagccaaaaaatgaaatcggcaaccaagtgagtccgttacctgagctcattgcagagcctaccgatgcccggtccatgtcatttgttggaactcacgaatacttggcaccggagatcattaagggtgaaggtcatgggagtgcagttgattggtggacttttgggatctttctatatgagctgttgttcggtaaaacgcctttcaagggatccggtaaccgagctacattgtttaacgttgtcggtcagccactgcggtttccagaagcacccgttgtgagttttgcggcaagggatcttataagggggttgcttgtaaaggaacctcagcacagattggcatataaaagaggcgctactgagatcaagcaacaccccttttttgaaggtgtgaattgggcattgatcagatgtgctaccccacccgagatccccaaggctgtagagtttgagaagataccctcaccagcttcatcaagtggtggtgaaaaggctgttaaccatatgtcaatagctaatcagaaaggattacgtttagttgagaaatttgtatcctctcctcttggtaaagttcctccaagggatgaatgtaatattggtggtaaattgccagatggcggtttaataaattctagacagttgttggaatgtactctttcaccggaactgggccagatcctaaaataa

SEQ ID NO: 83149 - DNA, 258 bp, Glycine max
  Peptide Sequence Number=SeqID_174834
atgaagaagatccaaggtgatgcaatcctccctaggaagggaccagtcactagagccgtgagcaagaggctccaagaggattgggctagagctgctgaagaaggccctagggttctcatgaacctcaggatgaatggcagcggaatggagaaggaagagagagaggagatgccacttcaaggagaagatgagtctagaagaagctcaccaccattggaggccatggataagagcttggaggaagaaggagatgaatga

SEQ ID NO: 83150 - DNA, 357 bp, Glycine max
  Peptide Sequence Number=SeqID_174835
atggttagaaccagaggattaggtcgtgccttaggtcacattactgacagaggtgtgggcagaggagatcgtgatgattccgatgatgctccgcagcgtcgacggcctaccgcatccacacggaggcagcgagtacctgtgattgctacgcacgatgagtcagtggtccctgcgccaaatgtagatgctgacatatttctggatgactcaatggcaccagcagatgtagaggacattgtggcagacattcttgcgaacacaggcgcacatgttgctgaggatgagcatgagggatttccgggtggttcgagcgacccatccgtgctgacccagtatacggatcacgttacttgcagc

SEQ ID NO: 83151 - DNA, 117 bp, Glycine max
  Peptide Sequence Number=SeqID_174836
atgaatgctactagcatcacaagcaccaacgatgctatagttgaaaccaccaagactacctttctccgatgctcgtgtttaccatctacaagaattgacaggttgataatgaaataa

SEQ ID NO: 83152 - DNA, 352 bp, Glycine max
  Peptide Sequence Number=SeqID_174837
atggtagtaggtcatcatatggcattggaaacgagttttgtagggaaggactttatggttgagcgggcaatctttgttggatgggcgccggattgggagggttcccgatgttggccaaataatttggttggtgcggggaatattgcgagtgtgaactcgctaagcgcaccgccttcaacccttaggctaagcgagaagactggcgctaagccagaagtcacttacgcagtctttggctgtggagagactgagagagagctgagcttgacgaggaagccatcttgcggagctttggatgagattttgagagattgtgaggtttcaagaggtggaggagacatccccactactt

SEQ ID NO: 83153 - DNA, 696 bp, Glycine max
  Peptide Sequence Number=SeqID_174838
atggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcaggcggggcgtaattttttaaggcagttatgtgctagaatatttatctga

SEQ ID NO: 83154 - DNA, 303 bp, Glycine max
  Peptide Sequence Number=SeqID_174839
atgtcatgggtcaatctcaccagtgcattaccacaaaatcctagggaccatttcttacaacatggaactgagctagcagagggagttaagtctaaaagatggaaatgctggtggattgccttaacctggacaatatggcagcatagaaataaggtggtgttccaaaatgcaacatttcacggttctaagctactggacgatgctctactcctactatggtcatggatcagagcaatggacaaggatttcactcttcactttaaccaatggtcctctaatttgaaggaagggttatgtaattag

SEQ ID NO: 83155 - DNA, 56 bp, Glycine max
  Peptide Sequence Number=SeqID_174840
atggggcaaaaccccccaaatgattatgatgatggatggctcaaattctcccaaag

SEQ ID NO: 83156 - DNA, 287 bp, Glycine max
  Peptide Sequence Number=SeqID_174841
ggaaagctgctgcttcaggtgctgtatccaaggatgccttgattgctgaactcaaggacacatgcaaggtgctggaggcaaccatcaaagccaccacagagaagaaaatggagctggaacggctgatcgaaagactcacagacagtggcattgatgatggtgaagcagctgaggaagaagaagatccagctgaggaagaagaagcagctgagcaagaagaagaggcagctgaggaagaggaagatgcagcagaagagacggaatcagattctgaagccaccccatga

SEQ ID NO: 83157 - DNA, 369 bp, Glycine max
  Peptide Sequence Number=SeqID_174842
atggattctagaggtatcaaccccgtcgacaaacatattgcgacaatagggactaccagcaacaatatgttatcaaagagaaaaactctagatgagggttcactgttatcaagcaagtcggagacccagcatgaccatagattcacctccactccttatgttcccatggaaccggatataaggccccttttcaactcaccgtgtgtgcaaaaagtccccagtggagtcgtcaactgtcgcaacctaccctttggcgggagggcgacgcagggctcacgggtgagtcttccaagggaggaaggcgcgcggagtcaccaccaacatttattcgaggaaaacgtcggaaaaactggaatgtgtggtctatga

SEQ ID NO: 83158 - DNA, 514 bp, Glycine max
  Peptide Sequence Number=SeqID_174843
tccggcgttcaatgcaggacgaagcatatggttgcctggttggttaaacgctgttaatgagaatagtaattctctattcttaacaatagggcctggagacttcttggttcatcatgctattgctcttggtttacatacaactacattgatcttagtaaagggtgctttggatgcgcgtggttctaagttaatgccagataaaaaagattttggttatagttttccttgcgatggcccgggacgaggcggtacttgcgatatttcggcttgggacgcattttatttggcagttttctggatgttaaataccattgggtgggttactttttattggcattggaaacacattacactatggcagggtaatgtttcacagtttaatgaatcttctacctatttgatggggatggaattgattgaaactttagcatgggctcatgaacgcacacctttggctaatttgattcgatggagagataaaccagtggctctttccattgtgcaagcaagattg

SEQ ID NO: 83159 - DNA, 136 bp, Glycine max
  Peptide Sequence Number=SeqID_174844
atggctccgaaaaagccttccgcgaagagatctaggagggacatcgtggctaaagggaccaatgccgcccttgagtttgatggccaccgttttagagcgctgagcaccagcagcgcttcgaggccatcaaaggatg

SEQ ID NO: 83160 - DNA, 417 bp, Glycine max
  Peptide Sequence Number=SeqID_174845
ttcgccgtcaaatcccagggctcaaccctggacaggcggtggaaactaccaagctggagtacgagacgaaagctaggggagcgaatgggattagataccccagtagtcctagccgtaaacgatggatactaggcgctgtgcgtatcgacccgtgcaatgctgtagctaacgcgttaagtatcccgcctggggagtaccgaagaaccttaccagggcttgacatgccgcgaatcctcttgaaagagaggggtgccttcgggaacgcggacacaggtggtgcatggctgtcgtcagctcgtgccactgccggtgataagccggaggaaggtgaggatgacgtcaagtcatcatgccccttatgccctgggcgacacacgtgctacaatggacgggacaaaggatcgcgatcccgcgagg

SEQ ID NO: 83161 - DNA, 62 bp, Glycine max
  Peptide Sequence Number=SeqID_174846
ttgatacctgtgatgatcaagaaccttgttcgtgggagcagaatgacagtggcagggtgtag

SEQ ID NO: 83162 - DNA, 759 bp, Glycine max
  Peptide Sequence Number=SeqID_174847
atgggaacccaaaaatatacccctaaaaacaaagttagaattgtaacagcagcgtcattatttgacggacatgatgcggcaattaatattatgcgtcgtgttattcagggaaccggctgcgaagtcattcaccttggacatgacaaatcagctgaagaagttgtaaatactgccatccaggaagatgcaaatgctatagctttaacctcttatcagggaggacacaatgaatatttcaaatatatttatgaccttctgagagaaaaaaattcgccacaaatcaaaatcttcggaggaggaggaggagtaatcctgccggaagaaatccaagatcttatgtcttatggaatcgacagaatttattccccggatgatggaagagagcttggccttcagggaatgattgatgatctggttaacagatcagattttgccacaggaaaagatgtaacagcacaggatctggactctatcaatttcgaaaattcaaccagcattgctaaaattatctctgctgttgaaaacttctctgatgaaaaaccagagcttgttaaagctatcgatgaaaaagcaaaagatctgaatattcccattattggtattacaggtaccggtggtgccgataagaaaatagcgattatatctattgacccatctaaaaagaaaacaggaggagcattacttggagacagaatccgtatgaatgcgatcaatgatccaagagtttatatgcggtccatggcaaccagagaaaacaat

SEQ ID NO: 83163 - DNA, 914 bp, Glycine max
  Peptide Sequence Number=SeqID_174848
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatgaaacagccagacgcgaatcatggcagtaagtacggcaaagacgagtgccaggctgaaagatatcagcgtgagtgggagcggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 83164 - DNA, 225 bp, Glycine max
  Peptide Sequence Number=SeqID_174849
atgtcagcgaaaaacctcgtcgggtgcctaggagtacatgacaagacaaaccacataataataagtcaatcagggtcacagtgttttgcgagaatgctccaaccatatgggatcaaaataggcttaaaggagcactcaaaccgtgtgacccccaaggcctacactccaaagagtccgttagggcctctccctcttgattcaggtccaacccagaaaacattttag

SEQ ID NO: 83165 - DNA, 806 bp, Glycine max
  Peptide Sequence Number=SeqID_174850
atgatcagcgtctatcgtacaactctcaattttcttctaagatcatcttagaccctaagtacctagacataaatttctttaatgatgagacatttgactgttatcaagtgtttcaaaactctggattagttgattttatgtccttaacattgccttattatcctgaactagttagcgtcttgtacagtaatttaaaaattcaggatggtattatttgttctgaggtgcatgttatttctatgatcattgatcaatctctgttcttttcattgactaaattacctagtcaaggtgcaccttttgagggaaccattattaatgactggaagtttgactattcaagtcatgatgctcgtcgtatggtccgtaatgaccaggctgatatgaccgatagattgctgcccggatcattaacctttgattgtcgcatcatgcactatattatcattagaattttgcttccccgttcttctaatctggctcaagcatctgaggaggacttgattttgatgtgggctttccttacttgtcgtcagattgactgggctcacttggttaggtatcgaatgcataaggcattacgggccaatacaccttttccgtatcctcaattggtcaccctttttctccgtcattttcaaattcctcttgatgatgaaccttttgttcaagtcaagagatcttttgctataggtgctggtgtagtaacttcatttggttaccataaggatcgtgatggacaatggctgaagaaggacgcgctacctccacaagacgagcatactccttctcctcctcctcaatga

SEQ ID NO: 83166 - DNA, 315 bp, Glycine max
  Peptide Sequence Number=SeqID_174851
atgggatcgaaccaagcacctttttttaagaaaatgttctatcatgtcaaaatcaagagcctagaagtagccagtttgcaagagctagggcaacggatggatcaagttcaacgtcaagccttccacaagacatatgggaaaatctgggacttggctatgatagaagtttctgtggaagccatcacatcccttactcagtactatgaccagccgctaagagagaaaggtccaagttccaaagagtttcgagagcttttgctatgcgaagactggcagagaactgagcttgaagaggaagctatcctaagagcatga

SEQ ID NO: 83167 - DNA, 624 bp, Glycine max
  Peptide Sequence Number=SeqID_174852
atgaccatgattacgccaagctcgaaattaaccctcactaaagggaacaaaagctggtaccgggccccccctcgagaaggtggcaaagggtctcccaaatcttcgtctttgagtccctatgaagaagcaatggaggccttgtcgtctttgatcactagacgcactcgtgctgatgatagcaacgtgggggatcagttcagcctgttatatgattacctgaagatgctagagttggaggagccaattgcaaatatgaaggttatccatgtggctgggaccaaagggaagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 83168 - DNA, 351 bp, Glycine max
  Peptide Sequence Number=SeqID_174853
atggcagagccatcaaagaagagaaagggatcatcctccaccgctaccgccgctgcctatcgccgccacggcccatccggagcacccacaacacctattcctccttctttgtcatctccaagatcatcaacattgttttcatccgatgatcaacgtctacgtcaaggtgcaccttttgagggcaccattgttgatgactggaaattcgattattcgagtcatgatgctcgtcgcatggtctgcaatgatcaagctgaaatgaccgtcgtcagatcgactgggcccatttggttcggtaccgaatgcataaggcattacgggccaatgcacctcttccttatccacatttga

SEQ ID NO: 83169 - DNA, 396 bp, Glycine max
  Peptide Sequence Number=SeqID_174854
tcctctgaaggcgagggcgtgtagccctctgaaggtgaggatgtgtagtcctctaaaggcgagggtgtgtagccctctgaaggagaggacgtgtagtcctctgaaggcgagggcgtgtagccctctgaaggtgagggcgtgtggccctctgaaggcgaggacgtgtagtcctctgatggcgaggacgtgtagtcctctgaaggtgaggatgacgtgtagtcctctgaaagcgaaggcgtgcaaccctcagatggcgaggacgtgtagtcctctaaggcgagggcgcgagggtgtgtactcctctgatggcgagggcatgtatccctctgaaggtgagggtactagtacccaagggtccacccttatgagaaagcaagagattgactcaatgagagg

SEQ ID NO: 83170 - DNA, 468 bp, Glycine max
  Peptide Sequence Number=SeqID_174855
atgcatgccctcgccttcatagggctacacgccctcaccttcagaggactacacgtcccttcagaggactacgcgtcctcgccttcagagggctacacgccttcgccttcagaggactacacgccctcgccttcagaaggctacacgctgcaccttcagagggctacacgccctcaccttcagaggactacacgtcctcacctacagacgactacacgtcctcaccttcagagggctacacgccctcgccttcagagcaatatagagggctacactccctcgcctttagagggctacacgctccttgccttcagaagggatacacaccctcaccttcggaggactgcacatcctcaccttcagaggacaacacatcctcgccttcagaggaatacacgtcctcgccttcagaggcactacacgtcctcaccttcagagggctacacaccctcgccatcagagggctga

SEQ ID NO: 83171 - DNA, 747 bp, Glycine max
  Peptide Sequence Number=SeqID_174856
atgcaatctcagggacttgcagtgcctcctgagcctctagttggtccctccggtcctcgagtgagcaccaaggggagttgtgttgatccctcaggaaacgatcctgagatgggtgactctgacaggtgcggcttgtacataaaagcagatcctgcccgcctggttgccatggggagagtttatgagggatccactattgttcataacacttctttgttgcctggccaagtaaaggtgagtgtggaggaggttacagatgcagatgctcttgttcctatacccactgatgcggtttccttagtggggcaggcacttcacaccttccttgcttggccgacacatctggccaagtctttatcacaacagagttcacaaagcgatgtctatcttggcgcctacctaaatgggttccactgcagcggacactggcagatggtggtcatcctgcccaaggaagacctagttgtctggttttgttcattgcataacaggctagacaactaccttaaggggattattaatagtgctatcaagggtcttgatgatgctccacaacctaaatcaaaggcttctgctaggtggattgtcgtcaagtgtaatagagaaaaaggaagtactgagtgcggctactatgtgatgcactggatgtccaccatcattttaggaacttttaggaataattgggaagcgtattttaacgatcctagaccattggagccagagagattaaaagcattgtggatctag

SEQ ID NO: 83172 - DNA, 153 bp, Glycine max
  Peptide Sequence Number=SeqID_174857
atgttgattgtgctttttttggttttcaagcttgacgagagttacacgccgagcaaagtttccatccgtgccggtgatgagattaagaccgtggaactcgtgaaggcaactgggtgggtttatctatccttgtctggagctgatcctaggtaa

SEQ ID NO: 83173 - DNA, 324 bp, Glycine max
  Peptide Sequence Number=SeqID_174858
atgaagtcaggggaaaacgagcccattgacgcgcagagactaacatcatcttccgcaccttttgtcatccagggacaacaagtcaggtggcaggcggagataccttatggtcatccgcacctttcgtcaaccgaggcaaacgaattcgacagtttttactgtcgtcgtccgaagacattcaagcccgacgatgcacgagattcttctctgctgggcggggggcgatcaagttctatggcatggggaaatgtcgtggttgtcccatttatcgctttcaagacactgaagtttgtgacgcttctgatgccttttctctctttctga

SEQ ID NO: 83174 - DNA, 358 bp, Glycine max
  Peptide Sequence Number=SeqID_174859
gttcgttgaaaatggtgaaatcagtgggagtacaattccacgagaagtggaaattaaagaggttagagtgcaagtccctttagcttgtgcctctagcagtaaggtgattgctcctttagttgttgttacaaactataatgaagaagcacaacacaataatgaacccatgatatataatgaacctattgtggaagaaccacaagaagtagcattaacaaggtctcaaagagaaaggagaccagctatttcgaatgactatgtggtatacctacatgaaacagaaacagacttcaacattaatgataatgatccagtttcattttcacaagctgtaaggtgtgataattctgagaagtag

SEQ ID NO: 83175 - DNA, 456 bp, Glycine max
  Peptide Sequence Number=SeqID_174860
atgactagaggcaatccatctgacttacaaccctttgatcctgagatagataggacatttcatagattagttaggcatcattttataccttttgataatcctgagcattccattactggtgaatctgtgcattctattattggtgattttgaacatcctgattttaagcattctgattttgaacattctgagaacatggcacaacctccaccccgtgagaggactctaagggaaatggttgcacctgatttcacctacaaaagcttgtgcatccaataccctgatgaggatgtcccacatgttcttaaaactagactgatccatttgcttccaaagtttcatggccttgcaggtgaagacctgcacaaacatctgaaagaatttcatattgtctgctccaccatgaaacccccagatgtccaagaggatcacatatttctgaaggggatcctctag

SEQ ID NO: 83176 - DNA, 897 bp, Glycine max
  Peptide Sequence Number=SeqID_174861
atgcagaattttgctgtcaaaataggtgcagcaggattttggctttgtgcagaaaaatgcttgtgtgtggttggctgtggaaagagtagtgcggaacgagttctggtgagaaaagctgtgattttggttggtgttttgagcaaagttttctgcctttgccctgttttcttggctgtgagaaacgaggatatgagctacgtgggagtacgtgagttcagttggaggtgggcaacaagggatggtggggtgaaacttcctgcttttattgttgaccacagagtggtacccggagatatgtcgcgggggttaggagaccttggagacgtcaggcttaaaaatgaagacaggaggctaagatggtctctggttatcgattaccaagggaaaggggactggaacattgtggaggcctctggtaatcgattaccagcctgtgtaatcgattacacagagggatggatcgtgatggcggcgcagctaatccatgatcgagtagagatgaagtgcctagagggagcttgggagaccctcgaaggcaacacgaggtgccgatttcggggcaccattcgattcacggctacttctttggtgcatccagatgaacctggacggacgcttcagcgcacggtggagtggatactacccacgcctacaccatatcgtctagtggagcccgtccaagtgatcgaggtaacgtcattcgaggaagaccctgaggaggatctggaggagctacctcctgagcctgctgtggatgcccttgactttctagagggtgatgaggatccacttcttgaggtggattctcccgaggaagtcatgtcggcatctgaggcagactctacggaggatagtggcccgggggagatggcgatcagcggaggctcttcatcatag

SEQ ID NO: 83177 - DNA, 381 bp, Glycine max
  Peptide Sequence Number=SeqID_174862
atacgctccacgcccatgacccagctggatcggcctgtcgaggtggtggcagtgcgtctgcggctgatgtgcatcacctgcgcctgcctaggcgtgcagtacttctcgacgaaggctcaggtgatcggcggttagattactttactgggggtgacgagaactccgtaggaccggcagaggcccgtgatcagcgccggaaaccccagggccctattggacttatctgggtccaaagggatggcatacaccaactggcacttaggcagagggagatcagagttgtgatcactaggcaagacattgctgagcagcaatgtcatccatgtctaggtcaaggtggtcatgctagtgtgcatgatccgcacccgcctccctgtagcg

SEQ ID NO: 83178 - DNA, 138 bp, Glycine max
  Peptide Sequence Number=SeqID_174863
atggtagttaagaaggacttcatgttggggcaaaaagtgttattgtatatttttaggctgggactcatgagtgggaccagtgaagatcaaaagcgactccccaaccaagagcttcaaggtcaacggacatcgacttaa

SEQ ID NO: 83179 - DNA, 525 bp, Glycine max
  Peptide Sequence Number=SeqID_174864
atggttggcaattattttattccaaagggtagccatgtgctactaagcagacatggacttgggagaaaccttaaagtgtggaataatgaacctcacaagttcaagcctgaacgccacataaagaatgatggatctatgattgttttgtcagagccagatttaaacccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 83180 - DNA, 417 bp, Glycine max
  Peptide Sequence Number=SeqID_174865
atgtcaatctccccctgtagatgtatcggttgggatcgcgcccacaagacgcccaacagggccctggggtttctagctctggttaccggcctctgtagtcttacagggtgcccgttccccccggcaaggtcacgtcatcatgacatagggatcacgcctacaagacacccagtggacccgaagaagtccaatagggtcttggagttgtcaagctctaattacgggtctctgtcagttctacggagtgcctgtcacctccagatgtcacatgaccataaaatcttgaagcttgagtgtccacatggatgcatgtatgaccagttttgcataatacttcctaatcatcattgttgcatgtatatcatggaaataatgtgggacgtcccctttatccccgaaccgctggccaaaccctga

SEQ ID NO: 83181 - DNA, 413 bp, Glycine max
  Peptide Sequence Number=SeqID_174866
aaattgctgataaaaaagtagcagcagctgaggcatggattgaagctctcaaggccagcaagaaggaaatactgatggaaacaaaaatagctcaaagacaactcaaagaatcaaaattggagcaagagctggaggtttacaccaaagagaagatgctttcaagaagagttagtagtgaggagcttcacaattcatatgcatattttacacttaggtggcaccatccagtttttagtttacaattacacgaaccccagaaaaagcaccagatgcaggacaccatggtttggaaagctgatcctagtggtttttattccactaagtcggcatataggatattgatgactttcaatagacctgttcctcagaggaggattttgcagactattgaagcatgcaatgcacacaagtaa

SEQ ID NO: 83182 - DNA, 324 bp, Glycine max
  Peptide Sequence Number=SeqID_174867
atgctgcgcgctgagcctggacattatcgcgaattaccgcatttttaccgcgaacgtcgggatctgtttgtctctgcgctcggtaaaagccgtctggagattttgccttcggaagggacttacttcctgctggctgactacagcgcggtttccgatctggatgacgtcagcttctgccagtggctgaccaaagaggtgggcgtggcggcgatcccgttatcggtattttgcgccgatcccttcccgcataagctgatccgtctctgctttgcgaaacaggaatcgacgctgctggcggcggcagaacgtctaaacgcgctctga

SEQ ID NO: 83183 - DNA, 675 bp, Glycine max
  Peptide Sequence Number=SeqID_174868
atggctccgaggaagctttcctcgaagagatctaggaaggaagccgcggccgcagggactagtgccgctcccgagttcgatagccatcgtttcagaagcgttgagcaccagcagcgtttcgaagccattaagggatggtccttccaccgagagagacgcgtccagctcagggacaacgagtacacagatttccaggaggagatagctcgccggcgttggacgtcgctggtcactcccatggccaagtttgatccagatatagttcttgagttttacgccaatgcttggcctacagaggagggtgtacgggacctccggtcatgggtaaggggccagtggattcctttcgatgcagatgccctcagtcaaatcctgggatacccgctagtattggaggaaggccaggagtgcaaatatggtcagagaaggaaccgggccgatggatttgatgaggaggccatcgctcagctgctatgcataccaggtcaggattttgcccggaccgctgctgggagacgggtgcgaatcatgcgcaccaacatgactaccttgacccagacatggatgatgttgctgctcagcaacatcctgcccagcgatcataattccaacctccctctgccgaagtgtcagctggtgtatgccacctaccaggcactctctagacccagataa

SEQ ID NO: 83184 - DNA, 141 bp, Glycine max
  Peptide Sequence Number=SeqID_174869
atggtccatgacatctttgtcaagaaatgggtttatgatcccaatatggttgtgtcataccctaatttcgtccggggacctttgctcgatgacgtgcgaccattctttggtcctcgtgaggtgcttggcacccatcattag

SEQ ID NO: 83185 - DNA, 150 bp, Glycine max
  Peptide Sequence Number=SeqID_174870
atgggcgctagggatgcaaataatggtgaaattttagaatccaactgcaaggtgctagggctctctaacttcaactacaacaactaccttttgcagtgtggttctcccaattatcaatcatggatagcggcatatagcagccgactttga

SEQ ID NO: 83186 - DNA, 225 bp, Glycine max
  Peptide Sequence Number=SeqID_174871
atggcaactaagatgaagcggtgcccgtttgaagccttgggttcgatgaccccgatcacgtctatgccccacatagagaatggccaaggtgttgccaaaatctccaatggtacaggccccaggcaggtattccttgtcttcgatgtatcatttgatatcgaagtaccataccatcctcatcttcttctatcaaacaacaatgtgcgagctcaccacgacatctga

SEQ ID NO: 83187 - DNA, 471 bp, Glycine max
  Peptide Sequence Number=SeqID_174872
atgtttgaccgctcgaaaaagggcgaacacgccctgttgatccagccccatttcggcaagctggaagacgatgtgctggaagaattcggtgatctggcccgctcggctggggccagcattgccgcgacgatcaccgcgcgcctggaccgtccgaatccgtcgaccctgatcggcagcggcaagctggacgagatcaaggcggcggccgacgccagtggtgccgacctggtcctggtcaaccatgcgttgagcccgggccaggagcgcaacctggaacggttcctggagcgccgggtgatcgaccgtaccggcctgatcctggacatcttttgcccagcgtgcgcacagccacgagggcaagctgcaggtcgagctggcgcagctgcgtcacctggccacgcggctggtgcgcggctggacccacctggagcgccagcgcggcggttcgatcggcctgcgcggcccgggtga

SEQ ID NO: 83188 - DNA, 297 bp, Glycine max
  Peptide Sequence Number=SeqID_174873
atgtgggcatgggaacgatgcacgactttggctccaaagaggactcctccttttatgtgggagccttatacaacaactattatgtctgcgttgcctccaatttgtttggttggaagtgtagcatggtgcgcggtgctgccactcatttgtttccatgttgttgagtggcaccaacccgatagagttttgcgacaatttgggatgcaacaacctattcctgagtgtccttcgcaactaggggtggaaatgagccaagccaagccaagccttactaggcttgagctcggcctgagttga

SEQ ID NO: 83189 - DNA, 516 bp, Glycine max
  Peptide Sequence Number=SeqID_174874
atggcggtgattgtcgccctgctggtggtggcactggtggcggtgattgccactgcactgctgacccggcagtcggcgcagctgcgcgcgctgcgtagtgaccagctgcgcgcacaggtgcgcatggcggtcgatgccaccctggagcgggcggcgcagcagctgcgtgaggatgtaaaggagcagctgaccacgctgcagctggtggatgcgcagtcgatgttcaacctgcgcaacctgctggcgcatggccggccggaccccgaggcgcgacgcgcgttcatcgcgttgtgtgctgcacaggggcttggccagggggcctgcgcatccgcggcggaccacatccaggcgcgcctgcgcgacggcgacatccaggcacaggccccattgccgcgcgaatcactgatcgcgcaggcactggccgaccctggtcaacgccaacaccagcgacctgagcgttctgcaggcggtgacgcctgcggtcgagccggcacggctgcaggcgctgctcggtga

SEQ ID NO: 83190 - DNA, 132 bp, Glycine max
  Peptide Sequence Number=SeqID_174875
gcccctagcaaagctgtcctgagaagcacgaaatcagatgaaagtcctgcacaggtcggtgcttcgtacatggcatacaacaaacatctgagatcctcagacgatccaagcgttacctgtacgtcgttgtag

SEQ ID NO: 83191 - DNA, 327 bp, Glycine max
  Peptide Sequence Number=SeqID_174876
atgtcgggccaaatccaaagacagagacaaatcgaggtaaatgataacgcggccacagtttgttgcgcaatgttgtttcttgctgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgaactttttagtgaaaggttcgggagttgtatttacgcacggggaagggtgtttccctttgctcctacgtattcctcaatttgggatgagaaaatcagacctacgtag

SEQ ID NO: 83192 - DNA, 264 bp, Glycine max
  Peptide Sequence Number=SeqID_174877
atgctaaagttgtcagataacatcataaggttccatagaagagttgttctaggttatctagaagtagtatctagaccatggagattaaccgtagggaactggttatgtgactcagatctagttaatcctacagggattgaacgagttcttactgaaaaagaccttctagcctattcatactcagacctagaggcttctatctttgatgaaaatgaatttcttctattaaaggtcggggatcagacagtgtggccttctccatga

SEQ ID NO: 83193 - DNA, 399 bp, Glycine max
  Peptide Sequence Number=SeqID_174878
atgcatcctccacctatcgagtctggagccccgcgaagttattgtgtagcgctgttcgccaattctccattctccacttttttcggagaccccatgaatttattgcctagcgctgttcatgctgtcctccaccttcgagtctggagccccgcgaagttattgcgtagcgctgttcgccaattctccattctccactttattcggagacccatgaatttattgcctaacgttgttcatgtgtcctcctccatcgattctgcagccgcacgaagttattgcgaagcacgttgttcgccaattctccattgtccactttattcggagacccatgaatgttggctagcgctgttcatgtgtcctccacctttgagtctggagccccgcgaagttattgcgtag

SEQ ID NO: 83194 - DNA, 384 bp, Glycine max
  Peptide Sequence Number=SeqID_174879
atggagcttgcatcaacagagatagagctattagcgatagttattgctcttgagaaatttcgttcatatttacttggtactcgtgttattatttatactgaccatgcagctctaaagttattaggagatgcattccagaccatgaaatcgactcggtcctgcaattctgtcactcttccgcaccaggtggccatcttggcatacagaggacagctcgcaaggcgcttgactgcgatttctattggcccaccatcttcaaggatgcgtggagaatctgtagcacttgtgagccttgtcagagagcaggcggctcacattcatggagatagcaaatgccttaacaacccatgttgttctgtgaggtgtttgatgtctggggtatag

SEQ ID NO: 83195 - DNA, 633 bp, Glycine max
  Peptide Sequence Number=SeqID_174880
atgagcgacgaagaagtcggcatgctgatcttcgcgccgggcttctccactgccgagcaggtgaccgacgtttccggccgcggcgtcggcatggacgtggtgaaacggaatattcaggagatgggcggccacgtcgagatccgttcgcaggccggcaaaggcaccaccatccgcatcctgctgccgctgacgctggcgatcctcgacggcatgtcggtcaaggtgaacgacgaagtctttatcctgccgctgaacgcggtgatggaatcgctgcagccgcaggcggaagacttgcacccgctggccgggggcgaacgcgtgctgcaggtgcgcggcgaatatctgccgctggtggagctgtatcgggtatttgaagtggacggcgccaaaaccgacgccacgcagggcatcgtcgttatcctgcaaagcgccggccgccgctatgcgttgctggtggatcaactgatcggccagcatcaggtggtggtgaagaatctggaaagcaactaccgcaaagtgccgggcatctccgccgcgaccattttgggcgacggcagcgtggccttgatcgtcgatgtctcggcgttgcaaaccttgaaccgtgaaaagcgtctgacggacgccgccgcataa

SEQ ID NO: 83196 - DNA, 408 bp, Glycine max
  Peptide Sequence Number=SeqID_174881
atggtacatctacttgggttgttgactgagaacgagaaagggtacatctcttgtggatcagttctattggagggtacatccactaggttcaaagagaacaagggagggtacatcccttgtggatctttgcttgtaaaaggatttttacaaggttggaaaagaaatctcaaggaccgcaggtcgcttggggactggatgttactccaagatcatgatgaagaccaagtcaacttgtgtctcatgacaaagtctaatgagaataacaaagaagattctgtaaggaagaaacagtggatgttccaagcacatgacgggagatatatccaaattcacaaccatttcccccaagaaaagtggacacgttacatatggcgacaacaacaaaggaaaaattattggagtcggtaa

SEQ ID NO: 83197 - DNA, 672 bp, Glycine max
  Peptide Sequence Number=SeqID_174882
atgaatacttgggcatctagagtcctgttaaaacctcaaaaaggagaaacaactttgtttatcactgatatgacaaaggctaacgtttctctcccgagacaaataaaatgggatgaagtaactcttcccaaaagatgggttatggataaggccacaccgtctgttccccgacccgctccaaccatagagcatattaagcaagataactccggaaaggtagagataacctttaataggagaaattctttttcatcaaggatagaagcctctaggtctgaatatgagtcagccagaagaaaggatatagattacccttggaaacaagaaatcataggtgatccaacaacaaatgtcataacaaactggcaagtgagagatggtgagttaatccaatcggaattacctcccacaacacaatatcaactaccaaatatcaaagacagtaataataaacctgtcatggcaattccattcaaaacaaaagatgtcaacgaggaagtaacctctaaagacattaaaagcctaatggaacaggcaaattataccaataaatacttacaagctttaggagaaaccattaaaactaaagtagttcctaaacaaaaatcaattgagggagcctcgccaagtgtccccatcgaaattgaaaaacctttattcaaacctttcaaa

SEQ ID NO: 83198 - DNA, 510 bp, Glycine max
  Peptide Sequence Number=SeqID_174883
atgtatatatgtgtgaagaaatctaggaaggatgctgcggccgcagggactagtgccgctcccgagttcgatagccatcgtttcaggagcgctgagcaccagcagcgtttcgaagccatcaagggatggtccttccatcgagagagacgcgtccagctcagggacgatgagtacacagatttccaggaggagatagctcaccggtgtttgatgtcgctggtcatgcccatggccaagtttgatccagatatagttctcgagttttacgccaatgcttggcctatagaggagggtgtacaggacctccggtcatgggtaaggggccagtggattcctttcgatgcagacgccctcagtcaattcccgagatacccgctagtattggaggagggtcaggagtgcgaatacggtcagaggaggaaccgggccgatggatttgacgaggaggccattgctcagctgctatgcataccaggtcaggattttgcccaaactgctgccgggagacgg

SEQ ID NO: 83199 - DNA, 63 bp, Glycine max
  Peptide Sequence Number=SeqID_174884
atggaattgtccactgctttgcctgagaatagcaattgcttgaccacaacaatgctggaggcg

SEQ ID NO: 83200 - DNA, 183 bp, Glycine max
  Peptide Sequence Number=SeqID_174885
atggctttcggagcttccgggactcctagtatttgcaaagctggattgcttttggaggaagcaacccagcttgcctgggcgagctgggtggcaacctcctcccccttttttcctataaataggcagaagggggttgttctaagggtccctgattcccctggctatgcatttcagctgttttga

SEQ ID NO: 83201 - DNA, 321 bp, Glycine max
  Peptide Sequence Number=SeqID_174886
atgtacatagaaaaggtgtcatcggtcgattcttcaccaactgtgcagggtgacgagaatcctaaaactgtccaaatacagggacctatgaccaggaataggaccaaacagtcagtagataccctccaacaaattatagcaggcatatttagcaaggcccaagtggagaaggacaaaagcccaaatggagaaggacgaaggccgaagtggaaaaggacgaagccccaagtggagaaggacaaaggtccaagtggagaaggacgaaagacccaagtggaaaaggatgaaggcccagaagcagaggcactactaagcatataa

SEQ ID NO: 83202 - DNA, 480 bp, Glycine max
  Peptide Sequence Number=SeqID_174887
atgtcaggaggtagggcagcggaggttgacgcaggaatggtgaatggtactatggttgttggaagagaagaacgaaaacagatggatagaaagaaggtatgccaagcttcgtggggggatcctgaggctagatgggaggtactgccagcacgtaatagtgctggagggttgacgatgtaccttctgtgggacgaagattcacttggtacagaccaaatgggacagccaaaagcagattggacaaagttcttgtatccactagctccacttctatttaatattgttgcagagggactaaatgatgatacgcttttcttcggggcggtgtcaatggaaaatgtaagagcaatcaaggtgatattgagtagttttgagctggacaggttgccaacaaagattaatctacgcaggaggaacgtggaatttaatgacgttatatgcccattctgcagaaataatgaagaggatgcagcacactga

SEQ ID NO: 83203 - DNA, 246 bp, Glycine max
  Peptide Sequence Number=SeqID_174888
atggtacctctgatttatggaggttgggtagacctgcagagtggtagagataaagcttggcattcccattggtggaaggaccttagaagactctataatcagcctgattttcacagcatccatcagaatatggtttggagagttggttgtggggacaaaatcaaattttggcaagattcttggctgagtgagggctgtaaccttcagcagaagtataatcaactctacaccatcagcagacagtag

SEQ ID NO: 83204 - DNA, 823 bp, Glycine max
  Peptide Sequence Number=SeqID_174889
atggcctcctctggacctattttctccttttctgggactcgaaccatcaccactgcaaagcggcaccatgaccacttggagaaagcttttgattctgttccagatgataaaagacctgaatgggagaagcttgactatcaactctgcgctgtgttatggcaatcagtagagccagatattttggagatccttcgatcatttaaatcatgtcgttctttttggaagaaagcccaggaaatctttgccaatgatatccaaagcttgtttgatgtaaccatgaaagttacagccctcaagcaaaccaaccatgacatgatcgctcatgtggactttgatcatgtgcgtgatcaagtacttgctggggaccaggttccatcaatgaattccctcatcactagacttctccgcgtgcctcatttattgaaggatgagaatcctgctgatggtgtggagaggtcagccatggttgcatctcaaggtagagaggcggccgcaactatagaggagatcgcaatggaaggggtggacgtcctcattgcacctattgcaagaggatgggtcacacccaagagaattggtattcgttgcatgggtttcccgacaaggtcacacaggtctctagataagagaaagcagagtctagattctctgatgaggacatgtatctctcaatccattgaaggtcctagtccttggatactcgactcaggtgccgctaatcatatttttggtaataagtcctccttttcatccttttcctttccaaaaattcatcaccttgttactgtagctaatggctccaaggttgcatctcaaggaagtg

SEQ ID NO: 83205 - DNA, 360 bp, Glycine max
  Peptide Sequence Number=SeqID_174890
atgactgcttctgaatcaaatatattgaagccttggggtcaaaatcaactcttagcttgcgcacttgagctcctggaacccaacttcacaaccaaacaattgttgtacaagcacgagagaatagtcccactatccagactgaatctaaatgacaatctaaggactcaaacaaaaccgaaagaggtcgacgaacataaccatggcatcgcgcctgagttccagtggccagataccagcatgtgggttggacgcgatggatgggccacgcttggagagatgcaccaaatccaggtgtcattggagactagaccaggggaacaggtgaggccatatgaaatattggaggataccaaatcttaa

SEQ ID NO: 83206 - DNA, 312 bp, Glycine max
  Peptide Sequence Number=SeqID_174891
atgggcaaggaaaataatggcagaaatgcacaaccagtgaagcacagaaaagttgccggaaaaggatgtcgactggaaagttcgttgctggaaaatgagaggcaagaaattaagtttgaaccaaatgtcatgtgtgaacctattgacaagaaagtaacatttcgaacaagccagggctgttggtgtccactgtcaacttatcaattatggcagacagtggtggattctggtgatgtgggcagaaggtgccttcctttgtcagtcagtggtagactggcaatggcattgagttgccgaggtgtggcaatttga

SEQ ID NO: 83207 - DNA, 183 bp, Glycine max
  Peptide Sequence Number=SeqID_174892
atgtcggtcgaaaaacaacacttatcgcgcctggatttccggaactgttcggttggttcatccgcggtgatgctctttgggatgcctcggccgtccaatgtcacccgaaacgcaacgtcggttgagtttgcacgaaataccataggcaaccttgacagaaaacattttgagcaacaacaatga

SEQ ID NO: 83208 - DNA, 312 bp, Glycine max
  Peptide Sequence Number=SeqID_174893
atgtggcatccttgttccattgttgctgatgaggattatcatgaaaggaaagccatgtgtttgtcgatggaagtctgggaagctattaccagtgtggacgtatcatggggttcatctattgtcatacaccgactaaagagggtagtgcgacagttaggttatgtgcagaccattcctcaacaccgggctactccatccttatctaaagagaacattgacgatagatggcttcagttattattagaataccttgcaccagttacacatatttgtagtgctcctagacaatgtgcagcaaactacatggagtga

SEQ ID NO: 83209 - DNA, 492 bp, Glycine max
  Peptide Sequence Number=SeqID_174894
atgagcgcccacgtggcccaggtatggcgcctactaggcaccctctggacccagataagtccaacagggccctggggtttctacgctgatcacgggcctctggcatactgcacgcctaggcaggcgcagggtgatgcacatcaggccgcagacgcactgccaccacctcggcaaaccgatccagctgggtcactgggcgtggagcattatctacagcatttggttcaccagcaggccgccaaccaccgtgggcaggtgcagatacatgagtgtctctaccgattcagcctcagtcagcaggggcagggttccgccttttttgcatgccctactccagagcagtttggggctgaggtcgcatggcctggagactggctcgatgcccaggcaggggaggagcctgcaggatcccccggtgagccagatgagtcccatatggatgaagatatgactgacttgctcggtttcttgggagggagcggagccacgtga

SEQ ID NO: 83210 - DNA, 252 bp, Glycine max
  Peptide Sequence Number=SeqID_174895
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttggattgcctaacgatgggtgtcaagtgcctcgaagtggtcaagcgtgggtcgcatcccaacaaacagatggtcccccgaacgaaattagggtatgacaagtgtcaaccaaggtag

SEQ ID NO: 83211 - DNA, 147 bp, Glycine max
  Peptide Sequence Number=SeqID_174896
atgcttacccaagaactttacggattgtgcaacaatactctttttgacttatggaatgttgcggaactttacggattgcgcaacaatgcttgttttgacttccagaatgttgcgagactttacggattacacaacgatgggtgttaa

SEQ ID NO: 83212 - DNA, 1059 bp, Glycine max
  Peptide Sequence Number=SeqID_174897
atggcagaaccatcgaagaagagaaagggatcatcctccaccgccgctgctgctgcccatcgccgccacagaccatccgaagcacccacaacacctattcatccctctttgtcatctccaagatcatccacgttgttttcatccgatgatcagcgtctatggtacctttctcaattttcttctaggatcatcttagaccctaagtacttagacgtagatttctttaatgatgaaacgtttgattgctatcaagtgtttcaaaattctggcctggttgatttcatgtccttaaaattgccacattatcctgaacttgtaaaggttttttactgcaatttaaaaattcaggatgacattatttcttctgaggtgcatggtattcctatgatcattgatcagtcattgttcttttctttaactcatttacccagtcaaggtgcaccttttgagggcaccattgttgatgactggaaatttgattattctagtcatgatgctcaccatatggtttgcaatgaccaggctgaaatgaccggtagattgctggccaagtcattaacatttgataatcgcatcatgcactatataattgttagaattttgcttcctcggtcttcgaatttggcacaagcctctgaggaggatttgattctgatgtgggctttccttaccggtcgtcagatcgactgggctcacttggttcggtaccgaatgcataaggcattatgggccaatgcacatctcccttaccctcaattgataactttgtttctgcgtcattttcaaattccgcttgatgatgaaccatttgttcaagtcaagcgttcctttgcaattggtgctagtgcagtgacttcctttggataccgtaaggatcagaatgcactcatgaatggagttttttccgaattacggggtcttcgttcttatgttggtgaacgtttcgactcattggatacacgttttgccgaaatggatattcgcctcacacagcttgaagaggatgtgggttacattcgtcagagtttcgatcttccaccaccacctccaccttcttag

SEQ ID NO: 83213 - DNA, 273 bp, Glycine max
  Peptide Sequence Number=SeqID_174898
cgtaggtctaatgtttttgtcgcaacatgcccgtttgcgggcgagcgaggcgagggtcacgggtgcgctttccaagggaggaaagatgcgtggagtcgccaccaacatttatttgtggaaaacgtcggaaaaaccgaaggaaaccggtcaaaaagaaaattccaagtttgggagttgtatttgcgtttgaggaaggtcgacaaaagcggggctcttgctcctacgtaccctccatcgaagaggaaatcagacctacgtagttcttctttaagg

SEQ ID NO: 83214 - DNA, 213 bp, Glycine max
  Peptide Sequence Number=SeqID_174899
aggttcaccgagagaaaggagggtttcagtggaagagagatatcattggaggaggccaacgagttcctccgctttatccaacagagcgagttcaagattatcgaacagctcaagaagacctcgactagggtctccctactagaattactcatgagctctgagcctcaccgagcattgttggttaaggttttgaacaaggcccatgtggcctaa

SEQ ID NO: 83215 - DNA, 252 bp, Glycine max
  Peptide Sequence Number=SeqID_174900
atggatgcatctttaaatgaggcacatttgatgcaagacggggacgtgacgggtatagcaaggggacagacaagggacgacgttgacttcttggatacggtgaccaagatgggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 83216 - DNA, 309 bp, Glycine max
  Peptide Sequence Number=SeqID_174901
atgctgggtgtcgcaacctaccctttggctggagggcgatgcgagggctcacgggtgcgtcttccatgggaggaaaatgcacggagtcgccaccaacgtttattcgagggaaacgtcggaaaaaccagaaagggtgtttcccttgctcctacgtattcctcaattgtgataaggaaatcagacctacgtagttctttcaaaaggggtgaatcaagtgattctttttaccttgaagagggtcatttaaggcattggaccttaaaattatccattttacttggtgagaaagctaaggcgttggacctctaa

SEQ ID NO: 83217 - DNA, 731 bp, Glycine max
  Peptide Sequence Number=SeqID_174902
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagaaagggcaggaggctttggtcagctgaaacagcggtttctgctgccgccgggcgtaatcggcgacgttggccgccagcgcggcggcatggctgtcgccaatcagcgctatcgccggtgtgtcactctgcggctggcactgcgcatcgcgggcgggccgcgtggcgccgtaatccagcaggcagggatcgcgctgggcggcgactttccattcgtcgccgagcttcaccgcttcactgacgcgcgatttcaggccaccgctctgccacagcagcaccatggcaccggctgccagcagcgacgaggcgcagtagccggggatcagccagcgcgtaccgctgcgcgcccgacggaatggctgttcgatgaagcgccagggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcg

SEQ ID NO: 83218 - DNA, 201 bp, Glycine max
  Peptide Sequence Number=SeqID_174903
atgaaagaaagagaatggaagatcttcagaccagacaaattcttagcaagcttagcccgatgtttcccctgtgtgagttttatacacaagtatattgtttctctaagatatggtgctctcgcgaatgcatttcatttttcatcattgcctaacgctgttcatgtgtcctccacccttcgagtttggagctatgcttcatga

SEQ ID NO: 83219 - DNA, 1268 bp, Glycine max
  Peptide Sequence Number=SeqID_174904
atggggacaaatcaaaacggcaaaaggttttatcaagtcaaggttaagggtctagatgtcaccagcctcaaggaattgggacgattgatgggacctctccaaaggaaagccttctgcaaagtgtacggaaagatcctagatttgatcacagcggaggtatttacggaagctgtcgtatccctcgcccaatactatgatcagccgttgaggtgcttcacatttggggatttccaaatggtaccgactattgaagagtttgaggaaatattaggatgccctcttggggggagaaaaccgtatcttttctccgggtttcttccctccttgagtaagattgcagctatggtcagagattcggcaaaagaattggatcgcatgaagcaaactcggaacggcgtagtgggcctgcctcggaagtacttggaaggcaaggcaagggatatggcgagccaagagaagtggggcccgtttgcggatatactagctttgttgatttatggggttgtcctctttccaaacgtggacggtttggtggacttagccgcaattgatgcttttcttgcatatcaccatagcaaggagagtccagtggtggctatcttggcggacttgtttgatacctttgaccgaaggtgcgagaaaaacagcgcacgggttgtctgttgcttacccgctctcagtgtgtggttggtttcacacctattccaacaagacacaagacacccgtgtccgcttcaaagttatcgctcatgcgtcgaaaatggaagagtcgattgggaccaacatttggctaggataggaggcagcgcaatcaattggtttcctcgttggaaggaaggcaaggagggagttcttttctcgtgtggggactaccctaatgttccattgatagggactaggagttgtattaattataatcccgcactcgccataagacagctagggtaccccatgaggggagcgccaacggaagggagtctctcacctttccttgtgagagatttaggcgcgcaaggtctcaaggttatacaaagaatccacaaggcgtggaggagtccgttgaggaaagacaaggagcttaggggcatccgtaatggcgtcatcggaggttatcatggatggctaagaattcacacgcgagggttagactggctctccaaattgaaagttatcgatgaggagaacttcgaagctccggaggaagatgaagaagtccaagctctaaaattagagctagggaaggcaagactcgccaaggagaagttcaa

SEQ ID NO: 83220 - DNA, 252 bp, Glycine max
  Peptide Sequence Number=SeqID_174905
atgaatcggaacgaagagaatgttactggggtatggattgatggggacccggtgttgagaagaacgaggataagggctacgtgggagtacgtgagctcagttgaaggtgagcaactggggatgtcgacttgcaccattgcccgaccgccacctagtactacatgtgacggagtggtacctggagatatgtcgcgggggtcaggagaccttggggacgtcaggtggggtgctattgcccaaaaccatgcttga

SEQ ID NO: 83221 - DNA, 180 bp, Glycine max
  Peptide Sequence Number=SeqID_174906
atggagtttcaaagaccaccaactgcttgggaggtgatggagaaaactaagaaattgaagttaggagaatgggttaatgataagtttggcgaatttgctgcaagagaaatatcaacatcgtcgagaggacatcttacaacattcgatagaggaagacacatctacataggattcccttaa

SEQ ID NO: 83222 - DNA, 237 bp, Glycine max
  Peptide Sequence Number=SeqID_174907
atggagagggagatgataacagtgatagtagacacgctactgatgttttactatgagaagatggtgggttacatgccttcaagctttgtcgatttagtgttcgctggagaaaggattgaagtgggtctgagaagaggcaaatttgattatcctgctttaatgaataggaagcctggggaaaatggagagaataagaaggagggaggaacccatcctgtgactattgttcctacatga

SEQ ID NO: 83223 - DNA, 208 bp, Glycine max
  Peptide Sequence Number=SeqID_174908
atggcatcttcgtcatcatcttcatcaaatattaaaattaagtctggtccaattgatggagacgtactatggatgcaagctaaacatgtttcagaacatgtttggaacggggaagaagaccgcaaattacacataagacgagctgtccccacatatcaaggggaagaagaaattccagaggaaattattcctcttctttggcaatgcg

SEQ ID NO: 83224 - DNA, 318 bp, Glycine max
  Peptide Sequence Number=SeqID_174909
atggttgaccattactcgttgggagatgacctaggatcacttcctagatactgcatttttaatgtttatttgattcgggtacggcctcgatcactaggtccattttggacaccaaccaagtggtgtagttcagcatgtactacctcagacggtgggctgcccacaccagggcacaacatgtcctttcgagcaaaaactccatgtggagcttgtaggccttggatcttcttcatcaatggagtccttggcttcttgaagatgaatggcaacggaatggagaagaaagatgattggagcaccaattcaaggagaagatga

SEQ ID NO: 83225 - DNA, 381 bp, Glycine max
  Peptide Sequence Number=SeqID_174910
gtcatctcctttttcccggccgtctcagatggggtcccttgatggtcattcaccaaccaaagagggttgtacaacagtttgggtacatccagactattccgccacatcctactgtgcctttgtgttcgtcagattacatggagtggttctacttcattttgcatccatttatgactcctgcacagccaagggatcctcctagagttccgctgcttcagcaatatgacacatttgttgaaccagatgatggttatgtagcaattgctgataagttggagaggctattgaacttgaggatcctgaccgaaggaatagaagtctatactgttgctgaagaatgtctgagcatcgcaagaagctacattggtcaaccaactatag

SEQ ID NO: 83226 - DNA, 853 bp, Glycine max
  Peptide Sequence Number=SeqID_174911
cttgcatccattagaagagaatgagcatgtgattggaattatgactgaaaatgttagtcagtttgtcagattgattgtgaaggaatgcaatgacagtatcccggccatgtttgattgtgataaccacttagccaaaaatctgaccacgttcttgaatgaattatcccttgcacccacattcgctaagcgcaacactcagtggctaagcgcgaggaagaatccagaagaagacgagctatacactgataatgtcctgggaagacatatattagctgagaggaaagtggaaatatatcatacagtgctggatgaatttaaggctaaattggagaggcgtaacttccataagcacctcaccaaattagttgacagtagcattgacctagcattggtgaaggagttctacgccaacctctacagtcctgaggggccttcaccaaaacaaggtgaacctttatctgcttactcaagatactgtaggatgcctactgacattaaggaaattgagactgctttgtgcatacccggccgagggtttattttaaatgctgaaggtcaccctaggaagattctcataaaagatctaaccactcttgctcaggtctggagtgttctctcatacttcaacctggctccgacttcccactcctcgaatttgactgtggatagagctaagttaatctttggcctagttactcagctggacatgaatgtcagagctctcatctctggacagatcacatcaatggcccagtctaactcctctagactcgagttccctgctcttatcacagctttatgtaggtccagaggagtcgcttccgacagcttggtctttgaacgtttgagcccg

SEQ ID NO: 83227 - DNA, 90 bp, Glycine max
  Peptide Sequence Number=SeqID_174912
atgtatataggtgtatggcaattagaatatgttggatgttctggagatggccccgaggaaacttgcctcaaagagatccaggaaggataa

SEQ ID NO: 83228 - DNA, 438 bp, Glycine max
  Peptide Sequence Number=SeqID_174913
atgatttggttgatgctcgccacgctggcgatagtgtttgttgtgggatttcagctgctgaccgccggttcgcgccacgccgcgcaggcgctcagcaagcggctgcagctgccgccggtgcatgttgaatcgctgcttgcgcagatgggcaaagaggcggcaaacgagttcaccgattacattcgcggcgacaacgaagtgcacctcaataatggcgcggcggtgctgctgatctggcaggtgctgattgtcgatggcagcgatgagaacgcacagcgctggcatcacattctgacgaaggcggggttctccgccctgatttcacgtcagcagctgttgctggcgctgggattcctgcgccagctggagccggacagccaggagctgaatgccttacgcgagcagtataatgcgcgctttacgccgcaggggatttga

SEQ ID NO: 83229 - DNA, 489 bp, Glycine max
  Peptide Sequence Number=SeqID_174914
cggtggtttgtttgccggatcaagagctaccaactctttttccgaaggccaccacttcaagaactctgtagcaccgcctacatacctcgctctgctaatcctgttaccagtggctgctgccagtggcgataagtcgtgtcttaccggcgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaat

SEQ ID NO: 83230 - DNA, 699 bp, Glycine max
  Peptide Sequence Number=SeqID_174915
atgcactacattattgttagaattttgcttccccggtcttcaaatttggctcaagcctctgagaaggacttgattttgatgtgggctttccttaccggtcgtcagatcgactgggcttacttggttcggtaccgaatgcataagttattacgggccaatgcacctcttccttaccctcaattggtcactctgtttctccgtcattttcaaattccacttgatgatgaaccatttgttcaagtcaagcgttcctttgctattggtgctggtgcagtcacttcttttggataccgtaaggatcggaatggtcaatggctgaataaagatgcacttcctccacaagatgagcgtactccttctcctcctcctcagcgaaatgattcagccctcatgactgaagttctttccgagttacggggtcttcgtacttatgttggagaacgttttgattcattggataatcgctttgccagaatagatgtccgtctcacacagcttgaagaagatgtgggttatattcaccagagtttcgatcttccaccaccacctccaccttcttatagtttagtttataattttctttttaagccacgtattttggctataataatatggatattacaagagatcatacagcttcttgaagacctagatctagaagatggactaggagtcaagaccactctctctttttgctag

SEQ ID NO: 83231 - DNA, 222 bp, Glycine max
  Peptide Sequence Number=SeqID_174916
atggtgtcgtttgtcaatgttaggattcaaggtgattctcctcaaatttcagccagcccgcatcaattagactttgcaccttacgcttcaaggtcatacaatgctcaatggaatgccccggggctcctccatgataagcacacattgcgttcgagtcgtatccttagaaaaatggaggtggtgttcgtcattggaagtgcggtagacaggctttgtggttga

SEQ ID NO: 83232 - DNA, 408 bp, Glycine max
  Peptide Sequence Number=SeqID_174917
atggagatgagtatgattgatgctgctagtggtggagcccttggtgatatgactcttgttgaggctaggaatttgattgagaagatggcttccaactcccaacaattcagtgcaagaaattatgttattgtccttagaggagtccatgaggtggccacggattcatcttcatttgctgaaaataaaaagcttgagggaaaacttgatgccttggtcaacctacaatcaggagttaatgagcaacctaaagcttatgctgcaaacatttataatagaccccatcagcagcaaaaccaacaacaacagaataattatgatctttcaagcaacagattcaatacaagttggaggaaacatccaaatctgagatgggcaagtgatgtgtcattattttctcctatttcttaa

SEQ ID NO: 83233 - DNA, 564 bp, Glycine max
  Peptide Sequence Number=SeqID_174918
atgggtgatcaagaggagacacgggaacagatgaaagtcggcatgtcggctctgaaagaacaaatggcttccatgatggaggccatgttaggaatgaggcaactcatggagaaaaacgtggccaccgctgtcgcggttagttcggttgccgaagcagacccaactctcctagctaccgcgcaccatcctcccccaaatgtggtaggacaaggaaggagcacactggggcacaacagcaacccccatttaggatacagctgggtggcttacccttatagattgccgcctaattacacgccgctagtcatgcaggatgacacgggtcatgtctcttcccccatccttgaaggggagcctcctcgacagcccgacaaggttcacgaagaccatcaggagtatgccaaggggatattgagttctaccccccgatccccgtcgaggggtcgacacccaacactttgcctcagcccaacctcacagcacaaccaatattcttgtccacagaaggaccacccccgacggccgaagaaagaaggaaactcgatctcctcgaagcgagattga

SEQ ID NO: 83234 - DNA, 348 bp, Glycine max
  Peptide Sequence Number=SeqID_174919
atggacgccatgaaagagaaaatggccgcaatgatggaggccatgattagcgtgaagaagataatggaagtcaatgcggttataattgccgctactagcactgttgctaaggtgaacccgatgcccccatctggcctcaaccaaatgaatcatccaaccttagatatggtaggcaaagatttgggaagtagggacggcctccatgatgtgcaaaatcaaaataagcacgccttcccgccatatggcctgcctctcaactatacaccacccaatgtggcgtacactctcaatgaggatgtcaataactccactcctatacccattgagagccaacaacccccaaactaa

SEQ ID NO: 83235 - DNA, 132 bp, Glycine max
  Peptide Sequence Number=SeqID_174920
atggagaatcgcactaagcaatcactacgcatggctccaaactcgaaggcaatcactacggatggctccaaactagaaggtggaggacacatgaacgaaaacgcaattcatggggctccgaaaaagggttga

SEQ ID NO: 83236 - DNA, 1260 bp, Glycine max
  Peptide Sequence Number=SeqID_174921
atgtctcctccacctctagaacctcacaatcactcacaaactcatctcaagctcttaggacgacttcctcttcaagctccgcgcgtgcttttctcactcagcggatggactgaagtggtgcgcttagtgggattacccttcgctcagtgccaatgcatagctcatccttcttctagattcttcctcacgctcaacaaaggagtgttgcgctcagcggatggctcgctaagccagaagattggcttagcgagagctctggccagccaaggagaatgggcagtattcatcaacgtattaactctgctattgtttggaacaatactattcccgaatgtagacaggttggtggatctagtggcaatcgacacctttctggcttatcaccactgtaaggaaagcccgatcatcgctgttttggcagatacatatgatatgttcaacttgagatgcgagaagagcagtgcaagaattatctgttgtatgcctgctctttatggtaaagcaaattgggaagaactcttggcagacatgataggagcgtcaattagttggttcccacggtggaaagaaggaggggcaagagtgttatgctcatgtgagggattcccaaatgttcccttgatggggacaaggcgttgtattaattataatcctgttctggccataagacagttaggctaccctatgagaggtgcaccatcggaggaaatcatcacgcctatcattgtgcgaggttttagtgaagctaatgcgaagatacttcaaaaaatccgtaaatcatggaatagagtggaaaggaaagataaggagcttaggggaagtagcaacaacgtcatcgacgactatcacaagtggttgaagtctagaacacaagggataacttggatcctaaagctaaaaagtctaagtgggaaagaggctaaaattcctgaggaaactgaagaagtgcaagctttgaaagcagaactcgaaagcacaagtgtggtgaaaaagaagctaaaaacgacagtcactagggttaagaaagactgtgatgagctgaaagatatcaacatgaccacgcttaaagcattagagcgggaaacaaaaagggcccgaaaaaaagaatggagcaggaacaagttccgaggggctctatggggcagcagtaacgtgctcaagcttagaaaggttgagagggatgaatcaaggatggaaagcatggtgttagaggataagttaaaggcttatcagaggttgaagagatgtttgacagaatag

SEQ ID NO: 83237 - DNA, 504 bp, Glycine max
  Peptide Sequence Number=SeqID_174922
atgagaactactcacgatcttccatgtgcatgtgagctatctagatatgtcgttggtaccataccacttgacacaattcatatgttttggcgaaggctaagttttacaaaccaaggtttatctgagcccaaagtcagcacaactgaagagatggaaaccatatccaagcagtttgaagaggttgatgtatgcggcaaagttactctaaagagtataggtgaagattcttggtctttagttcgtaaccatttgcttaaagaaccttcaaaatggtctgatgagtatatcaacctgcttggtggcatagatagatttgaggagttaaagcggtcgctacttgttgatggcttatccatgaatgagttcaagattgaatcaagaacacttcaaggttcaagaggaaatttgatttcaagaatcaagattcaaggttcaagcttccaagaatcaagatcaagattcaagactcaagattcaagaatcaagaatcaagagaagacttaa

SEQ ID NO: 83238 - DNA, 1722 bp, Glycine max
  Peptide Sequence Number=SeqID_174923
atggcggcaccaccgcagaatggcaaggaagattcttttgccaactgccatagacagttcgtgaagggaggcttgctatggcggaatttgggccttctgctgtcctccattgataacactgacctagagactggaagtgtcccagggcctaggttcggggagagcaacgaccataccttcgaggtcgaggtcgaggaggacctggcatccgagcctggagtgcttgttgagggctctggctcgggaattgcggacgaggacgtactcctcgtcgtaggagcgaggggggagcttgtcgagccactcctgggcaatgttgacctcgcagtgggccgcgcaggcgtcgatctcctcgaggcggtgggactccgggtcgaccaggcccgtgttgatcagggccttcagcaaggtctggccggccaggcccaccacctcgtgcttctttcccacgaagtcgatcgccgagagccgtacgatgcggtcggcgaccttcttcgtggaagaggaggtgcggcggtagatcagggatttggagaagaacgagagggaggggaggcggtgcgcttgcgaggacagtctctgcagattcgcgactgccattggtgcttcttgttttgggaagctcgtcgagagtggtcttttggttgggaaatcggaacaaaagaaatgattgggtttggccgtgaaatgggcggaatacaaggtagcaaattcctaggtgcacccattccaatctctgcggtgatgtggaataagcccctcagcgttgaaggtcgacagcatctgcacgtagataatgggcagctgcagttgttgttgaggatgttgatcatccaactgacgaggtttatgaacagccttaggagtcagttactgatgatccacagtttgggcatgagagaacgtcctgagttgaagttgtcctctcatgggaggaaggtacaaaaatttggaaggcatgcaccagagattgaaggcataatggttgtcacaggattaagtcttctgattgcatgttccttgggcactggtcacttcactatcaccctcgatgatgtggcatttttgctacacctgcccattacaggagccttccatacctttgatgctcttcatgtagaccaagttgtggacttgttagttgagttgcttgaatggactgtagcaactcgagcacatctgttgcatctagttggttgcacactgttttctaacaagagtgtcatacatgtgcatgtggtattcttggacgcatttcctaacctcagccaatctggaagctattcattgggagcgattgcattggtccatatgtatgacaatttgaatgatgcatcaaaaaaatccgctaggcaacttgtaggatatatcacactattacagtattggatctacgagcatttccctactattgtttcgtgtgtttccgataaggattatcatgaaaggaaaccgcgtgcttgttggtggaagtctgggaaggcattaacagtgtcaacgtatcgtaagcgattggatagattgacgtcaaatgttgtctgttggattccttatggtgatcaccgtgcattcaaagaatttgagcttatctccttattttcggacaaattagatgtggttcataagattgacgatagaaggatgcagttttctgaataccttgcaccggtgggtcagatttgtgttgctcctagacagtgtgcaactgactacatggagtga

SEQ ID NO: 83239 - DNA, 252 bp, Glycine max
  Peptide Sequence Number=SeqID_174924
atgatgagaatcctgaaactggccaaatacaggctaaaggcccaaacttatcaaggtaatccttgtggcgtctaccctgacttatcttccttcaccggaagtggcgtctatcctgacttatctttcttcactggaagtggcgtctaccctgacttatcttccctctctggaagtagcatcatccaaaatctctatagcctgtatcaagcaatccgctcctactcaggttcacatcagaaagcatgtgagtga

SEQ ID NO: 83240 - DNA, 462 bp, Glycine max
  Peptide Sequence Number=SeqID_174925
atgaaagaaaagattgagggcttgttctccaccgaatccttgaggcagattctgctccaatttttgtggtggccactagtggtcgtgggtggtggaggaggagtttctaggatggtttggcagagttttgagagagggagggatcttggagcaatagatagatcaaatttgattatcccatgtgagaatatagcatcggtcaattactgtcgtaacctacccttcggcgggagggcgacgcggggctcacaggtgtgtcttccaagggaggaaggcgcacggagtcgccaccaacgtttattcgaggaaaacgctagaaaaaccagaacatgtggtctaagaaatttaatcgtgaaaggttcgagagttgtttttacgcacggggaaggtattagcaccccatgcgtccgtcacaagggacggcagccttcaatcaagtgtgcaaatatgacttcaaaatga

SEQ ID NO: 83241 - DNA, 243 bp, Glycine max
  Peptide Sequence Number=SeqID_174926
atggcaagaatagcaaaagtggtcaagatctcagaacaagagctggaccgagtgaagcaaaataggaatggagtggcaggaaaatgttcggtcgtggaaagtgcaccggatcgcacaaatacacaagtatttacatcaagtacctacaaggaagaaccaacagaggatttagctctcatatctgggaagcttcctttacaacaaagagaagagaaagatgaaggattgaagaaatacaagtag

SEQ ID NO: 83242 - DNA, 531 bp, Glycine max
  Peptide Sequence Number=SeqID_174927
atgaccgatgtttggtctcggacatcccaccacattgaagatgaggaattgatggcgaggaaaagagctatggagaagaaggagactagatggacatctggatcgacacctgcctccaaattgcaccataaagagtatatgaagccatgtaacaattggaataaagggatagttgaccatatgccaaggagagatggtggatggaagaattatgatcaagggaggcaaaagataggagatactcaacctgactctattgacaatttcacgatgagaaattctgatggaggtatcgaatacttgattaaaataaacccattggccaagaagatcaacaaactggatgaaaaaggaaaagataagcacgacaagagcgacccacctctaccaccaccaacaccaagtgtttctaaggcatctggtcaccaacaactaatttttggtgatttcaatactattgctggtggattttcaagagaaggagaaaattctttagcaagaaagcattacgcacgatcaatcatgtcctag

SEQ ID NO: 83243 - DNA, 594 bp, Glycine max
  Peptide Sequence Number=SeqID_174928
atggagagaacgaggaagaggcagcccatgacggagccaatggcggagcccagcatgccaagccttagggccctgaggttgatgtgggcccggaaggcctcgtcggcgtccttgctgttgagcagattcagcgccagcttcagcccctgcgctaccagcgacgagaagaggaagaagctaaacgacaccacttcgaagacgaggagcttcttggctacgtcaacgtcggcgtcgcaggaggagcggttctcgaggctgcgctggcccggggtggtgagggagagacccacgaagacggcgatcgtgaagagggagttcacgttcaccaggccgtctagggctgtcacgtggacgctcgtcgtggaagaggacgaggatgaggagactcttctggtgagggtttggtcgttaggagagagagagagagagatactcgtccatggagaatcaatgccggtgagagagggagtattttggatcgtttcgaagtcgaaagggaaagtaaatgcaacctcgaaagaaagtgaagggggacacaggacaaacacttcagaaatttttagaacagataataacatcactacacgctcctaa

SEQ ID NO: 83244 - DNA, 664 bp, Glycine max
  Peptide Sequence Number=SeqID_174929
atggcttgtcctgaggacaagaaagtgtcttatgtggtgttcatgttagctactaaagcagagttttggtggcatggaacccaatcaatgatagaagctcatggggaagccttcaaggaacgatttttgggcaagtttaaggtgcagaggacaatttttctgatggctatcatagagtttcttgccatggttgagaagatgaagattgtcgatgtaacaccccaatcgaatcacaccagaatgagagggatccagaggttgtacaatccatcacttaagaacttcatagttaagtatgcttggcttggagtagttgtgggatgggtgaccatctgggaagtttcccaaaaagcatgtctcaaaaagggctacctatggagtgttctaaccaatggaggggatgttataatggagcacttagagtgcaataatcgggtgttgaagactcatggagatggatcatctagacctaagaagggaaaccatcagaagaagccatacaatagaccacaacaacatcatggaggtccaattgtgtctcgtacagggaacaagggtgtcaggcacatctcaaagaattgccaagttgttgtgaaaactagggtgtgtgttgcatctcatcaagtattagggtgtgtgttgtgtggaagcaatgccttcaaag

SEQ ID NO: 83245 - DNA, 112 bp, Glycine max
  Peptide Sequence Number=SeqID_174930
atgggcagagttgccaccaacgtttatttgaggaaaacgtcggaaaaatcggaaaaggtgtggtctacgaaaagtgtgaaaggttcgggagttgtttttacgcacggggaag

SEQ ID NO: 83246 - DNA, 234 bp, Glycine max
  Peptide Sequence Number=SeqID_174931
atgcgcttagcggataggaagaatctggaagggaatctgtcacgcaggcacgcgctcagcgcgtcatcagctcgctcagcgagtcgtttgtcaccttccaggcttagcgggagtttggcattgagcgaaaattcacttactcgcgctaagagcgagaatggcgctaagcgcgacgtcgaggagcttccttgctatgaaatgctaaatcctcagttggggattcttgttgagtaa

SEQ ID NO: 83247 - DNA, 243 bp, Glycine max
  Peptide Sequence Number=SeqID_174932
atgttctggtttttccgacgttttcctcgaataaacattggtggcaactctgcacgccttccttctttggaagacgcacccgtgagccccgcgtcgccctctcgccgaagggccctatttgatgcaatcctccctaggaagggaccagtcactagagccatgagtaagaggctccaagaggattgcgctagagctgttgaagaaggccctaaggttctcatgagcctcagggtagatttctga

SEQ ID NO: 83248 - DNA, 318 bp, Glycine max
  Peptide Sequence Number=SeqID_174933
atggcagaatcgtcaaagaagagaaagggatcatcttccaccgccgctgctgctgcccatcgccaccatggaccatccaaagcacccacagcacctatccatccttccttgtcatctccaagatcatccactctgttttcttccgatgatcagcgtctacggtacctagacatagatttcttcaatgatgagacatttgattgttatcaagtgtttcaaaattctggcttggttgatttcatgtctttaaaattgccttattatcctgaacttgtcaaagtcttttactgcaatttagaaattcaggggatcctctag

SEQ ID NO: 83249 - DNA, 348 bp, Glycine max
  Peptide Sequence Number=SeqID_174934
acaacaaaggctaagggagtgcaaccttattgggcagaaatttatattgacactcagactcgaaaagatggaagcattgttactgaaaagactggtattgtaatcgatgaactaaaaaagaaaacggttgaagcaaaaagttcacaaaatttacaaactacccaagattctacttattggacaaatgatatatattccaaagtcaaaggacctgaaaaaaaaggacgtgcgggttgtcttgggaagcttccacatcaaacaagtatatctcaaagctcttatgcatacaataaaattcaaaaattggagaatttgcttagaaaccttgtttctgtccttaaagtgtga

SEQ ID NO: 83250 - DNA, 591 bp, Glycine max
  Peptide Sequence Number=SeqID_174935
atggatccattcagtgggagtcgttccctctacacttcatcagaaattgaagttcgtagtggaaaggcatttggtcatcgtatcaagagaggaagacatcttggtgagttgtccatcctctatgccatatatggaggccgcagaggagtcgttagaaaccattttccagtctttcgaggtgatacgacagtaatggtggcccgggtaatgttggggaatggctacgagcccgaaatgggtttaggcaaggacaacggcggcatatctagcctgataagtgccaaaggaaatcgtgggaagtttgggttaggctacaaacccacacaggcagatataaggaaaagcatcgcgggaaggaaaaacggaggtcaaggctcacgattaagacaagaagacgaaggaagcccactctgccacataagtaggagctttataagcatgggtctaggggacgaaggccaagtcgttgcaatatgcgaagatgatgctccgagtggttcagatttggtaccaccatgccctcctgatttccaactaggaaattggcgagtggaggagcgcccaggcatttatgcgacaagcataatgtaa

SEQ ID NO: 83251 - DNA, 310 bp, Glycine max
  Peptide Sequence Number=SeqID_174936
tgatcaaggagttcccatgaaccctaagagaataaaggtcattcctgagtggcctactccatcaagtttaagaaaaatttggggcttccatgacttagcaaacttttacaaaaggtttgccccatatttttctatacttgtagcaccactcattgagttggtgagaaaccatgttccttcatgggaagatgcccaggaaataggtgttgagggaaggagcccagagtatgaagaacctcaagatttgaggtcatatcctttccaaggtggagggaatgatgcaatcctaccctgcaagagcattggatag

SEQ ID NO: 83252 - DNA, 411 bp, Glycine max
  Peptide Sequence Number=SeqID_174937
atgggggccgtgaaggaccagatgacctctatgatggaggccatgttgagtatgagaaggatgatggaggacaatgcggccataatcgccaccaccagtgccgccgttgaggcgaatctgactcacccatcctgcataaaccaaacaagtcgtccagctccaaacatggtagatcagggaagagaagtgttggacagtacgggtggtccctatatggtgcaaagtaagaattctttcccaccgtacggcttgccacctaactatacaccacccaatgtggtgcatgtgcccagcgagaacaccaaccacttcattcccattctccttgaaagccagcaaccccagttggggcatcaccctttgctcaacctatgggagaagcccgtgaagagcctcgggatcacgctctag

SEQ ID NO: 83253 - DNA, 164 bp, Glycine max
  Peptide Sequence Number=SeqID_174938
gtgtcaagggaagaagcccagagtttcaagaacttttggatttgaggtcaaattcttttcatggaggaggggatgatgcaatcctaccccccctaggacattggatagaagactccaagaagattgagctagagatgcaggagaaggccctaagattctcatga

SEQ ID NO: 83254 - DNA, 252 bp, Glycine max
  Peptide Sequence Number=SeqID_174939
atgaatatcgaagaatccattcatgttacctttgatgaatctaatgctatcttgtcaagaaagaatatgctagatgatattgcagattctttagaacatatgaatattgatgaacaagattccaaaggaaatgataaaggaaacaatgaagatcctccagaagaagtcaaatccaatgatgaacttccaagagaatggaaagcttcaagagatcatcccctcgacaacattattggtgatatctcaaaaggg

SEQ ID NO: 83255 - DNA, 303 bp, Glycine max
  Peptide Sequence Number=SeqID_174940
atgggtcattttaaggtccaacgccttaaaaggacctccttccaattgtcctttgggacaaacgtgagaggtgctaataccttcctcaaacgtaaatacaactcccgaatctggaatattcttcatgatcggttcccttcgatttttccaacgtttttcacaaataacgttggtggcgactctgcgcattttcctcctttggaagacgcacccgtgagcctcgcctcgctcgcccgcaaaagggtaggttgcgacagacatggtttccatttcctcagttatggtcacctcagcctcacataa

SEQ ID NO: 83256 - DNA, 474 bp, Glycine max
  Peptide Sequence Number=SeqID_174941
atggcggaaattatcaacgaggagaacttcgaagctccggaagaggatgaagaagtccgagctttaaaaacagaactaagaaaagcaagacttggcaaagaaaaattcaagttagtcgctacagacgtccgaaaagagtgtgtcgggttacgagaagaaaatgcagctaccgcaagagcccttgaacgagaaaccaagaaggcttgcaaggaagagcatggtcgagacaaattccttggagctttgtggggcagcaatagtgatctcaagcttcgaagggaagagagagaccagtcacgagcacatagcatggtcttgaaaaaggagttagctgcttgctcaaggtccaagagaagcttgtctcagcgtttatgcgagacagagaccaacatgttagccatcgtcagcaagtaccaagaagaattaaatctagccacggaccacgagcacaaagtggcgtacgagtatgcctga

SEQ ID NO: 83257 - DNA, 417 bp, Glycine max
  Peptide Sequence Number=SeqID_174942
atggcttccaaaaagagaaagagtattggtacgaggcccacaactcagtatgacacaaggagattctcttccttagatgcttggactagatacacagataatgttctagggagaaacattttacctgaaaggaaggtagagctctatcacactgagctagatgactttaaggatgaattggagaggcgtaatttccataaacgcctcaccaatttagtcaatgggagcatagatctggctttggtgaaagagttatatgcaaatatatacagttctgaggaccgtccaccaaagcagtccagagtcagagatcatttggtgaagattgatgctgatagtctcaacacattactggagacacctatggtattagttgagggagagactctacctgcatactccagatattacaggtag

SEQ ID NO: 83258 - DNA, 295 bp, Glycine max
  Peptide Sequence Number=SeqID_174943
ccttggaccaaggacgtgtttgccctgggttttgtcacttccatggagttgtgtcgaggcttaccaaggacgggccttggattttgtaaacccttatggatcagcaagcgcgaaggttgggtttgatgagtcttgcgtgcagtgcaagtattgtgctcttacatacacgcctcttacaaagtggcaggtactggagacacggtggtgtctatcagtgggactcaccaaaggaggaccttgggtttcgcaagccctttggaggattgaccagggaattttccgacttgggttttga

SEQ ID NO: 83259 - DNA, 219 bp, Glycine max
  Peptide Sequence Number=SeqID_174944
atgagtctagaagaagctcaccaccatagaaggtcatggataagagcttggaggaagaaggagatgaatgaagggagaggaagagaagagcatgaaattttgtgctctaaaagagctctgaaatttgaattatggttcatgatgtggaccttacggggtggatcgcttgatacaggctacggagttttggatgacgccacttccagtgaaggaagataa

SEQ ID NO: 83260 - DNA, 137 bp, Glycine max
  Peptide Sequence Number=SeqID_174945
atggatgattttagtgaggatgaggatcaacagttctttgatcacatcaatcaccaaagtgacgaccaaagcgatggcaagggtgttggcagaccaacgacacctccgtcacctccgttgcaatatcaccaacctag

SEQ ID NO: 83261 - DNA, 255 bp, Glycine max
  Peptide Sequence Number=SeqID_174946
atggacccgaagaagtccaacagggccctggggtttccagctctggttacgggcctctatcagtcctacaaagtgcatgtcacctccagcaagggcatcaggctccctactaatcgagctttcatcaagaagtactgcgtccccaggcaggtgcagggcgaaacaccacagaagcctggggatggccggcagcgggcaacagacacaccgccatcacctctagagttcacctcagctcatccacaaaaaggttag

SEQ ID NO: 83262 - DNA, 111 bp, Glycine max
  Peptide Sequence Number=SeqID_174947
atggcccgcaccaagaaaaatggtcaaacgacgtctgaggcagcaaaggaaattgcagacaagattgattcattggaggagcaagccccacaggacattaggatgtactga

SEQ ID NO: 83263 - DNA, 830 bp, Glycine max
  Peptide Sequence Number=SeqID_174948
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatcagcagaggcagccataatcctcctggaacataactccattgacctgggaaccacagccctacagcccagcagctgcaacaagcctgcccaggagagtctgagctcaaacatgcctaacatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 83264 - DNA, 1828 bp, Glycine max
  Peptide Sequence Number=SeqID_174949
agggctgcatgccccacacctttagaggactacacgacctgaccatcagaggactgcacggcgtcaccttcagaggactaaacgtcctcgccatcagaggaatacacgtcctcaccattagagggttaggactacacgtcctcgccatcagaggaatacacgtcctcacaatcagaaggctatacgccttcaccttaagagggctacacgccctcacctttagaggactacaagtcctcgccatcagagggtcgcatgccctcatcttcagaggactacacatcctcaccatcagagggtcgcacggcctcatcttcagaggactacacgtcctcacctttagagagctacagttcttcaccatcagagggttgcacgtcctcccattcagagggctgcacgtcctcaccatcagaaggctacacgccctcacctgcagaggactgcacgcccttcctatcagagggctacacgccctcacctttagaggactacacgtccttaccatcagagggcttcacgccctaacctgcagaggactgcacgtcctcaccatcagagggctgcacgccctcacctttagaggactacacgtcctcgccatcaaagggctgcaggccctcatcttcagaggactacatgtccttgccatcagaggagagctgcagttcttcaccatcagagggttgcacgtcctcgccatcagagggctgcacgccctaaccttcagagggctccacgtccttaccatcagagggctgcacgccctcacctgcagagggatgcacgtcctaactatcagagggctgcacgctctcaccttcagaggaccatacgtcctcgacatcagagggctggacgccctcacctttagaggactacacgtcctcgccatcagagggctgcacgccctaacctgcagaggattgcacgtcctcaccatcagagggctgcacgccctcgccatcaaagggctgcacgccctatcctttggaggactacatgtcctcgcaatcagagggctgcacaccctcacctttagaggactacatgtcctagccatcagagggacgcacgccctcacctttagaggactacatgtcctcgcctcagagggctacacgccatcatctttagaggattacacaggactagacattcacgtcttaagagcactacacgtcttcgccatcggagggctgcacgcctccacctttagaggacaacacgtccttgccatcaaagggttgcatgccctcactttcagaggactacacgtccttgccatcagagggctgcacatcctcaccatcagagggctgtactccctcaccttcagaggactacacgtccttgccatcagagggctccacgccctcatctttagaggactacacgtccttgctatcagagggctgcacgccctcactttcagaggactagacatcctcgcctttagaggactacacgtcctaccatcagagggttgcacgccctcacctttagaggactacacgtccttgccagcagaggactgcacgccctcaccttcagaggactacacggctgcacgctctcaccttcagaggactaacatcctcgcctttagaggactacacgtcttcgccatcgagctgcacgcctccacctttagaggactacaggtgtttctcccattagagggtgcatgccctcaccttcagaggactacacgtctttgccatcaaggtgcccgccctcactttagagactacacgtccttcaccatcagagggctgcacgtcctccccttcagagggcatacctcctcaccttcagaggactacac

SEQ ID NO: 83265 - DNA, 357 bp, Glycine max
  Peptide Sequence Number=SeqID_174950
atggcagctcaggtagcaaccccaatgattgagagagagttgatagcaatgatagtagacatgttgccggtgtcctactacgagaagatggtggtttacatgccttcaagctttgccgatttagtgttcgccggtgaaaggatcgaagtgggtctgagaagaggaaaatttgattgtctcgcattgacaagtaaaaagcctggggcaaatagagagaatgagaagggggaaggaacctgtgttctgactgccattcctacatggccaaattttctacctgctcaacaatttcattactcagccaacgttagcccttttcattacccaccacccaatcatccacgaggccatcactaa

SEQ ID NO: 83266 - DNA, 342 bp, Glycine max
  Peptide Sequence Number=SeqID_174951
atgcggaggaactcgcttgcctcctctagtgatacttatttcttgccacagccctcctttttctccgaaaaacctttcactggaatattctcgtttggagtggggatcactttgtcactttgttcttctgccatcttcgccttccctttaacatttgcgggttgtgtcgacaggtcagggggtgcgaacacacgaccgttgcgggtcacgccgctcagtcccttgatattggttaccctggccgacaacgagctgatgtcggtggcttcttccttcctttcgcttggaggcgcatacctccacggaactgcgtggctgttttggtatggggggatcctctag

SEQ ID NO: 83267 - DNA, 501 bp, Glycine max
  Peptide Sequence Number=SeqID_174952
atggcctacatcaggaagaactgttggaatcctgatgatctgacaatttctatccgaggggctaggagggcgaaagcgaggccaacgaatcttccttcaacatctacagttcctactccagcatccactttagtagctccttcagtcctagctcagcttgattctcagtgctttgaagccatgcttcagagcattcatcagggacacatcattttacttcaaagtttacaggtggtggctcctccaagattcattccttccattgagcagtttttggagagggtagcctgcctgggtgaagagcaggttagaccagagactgctgctactccagagagatcacttgagagtacatcaaagccttctactccagtagcagacctcttctcactacagcctgaagctgacccttgcactcctgtacttgatataccagaggatcagaccacaccagtctggacactgaacacctctcctccagctactccagtacttcactag

SEQ ID NO: 83268 - DNA, 207 bp, Glycine max
  Peptide Sequence Number=SeqID_174953
atgaagggaagaaagcataaatatgggtttaacaacaataaacgtgagaagacagagaagaaaaagaaaattgcattagacgatgttaatcaattctccttcatcatgatcatttcgattagcatgaacgtcgtcagcttcttcttctccgacaacgttacgagtgatttgagcggtcaaaggactaacataggtgtccatgtatga

SEQ ID NO: 83269 - DNA, 933 bp, Glycine max
  Peptide Sequence Number=SeqID_174954
ctaagcattcagagggctacaagtccttgccttcaaggaccacacatcctcgccttaagagggcaacacatcatcgccttaagaggactacatttcctcgccttcagtgggctacacgctctcgcattcgtagggctacacaccctcaccatcagaggactactcatcctcacctttataggactacatgtcctctccttcagaggacttcgcgtcctcatctgcataggactacacgccctcgccttcagaggactactcgcccttgccttcagaggactacacgtcttccatttcagaggactacacgtcctccccattagaggaccacacatccccgccttaagagggctacacgccctcgccttcaaaggactacatgccctcgtcttcagaggactacacgtcctcaccttcagacgactgcacgccctcgccttaaaaggactgcaagttttgaccttcagaggactacacaacctcgccttccgagggctacacgtcctcgccttcagaggagtacacatcctccccttgagagggctacacgcccttaccttcaaaagagtacacgtcctcaccttcagaggactatacgtcgtcgccattagagggctacacgtccttgccttcagaaggctacacgtcctcccctttagaggactacacgcccataacttcagaggactacacgtcctcgcctttagagggctacacgtcctccccttcagaggacaacatgacctcccctttagaggaatgcaagccctcgccttaacaggactgcatgttctcacatttagaggactacacaacctcgccttccgagggctagacgccctcgccttcagaggagtacacatcctccccctgagagggctatacgccctcgccttcgtagggttagacacccttaccttcaaaggagtacac

SEQ ID NO: 83270 - DNA, 135 bp, Glycine max
  Peptide Sequence Number=SeqID_174955
atgcatcatttcaaagataatccaagaattgcgatgaacgcactaagcgcgcctgctgcgcttagcctgttcatcgcaactgttaaattttttaggatttctgatgatcgcgctgagcggatgatgtcgcgctaa

SEQ ID NO: 83271 - DNA, 1010 bp, Glycine max
  Peptide Sequence Number=SeqID_174956
gcgggatttgctaccctggagtgttcggtgaccgcggaggacgacctccggcaggagacgcagaccggggacggccccgcctcgaggagtccggcgatgtcacgcacggaacgcacgcaactgatcggcatcacggacgtcgtccgcgtcgtcctgggatggggagccttcgcggcgatcctgatcctgcacccggtgctcggcgccccggttccgagccccgtgctcatcatcgcgctcgcggtgatcatcgccgtgatcctggtgtgtgcgttcggtgtggtgaagcaggccgaggcgctggcgcaccggctcggcgacccctacggatcgctcgtcctgacgctgtcgatcgtgctgatcgaggtgatcctgatctcggcggtgatgctcggaccgggcgagcacgccaccatcgcccgagattcggtcatggccgtcgccatgatcatcctgaacctcgtgatcgggctggcgctcctggtcgggggcgtccgccatcgcggcatggcgcacaaccgcaccggcacctcggcgtacctgtcgatgctcgtcgtgctggtcgcgctcgcgagattccgatcgtcgtgctcacgctcgcgctctacgcgttcttcctcgctcggcagatgggcgcgcaggccgacgacttcaccgaggtcgacccgcgtctgccgcgcagcacaccgcacggcgagcgggcgaccgggggcatccgcgaggtcctcgccgagcaccgcaccgaggtgatcgtgcggctcgccctgctcgtggtgaccgtcatccccatcgtgctgctgtcgcacgacatggcgaccctgctcgacgatgggctgggccgtctcggagcacccgtcgccctcgccggcgtgctcatcgcgggcatcgtcttcctcccggagtcgatcaccgccgtgcgggcggctctcggcggggaggctcagcgggtgatcaacctgtgccacggcgcgctcgtgtcgacggtcggcctcaccatccctgccgtgtga

SEQ ID NO: 83272 - DNA, 252 bp, Glycine max
  Peptide Sequence Number=SeqID_174957
atgatttgtgtaaacgattacaatgatttgggtacatcctttgtggtacaagtaaagggtacatctacttgggttgttgtgactgagaacaagagagggtacatctcttgtggatcagttctagtggagggtacattcactaggttgttcaaagagaacaagggagggtacatcccttgtggatctttgcttgtaaaggaatttacaaggttgaaaagaaatctcaaggaccgcaggtcgcttggggactag

SEQ ID NO: 83273 - DNA, 501 bp, Glycine max
  Peptide Sequence Number=SeqID_174958
atgatctatcttctccagccagcaccagaaacttatgagttatttgatgatataattatccgctcagatgggcaaattgtgtatcaacatccaagggaaaatgtgcttaagttctttgagtacatggggttgaaatgtctagagaggaaaggaataaccaattttttacaaggagctgcagtaactttggttgaactagggggatatgcaagaactgattctctacttgatgatttgacaaaggaaaaaccaaatgatgctgatgttttttgtttacttggagaagttaagtatgaactcaaagattatgaagggagtgttgttgcatataaaagctcaacaaggataagcgaagatttattcatccgaagtacaaggtgtactcgggagaaaacgggggcctcattaaaacctccaagagccaaaaccctatgggaaaaagactcaaggaggaaaaagagaaccccaaaatacatgcttatgtgttcagttgatacataa

SEQ ID NO: 83274 - DNA, 453 bp, Glycine max
  Peptide Sequence Number=SeqID_174959
atggcagcttcggtctggcctccaacggggacaccgtcatcttcctcccttagttttcacttatgcaaccaccttaacttctcccccctcacatgcggcctttgcttctgtgtgtggcgtggaatgcaacaaccccaaagtggcgagtcgatcgatcaaagaggaagagatggaagtggaagggtcatcgaagaagatgatagcgacacaggcaggctggctgagttctacctcccctggaagtgcaagaacgagtgccacttctatgaaaagtgcgagtatgagctcatcatggagaggatgcagaagattcgccaacaccaacaaaaatccaaccccaaacaaccccttatcccatttcccaaacctgctaataccttattcatttccccctctcacttctctacgtgtttaacacatgttgatgaagctaatgatatcaagaacaattag

SEQ ID NO: 83275 - DNA, 378 bp, Glycine max
  Peptide Sequence Number=SeqID_174960
atggagaagcaacacccaaaacagcaagagagaacatcatatcaaacaaataaactatcaatctctacaaaaaggatattgtatgtacccataattagagttattggaatgagaaacatgtctcgacttcacagcggcgttgatatgagctcatacatgtctcaaggtcacagcagcactgatatgagctcatacacgtttcgagttcataacggcatccacatctcgagacggtgggtcagatttgagttcttgctcaaatctgagagggagctttcgagtgaaggaatgacaaggagtgagtatgaagctgctgtggatggtggtggagacggtagattcattacagcgggtggtgtttcaaatggacaaaattag

SEQ ID NO: 83276 - DNA, 108 bp, Glycine max
  Peptide Sequence Number=SeqID_174961
atgatgtacggggtgatttcttggtcctccgccggtacttgcggattcaaaggtacacaaagggggttacattttgccgctcaaactgcaacaggaaatgctatttga

SEQ ID NO: 83277 - DNA, 540 bp, Glycine max
  Peptide Sequence Number=SeqID_174962
atggctctcttttactattttgttgaatcaaaaacggatccagcttcaaagcctcttgttctttggctcaatggaggaccaggttgttcttctcttggagtgggtgcattctctgaaaatggaccttttagaccaaatggagaagttctgattaaaaatgagtacagttggaacaaagaaacaaacatgttgtatttagagacaccagttggagaagggttctcttatgctaaaggtggctcctcctatgactttgcgaatgatgagacaacacaaattattggacctttcttgattcctaatctctttctctcatacaccatgagtacatcaaccaaagcttggatagtggcatcaagaataggcgcagtggaggccttgaaagaccaattaggtgtatgcagatggaactatgccttaaggtcactacaacaacatgcaaagaacaacatcagatcttatagtcaagctaggaaattgtcctctgcatcctctgttgcggtttccaacagaatactcaacaaaagaaaggaaatgtga

SEQ ID NO: 83278 - DNA, 117 bp, Glycine max
  Peptide Sequence Number=SeqID_174963
atgactagagaagttgtcatcatcaaaaagggggagattgtggaagcaaagcttcatgatgaatcaacaatgattcaaaggtgttttggtgataacaatgatgacaacaaaagatga

SEQ ID NO: 83279 - DNA, 687 bp, Glycine max
  Peptide Sequence Number=SeqID_174964
atgggcaactgctgtagatccccggccgccgtggcccgcgaggacgtgaaatcgagcttctccaacgccgaccacggaaagcgcggcggcggattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcag

SEQ ID NO: 83280 - DNA, 1421 bp, Glycine max
  Peptide Sequence Number=SeqID_174965
acgatcgccgggcgtggtttcacgcgctgaagcagcaggacgggctgtcgtcaccggcggtgatggcgctggctgccactattgccgcctaccgtcacggcgcaccctggctcgacgcgctgcgcgattatctgcgcgccaatatgcagcacattgcgcaacggctcaacgcggcgtttgccgggctcaactggcaaccaccgcaggccacttatctggcatggattgacaccgcgccgctggccattgatgacgtcgcgctgcagcagcggctgatccagcagcataaggtggcgattatgccaggcagcacctacggcagcgccagccgcagctatctgcgtctcaacgctggctgcccgcgcagcaagctggatgacgggctggaccggctgattgccgcactgcaatccgagtgcgacatgattgatgcgaaacttcccctcaccgaccttcaccgccacctcgatggcaatatccgcgcccagaccatccttgatttaggtcgtcagttcaatcttgcgctgcccgccgatacgctggataccctgcgtccacacgtgcaggtgaccgccaaccagccggacctggtgagcttcctgcagaagcttgactggggcgtcaaagtgctgggcgatctcgacgcctgccgccgcattgcgctggaaaacgtcgctgacgccgcgcaggccggtatccattacgctgagctgcgcttctcaccgggctacatggcgatgaaccatcagctgccgattgccggcgtggtggaagcggtaattgatggcgtgcgcgcgggcgtacagcagtatggcgttgatgtgaagctgattggcatcatgagccgcaccttcggcgaagaagcctgcctgcgcgagctggaaggtctgctggcgcaccgcgacggcatcactgccgtcgatctggccggcgatgaactgggcttcccgggcagcgaattcctcagccactttaaccgcgcccgcgatgccggattccgcatcaccgtgcatgccggtgaagccgccggaccggagagcatctggcaggcgatccgcgagctgggcgctgagcgcatcggtcacggtgtcaaagcgattgaagaccgcgcgctgatggatttcctcgccgaacagcgcattggcattgaatcctgcctgacgtcgaacattcagaccagtaccgtagcctcgctggccagccatccgctgaaggcgttcctgcagcacggtattctggcaaccatcaacactgacgatccggcggtacagggcattgagctggcgcatgaatatgaggtggctgcgccacaggcgggcctgagcgccgccgagattcgccaggcgcaggaaaacggtattgccatcgcctttttaaccgaggcggagaaagccgcgctgcgccagcgcgtggcggcataa

SEQ ID NO: 83281 - DNA, 273 bp, Glycine max
  Peptide Sequence Number=SeqID_174966
atgtggctccgaataagatatgatggtggagggtgcgcgaacagtgctatgcaatcaattcgtggggcttcggactcagaggtggaggatgcaatcaattcgtggggctgtacactcaatggtggaggatgcatgaacaacaatcaattcatggggctccgaataagatggatggaggatgcacgaacagtgctaggcaatcaattcgtggggctccgtagactcaatggtggaggatgcatgaataacaatcaattcatggggctcgaataa

SEQ ID NO: 83282 - DNA, 157 bp, Glycine max
  Peptide Sequence Number=SeqID_174967
tcctttcgctaagcgcaagcctcgcgctaagcacaagcctcgcgctaagcacatctctgttcatgtgctaagctgtgagtctcaagagcttagcgcccaacccttgcatctgaggctgatttggtccactaagcttgccaaggttgagctaagctaa

SEQ ID NO: 83283 - DNA, 219 bp, Glycine max
  Peptide Sequence Number=SeqID_174968
atgggcccaaaatctaccctaaggctcataagaaccctagggccttctcttgcatctctggccaaatctacttggagtcttctatccaatgcccttgcgggagcatcagcatcaaagccacgcgctaagcgcaagatgagtgtgctaagcgcagcacgtgccttcagccaagctaagggcgagactagtgctaagcccaattccacttactcgcgctaa

SEQ ID NO: 83284 - DNA, 291 bp, Glycine max
  Peptide Sequence Number=SeqID_174969
atgggtgatcaagccacaagcatgcataatataagcacagatagaaacaatgaacacataaaaacaacttcaaatatatacttttcctctattctttgttctgcactaggctcacgtagtctattcagacctccccttcattctccgcaattcaggcttaaaaagggctttttgtccgtgaagcgccattctcgcgctaagcgcataagagacaatcttctcgctgaacaagctgatgacgcgttaagcgctaagcggctgatgtctagcttagcggttgagtctcactaa

SEQ ID NO: 83285 - DNA, 534 bp, Glycine max
  Peptide Sequence Number=SeqID_174970
atggctccattgtcgtcaccccaaaatggtcaagtgtttaaatcaaatagaacatacactctgagggagttcccggagagatttgcaaaagataggataagtaccctcaccttcagagggctacaagccctcgccatcagaggactacacgtcctcgcctttagaaggctgcacgccttcgccttcagaggactacacgtcctcaccttcagaggactacacgtcctcgccgttagaggactacacatccacaccctcagaggactacacgtcctcaccttcaaagggctacacgccctcgccttcagaagactacacgtcttcaccttcagaggactacacgtcctcaccttcagaggactacacgtcctcgcctttataggactacacgtcctcgccataagagggctacatgtcctcgtcttcagagggctacacgtcctcaccttcagaggactacacgccctcaccttcagaggactacatgtcctcgccttcagagggctacacgtcctcaccttcaaaggactacat

SEQ ID NO: 83286 - DNA, 429 bp, Glycine max
  Peptide Sequence Number=SeqID_174971
atggagaaagctttcccttctcaacctggtccagttcctgtacccactgatgaggtttccttagtggggcagacacttcacaccttcctttcttggctgacacatctggtcaagtctttatcacagcaggtagttgtgtctcctgcaaaaccacctccaaagcccgatgatccgctttatctgatgacattgaccatcccagagcttttctcgaggccttatcaggttagatgggatgccaccatgttcggggtctttaatccagatttccccctctacataaagcacgaagacctctccgaaatcgcacacggtggtcaatgtctcagcatatcagtgttacagttgtggattttgcatctcactgaaacatgtatgcgagcggggaattttgatatctatggattcctcgagccacagtccatttag

SEQ ID NO: 83287 - DNA, 609 bp, Glycine max
  Peptide Sequence Number=SeqID_174972
gcttctacacaagataccggtgcagaggatattggggacgagcctgagggatttcctggtggacccagggacccattagtgcttacagagcatgctgaccatgttgtggctagcgtatggtctggacaagaatgtcttgagttgaagttatcctcccatgggaggaaggtgcataacttaggcaggcctattcctgcaattgaggacatggttgctgggacaggattaagtcctttgatcacgtgttctattgacactggcaatcggggacttatatcctcctttgtcaagaggtggcaccgaaagacttctagtttccaccttcctgtggcggagatttcgatcacgttggacgacgtcgcgactcttcttcatttgccaatcgttggcgcactgcatgacttccagcctctgtacagcgacgaggcggtgttgctcttgattgagttactgatggtctcaccagaggtggccatggccgagacaggccaatgtggtggaccatacgccctgcgtgacctcactcttgctgggctgtatgcatggggagctgctgggctcgtccatatgtaccatcagcttaatgatgccagtcttagcaccagttga

SEQ ID NO: 83288 - DNA, 255 bp, Glycine max
  Peptide Sequence Number=SeqID_174973
atgacgattgtgtctacgtgctatcatgctttgagtcttagagatagcaaaagaagtgcgggaccaaatggttcccgcatgtcatcgggcccactgcctttggatgacaaatggtacagaagacgacagatagccaaagaagtgcgggaccaaatggttcccgcatgtcatcggggccgttgcctttggatggcaaaaggcgcagaagacgacattattctctgcgtgctatcatgctttgagttctacagatag

SEQ ID NO: 83289 - DNA, 273 bp, Glycine max
  Peptide Sequence Number=SeqID_174974
atggatgattttagtgaggatgaggatcaacggttctttgatcatctcaatcaacaaagcgataaccaaagttatgaccaaaccgatgacgagggtgttgccagactaacgacatctctgtcacctccgttgcaatatcaacaacctatgtgtccagtagacttgaactttgaccatctaccacactacattgatcgacactattgtgttcatcagcaaacacaatgtacaaccaacagtcggtatactcgaggttggcatgaccttcaatga

SEQ ID NO: 83290 - DNA, 431 bp, Glycine max
  Peptide Sequence Number=SeqID_174975
gtgatttagctccattggatttggagatagaagccactttttggaggaacaatgcagagagaagaagaaaaattttgcaggacaggacaacacaaccaagtccagaggaagctcaatcttctaagtcatcttctatctttccagagccaagagaatcaaaagtaggcgcatctgaggctgatatcatggctaaagatcaacctaggagggttactcttgaggattactctagctcaaccgtgccgcaattcttcacaagtatagcgtggctggaagttcaagcacacaacattacttatcctcattccttaatacagttaattcagggaaatctatttcatggcttgccaaacaaagacccgtatgaacacttggccacatacattgagatttgcaatacagtgaaaattgccggtgtgcttgaagatgca

SEQ ID NO: 83291 - DNA, 291 bp, Glycine max
  Peptide Sequence Number=SeqID_174976
gaaatctatgcaaatctatatgtccctgaggacaagtttcccaagcaagttagggttcaagggcacctaataaactttgatgatgattccctcaacaccttcttggagactccagtggtcgtggagcaaggggagagcttgccctcttattccagatttgctagactgaggcttgatcctcaggagcttgcagctcggttgtgtatccctaggaggggatttgtttttaatgtcaagggtctaccgtggaagctcttgaggaaagatattaccactctcgcccaaacctag

SEQ ID NO: 83292 - DNA, 246 bp, Glycine max
  Peptide Sequence Number=SeqID_174977
atgggcacaaaaatctaccctaaggttcatgagaaccctagggccttctttagtagctctagtccaagcctcttggagtcttctatccaatacccttgggggacttatcaaggtaatccttatggcgtctaccctgacttatcttccttcactgaaagtggcgtcatccaaatctccgtagcctgtattaagcgatccgctcctagtcaggatcacatcatctggtatcaaagcttcggctcttga

SEQ ID NO: 83293 - DNA, 575 bp, Glycine max
  Peptide Sequence Number=SeqID_174978
atgctacatgccattatgcagagcctacaccgagggcagccttctccttttggagagagtggaacctccgcagcccaagagcctgagcccacagaggagcatacaccagtagtggaggatgagcttactcctcctgagcccttttcatttgcttctgattcagttgtggctcaggaggaagtacctttaccagagcctattccagaaccatcccctacacttatctctaatgtgtatgttcctatctttgaaaagttgcatgtttgtgaaaagcaattgattgaagcagtccatgatattcagttcatatggttgaatttctctgtgaagcaaacaccatttttgagggatcattatagcttgtcacttgaagacaatgggctaagcgcgcatccaccgctaagcgcagcttcaacatgcttagcgcgacagaaaaatctggcagggcatcaatatcaaggccgcgcaccaagcatgagcgcacgactcgcgctaagctcaaatccacttactctcgctaagcgagagggtggtgctaagcgaaacgtcatgaattcagagattattcaaagcct

SEQ ID NO: 83294 - DNA, 333 bp, Glycine max
  Peptide Sequence Number=SeqID_174979
atggcaagcagagaccaagtttggtcgttctgcacacatgatacgcggagataccttacggttatccgcacccctttgccattcagacacagtcgtgtccaatggcacgcagagaccaagtttggtcattctgcacacatgatacgcggagataccttatggttattcgcaaccctttcttttgctatctgtaagacagaacgcttgatagcatgcagggggctgacacagtcttctgcaccttttgttcctccggggaacaacaaagtcatttacatgcgggaaatttcatggtcgcccgcgactctcgtcagccgagaggagcgaaattag

SEQ ID NO: 83295 - DNA, 189 bp, Glycine max
  Peptide Sequence Number=SeqID_174980
atggagaattggcgaacagtgctaggcgatgacattcgcggggctccagactcgaagcgccaggcaatgacattcatggggatccgagaaaaagtggagaatggagaattggcgaacagcgctaggcaaagacatccgcggggctccagactcgaagatggaggacacatgaacagcgctaggcaatga

SEQ ID NO: 83296 - DNA, 171 bp, Glycine max
  Peptide Sequence Number=SeqID_174981
atggcctttgtggataaatgggtggtgggtaaggaggaggtttgttattggctgagtaatgacattgttggtcgtcctagtaggatgatcaaatttgcctcttttcggacccacatcgatcctttcactggcgaagaccaaatccgcaaagctttgagggtgccactttga

SEQ ID NO: 83297 - DNA, 327 bp, Glycine max
  Peptide Sequence Number=SeqID_174982
atggactcggcatcaaagagttatacacaagaacgtaagagaaataaaaggaaactgacaaaagatgaagtcacaatattgcacgatattagaaggcctaactctctaaaaacagtccccagtggagtcgccaactgtcgcaacctacccatcagcaagagggcgacacgagggcttacggatgcgtcttccaagaaaggaaaatgcacggagttgccaccaacgtttattcgaggaaaacgtcggaaaaaccggaaaaggatgtggtctacgaactttaagtgtgaaaggttcgggagttgtatttacgcacggggaaggtattag

SEQ ID NO: 83298 - DNA, 542 bp, Glycine max
  Peptide Sequence Number=SeqID_174983
ctaccaccaaagccttggaacaagaaaccaagagggctcgtagggaagagcacggccggaacaagttccgaggggctctgtggggcagcaacagcgagcttaagctccggagagaggaaagggaccgatcacgagtagatagtctgatcttgaaagatgagttgaaggcttgctcaaggtccaaaagaaacttgtctcagcggttaagcgagacagagagcaacatgttagctatcgtcagcaagtaccaagaagaactaaatctagccacggcccacgagcatagagtggcggacgaatatgcccaagcgtacgcggaaaaggaggctagaggaagggtgatcgactcgttacatcaagaggaaacaatgtggatggaccgatttgctcttaccttgaacgggagtcaagaacttccccgattgctagccaaggccaaagcgatggcggacacttactcttcccccgaggagatccacggacttctcggctattgtcagcatatgatagatttaatggcccatataattagaaaccgctag

SEQ ID NO: 83299 - DNA, 376 bp, Glycine max
  Peptide Sequence Number=SeqID_174984
caacgcggcctttttacggttcctggccttttgctggccttttgctcacatgttctgtcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatggatctttcttacaacacaggcttgacaggaacagttccacaagaaattgggaatttgaaaaagctaaaatccctatcattggttggttgtggtttctctggtcgtattccggattcaataggatctttaaagcagctgacatttctgtaa

SEQ ID NO: 83300 - DNA, 564 bp, Glycine max
  Peptide Sequence Number=SeqID_174985
atggcttcagcgactaagcagcaacaagagggagagaaaccggcgaagcgaaaaccggttttcacgaaagtggatcagctgaaaccgggaaccaacggtcacactctggtggcaaaggtgttgtcctccaacactgtgttgcagaagggacgaccctcttcttcgcacaacattcgtcccactctcatcgccgagtgcctcatcggcgacgacaccggcaccatcatcttcaccgcgcgcaatgaacaagatgtgacttttttccttacccctttacgtgcagttgacatgatgaaacccgataacacagttattcttcgtaatgcaaagattgacatgtttaagggatcaatgaggcttgctgttgaaacgattgacatgatgaaacccgataacacagttattcttcgtaatgcaaagattgacatgtttaagggatcaatgaggcttgctgttgacaaatggggccgcattgaggttactgatcctgcaaaattcgtagttaaagaggacaacaacctatctctggtcgaatatgaattggtgaacgtggctgaggaatga

SEQ ID NO: 83301 - DNA, 4731 bp, Glycine max
  Peptide Sequence Number=SeqID_174986
atggaaatggaaaaggacactggtggtaagattatcattttaaatgctctttcaagttttgatacaaatgatcctctgtctgtgttttcctttacagctttggcaaggacattccgtgacaatcaatttctaccaaacaagtctggcattaggtctgatgcttctggacagttcagccaatctcatttacacgatccaattgaaggttttgtcagaaatcctccttttgcacatggaaatgaacatctacctagaattcatgctactaaaggtcattcttctcgtgttcgtctcttgtctcaacaagacaagcaattgattccctatcaatctccttctcgggatgatgatgctgcccctcaaagggaattgtacccaaacatagctaatgctggaaagaactctcactctactggtcaccaaattgttgggccggaaaatctccatgctctacctagtgtacaagttttgcataacaatgctacatggattgagaagaaacgaaagagtgatgatgcccacgatgttgaagcccacgagatgaaaatccggaaagagcttgagaaacaagacaacctcagacgaaagagtgaagagcggacaagaaaagaaatggagagacaggatcgtgaaagaaagaaggaagaagaaaggttgatgcgtgagagacagcgagaggaggaaagagcaagacgtgagcaaaaacgtgaaatggagcgaagggaaaagtttttgctgaaagaaaatttaaaagcagagaaaaccaggcaaagagaagagcttcgcaaagagagagaagcagagagaaggaaagctgctcttgagaaggcaactgctcgtagaatggccaaggaatctatggaacttattgaggatgaacagctggaaatgatggagttggctgcctcaagcacggggttttcctctattgtccatcttgattttgatactctgcaacacattgagtcatttagggattcattgtgtgttttcccaccaaagagtgtaaagctaagaaaaccatttgcaatcaaaccctggatcaactcagaaaacaatgttggcaatcttctcatggtttggagatttttgatcaactttgctgatgttctagagttatggtcttttactctagatgagtttgttcaagcatttcatgactatgactcaagattgttgggtgagatacatgtttctcttcttaaggtgataataaaggacattgaagatgttgcaaggacaccttctacaggattaggagcgaatcaaaatggtgctgctaacactggaggtggccatccagagattgtggcaggcgcgtatgcatggggttttgacatacgaaattggcacaagcacttaaatctgttgacatggccagaaattttccgacagctagcattatctgctggatatggaccacagttgaagaaaagaagtatttcttggtcatatgcaaataataaagatgagggcagaagttgtgaagatatcatttctacacttcgtaatggttcagcggctgaaaatgcagttgcaaaaatgcatgagagaggtctgttagcccctcgaagatctagacatcgattaactcctggtacagttaagtttgcagcatttcatgttctctcgcttgagggtgagaagggattgaatgtactagaacttgcagaaaaaattcagaaatccggtcttcgagacctgacgaccagcaagactcctgaggcatcgatttctgttgctttaaccagagatgccaagctttttgaaagaatagctccatcaacatattgtgtacgtgaggcatttagaaaggatcctgctgatgctgagtccattctttcagaagcaagaaagaaaattcagatatttgaaaatgggtttctagctggtgaggatgctgatgatgttgaaagaggagagtcagaaagtgatgaaattgatgaggatcctgaagttgatgatttggtaaatccaacaagtgctaacaaaacatctgaacagtgtgatgatttctcatcaaatggaaaagaaaatttgggtcataatgttgaactgcaaggtgagtttgataagaatcttccttgttttcctgagagtggttccaagaatgctgatgctccaattgctgtaactggacaatctggtgcttgtgaagatctggatgttggaaatcttggtgaagataatatggaaattgatgaaagaaagcctggagagtcatgggttcaagggcttgcagaagaagaatattctgatctcagtgtagaggagcgtctaaatgctcttgctgtgttggttggtgtggcaaatgaaggaaattcaatccgtgttgttcttgaggatcgtttggaagcagcaaatgctctgaagaaacaaatgtgggcagaagcacaagtagataaagttcgtctaaaagatgatactttcagtaaatctgactttccgtctatcaatgggaataaagttgaaatacaatattcttgtcctgtcacggagggcaagcaaagcccattgcttggcattaatattggcaataatattaataatagtgtgccctctcctagcattgcggaaaatcataaagcagcttctggttcacagagcctgtctgttgaaaaacactcttcagttcaagatctttgcactggtccagataaccctcaggctcagtcatttgtacaatattcaaaaaggtcacgttctcagtggaaatcttatatttcccacatggcagaagagatgtatgtctacagatccttacccctcgggcaagatcgcagacgtaaccgttattggcaatttgttgcatctgcttcttccaatgatcctggttctggcagaatctttgttgaatatcttgatggcaattggaggcttattgatactgaagaggcatttgatgtgcttcttaattcacttgattcacgtgggatcagggaatctcatttgcgtctaatgttgcaaaaggttgagatttcctttaaggagaatgttcgtctgaatactcaatgttccaaaattggaagcataggtgaaacatgtgttaaaaatgaagctgatgaaacagattccagtcctgatcggcatactggatctgacagtcctagcagtaccctttgtggcttgaattctgacacttcagaaacttcatcatccttcaaaattgagcttgggaaaagtgagagtgacaagaaatctgccttgagaaggtatcaagattttcaaaaatggatgtggaaagaatgctataactcaccaatattgtgtgcaatgaaatatgggaagaagagatgcaaacctcaggttgtcatctgtgatatctgtctcaacccttatttctttgaagactcccattgcagtggttgccaccagacattttcctcaaatagtggatttagtttttctaaacatgcatttcaatgtggagataaattatcgaaaaatatttgtattttggattcttctcttcccttacggacaagattgctgaaagccatgctagcttttattgaggtatctgttccgcctgaagcatttcaatcaaattggacagaagatattaggaggcattggagtgtgaagttgagcaaatcatcttctgttgaggaactgctacagatattgaccttacttgagagagcattgaagcgagactttttatcatcaaccttctctacaacaggggaacagttgggtttgaacagtatgtcaaagagtgctgcacagacctccactgatcctgaatcagttgctgtacttccatgggttccactgaccacttcagctgcgtctctcagacttcttgagtttgatgcatccattgtctacgtaccgcatgagaaacctgaaccttgtgaggagaaagaagatagggtatacatgaagcttccttcaagatataatccttctaaatctagtaaagcggctgaagcagcagacttggaccatgacgaattcatgaaagttaaatctgcttctgtgaagattgtgcaaagcaacaataaacgaggacgagggagtcgtgataaaggacggggtaaaaagctatctaaaaccaaacaaaatactggccatcgtggtgctaaggttgctgggaatgcaagtcaaaggataaaacaacaggaagtgggatcacaaggacaagctggtggacgtggtcgccgaacagttaggaaaagaagagtggggaagaaggctgttgaagatttgttgctgggccataggggtgccactcatagctcgagcattggtagagaatcgttgagaagcatggatgaggactgggatgatgaaaaggcaagtcccgtgacacccatccacatgggggctgctaacaatagtaacagcattgaagaggctgaatctgatgacaatgttcaagcaatggagtctgatgacaatgtccaagcaatggaatctgatgacaacgaacaagctgcagaatctgatgacaatggtcaagctgtggaatatgatcaaggaaactgggaaataggttttaatggtgcccctagcagatggagtagggatttggttggaatgagtgatgatgatgtggaagcttctgaagacgatgatgacaatgacaatgtcattggcattgaaaacaatggagaggaggattcagaggtagatgctatgagtgaggagggttcagatggtacagcaaacagaattgtaaatgaagaaagctcagagtcggatgtctctgaagattcttctgattag

SEQ ID NO: 83302 - DNA, 378 bp, Glycine max
  Peptide Sequence Number=SeqID_174987
atgccctccctccctcactcaacttgtgccctcactcactggctgtcgaaagtgtctcttgtgccatgttgtgttgccatcgtgtgtcatcatcgtcatagaggcttcaaggacgttctacgacagaacttgatgaatgaggattcgtatgtggttaggaaattcaatggaccttgttccaaggttttgaagcgaccgaggtttctcaacgacttgctccccgatgattgtgataccgttgtcttcttcattttcattctcgcactcgcaagaggagacaaaaagaacttaggggaagtggttgccaagacctttctcactaggaaagaagagaccaaacttgcaaagaaaagtaatgatgcaatgctgaaggattga

SEQ ID NO: 83303 - DNA, 300 bp, Glycine max
  Peptide Sequence Number=SeqID_174988
atgtcttcatgcaggaatcttaacagcaacctcctatctggaagggtcccatcaactgtaggaggaagactactctacagagctagcttcaattttactgacaatgcaggtctgtgtggtttacctggattacctacatgtggacctcatctttctggcggtggcgccagaatatcctccgagctcagcaaatggcagaattgccctactaatatcgtagatgaatggcactgtaatctgatcgatcttctaatggtgcttgtcctccataatatcgggtttactacaacaaaatactga

SEQ ID NO: 83304 - DNA, 81 bp, Glycine max
  Peptide Sequence Number=SeqID_174989
atggcgctcagatttggatattttgttgaaactgtgaattcatcgtacttcaatggcaaaaagatactttttgagttatga

SEQ ID NO: 83305 - DNA, 356 bp, Glycine max
  Peptide Sequence Number=SeqID_174990
atgcagctcccggagacggtcacagctttctgtaagcggatgccgggagcagacaagcccgtcagggcgcgtcagcggatgcgtaaggagaaaataccgcttcgggcgcctttcgccattcgggctgcgcaactgttgggaagggcaatcggtgcgggccttttcgctattacgccagctggcgaaagggggatgtgctgcaaggcgattaagttgggtaacgccagggttttcccagtcaggacgttgtcgactctagaggatccccgggtgcaagccattggtctgtttgctcaagcaacctgtgctcctgagtttggacttccaagaccgttcaaagattactcgtcttgcac

SEQ ID NO: 83306 - DNA, 183 bp, Glycine max
  Peptide Sequence Number=SeqID_174991
atgactcatcaggattttcaagtgcaagccattggtcagtttgctcgagcgacctgtgctcctgagtttggacttccaagactgttcaatcagagattactcgtcttgcacattggtggggttgccgtaaaacaacgactgctggtaatcgattaccggagagcaaatctcaatttgaaatga

SEQ ID NO: 83307 - DNA, 384 bp, Glycine max
  Peptide Sequence Number=SeqID_174992
atggagtctcccccggtacagccgcgctcatctggtgccgcgttgatggtagctcgggtgatgttgggtcacggatatgagcctagaatgggtttggatcagaacgggaatggcatagcaaatctagtagagaggatcgccctagaaaggagggagagaaacacgggtcaacctcaagggttgcaagtgaaaggagtccccttatgtcacattgacgaaagctttcttagcgcggggtggatgagcaagggacgggttgccatgatacatgaagatacccctcaagtccaaccaaattgggtgcgggcgtgtcctctagagtttgaattggggaattggcaagtcgtcaaacaatctgggatttccatggccaaattaatgtaa

SEQ ID NO: 83308 - DNA, 1128 bp, Glycine max
  Peptide Sequence Number=SeqID_174993
atggattgggaccagctcttggccaggataggaggtagaacaatcagttggttccccctatggaaggaaggaaaagaaggagtccttttctcatgtggaagatacccaaacattccgctggtaggaacgaggggttgtattaattacaatcccacgctcgctataagacaactagggtaccccatgaggggagcaccgacggaagaaagcatgtctcctttccttatgagggatctcggcgcacaaaattccaagactatacaaagaatccataaggcatgggaaaccccgttaaggaaagatcaagagcttagaggcattcgtaatggcatcattggtgggtaccacgaatggctgaaagttcgcatacgaggtttagattggctcgccaagttaaaagtcgtcagcgaagagaattttgaagcaccggaagaggacgaggaagtccaagctctcaaaagcgagttaggaaaggcaaaactcgccaaggagaagttcaagttggctgctacacacgttcggaaggagtgtgccgggttacgggaagagaatgcaattaccgcaagagcccttgaacgagagaccaagagggctcgcaaggaagagtatggccggaacaaatttcgcggagctctatggggtagcaatagtgaactcaagttgcgaagggaagaaagggaccagtcgcgagcacatagcatggttctgaaagaggagttgatggcttgttcaaggtccaaaagaagcttgtcccagcgtttatgcgagacagagactaacatgttagctatcatcgccaagtacgaagaggagttaggtctagccacggcccacgagcatagaatcgcggatgagtatgctcaagtatatgcggaaaaagaggctagaggaagggtgatcgactctttacaccaagaggcaaccatgtggatggatcggtttgctcttaccttgaacgggagtcaagaacttccccgattgttagccaaggccaaggcgatggcagacacctactccacccccgaagagattcatgggcttctcggctattgtcagcatatgatagacttaatggcccacataattagaatcgttaggaacttgtatggtctcttagacattgactag

SEQ ID NO: 83309 - DNA, 141 bp, Glycine max
  Peptide Sequence Number=SeqID_174994
atggaaaatcaaagttgtcatcatcaaaaaatgggagattgtagaagcaagcttcaagatattgaatcaagattgattcaaggagttttgatgataacaaagatgatgacaacaagccctagagtatgcattcaagattga

SEQ ID NO: 83310 - DNA, 733 bp, Glycine max
  Peptide Sequence Number=SeqID_174995
atgaagaagctttgcagacttccaacgctttggaaattctcagcaaatgcaacagataatgctcctacccgatacttgatcagtgattgctgtgtggttctaggaaagcctcttgtatcaggtgctgcactgggattggaagggcagcttactgtctacaattacaatggtggtccttgctatcgatgcctctttccaactccaccacctagaacagcatgccaaagttgtgctgagggtggagttctaggagtagttcctggtataattggctgtctccaagctcttgaggctattaagattgcagcttctgttggtgagccactctcaggaaggatgcttctcttggatgcattgtctggacggattcgtattgtcaaaattagaggaaggtctatgcagtgtgaagcttgtggagaaaatgcaacatttacccaacagcaattccgagaatttgattatgagaagttcactcagactcccttgcgtgtgcctcctttgaagttaaatctacttcccagagaatcaagaatcagcagcaaggagtacagtgaagtaattattaagaagggacctcatgtgctggttgatgttagaccagcacaccatttcaagattgcatctctaccaaagtctctgaacattccactctcaacattagaggctaggctgcctgaagtatcatcagctttgaagaaagaggaagaggaaagtggggcagtttctgggtcaa

SEQ ID NO: 83311 - DNA, 269 bp, Glycine max
  Peptide Sequence Number=SeqID_174996
tagagtcgccaactgtcgcaacatgcccttttgcgggcgagcgaggcgaggctcatgggtgcgctttccaagggaggaaagatgcgtggagtcgccaccaacgtttatttgtggaaaacgtcagaaaagccgaaggaaactggtcaaaaagaaaattccaagttcgggagttgtatttacgcttgaggaaggtcgacaaaagcggggttcttgctcctacgtaccctccatcgaagaggaaatcagacctacgtagttcttttttaagg

SEQ ID NO: 83312 - DNA, 540 bp, Glycine max
  Peptide Sequence Number=SeqID_174997
atgcgtagtgattgcctagtgcaattctccattctcgccttttattcggagccccatgaattgattgtcgttcatgcatcctccacccacgagtttggaaccatgcgtagggattgcctagtgcaattctccattctcgccttttattcggagccccatgaattgattgtcgttcatgcatcctccacccacgagtttggagccatgcgtagtgattgcctagtgcaattcttcattctcgccttttcttcggagccccatgaattgattgtcgttcatgcatcctccacccatgagtttggagccatgcgtagtgattccctagtgcaattctccattctcgccttttcttcggagccccatgaattgattgtcgttcatgcatcctccgcccacgagtttggagccatgcgtagtgattgcctaagaaagaagaagaagagacggaggtcatcatggactaattacggaaagggcgaagacggacgaaatcagtgtcttatctttgctttcctcttatctccgataaaaggtaagtaa

SEQ ID NO: 83313 - DNA, 288 bp, Glycine max
  Peptide Sequence Number=SeqID_174998
atgaagaaaatccagcccgaggtgcttccgcaacgcttccgagaggttttcataagcaaatccgtgaagattttcctctgttcttcaccgttcttcattcgtttttcatccgttcttcgttcttcaacgggacgtttttctttggaagtttccttgaatgaattgactaataaccaaagtgaaactaaggctaaaatcaactcacaaatcaagctttgtccgcaaaaatcactgaaaaccgctttggggtccaacgccttaaacggtcctcttgctttttatcattga

SEQ ID NO: 83314 - DNA, 267 bp, Glycine max
  Peptide Sequence Number=SeqID_174999
atggttcagcctaaaagaaaaaaagaacatgaacaagaagaaaaggatgggaaattggcaagattcaagggttgggcagtgactaatttcctgggtcttaataaggtggatctcggcataaaatggatgaatgggatgaaatgtagaaatggttataactcaagctacagggctccaaatgagaacaaggttgaagatgaaatggtggaaggaaagaatcattctttccggcgagggcaacacacaaaggatgtgaaagacctttga

SEQ ID NO: 83315 - DNA, 591 bp, Glycine max
  Peptide Sequence Number=SeqID_175000
atgcatcccgcgagtcatgcgtcgccctcccgccgaagggtaggttgcgacaattctgaactagtcaaagctttctattctaatttagaaatccatgaaggtaccctaatatctaaggtttatgggattaagatggtcatttaccaatccctattttatgatttaacaaaattgcctagtgaaggtgtgccttttgagggtgcactgattgatgattggaaattgaatttttctgtgcatgatgcccgccagttggtttgcaccaaccaagcggatatgaccggaaggcttcttgccggttcattggcttttgaaagccacatcctccattaccttattgtccgcattttgcttccgaggtcttcaaaccttgctcaggtttctgaggaagatctcattgtcatgtggacctttcataaaggtttacaaattgattgggctcatcttgttagatatcgcatgcataaggcattgcgattgaatgcccctttgccttatcctcatcttattactcttttccttcaacacttcaacatccctcttgattttgaaccctatgttccaatcaagagatcattccttattaaataa

SEQ ID NO: 83316 - DNA, 447 bp, Glycine max
  Peptide Sequence Number=SeqID_175001
atgtcagagctgccatcacggttaagcaccctcaacgagggactggaaatggttcttgcgactttgcctaaattaacaaatgaagagcatggacaatgctgcgaaatggccaagatcatgctgaaggtcatggtttcaccatatactattttaaacaccgttaacgccaaagaccagatttacagtgaagttagtatgtcatttgctgtgaggtggaaagacgtacttgactacttgtggcatttcattgacaaggatgaaaatttccatactgttgtttacaaccaagatttggacaaagcagccattgtagcagggtggataacactaagagatttttatcacctaaccagagatcatcaagtgccgttaactcattatggtaagagtgtattctttctcaccatattcaagagcagtagcctacgaaaatcattcccaagatga

SEQ ID NO: 83317 - DNA, 96 bp, Glycine max
  Peptide Sequence Number=SeqID_175002
tattttaacaatcctagatcattggagtcagagagattaaaggcattgtggatcaagtggacacagttttatctccgagttagagatcagacctag

SEQ ID NO: 83318 - DNA, 381 bp, Glycine max
  Peptide Sequence Number=SeqID_175003
atgcttcaaagcatacatcaagggaagattgttttattacaaagtttacagctggtagcacctccagactctatcccttctgttgaacaatttaatgaatgggtagcctggcccgggactcagcctccccttcacagggaagacgaaggtctcactgctcagctgcaaccacttctgagaaatctcttgaggccacttctgagccttcagaaccagtggcaggcttcaattcagcaggcaatagacccctccactcctaaggatcagattacaccagtcctatctccgaacacctctcctccagctacccctatgcttcgcttaacagatgagaaggatgttcagacaccggatactcaggatagatcacaggatttttaa

SEQ ID NO: 83319 - DNA, 207 bp, Glycine max
  Peptide Sequence Number=SeqID_175004
atgtgcaatttcagttgggctaagtgcgcatccaccactaagcgcagcttcaacatgcttatcatgatagaagaatctggcagagcatcaatatcaaggtcgcgcgctaagcgcgagatcagtgcactaagcgcagcagttatcttcagtcaggctcaacgcatgactggcgctaagcgcaacgtcacggattcagagcctatttaa

SEQ ID NO: 83320 - DNA, 452 bp, Glycine max
  Peptide Sequence Number=SeqID_175005
ttggaactcttacgtgccgatcaacgtctcatttcgccaaaagttggcccagggcttcccggtatcaacagggacaccaggatttatttattctgcgaagtgatctccgtcacagctgtccttcctgttcagctacggacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatagggaaagggaagaatcaaaagaattatcagattgtgtcgattttggaattctttgaaaagggaggaaagggaggaacaacgaaaaggaaattcaggcg

SEQ ID NO: 83321 - DNA, 297 bp, Glycine max
  Peptide Sequence Number=SeqID_175006
atggctagcaggcaggcaagtacgcaggtgaccatgctatactcgtggatgataaagactgtactcgaaggggagactaccatgtggaagagactcacacttgagggggagatgtgttgggttataagtgtgaggcctccttatgtggtggctcgtggtccacagatgagtatgcaagtaccacaggtggcaagaatggctagcggcacagcatgccccgcaggtggagcggggtggccagaatggctagcgggcagggcaagtactgcaggtggccatgactatactcgtggatga

SEQ ID NO: 83322 - DNA, 291 bp, Glycine max
  Peptide Sequence Number=SeqID_175007
atggatgatgcatctttcctactttggacatggctcaggtgtcttgagaaggactttgtcacagattttaatcattggacgagtaatcttagatcagggtctccttatgtggtggctcggagtccacaggtgtactcctcgaatctccccaataattggtatcagagccgattgttcaagttggtgaccggctcagatgagtatgcaagtaccgcaggtggagcgggttggccaaatggtctagcgggcagggcaagtaccacaggtgaccatggctatactcgtggatga

SEQ ID NO: 83323 - DNA, 234 bp, Glycine max
  Peptide Sequence Number=SeqID_175008
atgtcacatggtgagaagcatcagaatcagggtaccaattctgagttggcactgcagaagagctggccaaaaacacttgtggaggatgggattgttgattggtctgaggtgctgactgaagataggtgtactgaggttgaacaggttggacatatccatactgaggtgaggaaaccacatactgaactggctgagcttgttgtacttagtgaaggcaaaacaggtgtccactga

SEQ ID NO: 83324 - DNA, 317 bp, Glycine max
  Peptide Sequence Number=SeqID_175009
atggggaaaggaggctcacggcggagccttccggaagacccgttaggggttcttccggaagttccggaagaacattttccggaaagtttccggaagaagtgttcttccggaaataaccaaatgccttccggaagaacacttcttccggaagactcccggaaaacctcttccgggaactttccggaagaagtggttcatccggaagaattccggaagacgcgctcttccggaagaactttcaaatttccggaagacctttccggaagaaccacttcttccggaagtggtttccggaagaaccacttcttctggaagtg

SEQ ID NO: 83325 - DNA, 444 bp, Glycine max
  Peptide Sequence Number=SeqID_175010
atggacgtcttcatcggtggggaaattttcaaggtgcatgttgttgaagagagtggaggtgggtatcgtgaatgcagtgggaaggcacgaagtatggggggctcgtcagaggagatcgcctctcatgatagccacctcgagtgcctatcgccgacctcgatggagaagatgctgtccgaagaccgcatgcgcaactcaccggagaggatgacggagaagtcgatgttcgcggaccagcggacaatagagttatccagaagtcttgataaccacaaaaacccactgggtaatggcgacaacctgcggttttctggcggaaaacagcagtttcggcatcatgggcagacacgagaccaagcggcgacagcaacggtcacctatgatcgtgaccacacagccacacaaggacaggagcgggtgatttcttttcttgatgattgttag

SEQ ID NO: 83326 - DNA, 336 bp, Glycine max
  Peptide Sequence Number=SeqID_175011
atgacaagagcaagagcgaaaaaggcccaagaagctttggagcatatggtgactattctgaggaattcacccaattcttgtggcgatcctccaggcttatcaaacctcgttgtttgtggtgcctattcgattttctatcttccatgtttttctgttcgtttctacatttcagcgttcttcagtttatgccttcagcctgattttctcaggtgcatgggtctctttggagcttgtatcaccacatatggagcatttcatgcaatcttggtgcattgctttgtcaatattgagtggcctattgaaaaaattgttgcagctacatttcttcttgtttga

SEQ ID NO: 83327 - DNA, 118 bp, Glycine max
  Peptide Sequence Number=SeqID_175012
atggtgcgaaaaggccaacataaatgggccgaagtgtttgtctccaagggagaaaataagcggagtcgccaccaacgtttattccaggaaaacgttagaaaagccaaaaaggacaaag

SEQ ID NO: 83328 - DNA, 291 bp, Glycine max
  Peptide Sequence Number=SeqID_175013
atgcctcccgtcgctcctcgatccggtgatgccatattcgccaacgtcgaacgcgtcaatgcggagctgtttactttgacgtatggcgcaattgtgcgtcaattgctcacggatctggaagaggctgaggaggttaacaagcagcttgatcaaatgggttacaatattggaatccgtttgattgatgagtttttagccaagtctaatgtctccagatgcaacgatttcagagagacgactgatgttattgcaaaggatcttgctgatgagtgctctaaggctgctggttaa

SEQ ID NO: 83329 - DNA, 213 bp, Glycine max
  Peptide Sequence Number=SeqID_175014
atggtgagcgagatatgtgagaactcaagatctacaatgagatctaacttccttctcattggtatcaccatcattccccccatcctcccttgtgttgaaacctcccgctttgaggaacaatatttgttggaaacaaaagggagggcattcttggatttgaaaaaagagaagaatatgttagttaatagtgtagacgaggggagaccaaagtaa

SEQ ID NO: 83330 - DNA, 201 bp, Glycine max
  Peptide Sequence Number=SeqID_175015
atgacccttcgcttagcagacatgcatagctcatccttcttccagattcttcctcgtactcagccgaggagtgttgcgctcagcggatggctcgctaagccaacagattggcttagcgagaagattacaccaatagttatagacaacatgtctttcaaaatcacaagtcataagaaccttcacaaaggtctacaacagtga

SEQ ID NO: 83331 - DNA, 189 bp, Glycine max
  Peptide Sequence Number=SeqID_175016
atgtggaatcggcacatgcttaaaggagcactcaaacagagtgtatttacccccaaggcctacactccgaagagtgcgtcaaggcctctcccttctgattcagatccccacagtggttcccatcacaatactcgtcgcgcattaactcgttgcccttacagggtcttaacattaactcgtcgcccttaa

SEQ ID NO: 83332 - DNA, 192 bp, Glycine max
  Peptide Sequence Number=SeqID_175017
atgtcgatgggggtcgaagtggtggtgtggtttgcggtggagtgtttggggtctggcacggtggttttttggtgcggcggtgactggtgttgggtagaggaagaaaaagaagaggggctcttcatgcagagaggaaattcaaacgcaaatgaagattattgggttggaaagaggcgaacaaaaacgaattga

SEQ ID NO: 83333 - DNA, 207 bp, Glycine max
  Peptide Sequence Number=SeqID_175018
atggtgataacaccagatgatgacaaaggtgatgacaaaaagctcaaagatcaatcaaagaacaactcaagtgaatcaagaataattcaagatttcaagataagaatcaagaataagagtcaagaatcaagattcaaggttcaagatctccaaaatcaagatcaagactcaagattcaagaatcaagagaagactcaatcaagataa

SEQ ID NO: 83334 - DNA, 231 bp, Glycine max
  Peptide Sequence Number=SeqID_175019
atggcttttaaagaaaatgaaccaagaggtgctagaccaactcgcccagaggctgaagaaatagtactagcccaagcgagctggttgctagcctgggcgattggtactctgaaatattgcaaaaatgatccttttgcctttcatcctggcttggtttctggatccaacaaacaagcatcaaaacataaggaatgcatgaatgaatcttccatatttaaacaaaaacattaa

SEQ ID NO: 83335 - DNA, 620 bp, Glycine max
  Peptide Sequence Number=SeqID_175020
acaatgtcgaggaagagactggcaactttgtgggcagagtgctttggcgaaaaagcaccgagatgggtgcctttagagtatctatcgactacgaccaggatgatcgtgaatccctaggatggcagcagtccaacttggtggtcgacatcgcgacgcataccatcccagaagaagttatccggaagtcgacaaagggtcttagctgtacccatatggcttcccagtggggtagagttgaattctgccaaaagcaagggaatggactgagtagtcagagtgagattctagctgctgacgaatcttgtgtagtaagtcacggtctgaatgacctgggtcatgagctccttcaggctctggtgatccgtgaggatgatgaaggggtgtcccaaaaggaaaggattgctcccattgtgaaaccggaggcatctgtctctaggaaaaacggaatggtgaaatcagggggtggtctttgggaagaagagtcgtcagtggtgttgccatggtcgcgtacccgcgggccacgccctccgccaaaacaatatggcctaagtattggagtttggttttggcaaacatgcatttggactcatgcagatggaatgacccttgggataacatag

SEQ ID NO: 83336 - DNA, 174 bp, Glycine max
  Peptide Sequence Number=SeqID_175021
atggacgagcctagacatgcagtggaaatttgcagtgacattgctgagaggttagagcgccatctgagccttggggtggtcatgccaggctcatcctcacatgacgtgatccaagaatgcatcaagatggccaggagtgtgacacaggatcagctagtatatgttaggtcttga

SEQ ID NO: 83337 - DNA, 270 bp, Glycine max
  Peptide Sequence Number=SeqID_175022
atggattcaaataccaatgccgacaatggaagacgaaaaagctgcttacctcggcaatgccggcgcagagggacaccaccaccctcaaaatgcctggaatactcaacaccaacggcagtgcagtcgcagaacacggactcccggcgcggaggaagaagacgaagcttgcagggtgaacgcgacgcagacgaagcttttctgagaccagcaaccacttggaagaagaaccacgaagaagaaggccaacacgggagggagggagagagatga

SEQ ID NO: 83338 - DNA, 330 bp, Glycine max
  Peptide Sequence Number=SeqID_175023
tccctccagtattgaggatgtgtgctatgccttttgatcctcaggcaaaaccagttagcagcattgctgtgcaagatgacgctgcagtaagggaccgtgttgcagtggtcgtggcgaactccaacgccaatacgggtcgtgatgacaaccagaccgcttgtgtcgcaccgtgtgttatcagcagaggggccatcgttgacgacaactccggcatactcacatggacaagttcctccgcggcgtcgctgggaacttcctcgtcgtcgtggtgtctgttgatcgatgaagaagatgggatcgggatatgcagtttcggaagaatgccatcaa

SEQ ID NO: 83339 - DNA, 720 bp, Glycine max
  Peptide Sequence Number=SeqID_175024
ggccaaggtcttggtaaagctcttatagagaaactgattcgaactcttctacaaagggatattggcaacataactctatttgcatatagtcaaggtctctggtgtgctgccacgagtatgtgtaacatcattggacaaaaaaaattgatatgggagtgttgtgtctctggtgtgttgtcgattggtatgctgccacgagtgtgtgctgctcagaaagatttgatatgggaggatattcagactgtgaaggagcagtggagacagtttaagtttgatttaacgtcgaaatgggcacttgcagccgacaacgacagtatcgatgacactatatgcgaaaactacgacattagcaaggagaagtgggccatattatgtcagaactgcaaagacccttattgccagatgtgcgaaaaaaaggcacaggccatccaaaaacaaaacagtgcccttcacgtgttgtctcgtgggggttatgaatatctagaaaacaagttgattgaggagaaaaaaaagaaacaattggaggaagctactaaatctagaagcatatacactttcattgatcctccatctcccatcaaacaacacgtgaagtggaagatggcccgcaccaagaaaaccaggcaaatgacttctgaggtagttaaggaaattgctgacaaaattgttaagtcatttccaattgcgaattgtaattatttatgtttattgtttgattga

SEQ ID NO: 83340 - DNA, 228 bp, Glycine max
  Peptide Sequence Number=SeqID_175025
atgacatcagcaaagcgaaaaatgcattctcgttttatgtatcctttcgaaagcacaagccaaaggagtgaacctacaaagtcaacgaggagatgggaggagtggctagcgacccaaggaaaagtttccctcactgtgtcgtttcttttgacaatgacacgaaccacaaacccttttagcagcaaggtgaggaggagacgatgggggagaaacgtcttttcagcctga

SEQ ID NO: 83341 - DNA, 93 bp, Glycine max
  Peptide Sequence Number=SeqID_175026
atgacgaggcatttctggatggataaagcctggagggctaaggagagaaccaatctgaccgtcgttggtttaacagcaggactgaaagtctga

SEQ ID NO: 83342 - DNA, 441 bp, Glycine max
  Peptide Sequence Number=SeqID_175027
atggctgatatgcttttaaaatgtggtatttgtatccgtgatgactcaggtgcgcttgttttggccaaaatatccctgcttgaaggctctcctcctaccaaagaagctgaaggagtggccccctccatggctccatcatgcactttcatggatcacggaactcaaattacaaaatctcactacatgagcattgattacccaacagtggtattagagctatggccggaaacacacaaaggtcatgatcaagcgttagaagatgaaaggccgggttctataaatgaaaccgagtggactaagatccaaaagagagttgtgagtgtgattcggttagtccttgctcccgagataaaacacaacgtgttgaaggagatggagttatatcaactcaaattggagaagggaggagaacttcatgaccacatcaacaagttcaattaa

SEQ ID NO: 83343 - DNA, 498 bp, Glycine max
  Peptide Sequence Number=SeqID_175028
atgactagaggcaatccatctgacttacaaccctttgatcctgagatagataggacatttcatagattagttaggcatcattttataccttttgatcattctgagcattccataactggtgaatctgtgcattctgttattggtgattttgaacatcctgatcttgagcattataattttgagcattctgattctgagcattctgattttgcacattctgagaacatggcacaacctccacctcatgagaggactctaagggaaatggctgcacctgatttcacctatgaaagcttgtgcatccaataccctgatgaggatgtcccatatgttcttaaaactggactgattcatttgcttccaaagtttcatggccttgcagatgtccaagaggatcacatatttctgaaggcttttcctcattcattagagggagtggcaaaggactggctgtattaccttgctccaaggtccatcacgagctgggatgacctttag

SEQ ID NO: 83344 - DNA, 615 bp, Glycine max
  Peptide Sequence Number=SeqID_175029
atgacagaggtagtcggcctggaggaggtggaaggcttgcaggatgtagtggcactttgttcccgagtccaacgacggctgccgcccgccgctcaccacgcggaggatggttatgttcagtggacatgggagggtgttgttaatttgcggctagggaagctggtgggaaattattcaaggttccaccctatgctcctttgcggtagatctcggattcctaacaagctgaagttgggacactgttatatcatagttgttactgatggacttgacaacccattattccatgttcagatggcaggatggcagagtggaagtagcaaatctaaggggatggacaagcttaagaggcagaggatggcagagtggaaagccatggaaaaacttaagagtttttatactggttcggtaacaacccgtgcctacatccagtccccaagcgacctgcggtccttgagatttcttttccaaccttgtaaaaatccttttacaagcaaagatccacaagggatgtaccctcccttgttctctttgaacaacctagtggatgtaccctccactaaaattgatccacaagagatgtactctctcttgttctcagtcaaacccaagtag

SEQ ID NO: 83345 - DNA, 342 bp, Glycine max
  Peptide Sequence Number=SeqID_175030
atggatgatgccctactactactttggtcatggctcaagtccaacgacaaagactgtacagtacattttaaccaatgggctactaatctaacattagttggggtagggggtattttaaatcgtcatattctaaggcagcacaacattccaataagtcctaagattgcaaggcagcatgattttggtaaaattttagtggaatcaggctttgagaaagctattgggtttgtgttagatggatgccctacatctacatctacattgctgcatcattgtttcccactctattatgagttgaaagctctaacctctactacaaatcaaaaatcaagcaaaccttag

SEQ ID NO: 83346 - DNA, 606 bp, Glycine max
  Peptide Sequence Number=SeqID_175031
atggtaggagcagtaaactctacattgagtgcatacatagaagcagtgagggagctggcatgtgagatattggagctaatagcagaggggttgggggtcccggacacttggatattcagcaggttcataagggatgttgatagtgactcagttctcaggctcaatcactacccacctataattaacaaggacaacaacaaagacacgtcacaacaatttaccaaggttggatttggagagcattctgaccctcagatcataaccattctcagatccaacgaagtgggtggcctccaaatttccctccaaatgaacgtgggtgatgtactagagactgtgatgctagattttctttcagacagcaacggtgctagttccttatcagtgccaaacaaagatatttatgcagaacttttgaagaaagcaaaaaagttgaacaaactgaaagaaaaggatctagggttttctaaatttctagaaagttataatatgaagatcgaacaaaccgaatatgaagaaattagggattggaaatctctatgggagtatgatagtggcttacaacaaatatggtctataggaggaataggttgggcaacagagtag

SEQ ID NO: 83347 - DNA, 393 bp, Glycine max
  Peptide Sequence Number=SeqID_175032
atggaggctggtcagatcttagtaatggaagggacaaagcttggcattctcaatggtggaaggacctccgaaagctatatcagcagcctgagttcaatcttattcattagcagatgtggtcagcagaatagtaccatctcgaacatgggaagcttctctcaaggcaattggtgttggggcttaaagtggagaaggaatctatttgattatgagcaacatatagctatggcatttatggaagcaattattgatatacaaatccaacctcatatgcaggatattatggtctggaaagctgatcccagtggtgtatattccactaagtcagcctacagattattgatgaccagcaatcaaattccagaggccaacatcttaaagacaatttgctaa

SEQ ID NO: 83348 - DNA, 750 bp, Glycine max
  Peptide Sequence Number=SeqID_175033
atgtcatcaggtggtgctgaccctccccgacccccgtcacatcaatccaatgggaaagggaaaactgcaaagaaaagacgatatatggttaggctattaccgcctcgagatattctgccatcatctaccccatccccgtcttctgtgtctatgctagttaggcctctcgatgttgcacctacaccatctccacccccaattgaagctagactaactccatctgatgttaatgcacatggatcgtccttggtacttgcatccacaccatctccatcatcggttgatgcacgtggattgtccctgatacctacattcacaccttccccatccccgactgtagtcaacatgcctacagatgttataatgatcatcctacggtttcatccatctaaggttgcggcaaaggttgtcactttgtccattaggcaacaatttgaccctgctgaagaacaaagacttaggagtcgatgttgggttgtggctgcgggaccaaagcataaaggacgcctttatggtactggagaccttgctcatacttacaaatgtggaaatgacatcttcatgaagcatacaaaaggatcttcctgtcacactgaagatgctgcagagattaaccgactgaaggaggagttgtgtcaatcaaagggggagatgcatgtttttcagtcagttgtccttcagttcttacttcctgaagcgcggaacattattcatcaacaacaacaacctcaccaacagcatcaggactag

SEQ ID NO: 83349 - DNA, 426 bp, Glycine max
  Peptide Sequence Number=SeqID_175034
atggtggagctccgacactcttcctcccttggcagccgagcctccaattctccgatgaagtgcgatactggtgattcctcccctctcattcctgacaaccacctcgccgacgacgacgagcacgatcaacactcatccaaggaccgcgaccggcacatgtgctccttctttaccgacaactttagggtttcgcctcacaactctaggatctttcttgttttcacattccttcttcttcttgttggtttagtctccattttcaccatcttcaataatctcgttagtcctcatctctctggttgcattttcagattcactactaaatcactagggagtgatatgcactttaggtttggaggggaggagcggggtgcgacgtcagtggttgagagatgggggaggaaaccacgattgaaaatgaaatga

SEQ ID NO: 83350 - DNA, 708 bp, Glycine max
  Peptide Sequence Number=SeqID_175035
atggaccattttccattttgtacagttgccactcaaatcattatattaagaaacccgaggttttacttggatgggcaactgaaagtgttcctgtggacattgacttgggctaaggagggcatgacaatgcaatatcttgacgtcagccttcaggaacacttacctgtgctgtatccagaagttgttctatctgtagagaggtttaccataatgtttgaaaggatccaagagttgttaattcttggaggtcagaccttaactgctctgagggacaagatcttttgctcaacaaaccaggtgatgcacaaagttgggcagcatgatccttctagttattttctcattgaagatgtattatgtcctgatttgagggatccgtctactattgatctcacaagacctatactagattggctcagagactccaaggaggaggcccaaaagaaatgggaatatattataactgaggaactgcagaagaaacaaaaggtactaggggacatggtcccgacaacaataacgaaaaagtataatgacagggaatatcccaacaaaatgatattccttgatttttcactactacacgaagatacgagtcctagcctcagctctattatgcgcttcatgtacgatgcatgttgcatgggcaccactaaccatgtcatacttaatccttcaagtaagctgagattgttgccttcctcttag

SEQ ID NO: 83351 - DNA, 84 bp, Glycine max
  Peptide Sequence Number=SeqID_175036
atggacgacaatgaccgagagggagatgaattcaaaatgcagatggagttttgcggtgcagagggagttttgccaagggactaa

SEQ ID NO: 83352 - DNA, 1284 bp, Glycine max
  Peptide Sequence Number=SeqID_175037
atgatgaagaattttgcctactacttcagtcaaaaacaacaacatcaacgtttttgtaggtttttcccacacagccttggattcttggttcgttttctagccttccatgtccaccccttctttattcaactttgttattttgtgattctttctctgcttggttacctcggtctcaaggcctccaagccaaggaccccccttagaccaaatgacttggacctcttttacacctcagtttctgcttccacagtttctagcatggtagccgttgaaatggaggttttctccaattctcaactaattctcctaacccttctcatgtttgttggtggcgaagttttcacttccatgctcgaccttgtatttgctaggtataaattcacccggagtgtccaaaataaagttagcaccaatcattcttacctgactcgaacaagattacctccggtagatgatacttctggtttagaccaaattttttttagcagcaatccttttttatccacaaagaagccctcgattaatgccaatcaaattgaacttggtttagtttctattcatcattcagaatcagaaaaccacaaaccaagtgatagtaataatactaacgttccaaagggcacggtagtgtcctttaacgacagtgatagacttaagtataactgtcttagttacctgacttatttagttttaggttaccttgtggtggttcaatttgttggctttagttctgtgtctttgtacataaccctggtaccgagtgcaagacaagtactgaaaaataaaggcattaagattgcaacgttttctttgtttaccatagtttccacgtttgctagttgtggtttcatccccaccaacgagaacatgatggttttcaagaagaactcggggcttcttctccttgttctcccacacatccttctaggtaacaccctttacccaccgtgtttgaggcttgtgataatggttctggaaaggattactaaaagagaggaatactcgcacttgcttaagaatttcaaagacgtgggttatgatcacatgctttctgctcttcattgttgcctcctggttgctactgtgttgggttttaatcttatacagtttgtgatgctttgctctatggagtggaacaccaaaatcatggagggtttgaatgtgtatgagaaagtggtggcgtccttgtttcaagttacaaacgcgagacacgccggtgaatctgtttttgatctctcctccatctcttcagtcatattggtactcttcgttgtcatgatgtaa

SEQ ID NO: 83353 - DNA, 213 bp, Glycine max
  Peptide Sequence Number=SeqID_175038
atgttcaagaccccttgtgatggggacatgaccaagagcaagggcaaggatccacttgaaggacatggaggacctatgacaagggctagagcaaggaaagccaaggaagctcttcaacaagtgatgtccatactatttgaatacaagcccaagtttcaaggagaaaagtccaaagttgtgagttgtatcatggcccaaatggaggaggactaa

SEQ ID NO: 83354 - DNA, 474 bp, Glycine max
  Peptide Sequence Number=SeqID_175039
atgctttgttgtggtattagaggtttctacaaagactgtcaaatcatccacccagaattgattcaaactttttggcgcgatactgaattcaaaaccttctacgccatactctccattgtttttggaaagaaagtgactttatctgtagagaacatcactcaagtcacttattggaagagggaagggagcagaaagatcatagctcaacaacaagctccttttgctccaaagaaggaaaaagttgataaggcaattccctctggcaaggaacctatcattgtagctgttgtgctcagaaagatgaaggtaattgcaactagggcaaatcctaccatctttgaaaaggaatggactctaccctatccttctcaaggatccagcagcaatgatgttttttctgatgctactatctcacaagaccatcgtccatcttcaccaccatggcagtgtccaccccatctcttatcaacttga

SEQ ID NO: 83355 - DNA, 216 bp, Glycine max
  Peptide Sequence Number=SeqID_175040
atgagcctatgccttctgcctaggtggggtgcaatggacgcagaagcatatccagaagcatcaaagagtgtgctacaaattttgtgggatgtagttacctatggtcagggtagacagtggggaaaagcaagaatttcagccctggaggcagttgctcaatatgaaaaatcgtcagagagtagtcaaggaaaaaagagttacaggaagcaagattga

SEQ ID NO: 83356 - DNA, 224 bp, Glycine max
  Peptide Sequence Number=SeqID_175041
atggaagaagaacacgcgacaaaggtgccactaccggacgctttccttcagttcctggagaccaacgggctcgacccttccatttacactgctattgattccaccccacgatacattcgggcataccgagaagggaagatatatggaattgatgcagcttttggagctgtagttatggctttaaatacctggggatcatgttctcgacctgtgtgctactcctg

SEQ ID NO: 83357 - DNA, 276 bp, Glycine max
  Peptide Sequence Number=SeqID_175042
atggcgaaaaagcacggtgctttcgttttcgaactaatgccattagaagagttttgttttcgttttcgaacatcctcctactccggcaattggaaaccaaatgtcagcaaggcggcaagggaggctgctaagaagtccctggaaaaagctactgagcgtgtgagatgccttgaggatgatttagcaaagtctaggacaaatagaaaggggagagagagagacttgaaattgtggcattcccgtgaagagattgtgcagtttgcttgtactcgctaa

SEQ ID NO: 83358 - DNA, 720 bp, Glycine max
  Peptide Sequence Number=SeqID_175043
atgcccgtgtgtgtctcttcatctgcgccttcgaaggttctagatccagaagtagctgtgaacaaagaagaataccaagtgtttgaagaactcgggcgaggccgttttggcactgtgtttcactgcttccaacatcgaggactgcggctgcatcaaaatggaggccttggaggttggtggcgtggtggtggtggttgtcgccagggaggagacagaaaagaagtagccgctggagaagaagtcattgtcatagtcgtcggtgaagaagttgcagagtgcgtcgatttggtgaagaagaaggagatggacggcctacgcaccaagatgccggtggcgctggcggaaggagatcgcgaagctgtttccgaacctgttcgggcaaccgtcggcagctttggtgctgagcgattcccacgtgccgcctaccttgcagaaggaagcacattgtatggtttcaggggtggtccagctggcatcaagaagtgcaaatacgttgaactcacctcagactatatttatccttacagaaatcagggtggttttgacatgattcgcagtggaagggacaagattgaaactccagagcagtttaaacaagctgaagaaacagtgcagaaactagacttggaaggccttgttgttattggtggagatgactcgaacacaaatgcatgcctccttgctgagcatttcaattttggcataatattatttctttaa

SEQ ID NO: 83359 - DNA, 1047 bp, Glycine max
  Peptide Sequence Number=SeqID_175044
atggttatgatgaagcatttcatcaactttcttttcaatcttatgtttttggaagtaaaggtagcgatacaggttctgatgggttatcgggagaggcacaaagctgaaggtggaaaaaagcagcaacacgccattccactccaaaacaagatcaagatccccaagggccataacatagaggtccatggagaaatagtgcttgtggatggaaacagacacatttctgcacacctaattacaacaaagttcactcccatttcccaccatgacgctaagtggttgagtgggttgggccctaagattcaaaaagtggaccatgtcatcctagatgaagttgtgggtactacccccatcgatgaggaccacgacgttatgcccattaacggaaccatcaatgtgcaaagtggcggaggcaggatgatcagagttagatcagaaggaccaatgtcaacagggttgtcattgtcatttgtgataaggagaaagaatttcaccttgcatttatggttgtctttgggagagtcagaagaaggggaggtaattgtgaagggaaacggaggtgaggggaataatataaagcttccttggggtcgtcatagaatgagggtgcgaagtgcatctccaaagcctggaagaaagtcgtttgtcattgggagtgccatagaactcgaaaaattgagaaattttaaagatccaggacatggcattagaaccatcaaaccacaggacatcaagtttcagatgtggaggggagttgaggtgagaaacgacctcctcaattttggagtggagggagctctaggtagcggtgagggcactctagttttgggtgagttgagtgacagcctcttcaaggtgggtgattgtttgggaacttgtgttatcaatcatggaagagaggcaatgaaagcaccaaagatgatagctacaaaacttaaagacaatgaattaatctcacatgaattggaggctaggagattacctctagaaatgcagaaggaaaatgatttattgaacattattctctgctttttccattcattctaa

SEQ ID NO: 83360 - DNA, 117 bp, Glycine max
  Peptide Sequence Number=SeqID_175045
atgggggaactatttcaagctcaggagaaggagacatctggtcctatggctgctgacggaggagttgggatggatgatgaagggatgtcatctgttctagctagctctcttccttga

SEQ ID NO: 83361 - DNA, 222 bp, Glycine max
  Peptide Sequence Number=SeqID_175046
atggtctatgtggttactggttacatagaaataaacattatctttaaagctcatatacctctatatttgtatcccttccttaatacaaccagtaagtccagattatttgagtatttgaggcttaccactcttggagtcattggcgccttagtgaaggtacaacctccttgcacaaacaaattcacttcttcttcccaagaaattgttgatgcctatgggtaa

SEQ ID NO: 83362 - DNA, 936 bp, Glycine max
  Peptide Sequence Number=SeqID_175047
atggcttgtattagaatccaaagaggctcttcatcacacacgaagaattttgatgtgtttgtgagctttagaggtctggatactcgtaatagtttcactgatcatctttttgctgctcttcaaaggaaaggcatttttgctttcagggataaccaaaatatcaacaaaggggaactcttggagcctgagctcttgcaggcaatcgaaggatcacatgttttcattgttgtcttctcaaaagactatgcatcatccacatggtgcttgaaagagctgagaaagatttttgatggggttgaagaaacagggcgaagtgtactccctattttctatgatgtcactccttctgaggtccggaaacagagtggaaagtttggaaaagcttttgctgaacacgaagaaaggttcaaagatgaattggaaatggtaaaaaaatggagggaagctctcaaagcaattggcaatcgtagtggttgggatgtacaaaataagccagaacatgaagaaattgaaaaaattgttgaagaagtaatgaacctactgggtcataatcaaattcatagtcaaatttggagtttctctggtgatttagttgatatggactctcgtgtgaaacaattggaagagcttctagatttgagcacaaatgatgttgttcgcgttgtgggaatttgggggatgagtggagtaggaaagacaacacttgttactgctttgtttggtaaaatctctcctcaatatgatgctcgttgttttattgatgatttaaacaaaaaatgtgggaattttggagcaataagtgcacaaaaacaacttctttctctagctctacatcaaggaaatatggagatacacaatctttcccacggaaccatgttgataagaactaggctatgtcacttaaagacacttattgttctggataatgttgatcag

SEQ ID NO: 83363 - DNA, 247 bp, Glycine max
  Peptide Sequence Number=SeqID_175048
agtccccggaaaacatgttcttcctattttttatgatggtgatccatctgaggttggaaaacaaacaggggattacgggaaagccttcaccaaacacgaagagagattcaaagatgatggagagaagatggaggaagtgaaaagatggagaagagctctcacacaagtagccaatctctctggttgggatatgatgaataattctttagcagttgtgatcgtgagtgtggtcatcactgaggcatga

SEQ ID NO: 83364 - DNA, 738 bp, Glycine max
  Peptide Sequence Number=SeqID_175049
atgaatgcctatttcaaccaaaaatttgtatgcgtcaacaaaacccctttctgcgaagacaaaaccaattgtccttgcaaaataaaatttcttttcaagaaagccaaactagacctagaccagtttaagtcctttggatatgaggacttagcaatttccacaaagagtctactggactatggatgtttggaatcagtcttgattcctccaccagatagatttgaaggatttaacccttcaatcaatgaggccataaacttaatacagacagaaatgatggattacattgtcatcaagataacaacctacccgagtaattttttggcccaaaattacccctgccatgtcatgaaactcctaccagaggatcatagaaattttccctgtctgttcaatgacgaatatgagagttgggatgtacagggtaacacacagtaccaatacagcctcatgagggcacaaatacaaggagaaacccacgacacaaagctcttccagccatcatacaatgggaagttttttattcctttctcggttgatcacaacaacaaattggtgcaattcttccaaaaagagaagaaagataaagaaatttatgaagccagtggatgtcatggacaacaaacctctcattttccatccaccgatctctcaatggaagacttatcagacattttctattctggaaatatccaagacgaagaagatgttactattacaaaatcaacaaagagctga

SEQ ID NO: 83365 - DNA, 468 bp, Glycine max
  Peptide Sequence Number=SeqID_175050
atggacctgtttcctgtcatggacgatcaaaattggatacgcgttggttactttgcagtatttgtggcacatgatgatccaaagaataattacggtaatagttgggtacccgattattgtcatcatatcgcatttggtgttcgaaatgtacaacataggggatgtgcaagtggaatgcatgatcctgatacaatggaattcggatccatcaatagcttcaatcaagatacgaaaaatgatgttacattaagcaaaaaaggcaacagaaatgaagagaaagaaagaattctgaagcaggcccagcccaacagtggcgctaagcgcgcagaaggcgctaagggtggcgttaagcacgaaggagcagaaaccgttacgcgcgctaagctggctacgcgcccagtgcgcgatccaacagaagcacaggctaagcctgcagggagcgctgggcgcgcgatccgaacgcgctaa

SEQ ID NO: 83366 - DNA, 789 bp, Glycine max
  Peptide Sequence Number=SeqID_175051
atgagccgcaacatgaacaattttacacatttgcttgggccatggcaaacagattttagatccaatgatggccacactttcaatcatcgtgaatccaatgaggtgcctgtgttttacagatctcactctactcatgtcactgatgacagaagttcaggtgtattagctcgacaacggttttcggacttcagaaatcctttaggattccacagtataccaaattttccagcaccaccacctagaagacaacaaattcatgtgcacaatgaggatatgagaaggcttagagagattttccttcagccacctcaaagatccacattccaaataaacacacaagctcccccaccggtagaaatttccaaatcaacggctttgagcaagcttaagaaagtagtccatgaccctccaccaaagaggtatgctaggagggtgagcttatattacagaaacaatgttgcaaagccttggaaagagaaggagaaagaaaaggatgaagatggcaagagttgtgctatttgcttggaagattttgagcccagtgaggaggtcatgctcactccttgcaaccacatgtttcatgaggattgcattgtaccatggctaacaagtaagggccagtgcccagtttgtaggtttgtgatttttgagatagaaagggggaatcaatcatccttcaataacaatgacattgccaatttggaacctagcaacattattaatagagagtttttgtcaattttgagggcaatggaagaagattttcaattgagcagtatgacttactaa

SEQ ID NO: 83367 - DNA, 162 bp, Glycine max
  Peptide Sequence Number=SeqID_175052
atggggggagattatggaagcaatgtcttccaaggttattttgatgatgccaaagaatcaagagttaaacaaagtttcaagcaaagattcaagaatcaagattcaagaaaaatcaagatcaagattcaagactcaatattcaagaatcaagagaagtactaa

SEQ ID NO: 83368 - DNA, 177 bp, Glycine max
  Peptide Sequence Number=SeqID_175053
atggcatttgaggagagacaacacataacaaccatcagcaggtacaagcaagacaacaagaaggagaatgaatggaacgaactcatgaagcttaccttcaacatcgaaagttacaaaagtataactttaacactcctctttacttctagaactgtaaactccaattctttgccgtaa

SEQ ID NO: 83369 - DNA, 198 bp, Glycine max
  Peptide Sequence Number=SeqID_175054
atgggggtaataaaaacaaagaatatagagagaaaagggagagctcgggcttggaatgctgcgagaattgctctgaggcgagctgttgaagtgggctttgggccttcgcaagtgcgcttagcacgacacctcgcgcttagcgcgtttagatcgtgcgctgcaggcttagcgtgtgtttctgttggatcgcgcgcttag

SEQ ID NO: 83370 - DNA, 432 bp, Glycine max
  Peptide Sequence Number=SeqID_175055
atggcgtgggcgaataagcgaggtgactcaaaaaatgcagggtttatgagaatgttggtggtggtgttgttggtgttgctatcggggttttggtgtgtttccggtgtgaaagaagggaaaagaaatgcgtatgcaatgatgatgtacgtaggtacaccaagggactacgaattctacatagccatacgcgtgcttctcaaatcgttggctacgctcaacgctgaagtcgatcttgttgtcattgcttcccttgatgttcctcctcgatggattcgagctcttacaactttccagccttatggtaagcttgtttctgctagagctgtctctgttttacaggcaattcagcatggtaaagctcttgtgcgtgtagcaattagtgaagatttcctaataatcgaatatattctacctgaaatattgaagctctaa

SEQ ID NO: 83371 - DNA, 861 bp, Glycine max
  Peptide Sequence Number=SeqID_175056
gcggttcccaggaaccgtcttagaatgtcccttagtggcatttttgtaaatagcggtaagataattaggacggtcttcgagactcgtctttgtaggacttatttctacaacgggtctcagaactcgaaggacctcgaagctgacatcccctgtgccacatcaatgttgttgcagtatcaccgtgccgtaggctaccccgttgtggttgtcagctgtgtcgtgagaggagtgggtcgcgtcaacgacgccagcactggaaaatccttttacggccccggcggcccctatgccatgttcgccggcaaagacaccagcagagccctggcgaagatgagcaagaacgacgacgacatccccccctccctcgacgacctctctgataaggcgatagacgttctcaatgactgggagaacaaattccaagctaagtacctgggaatcagttatgctaaccttgccccccctgtgtatgttgttcttggaagctcaatggatcttgcagtaggacatgtttctattgcttccctagtgctgggatccatgctcacagaggaagtgtctcccagtgaacaacctcatcattttcttcaattaggtttaacttcaacattctttgctgggatctttcaagccgctcttggaattctaagaactgagcttgatggaagttctgagactgagatgatggtttatcctccattcgaattctcagatgtttcccctccttccattattaccgagggaacccatggaggtccgtggagaaaaaaaatgtctgatttagatggaactgtggatgaaaaagacttcccctggtggtgtttggactctgtattgaataatcggttacctagcttctag

SEQ ID NO: 83372 - DNA, 279 bp, Glycine max
  Peptide Sequence Number=SeqID_175057
atggatccatcccagcttgtgggacttgagtctttactaattcaattcatgcaacccggtttttcacagccagacttgagtcttgcgttgatagggaagcgtgatagcatagcaaacaaagggatgtattcagaagaaatagatgcgaatcaagacatagcaactacagggttgtctacagcaaagaagggtgcaaatcaagtagaaaaagaggtgcaagcaatagtcaataccaaaagaaagatctcgaagcctgcttaccttaaggactatgtgtga

SEQ ID NO: 83373 - DNA, 741 bp, Glycine max
  Peptide Sequence Number=SeqID_175058
atggcatctcaagctgcacaagatatatctgatataattgtgagtaaatggactcgttacaagaatagacgacacaaggtagctttattcccaatggtcatgacaacatactcaacattgtcattgaggggatcccagttcgcacccccaatagaggtcgatatacaggtattaggtgaacgtgtcaacacaaaggggagcaacactgaaactgcagtgaacccatcaagagaagaacatgttgctcctgtgaaaccaaatactatagggttttacgtgcaaggtgataactgtatagacttggtggccttgggaaaaatatatgatgaggggtctaccatacactgcatggcttatgcagatgatgtcgatagggtcaatgtcgaaaaagtttttgacagtgacactaaagtcctcttaccgacatcagaaattcagcatgtgaggcaggcccttgacaaattcattgcatggccgacgtatcttatgaaacttgtatcacatgaggattcacatattactacaaagaaagtggctaaacctgctcaaaggtcaaataatgttgttgccgatgatcccttgatggaattgattaggagcgtgtttatggatgagtggagttctaccttgggtcatggttcgatgtacagatttcttgagcctcagtccatacacaatgcaaaggatagacgtgctgaatgtcaacattacattgaaacatggttcaaggaatcccagtga

SEQ ID NO: 83374 - DNA, 255 bp, Glycine max
  Peptide Sequence Number=SeqID_175059
atggaactatcactagtgacttctacaaggaggttgcacctatacttccaaagtcatttgatcaaagtcaagaccaaccatcctattagacaagtgcttcaaaagccagagcttgatggaagaatgcttcaatctaaatcgagtagtagtgacagaggtgattggtggatgctctatgttgttggagctagtaaccccaatggtagtggaacaggaatcacccttgaaggacctggagatatctcactcaagtaa

SEQ ID NO: 83375 - DNA, 213 bp, Glycine max
  Peptide Sequence Number=SeqID_175060
atggcggcaagcatggtaccgccagtgctattggcgagacagcctggtaccgccaatgttgttggcgagacagcagcttacgtggaaggtgccgccagtgaagctggcgagacacctccacgttggatctgcttcttctgctggcgatacagcatcgtttgcaggttgctacagctttatatttatagggttgcatgcatggtgaaaaagtag

SEQ ID NO: 83376 - DNA, 276 bp, Glycine max
  Peptide Sequence Number=SeqID_175061
atgcaaaacagtgctgtgggcttggtctcgcaggagccaatggcgggactggccacgttggcatgtcccgccaacagcacaggcggcgcaggcgtctcgcaggagctgatggcgagatcaccacgtcagcaggtgtctcgcccgtgccactggcggcacgctccaggaatgccagctaagccaccttctcaccatcttcaatggcggcaccctccttctcgccattgcagatggcggaacacccatctcgccattgcagatggcgggatcctctaa

SEQ ID NO: 83377 - DNA, 219 bp, Glycine max
  Peptide Sequence Number=SeqID_175062
atgggtagcattttcaaggatgtaaagccaaatcaaatcatagtgaggaattctccaaagaagaaaaaattccatgagggttacacaaagtggaagagaaacataaaactaaggggatttgagggagtcattgcatgtgttcaaaccttggagggaatgatcctcaacttcgacagcgatgaacagaagcagattgagaagaaggttatgcacgaataa

SEQ ID NO: 83378 - DNA, 99 bp, Glycine max
  Peptide Sequence Number=SeqID_175063
atgggtcatgaagatgaagaagaagatgatgataacaacaataccaacaataacgatgatgatgatgatgacaactgtgattatcaaaatttaaaataa

SEQ ID NO: 83379 - DNA, 550 bp, Glycine max
  Peptide Sequence Number=SeqID_175064
tggtgtctcctctctctcttccttctctattccgctaccattcatcttccaagaagcaaaggaatccattgatgaagaagatcctaggccgacaagctccaatggagcttacatcattaagtcttccttgaccactaaatttatgtatgctgacactgagggtgcacgttcaagtacaaaggggactgatgctaaaactactatcaatccatcaaggaaagaacatgttgctcatatgatgcctaatatggggttgtatgtgaaaggtcattgtgaggttgaggatttggatattcaggggaaagaatggcgagctctctgttacgggaagacttgcatcaggccaagtttagtgcaaaaggatgctttggggtctgctcttctgccatttgctggcaacaatgatagtggtgatagcggtagtgacaacaacggtaatggtggtggtaatggtgagagtggtgatgatagggtgagacgaaagaagggagagagagagagtgacaatcctatgttattgctttgtaacttaactcctacctcaggataa

SEQ ID NO: 83380 - DNA, 381 bp, Glycine max
  Peptide Sequence Number=SeqID_175065
atggctagagaacattgtttgatttttttcttctccaggctgatgttcatcatggcatctttagatggtcaagcaagtctgttagagacctcatgtatctttgtcctcaaaggggttgcagagaaatcaatggctatcctagagactgttcataaaaagaatggacaagccagcatacatgatgtgcgagcaagggttcaagctcatgacttacttttggatgagctgaggcaaatgtatgaggaacaaccggaatttttggaagaggtttcatcattgcaactttcttatacattaagccatggccttccaggaacatatactgaggatgcagttttgaatgcatatccaaaatgtgagacagtgccatgtgaagactga

SEQ ID NO: 83381 - DNA, 189 bp, Glycine max
  Peptide Sequence Number=SeqID_175066
atgacgttgttgggggacttgacgaattggaagtggtgtcggggagagtttcttggaaaagcaagggaaagagggccagtgagggtgggggaatttgtggtagagagtggggtagcaacggaggaagcaaaggacgaggacagtcaggctgggcaagaaaggaagagagaggtgaagagaaagagttag

SEQ ID NO: 83382 - DNA, 882 bp, Glycine max
  Peptide Sequence Number=SeqID_175067
atggccgaatcatccaagaaaataaagggatcttcctcctccgctatggcatcaagaactcaacgtcccgtagccaccagagtgtccccgacatcaattccaccctccttgtcatcctctacattgttttcatctgatgaacagcgtattcggtactcctctctcttttcatctcgtcaaattttttatcctaaatatctcgacctagaattctttgatgggcaaacatttgattgctatcaaatgtttcaaaacactagtctgattccttttatgtcattaaaattaccatattatcctaagttagtacaagtcttttactcaaatttgaaaattcaggacggaactttaatttctgaggtgcatggtatccctatgattattgatgagtctcttttcttttctctgacacaactacccagtcagggtgcaccttttgagggcaccattgttgatgactggaagtttgattactccaatcatgatgcccgccgcatggtctgcattgaccagggggatatgaccgatagactgcttgccgggtcattgacatttgattgtcgcatcatgcactatatcattgttagaattttgatgcctcgttcttctaatctagctcaagcctttgaggaggacttgattctgatgtgggctttcttgaccggtcgtccaatcgactgggcccatttgattcattaccacatgcataaggcattgcggtctagtgcacctctaccttaccctcagcttgtgactttatttcttcgacattttgaaattcccttgaattccttcggctaccgtaaggacatggatgggaaatggttgaagaaggatgcgcaacctccgcaagatgaatgcactccctctgctctgccttag

SEQ ID NO: 83383 - DNA, 315 bp, Glycine max
  Peptide Sequence Number=SeqID_175068
atgggagttattccattctgcagggcaaggaaaacttatattattcctaattttgacgtagaaaataaactccgtaaacgcataataggaacaacccaacaagcaaggcagaggtacaaaaaggctctgataccaaatagaagtgggtttggtgataccaaattgagagcacctcatcctatttatagagtctgtccatcacagagctcaaccaacttgttatcagaatgtgagatagaagttatcagtggttgcaaatatgttgcaaagatatgggttgaatgtggaaggaaaatggaccagattcaaaaataa

SEQ ID NO: 83384 - DNA, 138 bp, Glycine max
  Peptide Sequence Number=SeqID_175069
atggagaatgatgagctaaggagtgaggactcggaggaggaagaggttgaaatgagtgaccaactctcaagtacacatgacaacacactttgcatgctaatatgcccggtgcccggtaacagtcatataagcagttaa

SEQ ID NO: 83385 - DNA, 288 bp, Glycine max
  Peptide Sequence Number=SeqID_175070
atggtgaaaggagtggttacggtggtgttctggaaaatttccggaagaacggttcttccagaagtaacgaaaggtcatccggaagaacacttcttccagaaatcttccggaacaccttcttccggaaactttccgaaagaagtagttcttccggaaaattttcggaagaagggtactttcggatgccctttgaatattccgaaagaactttccggaagagccacttcttccggaaaatttccggaagaactacttcttccgaaagtgtatgtttttgaaattttataa

SEQ ID NO: 83386 - DNA, 237 bp, Glycine max
  Peptide Sequence Number=SeqID_175071
atgacgacgagtaacagcatgatgttcatgaacatggagaaccaagcaatcaaagagagtcattttcatattttgaaaccattagtagccaactttcagaaaatcaagagtactcaaatccttatcagaatagagggagtgctaagaacaagagtgacaagtacgttgtcacgtgtaatcaatatggtaatggatgttattggagggcgagagtatcattcagaaaaatacgcatga

SEQ ID NO: 83387 - DNA, 276 bp, Glycine max
  Peptide Sequence Number=SeqID_175072
atggcaaagggcatggaaatggtgatgaagaagaagaggaagaggaggaggacaacaaaagctgcaatacctaaactgggagcagcaggacaaacaattgtagaagcaaagcttcatgatgaatcaagattgattcaaagatgttttgatgataacaaagatgatgacaaaggtgatgacaaaaagctcaaaggtcaatcaaagaataagtttaagatgttcaagatagaatcaagaacacttcaagattcaagaggaaagttgaagaacacttaa

SEQ ID NO: 83388 - DNA, 429 bp, Glycine max
  Peptide Sequence Number=SeqID_175073
atgggtggtgtaaatcaattgtgtcaactaagatttggcaagaatatactacaaaggatgggaagggaaaacagtgaaggtgactcacaattcacaggatatgctattagactcaatggatacttcagctacaacaatttagtggacactttcagagctcctaaagaatccacgggtgatgaagaaagtccaaatggagttggaaactattgtgggtatgtagaggaaggtgaaggaatcagacttggacaagttggagtatttggatatggttataaaggaaaacatgaggctccatctagtggcaccgttactaatgccacaccaatcgagggaagattgcatggttggagattttttcataccaagaaaatcaagggtgatagtaaatgcatgggcaattatgagagactcaagtgcatggagtga

SEQ ID NO: 83389 - DNA, 1056 bp, Glycine max
  Peptide Sequence Number=SeqID_175074
atggccaattcccttaataaccacctgtttgttgtagtatctattctttctctcttagccttttctagcaacgcacaactatctcccaccttctatgccaaaacttgccccaaccttcaaaccattgtgcgcagtgcaatgaggcaagctgttgctaaagaagccaggattggtgcctctattcttcgcttgttctttcatgattgctttgtaaatggctgtgatggatcaatcttattggacgacactgccaccttcactggcgagaaaaatgcaggacctaacagaaattcagcgaggggcttcgaagttattgataccattaaaaccaacgttgaagcttcttgcaatgccaccgtttcttgtgctgatatcctagcacttgccacaagagacggagttgtgctgctaggaggaccctcgtggagcgtcccacttggaagaagagatgcaagaacagcaagccagagtgcagccaacagccaaatcccaggaccatcctcggacctctcaaccctaacatcaatgtttgcagccaaaggcctaacctcaagtgacttaaccgtgctctctggaggccacacaataggccaagcacaatgccagttcttcaggaaccgcatatacaacgaaaccaacatagacaccaacttcgccaccaccagaaaagccaattgccctgccaccggtgggaacaccaacctggcccctctcgacaccctcacccccaaccgcttcgacaacaattacttctccgacctcgttaacggccgcggccttctccactccgaccaagttctcttcaatggtgggtctcaggatgcccttgtgaggacctacagtggcaacaatgctgcattctttagggactttgctgctgccatggtgaagttgggcaacattagtcccctcactgggtccagtggggagatcagaaggaattgcaggctggtgatggcaataataacaagagtatcagcaggtggtagtagtagcgacgtgttagaggtcatgactcatgagagattagtgtattgcaaggtcatggtcatataa

SEQ ID NO: 83390 - DNA, 315 bp, Glycine max
  Peptide Sequence Number=SeqID_175075
atgaaaaaccgggatgaaacctttgagagaactgacccactactcgaatgtgggcaacaaaataagaaaaaggcttggaatgggtccaggaagtgtcgaaaaaccgttctgtggtggtcaagtgactttccgatcatcggagaccaacgtgtggacagaacgtgtctgactgggtcatgtgaagaagtgatgcttgagagcgtgagcaggattctgacctcgaaacttgcaggggtcaatcgcgattcggaaaacgcaccagatctaggtgtcatcagtgaaaagaccggtgatggcagaccgtggcgcttgtga

SEQ ID NO: 83391 - DNA, 256 bp, Glycine max
  Peptide Sequence Number=SeqID_175076
atgactaggggcaatccaggtgatttaaaaccctttgatcctaaaatagatagaacctttcatagattagttaggcatagtgtgcatcctgatcattctgtgtattttgagcattttgagtattttgttgctggtgattctgaatattctgattttgagcattcgactactaattttcatactgagaacatggctcaacctccacctcgtgagaggaatcttagggagatggctgcacctgatttcacttatgaaa

SEQ ID NO: 83392 - DNA, 333 bp, Glycine max
  Peptide Sequence Number=SeqID_175077
atggggatggacactatactttttgggatacattctactaatatgaaggtgttcagagacactcctgctatggctccacctagtgtgttttggctaaggaagtttcttctaataggggttgaattcaaattgttgcatgagtgtagaagcaagcttcatgatgaatcaagattgattcaaagaagttttgatgataacaaaggtgatgacaaaaagctcaaagatcaagaacaacttcatgataacaaagatgatgatctcaagaatcaaagaatgagttcaagatgttcgagattgaatcaagaacatttcaaggttcaagaggaaatttaa

SEQ ID NO: 83393 - DNA, 321 bp, Glycine max
  Peptide Sequence Number=SeqID_175078
atgttgaagttgtttagattaatgaagctgaaaatgattgtgaaggtgagggtcaggggcatgttgatgttgatggtgagggatagggtgaagatgaggttcagggtgatggtgaggtgcagggggttcatggtcagtgtgagggtgaggtgcaaggaaatttctcctaacaattgggagtttgatgtagctacaattgaatttggggatgaggatggtgaaactgatcagccagatacctcactaggaagtgaggatgaaggggtagaaaaggagaaatttcaaagatttagaatgcctaaggatgatgcggatgtttga

SEQ ID NO: 83394 - DNA, 216 bp, Glycine max
  Peptide Sequence Number=SeqID_175079
atgggctttgggttgagggcgagccctggtgcagtggtaaagttgtaccttggtgacttgttggtcatgggttcgaatccggaaacagcctctttgcatatgcaagggcaaggctgcgtacaatatccctcccccataccttcgcatagcgaagagcctctgggtaatgggataacaatcctttttagcaacaagaatgtcatattgtgcgtataa

SEQ ID NO: 83395 - DNA, 288 bp, Glycine max
  Peptide Sequence Number=SeqID_175080
atgaccaagtcaccaccttgtttgccaactctgtcatccaacgataattcaaatgccttgggatctttaagaatcggaaagtacaccccgtggtttaatgatgtgcattcaactgaaatctcttataaatgtgatgaagcacttaatttgctgtcaaaggcgcatggttgtgaaatgatagaaattattatactagagcttcttgagatgcgaactacccatgttgtttcaattggctctgaatgcttatgttcactgaatcctggttgtgaagactggtatgtttga

SEQ ID NO: 83396 - DNA, 1050 bp, Glycine max
  Peptide Sequence Number=SeqID_175081
atgagtgcttccactatcaaccaatatggttatacgagcactattgatcagtccatacaggcgaaaagtatcagaggcggagacaccggccagtgcgtgaaggctgatgtggggttgaagagaggaatggtcttttggaggggagccaaacgaacttttggaggtgtgtttcttgcggtccagggcgaatcgagcttcgattgcctggagaagagctggccaggaagtgatgaatccgttcccgaacatccactgaaaccaactgagagcgggtccatcgagatccaccctaatggatcatggccgtcaaaccgaggcacgtcgagcttgaccgacaaccgtggaggtgaaggaggctggtttgttgctggagtggtggaggtcaaaccagttgttatgtgctggtatgagactaacgtgaggaagaagaagaaaagccttggttcgaggtcaaggtccctcctgggtccttcgcgggcgttcctctcgagttgtactttcattgttgctggtgcgttcctctcgagttactcctttgccactgctgggctaaatcaaacatgtgcatcctatgaggaaccgtcatctataacttggtggtcatcatctgatgaagtaggggcctacgtcctatacaaacctcttgaagaccgtgagtggagtaaaagaattgaaagtatctttcctggaagtgaattaccaagtttgttcaacaatcagcgtcaaggaaggaaaacagtttcagagatgggtagtcctcaaaaaccaaatttcacctgttatattccaggggttctcaatgaagatccaatcacagatgaatcagatcacctttggctatgcgcgcttagcgcgacagaagaatctggcaaagcatcaatatcaaggtcacgtgctaagcgcaagatcagtgcgctaagcgcagcagttgtctttagccaggctcagcgcacgactggcgttaagctcaaatccacttactcagcacaccacagtgcctatttcgggaatagagctctagaggaagcaagaggagcaacttttgcatag

SEQ ID NO: 83397 - DNA, 303 bp, Glycine max
  Peptide Sequence Number=SeqID_175082
atggttgtgttgggtaatggggatatctctagtgcatcttcttctagcgcttctagttcttccagtgtgagtgaaagtgaatgtgatgtaccacccctggaaggtgatcttttgatggttaggaggttaatgggtagtgtgtataaggatagagatgaaactcaaaaggagaacattgttcatactagggtgacgcaaggctcacaggtgcgtcttccaaggaaggaaaacacaccgagtcgccaccaatgtttattcgatgaaaatgtcagaaaaaccaaaaaccaggtctacaaactttaa

SEQ ID NO: 83398 - DNA, 204 bp, Glycine max
  Peptide Sequence Number=SeqID_175083
atgtctggtggttgctgcaggtgttcattcagttatttctttgattcttgctttcattttggatcgtgctgctcatcttcacagtatttgaatgaatttagaccattggaagcagagagattcaaggcgcttcgcatccagtgggcacagtgtcataccctaatttcgtccggggattataatttgatgatatacaaccattga

SEQ ID NO: 83399 - DNA, 195 bp, Glycine max
  Peptide Sequence Number=SeqID_175084
atgaaagtatataatactgtgtgtcgcaacgtgcccttttgcgggcgagtgaaggcaaggctcacgggtgcgctttccaaaggaggaaagatgcgcggagtcgccaccaacgtttatttgtggaaaacgtcggaaaaaccgaaggaaaccggtcaaaatgaaaattctaagttcgggagttgtatttacgcttga

SEQ ID NO: 83400 - DNA, 276 bp, Glycine max
  Peptide Sequence Number=SeqID_175085
atgtcgaattggagctcactcaagatgttggaacatcaagagaagtgcatcatcatgatgatgcatctgaatcaaataatgaagaatctcttggacgagagaatgaaccaacaacattctcagatgcagttaaagatgatagatgacgctctgctatgcaacatgaaatacaagctcttgaagacaatgatacatggaccatgtgtcctcttccggcaaataaaaaggccttgggatgtaaatggatctacaagatcagataccattctccgatga

SEQ ID NO: 83401 - DNA, 106 bp, Glycine max
  Peptide Sequence Number=SeqID_175086
atggcgatcacaggtcacaaacagtggtcacagggtcttatgggtgaaagggagaagaggaaggttgtttgcgatactaggagcgcgagtggaaaaaagcttttaa

SEQ ID NO: 83402 - DNA, 273 bp, Glycine max
  Peptide Sequence Number=SeqID_175087
atggttccacctgcgaacaacggagttgagacagagcagtcagaaaagaagcaaaacacataccttgcgttgatgtcggactccaacggaggatgctccacttcgcggcaaaaacaaaccccaacgacagtcatgaatggcgaggatggtaataaggagatggcgatcacaggtcacaaacagtggtcacagggtcttatgggtgaaagggagaagaggaaggttgtttgcgatactaggagcgtgagtggaaaaaagcttttaagtaaataa

SEQ ID NO: 83403 - DNA, 309 bp, Glycine max
  Peptide Sequence Number=SeqID_175088
atgcatgatagtatcatgtttgaagaagttgatatgaatgttgaaaatgagaaagatgttggcgtgaaagtagaacatattgattgctctgatgcctttaatacttctcagaaacttagtttttcaattcaagggttatgtgaggctaaggtgaccataattgaggagatggaaaccatatcaaaacgatttgaggagctcgatgtttgtggcaaagattctattgaatacattattgatgtcaaagcggatggtaactgtggttatcatggaatagttgccttatggggtatgggtgaagaatcatga

SEQ ID NO: 83404 - DNA, 276 bp, Glycine max
  Peptide Sequence Number=SeqID_175089
atgtctactttcaaagacgttgttgaggtaagcaccctcttagaatgcgtactttcaaagacggtgcttacctcagcaacgtctttgaaagtaggcattcaaagacggtgcttacctcaacaacgtcttagaatgcctactttcaaagacgttgctaagaatctcctttttctagtagtgagagaaagctacatgttggtcagagtgagccaccatagaggggttgagctcatcagaacaaagagattaggaaacttagaaattctattgttgtag

SEQ ID NO: 83405 - DNA, 375 bp, Glycine max
  Peptide Sequence Number=SeqID_175090
atgtaccctcccttgttctctttgaacaacctagtagatgtatcctccactagaactgatccacaagagatgtaccctctcttgttctcagtcacaacaacccaagtagatgtaccctctacttgtaccacaaaggatgtaccctccaatgtgttaagacaaagttctcaggcggaaagggaagaatcaaaagaattctcagactgtgtcgttttgaattctttgacaagggagaagggagacacaaaagaattcaggcggttagtccttcgtttttttggaaaagggagaagagagacacaaaaagaattcaggcagatagtccttggcgaatttgttttggcaaagggagaagggaatgaaaaagatgaatag

SEQ ID NO: 83406 - DNA, 312 bp, Glycine max
  Peptide Sequence Number=SeqID_175091
atgtctcaacatatcagtgttacagttgtggattctcagacactggcagatgatggtcattgtgcccaacgaacacctagttgtctgcctaaatcaaaggctcccatgctaggtggattgccgtcaagacaaaaaggaagtactgagtgcggctactatgtcatgcactggatgtccaccgtcattttaggaagttttaggaataactgggaagcgtattttaacgatcctagaccgttggagccagagagattaaaggcgttgcggatccagtgggcacagtattatctccgagttagagaccagacctag

SEQ ID NO: 83407 - DNA, 702 bp, Glycine max
  Peptide Sequence Number=SeqID_175092
atgaaaagatttggagggccttaccgtgtaggaagcagtgttggggttggtgagaagagttgcttgtgtgaaattgcagagatcaaaggctttttggttcttgatatgaaattcgattcaattacctttgcattttggtcgaagagctcgatggatgttgagccaagacgaataagattgttgtccaatagatatactacaaacacacttttggatactgctgctaccatacagatcttgaagcctaggaccttcttggctactttctatccaaagcctatgatgtctgctacttctgctgctgcatgggaccgacttaaaaagcactatgctagtaggtcacatactcccatcatgtccctcaaggagagtcttgattcaataacaaaactcatcattgggttgaagggacttggccctgcatttcatgaattctctgcctccattcaagaatgtgattctcccttgttcgcaaaacttttccacaaacttgttgatagagatttttctccaacacgaggaatttctcacgcatcctcaactcatggccaaatcaaccctcatagtcacaattcctctacttgtgctgacccttcaaacaacaacactcaatggggtaatgtctctcactcagtccctgcatggcagtattgtggtcgttgtgaccacactgccgaaacatgttacaagctgcatggataa

SEQ ID NO: 83408 - DNA, 333 bp, Glycine max
  Peptide Sequence Number=SeqID_175093
atgaagccaaaacctcttggcctctgggcattgtgtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 83409 - DNA, 852 bp, Glycine max
  Peptide Sequence Number=SeqID_175094
atggggcatagaatgctgaaatttactgcaatccaacttgttgacaacgaagacgtgaaattaaagccttcctcgtcaacccaaccaaaggtgcctgagttcacagcaaagtcaagcttacctaacaaagaactcaatccctttagtgaggatgaagacgaagttcttcataatcaaccccaagaggaagatgatgaggaagaagctcgacttgcttcactaatcacaactatcgcctccgaggctgaagcagcgacagttgccgctctgagcagattgaagtggcattccgatgacgaagacgacgacgatgcaaagcatgaagccaacaccgttcaggaggtgaagaaggcgaagcagaagaaaccaaagaagccaaaggtgacggtggccgaagctgcttctagaatcaacgtcgatgatctcgaggcgtttcttgctgagattatcttgagtgcttcgtatgaatcgcaacaagatattatcctgatgcgatttgctgactacttcagtcgcacattctcgtcgggtatttacaaaatatcaacggattggatcaatcatcgatcatatgaagcacttggttcctttgtgctatggtcattggacaacattcttgcagaccttgccagtcatcagggagttaagaaggcaatccagcaatcatcattgaaatctctgagatggactagcttgtcaaacaatatgagaatgggttattattttatgtgtcctatgagacaatatgagaatgcattaggatttaaggatggcaaggatatgccatcaaggctgagagggaaaagtttggatgtgggttgtgcctccttggacaaatctattgcagtctaa

SEQ ID NO: 83410 - DNA, 533 bp, Glycine max
  Peptide Sequence Number=SeqID_175095
gtactccaaaaacctttgactggaccagcagacttgggatagcaactacaattgctgaggctttatctttcttgcatcaagagctatgccatcatgctattgttcgtggtaacctgaaatcctccaacattttgctaaacaagaatatggagccatgtataagtgaatatggtgttatgggtatggatgatcaaagaggttccctttttgccagtcctattgattctggtgcattagatatctttaaggaagatgtttatggctttggtgtgattctacttgaattgcttactgtctttgacaagtctttaatatctgagtatgcaagtgacgagaggatgagtgaaagaaccccacagttcacattggagattccatcactaacattactctctgctttgcctgtgtggtttgtgcttctcgggttggatactttgagcacaaaagcccacgtggctagtgttcttaattctatcatctgtttggttgcattcgagattgcattgcaaatcttaacacctctaacatggtaa

SEQ ID NO: 83411 - DNA, 48 bp, Glycine max
  Peptide Sequence Number=SeqID_175096
atggatggtaaaggtcttgtagatggatgtcaagactacattccttaa

SEQ ID NO: 83412 - DNA, 460 bp, Glycine max
  Peptide Sequence Number=SeqID_175097
atggaccacatgaagaaaactggccaaatgacgtctgaggcagcaaaggaaattgctgagaagattgattcgttggaggagcaggccttacagggctcgttagtcgcccatggatgtcaggatgtactgactgctgtcattgggcgaccagaacaccctggttgtgtgtgtgctgttggagccagtgtcacgatcaagcaatactttagactagctccaaggacctcccgcacatcttcctccatggctcccaaagacttggagcagctgacgcaacaaatcaaggaccagctggatgagtcactcacaaaaaaaatgactcgacagctaatgttatccttcagcaagatgcaatcacagggactcgcactgcctcctaagcctgaggttggtccttcagctactcgtgtcagcacaaaggagagttgtgttgatccctcgaggaacgatctagacacag

SEQ ID NO: 83413 - DNA, 264 bp, Glycine max
  Peptide Sequence Number=SeqID_175098
atgactaggggcaatccaggtgatttacaaccctttgatcctgaaatagatagaacatttcttagattagttaggcatagtgtgcatcctgatcattctgtgcatttcgagcattttgagcattttgagtattctgttgctagtgattttgaatattctgattttgagcattcggctattaattttcatactgagaacatggctcaacctccacctcgtgagaggactcttagggagatggctgcacctgaatttcacttatga

SEQ ID NO: 83414 - DNA, 1971 bp, Glycine max
  Peptide Sequence Number=SeqID_175099
atggagagggatttgatggaacctatatttatagtagttgagcgtgactactgggttgagcgcttacgcttctatagcagagctaacctggagggcgaaagaggttgtgcagtgttgagggagtttgtcctgtgtcgagggagtctatctaatatctggggtagtagtcttgacaagcagagggtgacaagtttattgagccctcaagtatggatgagtgttgtccggtgtcctaggcagtacataagccccccaagctctgagccggcttgtaggcaaaaaaggttgtccagtgctgagggagtttgtcccgtgtcgagggttgtcgggtgtggtaacctcaatgagtgtaagagattacaagacgatgtgccaggtcaagcgctcgagcctagacaagtgttgtctgggctgatgtcttcttttttgtttgattatgccatcggtctgggtgacagtgactctaagggcttgattgagcaacccatcatagatcgggaggtaatctcgataggcggttcctcgtctgaggatactcgtcgaggtgcatttgatagcgagtcctcatcttcggagagggcactaccttctgctcctaccggggagcctgtcccggttactgtgatcctccccccttgtgcttacgagggtgtgagaagaggtaatggtggcagagattctaggacgtctccccacgtcttggatctcattctacccttcacaacttttcaatgtgctctcttggagcacttgaatgtggccccttcccaactccacacaaaaaattgggcgatgatccaggcctttgagagtctgtgtcctttcttcaacatccagcctagtgtgtcggactattgtttcaaggtcctggctattggtgtcatgattgatggtatgccattgatgttcaacaaggacagggagtcctgcttcccgttctactggcaatctgaccccatcaagttcaagtcatatgacgaggatttgctgacctttgtggagagggtcgacaaagcaattttggagcagctgtcggcctcgttggatgcacgggccattttggctcttcctttggcaagcgatcctctcactgtcttggatagtgggattgtgccaccgtctattgttgctccgtctgttggagaagtgggtcaacctgtcggtaaggttggccctgttgctgttgttgctgaggtcacccctagtgctccttcttctgttttggcaaagaggatgatggatgatgttgctaggtcgtctagtcgtaagaagtcgaaggcccatctgagtctccatgccttgagactagctgtagggttgatggctagtgtgggttgcttttcaactatgcaagatatgccttcggctccacaggaggttactcctgctatagttgaagttactgtgccagccactcaggctgactttgtcatggccccgtcgtccactgttgcgacacctttgttgagtgtcggtgtggcaaccacgggtgcttccacagtgctgcttcctttctctacgactccagtggcttctccctttgttgttttagcaatggtggcgtcaccttttttgtcgtctcaccctctcgtctcccttgatcacttgtacacctctagtgatactgattcattaatgctactgattctaccaaagtttttctccaaaggagtttgccaattcaaaaggagtatggatgcagaggccgtaaggttgaaccaccaactgtctttcaaagcagagaagaaggacctaggtggcaaagtagaaagcatggaggctgagaaggatgggttttccaaggtgattgatgatttagaggtccgacttaaggattcgaagtccaagttgcaggttggcaaggagaaagagaccagcatggagcttgaggaccttgacctgggtctctttgatcccttcaaggatgtgaaggatgatgtcctacttgatgaggaagacattgctgcttag

SEQ ID NO: 83415 - DNA, 324 bp, Glycine max
  Peptide Sequence Number=SeqID_175100
atggcatatatgtggaacatggtgcatatatctataatttattgttgtcggttagtgcccggccgtgcccaaatttcaacggataatcatagacatcaaactataagattttatgatgtggacatcaaagtccaagcccatgacaaccaccagacccagactcatgaccagatggaagcccaagacctaatacaaggcataggaggacccatgacgagagcaagagcgaaaaaggcccaagaagctttggagcatatggtgactattctaaggtcagttcaaatgcagggagaggcccaacacttggaggcccacaagggatag

SEQ ID NO: 83416 - DNA, 423 bp, Glycine max
  Peptide Sequence Number=SeqID_175101
atgcttctgcatccccctgctgtgctacaaaaccgtgcgcattttaaacttgccaggagagatgatattctgggctctcgtgtctgtaaaatgcatttatgtcttgcatcgcgtaagcatttcttcatgcattcatccatttctcccatggtagatgtcggagtattaattctcactgaagttttttcaaatcaaacacctttgctcaaaaagaggttctatcaagtcaagatcaagagcctagaagtcagccgcctacgggaattaggacagttgatgggtcaactccaacggcaagccttccgcaaagcctatagtaagatctgggacctaactacggcggaggttcccgtggaggccattgcctccctcacccagtattatgaccaacccttgaggtgcttcacctttgaggacttctag

SEQ ID NO: 83417 - DNA, 465 bp, Glycine max
  Peptide Sequence Number=SeqID_175102
atgtttccccttgagaagaaaccggctgttaatccccttaatgttctcttgtcgttgttggaagcctccggtgttcttgagcccgaaggacatcccccgagtgacttcttattggacagtcctggaaatcaaaactcgagggcgcagtcattgccaggattcacaatcaattctcctcaaatttcagccaggctgcatcaatcagactttgcaccttatgtttcagggctttacaatgctcaatggaatgccctggtgctcctccatgataagcacatgttgcatttgggtcatatccttgatgaaatggaggttaagggaccttggttggggtcatggctaccattgacttacggagtagatacgggagtaagtcagcataggacactggaattggcgcgaattccctgcatcgtttctttttcgcaaaatccttgcccatgttggtgttttggttcgagctaa

SEQ ID NO: 83418 - DNA, 375 bp, Glycine max
  Peptide Sequence Number=SeqID_175103
atggcgtgcccgttagcgtgtgttccaaaggaaccctcgcggacttccactagcatccgctcagcctccttagcatccacgcatcagagtaacaccataaaacgcgcaaatccttctgagtcatctaacaatcactctcaaaattgccccatgtgtgggctttacaatgctcaatggaatgccccggtgctcctccatgataagcacatgttgcatttgggtcatatccttgatgaaatggaggttaagggaccttggttggggtcatggctaccattgacttacggagtagatacgggagcaggctttgtggctgattgggtggtgggtaacgagaagggccgatatcgacagagtaaggaaattattgagtag

SEQ ID NO: 83419 - DNA, 558 bp, Glycine max
  Peptide Sequence Number=SeqID_175104
atggaggcagacatactcttcaggtggaaaccactcaacctcgagcgatacgatgagacaattaacaaattcaaacgagcatctggatgtcttcctaacataggcgaacctttacaccaacgaagcgcgattctatgtcgtgtcttccttacatcccttaaaggggaaacattgacctggcatggtggactcccacctaggtcaatagatagctttgacaccctcatcaagctattcagtgccaagtataccaccaacaggtctcaccgcatgacctcggccgcctcagaaaaaaaattcattgacagatttgagagcacggtcgtccagatccgaaatcttaacctcgaggtagcgttgcattccatgctcatcgccttatgccccaacaagtttgcaaatagagtagacccagagaacatcaagaagatcaacacaggaaccaagaagcagacaaaagaaaagcagaagaccgaggcagacaaagacaacagcaacaacggtgtgagcgacctcctccaccagaacaggaacccgcctagcacattagaggtgtaa

SEQ ID NO: 83420 - DNA, 3447 bp, Glycine max
  Peptide Sequence Number=SeqID_175105
atggaggatagtgttctttccatcagagcaaagattgtagaatatattgtgggtccaattttacaccatgcaaaatacttgtgttgtttcaacaactttgctgtgaatctcccaaatgccaaaagagaattggaattgaccctagagcaagtgaaattacgagtaagagaagccactattaggattgaaaaaattgaaccaactgttgaagaatggctagaagaagttgagaaagttttagcagaagtgcagattctcgaaggaagagttttgaaagtgacaaagagtagtttcataaggcaatgtcgatattttcttgcaaaagaaatggtaagaaaaataggacaaatgaatcagctcaaatgtaacaagttagagcccttttctaggagtattaaccttccagacatgaagtactattcttccaaagattttgttctttccaattcaacagaatcaacttacaacaagcttttggaaacattaaaggataaaaatgttagcataattggactagttggaatagaaggctcgggaagaactactttggcaaatgaggtgggtaagaaagctgagaagttaaaactttttgagaaggttgtcatgacaacagtctctcaaaatctcaatatcataagcatccaagaacaaattgctgataagttgggtttcaaattagaggaagaatctgaggaaagtagagcaaaaacattatcacagagtttaagggagggcacaacacttctaatcttggatgatgtatgggaaaagctaaactttgaagatgtaggtattcctctcaatgaaaacaacaagagttgtgtaatactcctaacaactcaaagtagagaaatatgcacttctatgcaatgccaaagtataattgagctcaatcgtttaaccaacgaggaatcttggattttgttcaaattgtatgccaacataactgatgactctgcagatgctttgaaaagtgtggcaaaaaatattgttgatgaatgcgaaggattcctaatttcaattgtgactttgggaagcacactgaagaagaaaagtttaggagattggaagtcagcattgaaaagactacaagattccaaaccattggttattacaaaaggcctaaaaattcctcatgtatgtcttcaattaagttatgataacttgacagatgagttaaccaagtcgttgcttttgttgtgttctatctttccaaaggaccatgaaattgatttggaagatttatttcgatttggaaggggactgggactaactaagacttctgaaacaatggaaaaatcaaggagggagattgaaatagccgttaacatcctaaaggattcttgtttgttgttgaaagttagtaataaagaaagggtgaaaatgcatgacatggttcgtgatgtagccttgttgatggcatctgaaaggggtcaagcaatgttggcaagtactgcaatggatctaagaatgttggtagaggatgaaacactaaaagataagagagcaatatccttatgggatttgaaaaatggtcaacttcctaatgataatcaattgaattgtccaacactagaaattctcttgcttcattctccaaaggctggctttgaagtatctaatttgtgtcttgaaaggttgaaagttcttaaaatactgtcattcttaacatgtggctatacgtggaagttgcctcaatttagtccatcacagtacattttatcattgccacaatcaattgagtcattaaaaaatcttcaaactctgtgcttgagaggctataagctaggtgacatctcaattttggaaagtctacaagcactcgagattcttgacttgcgtggttcttatcttgaagaattgcctaatggaattgtagagttgaagaaattgaagcttttggatttgtacaattgttggattgagaaaaataatgcttacgaggttgtaggacgtttgcaactagaggaattgtattttcatttattctcgtataaagaagacattccacataatgtttctttctcaagattgcagaggtatgttattgtactagatcatagaccatattccttccacctaaagacagaaattatggaagagcatagaccatctagagctttgtacataaatggtttgaatgcatctactcaaaggtttatatcattaccaatcatggatctatttttaagagcagagtaccttcatttgaagcatctgaagggaggttacaaaaatcttatcccatccatggatcaacaaggcatgaatcagttgattgccttagtcctcgaatattctttagatatagaatacctctttgatagtactatgattaccaccaaagatgtttttttgtccaaacttgttactttaaggctaaatggcatgcatggccttcaagaagtgtttcatgaccagttttctctatgctctctggaaaatttacaagaactaatcatagaaaattgtgcacaattgtacagcatatcctttccaaggtactcaaatctatgcagtatcaaggtcttaagaatatacaattgcccagtcctaacttctctcttcatgccatccattgtcaaaactctagtgctgctggaggttctaaaaatatctgagtgccataaattgaagtacataatagaagaagtcaaagaagggactattaacagacaaaatcatgcatctatgacgctcccaaaattaagtatcattgatattgaaggatgtgaaaggttgaaatatatattgcctgtgtgttttctgggagagctagttagtttgcaaaggatgagcattcgaaaatgtagcgagttgatgtatgtatttggaaatgaaaaggagcatgatctttcagcgtaccaacaccagagtacataccattgcttgtatccaaatttgcttaatttggatactttcaagttggattccttaccaaatcttgttgacttttggcctgattactatcgtccgcgtttactaaatttgaaagagggtcgatgcactgagtgtcccggactgtccaattcagcgcgtaaggtggtgatttatttaaacttgcgccaagacataactgcaacggataaggtgggtaaagtctcctctcataggacacaacaggataccactataggcaagaccatcagacgtcttaagggaattttagatcgtgctgagatgacttcatcgactcaagaatcaattgctccttcttcatccaacaatgcctatgaggatatagctagagctcaacaacaagttgcagaagctcaaagggatgcatcaattgctcgacaagaaactactgttgtaagtcatctgcttgagcaaatgatggaaaagttggcagtaaatgagcagataggattacaaaagagggcccatgagcacgtgggactacagaggggaacccagcaagagccaggtgctgagagtaaggtttaa

SEQ ID NO: 83421 - DNA, 333 bp, Glycine max
  Peptide Sequence Number=SeqID_175106
atgatgacaaaggtgatgaaaaaaagctcaaagatcaaaggtgatgacaaaaagctcaaaggtcaatcaaagaatgagttcaaaatgttcaagatggaatcaagaacaattcaagactcaagaggaaaagttgaagaacacttcaagattcaagaggaaaagttgaagaacacttcaagattcaagaggaaagttgaattcaagaatcaagattcaaggatcaagcttcaagaatcaagatcaagattcaagattcaagaaccaagagaagacttaatcaagataactgtaatcgattacaatgttttggtaatcgattaccagtgcctttga

SEQ ID NO: 83422 - DNA, 228 bp, Glycine max
  Peptide Sequence Number=SeqID_175107
atgaaggaggctgaggaaggggttggacattcagtgttaagagaaattggagagaaatcaaggaaaagaagaagaaagaagagaaaaatgaggttgaagcgctaccgaattgcgaccataatcgacttctacatcgttcttcattcggatttggatacagtctatgcacccttaggggtcctctttgttgctttgcgcaccttcatctcattcttctaccttcaataa

SEQ ID NO: 83423 - DNA, 264 bp, Glycine max
  Peptide Sequence Number=SeqID_175108
atggatgattttagtgaggatgaggatcaacgttctttgatcatatcaatcaccaaaatgatgaccaaagcgatgaccagggtgttggcaaaccaacgacccaaacatttaccagtgtcatcgttggttgaggaggcgtacttcaagaccgcgcaactctttcctattaaaggtcgacaaactcgggcaatgatcaactctggctcactgtattctaaagttgtctctgaggcaatgaataatggtcaacaagaattaaaatga

SEQ ID NO: 83424 - DNA, 1126 bp, Glycine max
  Peptide Sequence Number=SeqID_175109
atggctttgaaagaatccatagataaaagtgccaaacaagtctcatccatagtgactagctatgataagtcacagtgcattttggaaaaggatgtgaaggatgatgtttttcttgacgaggaagatattgctgctgaagagaaggctactgaggaggaggctggcgaggaggagcaggatgatgagaatggagtctttgacggtgtaggaagcaggaccttggtgatcatgggttttacgagccgttggagaaccgaccagggaattattcgtcctaggttttggagagactcaccaagggtggactatgggtttgacgagcctgaaggattcaccaagggcggaccttgggttatgcgaaccctttggagaaatgacatgttttggagagactcaccaattgtagaccttaggtttgacgagcctataggactcaccaagggtggtccttgggttttgcaagccctttggagaaacaacctgcttcgcctcggactcgccacactaggtcgctgggttgaaaggttcatggttgaagctttgtattgtatcttcttactgctcagagcttgtctccttgttgacgattccccgactttagcagtgatcatggcgtttgtgccatgtgtgaatcgacatgtcgagtctagtgcacagggccctgaggatgactctgttggctgtctctgcctaaccgttggtctaaggatgtttgacagaggtgaagaggtgtttgacgcccaaccttgttacgaagtcttcataggtttgagatttgaattgtgtatcgttgtcaatgacaatggtgtacgagaggccatacttgcatatgaggtgtttccaggtgaatttctccaccttattggttgtaatttctcacaatggtcttgcctcgatccatttggtgaagtagttgatggtcagactgtggagattgtcaggataggtgcgtggaatatttgcaaactcttggcattgtctgcatctctttctgaaatcaagggtgttaaccctgagtgtcggccagtagtagttgatgtgcaccaccttggttgcaagggagctttccctggcgtcgggcttcattctcgtctaatggcaacaccccttgaattagcagattctt

SEQ ID NO: 83425 - DNA, 684 bp, Glycine max
  Peptide Sequence Number=SeqID_175110
atggaaggagtagcacctattgaggagaagaaaaaactcactgttgacattgatggctcattgggggattctgacggtctcaaagagtctggctcaaagaaaagagttaggtctgaatcatgtgctgcttctagctccaaggcatgtcgagagaagttgcgaagagataggcttaatgacaagtacactgtttacttccaaattccaactacctcccctctgaggcatgtaccttatatgatggatatgattaggtttgttgaattgggctccattttggagcctggaaggcctgccaaaacggacaagactgctatcctgattgatgctgtccgaatggtgacccaattaaggggtgaagcccagaagttgaaagacactaatcagggtcttcaagaaaagattaaagatttgaaggctgagaagaatgaacttcgcgatcagaaacagaggctcaaggcagagaaggagaagctggagcagcagctgaaatcattgaatggacagcctagtttcatgcctccccctgctgcaatccctgctgcatttgcggtgcaaggccaagcccacggcaacaagttggtaccttttattagctatccaggagttgcaatgtggcaattcatgccacctgctgcagtggatacctcacaggatcatgttctccgaccaccagttgcctaa

SEQ ID NO: 83426 - DNA, 669 bp, Glycine max
  Peptide Sequence Number=SeqID_175111
atggggccaatctacctggttgggatatccaaaataaaagtgagagtggttgaggaggctacaacaatatgcagagagattgaagaaattgttcaaaacatactaaaaattttgggtcccaaattttcaagtcttccaaatgatcatctagtttggatggaatcccgtgttgaagtattagtaaagcttttagaattggagttgtttaatgttgttcgagttgtcagaattagtgggatgtgcggaataggaaagacaactcttgattgtgctttatatgaaagaatctctcatcattatgatttttgttgttttattgatgatgtaaggaaaatttatcaagattccggtgcattgtgcattaggtgtacaaaacaattactttctcagtttctaaatgaagaaaatctagagatttgtaatgtttatgagggaacatgtttggtatggtctagcctacgaaatgcaagaacactcatagttattgatcatgttgataaagttggacaactgatgatgtttacagggagaagaaaaactctattgcgtgaatgcctaggtggagggagtagggtcaccccttggcaattgatcgaagtaatgggctcaacattgtttggtggaaatgtctcacagtggagaagtgcattggctagactaagaaaataa

SEQ ID NO: 83427 - DNA, 1194 bp, Glycine max
  Peptide Sequence Number=SeqID_175112
atggcacgacggtggtggacagttcctcgaatccggcaatggaagcatcgaacagcggaggcgtggcacaaacgaaacaccaatgaagacatttttgtcatttcacttaaactgcttggtgcactagcaattatactgggtgcacctagcaacaccctaaattttgccgctgtcgcaaccgcaccttcgtcttcttccttcttcatttctccttctctccgtgccaccattgttcatgccgcctgtcctgccactagtgacagctaccaagacagtcgtattcgtcttctccttcgccctcaatggcgaaggcccacaacattcacacgtaggcaacgagaagctacacttgttgtcgaggatgttcaccatatggattatgcagatgacgaggtccatgaacagcctgaagaagtagttgttgatgatgtggcgaccgatgccgagggattttcaggcggaccccacgacatatcagtgttgcaagactatgtttatgatgtggtcgtgaaaatcgaaggcttagtggctgccataggattaagtcctctgattacatgtttgttgaacactagtgattggggacttatgtctgctttcatggagaggcaacataaggaaaccaatagtttccatctgtcgataggagagaggcaagagttgagacagtataatgtcatggggcacgtgttcgactatcctggctgcaagacgtatattggagcaaatgtgatgcaacacaggctttacaatggatggggtataagaactgatgagagaaaaggggtgaaagaaagaaaaggaagaaatggtggaaagggagaagagaattccctaaggaagagttctcaaactctaggcccgcttagcgcgtccttcctcgctcagcacagactggattacgcgcttagcgagctcctctcgcttacgcctgttgcgcgcttagcgtgggtgtctccaatcgcgcttagcgcgagctgggcactgagcgagacgttggactgggccttgttgctgagtggaagctacgcatggggagctgctacactggtgcatatgtatgacaatttgaatgatgcgtcaaagagcacgccagacaacttgcaggatatatcacacttttacattgttggatctataagcactttccatctattggttcttatgttgttgttgaggtttatgatgtcctag

SEQ ID NO: 83428 - DNA, 567 bp, Glycine max
  Peptide Sequence Number=SeqID_175113
atgcctccattctaccatgaacagtgggcaccgcattaccccgaatttgcccgttttgactatgatggagcctcataccagatacgacttagacaatatcgaggaaaattgttctttactgttggcctcaaacaattgaggaaccacttaaatatctacgagttagtaaccatcaattttatggcttgtgaacacaaatggattttcaacctccatttcactcctctaatggaacaacaagcatgcagcagacccctacccgcatttagaatgcatgtctggactattgaactcactcaagccctgcttggtgatcctgaaccattgagacttccacctattgcagcaatacaccttccttcttgcggtttccatatgaccattttaagaaagttcggccctccattacaatggcctatcgtcccggttagccctagctttcatggcaagtatgttgcgcaaccatggtaccggtttcttgctgaagatgattttgttcatggagacgagcttttattctactacagacctcgtgaggatatttgggaaatggttattaggaaatag

SEQ ID NO: 83429 - DNA, 192 bp, Glycine max
  Peptide Sequence Number=SeqID_175114
atggcgatattagccactgtcacgagaagtttcgtcttttggctaggaaccattgtggatggtgacgaaactgcaacggcgacaatgacaaagatctgttattgtggtgctgctgctgctggtgttcgttcttgtttcagctttaaaggggaacattggggttttgtggaggagcatttgggttcctattga

SEQ ID NO: 83430 - DNA, 3588 bp, Glycine max
  Peptide Sequence Number=SeqID_175115
atggcaaagttgtcctttaaaatgaacatgaccaaatttgagaagttcctctctttctccttcctcttcctccgtgaccacctcctctctcgtgccgccgccttcaacaactcctgcatcctctgcgtcttcgtcggcactgatttgcggtgggcccccactccgccaccatcgtgggcttctgccaccgcaaccatctttcgccacactgtgctcgccaaacccaccaatatcgtaggtttcagtcagggattactgtccctcactgtgcaacttgcgaccttatctccgaaactcggtaaccttttgtcttattgcttggtttctcactctttcgacaaagaacgacttcgcaaaccaagtccactcattctcggcagctatgatgaccccggcgagcgtgttgagtttgtttacatctccatgctctggaatccaaaacattcttatttctactgcgtcggactcaccgaaatctctgtcgggaagaggactattccgacgccagagatgctgcggagggtggaccgcagaggcgacgacgacgtggttgttgatagcgaaaccactttcacgatgctgccggagagtctatataacttggtggtggctgagttcagccggcgagtcgggcgagttcacaagcgtgcgagtgagattgcagatggaatgactatacaaattgatactgttaatctattacttgaaactcgtggaagtgctagtcgccaagggggagcaacatggacaccacctatggcatctatcaccatacacaaccttttactgtataccacaaatgaaagctgggaggttgtgaatcttaaagaggcacgggaattctccagtaataagaagtatatatacgtcttcaaaaaactagaatgggaatctttgtctattgatcttttgcctcatcctgacatgttcacggatgctactttaggccgctctcaagagggagcaaacctgagagacgaggatggtgcaaagcgggtattgtttggaggtgagcgttttatagaaggaatatcaggagaagcatatataacgatacagagaactgaattgaacagtccatttgggcttgaggttcagttacatgtcacagaagctgtttgccccgctttaagtgaaccaggactgcgtgcgcttctccgctttataacaggattatatgtctgtctaaataggggaaatgtggatttcaaggctcagcagcgatcaactgaagctgctgggcgttctcttgtctcaattgttgtggaccacatatttctttgcattaaagacgctgctagaagtttttgccctccaatatatcctctaggagaacagcaatggctatcaattgtgggaactcctctgatatgcctccattccattcagatcgtgccgtctccacttccaccatcctttgcttctcaaactgttattgattgtcaacctcttatggaagaatcctgcctgacgatatcatcattcttagctgatggtattgttgtcaatcctggtgacattttaccagatttctcagtaaaatcttttattttcactctcaaggggctggatctaacagttcccttggataagacccaactggataattctgaaaccaatatggacaataaaatcaagacttcctttgctggagcaaggcttcaaattgaaaatcttttctttttagattcaccctcattgaaactgaaaatactgaacctcgagaaggatcctgcttgcttctgtctttgggaggatcaacctattgatgctagtcagaagaagtggactgctggagtatcccagcttactttatctctggaagcaagtactggcaagcttggtcatcagaattctcttggatggactgctggattgtggaggtgtgttaatctaagagatgctagcatagaagtagctatggtaactgctgatggaaatccattgttaaaggttcctcctccagggggtattgtgagggttggtattgcttgtgaacagtatctatccaacacttcagttgaacagttattttttgtcctggatctctatgcttattttgggagagttagtgagaaaatagaaatagctggaaaaaagaaacaattgaaggatgtcaggaacaaatcttttagtggaaagctgatggacaagataccaagtgacacatctgtaactttgacattaaaaaatctccaacttcaatttcttgagccatcttctgtgaatgctgagggaatgcctctagcacagtttgtcggagatgatctgtcttttagtgccactcacagaaccctaggtggtgctattgttgtttcatccactttaaattgggagagagttgtgatagattgtgtggattccaaggagcccttggcatgtgaaaaggactcatattttagtaccggagaaaatgttccctcaataagtgatgtaggatacccaaaactaagacctgttttctgggtgcataacaaaaaagaactattgaatggaaatgctcattcatacccatttctggacataagtgtggtgcatgtcgtaccattttgtatagtagacatggagtcacatactttgaatgtctcagctgttgtatctggtgttcgtcttggcgggggagtgaactactttgaggccctcctgcatcgatttggaatactagggcctgatggtggtccagggaagtgtctgtctaaagggttggaaaacttacaaactggaccattggcaaaactttttaaggcaacacctctgatttctgataattcagaaaatggagaagggagagataccagttttccaaacttgaagaacccagatattgtggatgtaactatagagttgaaagactggttatttgctctcgaaggtgctcaagagatggctgaaagatggtggttctcagtccatgaagatgtaaaaagagaagagagacagaaaatcacaatcacgcagaatacaaccatatccggtggaactggttacggtaaagacacccatccttctttcttcaagtttgatgcagtgtccctctctgtggtggcgccggagaaaggggctgcgcatggcggtgctaaatggccgcaatcctttggtagcaatggaaatagagaggctaagattgggacttctgataccaacttggaagataaagaacttaatatttcagttggagttcaagggctgcagatcatgaagccccacacccaaaaggacattcctatgtcactgataactgtaaacggagttaaagaattcactgaaaaaattgggggaactgatcttgaagtaagcttgatactatctgaggataatgaacatgaattggttaattgggaagtcgaaaacctaaagttttttataaggcaaccggttgtgtgtgatgaagattttaccatacagaatgaggcagttgtaaccaaggaagaggtccaacacctcacttttctgtgcaaatctgaaattgattctgctggccggataacagctggagttctacggctatttaagctagaaggctctgttggccagtctgcaattgatcagcttggcaacctaggtatgctgccaaattttcttatgtaa

SEQ ID NO: 83431 - DNA, 463 bp, Glycine max
  Peptide Sequence Number=SeqID_175116
ttaccggaaggcgggggaggaagttggaaaatggaacagcgttggagtcaccggaaccgtgccggagaggttcttgtcagagacttcaaagaattttagcaaggactggttaaaaagagggattgaactgttaaaagagttgaagcttaaacggaggctgtggaagcagtctagggaggtgaacgcggtggagataggtccagagaagttgttgtggaagaaatccaatgaagtagttgttatcgaggaagaggcttttgagattgaagagaccgttgagaatgagacggatcactttgaggccattgcattccacgccttgccacgcgcagaagcggaggccgcgcgtgaggggcaagaagttaagttggtcttcgacattggtggcggtggtggacgcatcttctcaagaagacattgggaaaaagagagcgacattggaaagaggagaagagcgaagtga

SEQ ID NO: 83432 - DNA, 501 bp, Glycine max
  Peptide Sequence Number=SeqID_175117
atggagagggaaaaaagttgctaccaacaagaaacaaacacaatcttgcttgattccatggtggcgagaaccgacaaaaacatgggtggtgaaggaagaaagagaagggtgcgacaggatattgggaatctcgtgactaaacaaggccatggaaatggaattaacgaactttcgtgctcaactattggccaatgcacaagccgcaacataaaagaacaagttgttatccagaaaccaagcactgaagtgaacaatggagcagtgttggcaactgatggggttgatgtagatattaatgccaagatgaggtcaatccttgtggactggttgatagaagtgcataggaagtttgagctcatgccagaaactctttatttgatcttgaacaatgtatgtttgcagtctactaacacgtttgatgttatcaaagagagcattacagggtcaatggctgcttcaggatccgtggctgtagaacttgcagagaagctcaagatttaa

SEQ ID NO: 83433 - DNA, 237 bp, Glycine max
  Peptide Sequence Number=SeqID_175118
atgcctgcccttttgcgggtgtgcgaggcaaggctcacgggtgcgctttccaaaggagaaaaatgcgcggagtcgccaccaacatttatttgtggaaaacgtcggaaaaaccgaaggaaatcggtcataaaaaatattccaagttcgggagttgtatttacgtttgaggaaggtcgacaaaagccgggctcttgctcctacgcaccttccatcgaagaggaaatcagacctacgtag

SEQ ID NO: 83434 - DNA, 296 bp, Glycine max
  Peptide Sequence Number=SeqID_175119
gggagaagcttgccacccagctcgcccaggcgagctatgttgcttcctccagaagcaaccgccttctggaggaatattctggaaggcccaagtgggcctgcatgtcacaaaacatcacgaattgcctaacgatgggtgccaagtacctcgaagtggtcaaacgagagttgcatcccaacaacggatggtccccggacgaaattaggggcgcagaatttgtctctgcgtgtttacccacccagggcgcagaatctatctctgcgcgtttatccactgaggttgttgttcctgaatga

SEQ ID NO: 83435 - DNA, 477 bp, Glycine max
  Peptide Sequence Number=SeqID_175120
atgggtgccaagtacctcgaagtggtcaaacgagggtcgcatcccaacaacggatggtccccggatgaaattaggattagtccttacactggggctatcctcttgaaatgtaagccatcccgcatcaatcaaactttgtactttatgcttaaaggctacacattgctcgacggagtgccccaggacgccaccatgataggcacatgtggtgatggtagcaggtcggcatacgacattgggattggggtgaactctgtgggttttctctttgggaagttcctccttaggttggtgtttgtattggagttgggatttgcacttggtctaggctgtggagtattgatacatggggttgtgaggggtttgtggggagcttggccatgtgggtgctgcggtcatgacgagggcatctccctcttttttctttgctccacctgccccaagcctcctattgccagaacttgtagaagcagcatg

SEQ ID NO: 83436 - DNA, 747 bp, Glycine max
  Peptide Sequence Number=SeqID_175121
atgagaggtgcaccatcggaggaaaccattgcgcctttcattgcgcgaggcggttatcacaaacggttgaaatctagaacgcaagggataacttggctccaaaagttgaagtgtctgaatggggaagaggaaaaagtgcatgaggagagtgaagaggtgcaagctttgaaagctaagctcgaaaagacaagagtaatgaaggagaagctgagggtggcagtcactagagttaggaaaaaatgtgatgagctgaaagatatcaacatgaccgcggctgaagcgctacaacaggaaacgaaaaaagccagaaaggaagagtggagcaggaacaagttacgaggggctttgttaggcaacaataatgagctcaaacttagaatggccgagagggacaaatcaaggatggagagcatgacgttagaggataagttaaagaattatcaaaggtcgaagagaggtttgaaagagcagttgagcaagacagaagaaaatatgttcataatcattgatcaatataaagagaaggtaaacctagctgctagccacaggcagatgctagaagatgaacatgaaaagttgtcggccttgcgggttgaaagggaagcaagagaaggggtgatagagatattgcataaaaaagccatgaaatggatggatagatttactctcactctcaatgagagtcaagagcttccaaggttgtttgccaaagccaaggtggtggccgacacatgctcctcccaatga

SEQ ID NO: 83437 - DNA, 288 bp, Glycine max
  Peptide Sequence Number=SeqID_175122
atggcaagcagaaatgaaaacgtctctaccgtagccgattgtgatgagggagttgagtttaagggaaaaaacaatgctgttaccatcagtgacgataaggatattgatggcatgtttgatatctataatcgacatcaatgcttaagtggctttcagttgctcgtacaatacgaacaacaactttcttctaccgccaatgtcgaaacaatcgttcaatcacaacaaattcatgaaacaccatacaccgactaccatactcaaacttaccatcaaggtccatcctcttaa

SEQ ID NO: 83438 - DNA, 1569 bp, Glycine max
  Peptide Sequence Number=SeqID_175123
atgaagttgtttgtcaaccagcctaaatttcacaggggaggtggcagggcagctaagccatctacagaccttcttaacagaccaaaaatcagcctcagggtgccagctggatcagaacagaagtcacaccaagtcccaacgtctacaagactgaaatcatttgtggaggtcgtgaaacagagtaacgatgaaacgaatggcagccttcactcaattcctgggaaggggttaagagtagacaacgatgaacccataagcattcagacgtcgctggagaaactcaaatggcttgacaatgtgtgggtcgggggtttaaagaataagggtatgtttgatagggtagacatggaggttcagggggcgtttggattggagttgaaaactgcgtattggggagacgacaagattataatctacgacatggatggtgatacagctaatcagctcatccatgacgaacaacaacacggagggacccctttttattcttttcagaggtggacgccggcgatggagccttcccaccgtctgacgtgggtatgcatttggggagtgccattaacggcatgggacgcggagaattttgcacgctttgtatcggcttatggtgacttggttgaacttgacgccatgacggaggaaaggtcacgggtggacatagcgagggtcctaatccacacagagcacaaaccggtcatagacggcaccgtagcgatcgtcgtagatggaacccacttcctcttgaagctaagagaggagtttgggtgtcaaagggggaatcgttcgtggatggagaggttggaacggctactgccctcaccattctctacggaagtggcggggtcagacgacaaaggtcacatgcacggagtgcgaaacttcacctccgcccttgagggactgacacctggaatcgggggccagcacggagaacctacctctcctcgccctagtcagcagcagcaactacttagggaagaagacgttggagataaagccaaaggtgcttcagaccacgtgtgggcaaaaggaggtgatcccctggataataacctcgaggctttacttggagtcaaacttgggtcaaatgaaggggactctgcaatgtgcatgggaaataaatcttctcatattttgggcctaggaggtattggcccaaatactaccagaagcaaaacaacctcacctctcaaggtctatgttagaaaaaaggcagttactccagcaattcacatgggccgtgcaattaatagccctgatcaacacgggattcaggctgattctcgaaagctggacatagatgaaaatgggaggcacactcaatctccagcagcacagggaacgagtcttgagaagcctcgcttggctcatagccctatatccagtaatagcttcaaaaaaggcctctgtgaaaatgaggaggcacttcaaagggacattattagagacctgggactctcctttgctgagataaacacctgcaaagaccacattatggctgatggaactcacagtagcatcatctctacaccaacaggagtgatgggtaaaaaacctattgaaccatga

SEQ ID NO: 83439 - DNA, 423 bp, Glycine max
  Peptide Sequence Number=SeqID_175124
atgataaacttgtggctaagcgagtgctatttcgctaagccaaggccaagcgagccatgctcgttaagccaattagtgtccagtagtcaagtcgcactaagcgagcactactcgtcattggaagcctggaacagatacatagataacattctcagttggaatatccttccggagagaaatgttcaattatatcatactgagtttgaggagttcaaagtagaattggagaggcgtaatctacacaaacacctcaccaacctccaggagggaagcattgatgtggcggttgtcaaagaattttatgccaacctatacaaccctggggatcagttgatgatgaatgacagcggaatggagaaggaagagagagaggagacgccacttcaaggagaagatgagtctagaagaagctcaccaccatag

SEQ ID NO: 83440 - DNA, 633 bp, Glycine max
  Peptide Sequence Number=SeqID_175125
atggttagaattaaaggattgtgtcggactttaggcaagctgacaaaggttcatgagttgcctcgggagctagttactgatgatgtatgtgctgatacgcagggcttttcaggcgggtttcacgatacattagttttgacgaattatgattatcatgtgacatccacaatatgggtaggagagtgttggatctacgagcattttcctactattgcttcatgtgttgctgatgaagactatgatgagaggaaaccacatgcttgtcgatggaagtttgggaaggcattactgtgtgcagtagactacatagcgtggttctatatgatatctcaccccttcatgagtccgacacagcctggggatccttctagacatcccctcgtggtgcacgatgacacatttattgtagtagatcctcctcagcaacccgtcaacgcagcagttatgccaaaaccacctaaacctatacttgcacttgccgatgtagacatgcctcgacatgcagtggacgcttgccaacggatagcaaaaaggttggaacacttaatcaacatgaggatggttacttccggaactaaagcatacactctgattgaggagtgcctaagaatcgccagggatgtcactgagtaa

SEQ ID NO: 83441 - DNA, 328 bp, Glycine max
  Peptide Sequence Number=SeqID_175126
tagagggtacatctacttgggttgtaatactgagaacaagatagggtacatctcttgtggatcagttcaagtggagggtacatccacttggttgttcaaagagaacaagggagggattttacaaggttattgtaaatctcaagaactggtggttgcttggggactggatgtaggcacggtcttctcgctcaaccttgaggatgcaaccagtgtgcttagcgagttaacactcgctcagcacttctgtacagctcatccttcttccagagtcttctatgcgcttagccaacggatgtcgcgcttagcggatggctccctcagcgcgtga

SEQ ID NO: 83442 - DNA, 177 bp, Glycine max
  Peptide Sequence Number=SeqID_175127
atggtacagcttaaacctctggccattcactacccaagttctatatggagtcttggattgaggatgacacagctctactgctccatatggtctgacttccttgatgccttgaggattcatatgcagtcagtctcatttcttccaactccaagagctgtagctttcttcgctctctag

SEQ ID NO: 83443 - DNA, 990 bp, Glycine max
  Peptide Sequence Number=SeqID_175128
atggataggcacattgatgtggccctggtcaaggagttttactcaaacctatatgatccagaagataaatcaccaaaacaggttcgagtccgagggcggctgattaagtttgatgcggcatcactgaatgcctttctggagacgccaccggtcattcagccaggggagcagtacctctcatattctattttttgcaagtcacacacagatcctcaggagcttgcctccaagctttgtattccagggcgaggatttgttcttaatgctgaaggagcaccctggaagctcctgaggaaggatctgatgaccttggcccagacttggagtgtgttatcatactccaacctcgcccccacctctcacacgtctgatcttaatatggacagggcgaggttagtctatgggttggttatgaagatggacatggacttgggcttcctcatttcgcaccagatctcacagatggcccagtccaactcctctaggcttggaacccgcgaggcacgggctagaggatctgagggtccatcttcggatgctcctcctgctcttgcttcctctgcacctgctccttctcggctccaaccccttctacttcagcaccaccacttcctcctactcattctcattcaccagctccctctgctccatcatcatcattctagtgccaatgctctgtggtcaccattcctatgttgcagagcatccactgtggcttatgcctgcatggatgagttcatggcacaggtggcctggccaagagtccagccttctcctttggggggaggtgaggcttccgcagcccaggagcatcagccaaagccagaggttgctcatgaggccactccagaggcgactccacaggtttcacatgctacttcacctatcgtcgaggagacaccacagccagcccaggatgcccattcttcacctcatggagagcctgcaccagctcaggacgagcccactgctactcaggatgattggtga

SEQ ID NO: 83444 - DNA, 1122 bp, Glycine max
  Peptide Sequence Number=SeqID_175129
atggcatctaagaagaggaaagctccttctacacctacccagggcagatttgataggtctagattcacatccctagaggcttgggagagatacactgacattgtggtgcctcgaaagctactaccagagtggaatgtggtagtttattacatagagtttgatgagttcaaggaggaactcgagagaaaacattgggatgagaagctgactgattttttttacagtagcatagacatcgctattgtgaaggagttttacgccaacctctatgaccccgaggataaatcacctaagcaagtgagggtgagaggtcacttagtgaaatttgatgaagatactcttaatatatttctgaagacccctgtagtgttggaggagggggagaacttgtgtacatattccagatttgcactcctgaggcctgatcctcaggagttggctgttaagctttgtatcccaaggaggggattcgagcttaatgctaatgggcaacctttaaagattttgaggaagaacattacctctctagctcagacatggagcatggacatgaatttggggtacctcatctcccaccagatctctttgattgcacaacatgatacatccagacttggattccctgccttgatcacaactctatgcaaggccagaggagtccagtcagattctagatccttggagaacttgagccctgccattaacttggcatatattaagaagaactgttggaatcttgatgatccaatagtgacatttagagggccaaggaaggctaggggtaagaggtcagaggccctcactacttcagcaccaccagagacaccagctccttcttcttccatagctccattacctcccactcagactccaattattcctcctacatctacacaaataccatttccaattcctatatctgaaggaccatcagattttatatttacaccaaagatcatggatgagttttatgcgcaggtggcttggctaggagcccagccttctccttctggagggggtggggcctccgcagcccaggagcctgttcctgaggagccagtagcagcagcagagggggaagatgagctcacccctcaagaggaggagacttctatagactag

SEQ ID NO: 83445 - DNA, 342 bp, Glycine max
  Peptide Sequence Number=SeqID_175130
atggagagagcacatctacattatagcaagatattcatttgtccattatgcttcggggatgataacaagtatatttgtagaagcaaacttcatgatgaatcaagattgattcaaagaagttttgatgatgacaaaggtgatgacaaaaagcttaaagatcaagaacacttcatgataacaaagatgatgatctcaaagaatcaagattcaaggttcaagctttcaagaatcaagaatcaagattcaaggttcaagtttcaagaatcaagattcaaggttcaagttccaagaatcaagatcaagattcaagactcaagattcaagaatcaagagaagacttaa

SEQ ID NO: 83446 - DNA, 138 bp, Glycine max
  Peptide Sequence Number=SeqID_175131
atgaggcaaaagaaagttgttgttacgtataaaagcgaccaaggcgttcaaggggctcaagaggaggagcatagaagggatcgacccaagcgcaagagtattcctctagcatacttgaaggattacatacgctattag

SEQ ID NO: 83447 - DNA, 276 bp, Glycine max
  Peptide Sequence Number=SeqID_175132
atgtttgatgtagtgttggagattgatttcaggttggatgaagaaggacttactgaagacttgtgtcgcaacatacccttttgcgggcgagcgaggcgaggctcacgggtcgacaaaagcggggctcttgctcctacgtaccctccatcgaagaggaaatcatacctacgtagttcttttttaagggtgaatcaagcgattctctttacttggaaggtgaacattttaaggcgttggaccttaaaaatgatccatttacttggtaagaaaaactga

SEQ ID NO: 83448 - DNA, 102 bp, Glycine max
  Peptide Sequence Number=SeqID_175133
atgaagaaggtgaaaccgacaatgaagggtgttagggttgttgacattggtttttattttgttccgatgaggaaggtgaagctgacgacaaaagtgcgttga

SEQ ID NO: 83449 - DNA, 168 bp, Glycine max
  Peptide Sequence Number=SeqID_175134
atggttgatcagaccaagagcatacaaaatctgaagacaactgctgcacttagcgcactgatctcgcgcttagcgcgcgagcttgatattgatgctctgccagattcttctgtggcgctaagcgcgctgaagttgcgcttagcggtggatgcgcacttagcccactga

SEQ ID NO: 83450 - DNA, 390 bp, Glycine max
  Peptide Sequence Number=SeqID_175135
atgcaacaggaacaggcagatatcctcatagccaggtttcctgaccctagctatggtgttaaaatgggtttcgttttctaccgaaaccgcgagccaagttggaagattccgcttcggtcgaagggttcctctcagtgtggggttgcaacggagaacaacggtagtttgtggtggctaatagtggctatgggtgagggagaaagttcttgggacgttagaaatggctttggaagaaagaaagaagaagaaatggtatttttcctaagctacacgaaagcaaaggctgaaaacgctcaagtgagaaatggtctcggacacggaaatgtcgcgcacactccagacatcttctcgaagatcccaacggtcagatcatggaaaattgtcttgtga

SEQ ID NO: 83451 - DNA, 508 bp, Glycine max
  Peptide Sequence Number=SeqID_175136
agggctacacgtcctcgccttcagaggactacacgtcctcgccttcagaggactacacgtcctcgccatcagagggctgcatgccctcaccttcagaggactacacgtcctcaccttcaaaggactacacgtcctcaccttcagagggctacatgccctcaccttcggtggaccacacgtcctcaccttcagagggctacacaccctctcctttagagggcttcacgccctcgccttcagaggactacacgtcctagccatcagagggctacccgccctcgcctttagaggacaacacgtcctcctcttcagaggactacacgtcctcacctttagaggactggacgtcatcaccttcagagggctacacgccctcgccttcagagggctacacgccctcgccttcagaggactacacgtcctcaccttcagagggctacacgcgctcgccttcagaggactacacgccctcgccttcagagggctacacgccctcgccttcagatga

SEQ ID NO: 83452 - DNA, 489 bp, Glycine max
  Peptide Sequence Number=SeqID_175137
atgacaaacttgtggctaagcgagtgctatctcgctaagcctagtgttgctcgtgctaagcactgctcttctgggctaagcgctattcgttgcggcatgcataaggctaagccagcgctgctcgctaagccattgttcgaaataaaaatggcatccaggaagaggaagagcactacttctaggcttgtagctcaatacactgacaacattctcgactggaatatcctttcggagagaaatgtgaagctttatcatactgagtttgacgagtttaaggtggagttggagaggcgtaatctgcacaaatgcctcgccaatctccagaatggaagcatagacgtggctctagttaaggaattttatgctcgtttatacaccatagaggaacaagctccaaagcaagcccctaatgataatgagattacaaaacctggtatctctacaaaagctgctcctcttgctgcctctaaagctctttccccgaaatag

SEQ ID NO: 83453 - DNA, 610 bp, Glycine max
  Peptide Sequence Number=SeqID_175138
gtgctccagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttatgcgccgctacagggcgcgtcccattcgccattcaggctgcgcaactgttgggaagggcgatcgggttttcccagtcacgacgttgtaaaacgacggccagtgaattgtaatacgactcactatagggcgaattggagctccaccgcggtggcggccgctctagaactagtggatcccccgggctgcaggaattcgatacattatgtgcaaccagcaaaagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcagagaaaaaaggctgcaccg

SEQ ID NO: 83454 - DNA, 249 bp, Glycine max
  Peptide Sequence Number=SeqID_175139
atggtgctagaactttattcagagatgttttttgctggtatcgacccagatttagacgctcaagtagaatttggagcattccaaaaacttggagatccaactacaaaaaaacagggttgcccaaaggcaatatataaggcatacccagtaaaacttacaagtaaaccagatatagagatggcaattagggttgctgtttccattattagaattctaaagtttcaagatcacaatagatctataggataa

SEQ ID NO: 83455 - DNA, 378 bp, Glycine max
  Peptide Sequence Number=SeqID_175140
atgtacatcatgtatggcccaaaatatatcatgaagcatagccaacaaaacacgatatccaaggaaacaaaaccccccaccacacttattcccaaaaaaattccaaagctccaaaattccttaagggtaaggttatatcatggtttttcacttaaggcttgtagtgagcttcaaaacaaggaaagggaaacaaggctcaaaagggctatcaaaggaattaattcaaggaagcatcaacaagaatcaagccaaggctattgtgcaagcaatcaatggggcaaaacacaccaaatgattaagatgatggatggctcaaattctcacaaaggtaaacttatcactttcaaattgagctttcaaaactatcatgacatgtag

SEQ ID NO: 83456 - DNA, 63 bp, Glycine max
  Peptide Sequence Number=SeqID_175141
atggagcttgcatcaattgtcgattggacaacctacacattcttctcgttttgcaggtcacag

SEQ ID NO: 83457 - DNA, 588 bp, Glycine max
  Peptide Sequence Number=SeqID_175142
atgggctggcggcgcctacctgatctggctcggcatccagctgtggcgctcgcccggcgtgcaactgcgcccggcgcccgacatgccgcggctgcgcggcacgcgcatgttcagccaggggttcctgtcggcgatttccaaccccaaggcgctgctgttctatggcgcgttcctgccgcagttcatcgatccggcgcgcagcctgttcacgcagttcgtgatcatggccgccaccttcgcggtcatcgagttcctggtggaatacgtgctggcccgcctggcgcaccgcgtgcggccttggctggagcgcgccggccggcgcttcaacaaggtgtgcgggggattgttcgcggcgatgggagtggcgttgccggggtcttgaacgtcgcccgtcaatgccaacgccacaatgcaaaagcccgactccaaggagccgggctttttaattctggtggcctggggcggaatcgaaccaccgacacgcggattttcaatccgctgctctaccaactgagctaccaggccaacgaagtccgcaactatacacaattttttggacttgtgccagccgcctcgaaaaaagtgtga

SEQ ID NO: 83458 - DNA, 240 bp, Glycine max
  Peptide Sequence Number=SeqID_175143
atggccgaagaatttgtgaatgactttgttcatcaaaatggcatcactgtcataatccacaatccccccaaaggtgatggggagaaaaagaccaaaatttggataatattagttgttgtggtggggctaatatgccttggaatccatatatttctggtatggaggtttaagagaaaacctaaagaaagtaaaggggggagaagatcgcagtggctatggcatggagctgaaggaggttga

SEQ ID NO: 83459 - DNA, 510 bp, Glycine max
  Peptide Sequence Number=SeqID_175144
atgaattcggttataacagtgttgtatttcaatggaagagtatatgaagacaatgatggtgtaatatttgaaggcagtaaaaaagcgattcagattaaacgtggaattagtttcaatgctttgaagaaaaaaattggagataaggaaaatatattgccttgcaaatttgtgatgacgaagacgttgaaacgatgctggaaagttttaaacaacaagaccaaatacgatgatgatgatgattattttgtgtctaattcatacgttgaagagtctttagacgaagatgacaatgttgacagtatatctgataccgacgatgaagtcaccaacattcctcaaccagtgcacaacgaattgaaaatccattttagaatgatgctttgcattataacaatatcaactggagttatcctgatgaggaggacatttacggtttggagataccgtcgacctttaatattggccaagaattatatgttggcatggaatttgatagtaaagatgcagtaa

SEQ ID NO: 83460 - DNA, 300 bp, Glycine max
  Peptide Sequence Number=SeqID_175145
atggtttcctatggtggtgagcttcttcttgactcatcttctcgtaaaagtggtgtctccaatcatctttcttccttcttcattccgctgccattaatcttcaagaagcaaaggactccattgatgaagatgatccaaggcctacaagctccatatggagcttcatcaccctttctctccactcatcttctcctaccttcaagctcttatccatggcctcctatcgtggaactaaatagcagccttgggattcgtgcaaggcattctgttatgccattcattattcagagctttgtttag

SEQ ID NO: 83461 - DNA, 732 bp, Glycine max
  Peptide Sequence Number=SeqID_175146
atggcgcttttgctacgcgtctggatgcagtgggcccgctgtgatttttacaacccgttctcgcagtttgtcgtgaaaatcacgcaacctgttgtcggaccgctgcgccgtattatcccggcaatgggtcccatcgacagcgcgtctttgctggtggcgtttattctgagcgttatcaaagcaatcgtgctgtttatggtcattaccttccagccgatcatctggattgcagccgtcctgatcctgattaaaaccatcggtctgctgatcttctgggtgctgctggtgatggccatcatgagctgggtcagccagggtcgtagcccggtggagtacgccttgattcagctggccgagccgctgctgcgtccgatccgtaacctgcttccgtctatgggcgtccacgggcgatatgctgctgccggggctgtggatggcgctatgagtgcagtaagcacctgcgctgacgggctggttttacggctgtatattcagccgaaagccagccgtgacactattgttggactgcatggcgacgagttaaaagtcgccatcactgccccgcccgttgacggccaggcgaacgcgcatctgaccaaatatctcgcaaaacagttccgcgtcgcgaaaagccaggtgcttatcgaaaaaggcgaactgggccgtcacaaacaggtaaaaatcattcacccgcagcagatcccgcccgccgtcgcggcgctggctgactaa

SEQ ID NO: 83462 - DNA, 291 bp, Glycine max
  Peptide Sequence Number=SeqID_175147
atgaaatcaatgatggaatttttggtagacatttgcagatcatggcctaccacatcggcacgtaggcaacagggtgctgtccctgttgccgaggatgaccctgtggtagctgctgatgagcttatggtagttgcagacgctggtgcagacgttcatccatctggtgcagacgtacatccacctggtgcagacaccggtgcagaggctgctgcagatgagcctgaaggatttccaggtggaccgaccaacccatcagtgtttatcgagtatgctgagcatgttgcagccagc

SEQ ID NO: 83463 - DNA, 186 bp, Glycine max
  Peptide Sequence Number=SeqID_175148
atgggtgttaagtacctcgaggcggtcaagcgaaggttgtatgccaccaaacaatggtccccaaacgaaattaggattgactatccttttgaaagaggtggtaattcatgcaactttatcctatcttttgcaaatctctttgggaactccctcagagtgtatgttctgtttgatttagtcacttga

SEQ ID NO: 83464 - DNA, 514 bp, Glycine max
  Peptide Sequence Number=SeqID_175149
aattattccacgtgctccagataacatcaagtctattaatggatcaaaagagacacctaaaattgccataagaattactgatctttggtttgttgggactcccaacaggtctgaacaagcaaaaatggtcataattgattctcatggagatgcaatccatgttgtctgcaaacaagatcaactaaagtcttggaaggctgatttgatggaaaattgtacttatgtaatgcataattttaaagtcatgaagaatgatgacattattggtgttgtggatgaagtggtcttccaccatgtggggtcaaagagtacaagggttgttttcaaactcaaggatttgtgggcctccaaattattgatcaatgaagctgtgtttgaaattcaagaattcagggagaggtttgttggccatggccttggtcctgtttcaggttcaagccaattgtcgtcaaaggatgcatttctttcaaaagctgaagcaaagacaatctctaagattaacaacatttctgag

SEQ ID NO: 83465 - DNA, 606 bp, Glycine max
  Peptide Sequence Number=SeqID_175150
atggccccgacgaagcttgcctcaaagagatccaggaaggataaagcggctgaaggaaccagttccactcctgaatatgacagccaccgttataggagcgctgagcaccagcagcgctttgaggccatcaagggatggtcatttctccgggagcgacgcgtccagctcagggacgacgagtataccgacttccaggaggaggtagttcgctggcggtgggcatcactggttacccccatggccaagttcaacccagacatagtcctcgaattttatgccaatgcttggcctacagaggagggcgtgcgagatctgcgatcctgggtgaggggtcagtggatcccgttcgatgcggatgctctcagccagttcctgggataccctttagtgctggaggagggccaggaatgcgagtatggccagaggaggaaccggtctgatgggtttgatgaggaggccatcgcccagttgctatgtataccggggcaggattttgcccggactgctgctggaagacggggtgcggatcatgcgcaccaacatgaccagcctgactcagatctggatgactttgctgctcagcaacatccagcccagcgatcataa

SEQ ID NO: 83466 - DNA, 531 bp, Glycine max
  Peptide Sequence Number=SeqID_175151
atggcgaaagatctgctgccgtttatgagcagcagcgccgagccattcagcatggaaaaagtgctgcgcccggtcgtggtggtgcctgagagcaagcgcgtcgatcgcatgctcaaagagttccgctcgcagcgctatcatatggcgatcgtcattgatgagttcggtggtgtctccggactggtgaccatcgaagatatcctggagctgatcgtcggcgaaattgaagacgaatatgacgacgaagaagatcgcgatatccgccagctcaatcgccacacctatacggtgcgtgcgctgacgccgattgaggatttcaatgaggtatttggtagcgatttcagcgatgacgaagtcgataccattggcggtctggtgatgcagggattcggccatctgccggcgcgcggtgaaagcatcgacattgagggttaccaattcaaagttgcgatggctgacagccgccgtatcatccaggtgcatgtgaaaattccggaagactctccgcaaccgcaactggaagacgaataa

SEQ ID NO: 83467 - DNA, 519 bp, Glycine max
  Peptide Sequence Number=SeqID_175152
atggctagagcgtttggaggagaccaaattgaaggaaacacaaacagggtagttgggacttatggatacatggccccagaatatgctgttgatggactattttcaatcaaatcggatgttttcagctttggtattttattgttggagattatatgtgggaacaaaaatagagctctttgtcatcgaaaccagacccttaacctggttggttatgcatggacactttggaaagagaaaaatgctttacagttgattgactcaagcataaaggacctatgtgctatcccagaagcactgcgatgcatccatgttagtctcttgtgcttgcaacaatacccggaggataggccaaccatgacctcagtaattcaaatgttagggagtgagatggaactgattgagccaaaagagcctggtttctttcccagaaggatttcggacgaagaaaaattcagctcaaatctaaaccataagacttcaaatgatgagttaaccattacctcattaactggtcggtga

SEQ ID NO: 83468 - DNA, 279 bp, Glycine max
  Peptide Sequence Number=SeqID_175153
atggggtggagaattttccgactggatgtcaaattggccatcctaaatggctatcttgagaaagatgtctatgttgaacaaccaatgagttttttcgtcatagggaaaaagagaaggtcactctcactaagtaagatcatagggagaccagtcagggtcacgatgttttgcgagaatgctccaaccatatgggatcagcataggcttaaaggagcactcaaacccagtgacccccaaggcctacactccgaagagtccgttaggacctctccctcctga

SEQ ID NO: 83469 - DNA, 108 bp, Glycine max
  Peptide Sequence Number=SeqID_175154
atgaggagggattggaagagcaagttgaaactccgatcattaaaccaatatgaggttcatggctatgctaaaaggccacctggcctcaaattccccgttaaggtatga

SEQ ID NO: 83470 - DNA, 126 bp, Glycine max
  Peptide Sequence Number=SeqID_175155
atgtttggtagagcttggccttttagaacaccaatcaaacctggtgttgttacattatggcctcaatttggctcaaacaaggcacgtagcatgtgtgattgcatacttcttggagcccagtcatga

SEQ ID NO: 83471 - DNA, 363 bp, Glycine max
  Peptide Sequence Number=SeqID_175156
atgaagaccattttgcaacgacgacaccaccatggacaccaacgatgccgtgatggccaaaacccgaatttctcgaagaggattaaaggttgggtgtcaaaggttatggtaatggttttgatctccaccatggagggggagaccaagaggaggatgacgacaacggttaagacacggataatgaagaccattttgctcatcatatcttccacgcgtgagaagagcactaagcgcaataccaactcgagagggaattgcgctgagcgagaattgtcgcacttagcacaaattgtcacgctaagcgcaaaaaatggactcccgcttaacgagataagctcgctaaatgagatctgcatattataa

SEQ ID NO: 83472 - DNA, 294 bp, Glycine max
  Peptide Sequence Number=SeqID_175157
atgtcagtgaaaaacctcgtcgggcgcctaggagtacatgacaagacaaaccacacactagtaaggaaaccagtcagggtcacgctattttgcgagaatgctccaaccataagggatcaacataggcttaaaagagcactcaaaccgagtgtatttacccccaaggcctacactccgaagagtccgccagggcctcttcctcctgattcaggtccaacccagaaacattttagcacacaaactctatctatgaactgtacaaaacacacgactcctcaattgttctcaaaatag

SEQ ID NO: 83473 - DNA, 216 bp, Glycine max
  Peptide Sequence Number=SeqID_175158
atgaaggagttcaaaactacaattgcccaagcattgaagacgaacaagggggtggagataaggaatttggagagaaaccttttagcgttcaggtttctatcagtaaacgataaagaggcagtgataaagggttgcccacggaattttgatagaagattgattgtgctgaatgatctgatgcgtaatcagaaccctaacaaagtagacctatcatga

SEQ ID NO: 83474 - DNA, 798 bp, Glycine max
  Peptide Sequence Number=SeqID_175159
atggctactagtgatggtggtggttgtttgctccccggtgatagctatccagattggttaaccttcaacaccgaaggttcatccgtgacttttgaaatccctcaagtgaaagggcgtaacttgaagaaaatgatgtgccatgtccattattcttccccggaaaatataacttcagatggtttgaaaaatttgttggtgataaatcacacaaaggccatcattcaactttataagagaaatgcattagtctcctttgaagatgaggagtggcagggggtactatcaaaaatagagcctggaaacaaagtgcaaattgttgttgtcttctggagcaaattaactgtttgcaagacaacaatttatctcatatatgaaccaatgaatgaaaaaatagagcattcacatgcgccaaataagaatgtaatggattctagtggtgatgaaaatgaatgtgttgttgggaccatctctcttcaagtagaatccatatataagccaacaaatgacataatggagcattatcatgcatcaagtaagaatgcaattgtttccagcagtgatgaaaatgcatgtgttgtcaggccgttctctcctgaagtggaatccatagatgacttaagagattgttttgggcagtggatgatttgttttacatgtagattggtggctactattaatgctctaaatctgattgctaaagaatggatacttggggaaggtccacttgttttgggatcttggtttctaagggagtccaacttgagcttgattttgatgcccttgattttaatcctttga

SEQ ID NO: 83475 - DNA, 465 bp, Glycine max
  Peptide Sequence Number=SeqID_175160
atgggccccgacgggtgcagagaaacgcgagggattggaaccagagaaatggcacgcaaaccaagaaaactggtagagatgaaggggaaagtcaacttaaggttaaatagtaacagggcactgatctcgatggcagcgcaattaatccatgatcgcgtggagatggagtgcctagagggagtttgggagaccctcgaaggcaataagaggtgccgattccgtggcacgattcgactcactgctacttcattgccaatccaagtgatagaggtgtcgtcctctgaagaagaccctgaggagttacctcctgagcctgctgtggatgctcttgactttccagaggatgatgagaacccactccctgatgtggattctccagaggatgtcgtgtcagcatctgaggcagactctacggaggagagcggccctgtagggacagcgaatagtggagactcttcatcatag

SEQ ID NO: 83476 - DNA, 753 bp, Glycine max
  Peptide Sequence Number=SeqID_175161
atggtgaaggatttaatgccatttttttctttatttaaggtacttgaaaatccaccaggtgttttcaaagcaaagcatcaacgcatatccaaaggagcatggacattctcaatgcagaatcggggttggcaagtctctagctatcttttatcccaagatatactagtttgtatagaacaagatcatttacgtgagctaaaaatgctaaacatttacgcttttcaagattggttgttagggaatttgctatacctatggcacctgcttcctaatggaggatggggtgagagttacttgtcaagccaaagcaagggagatctttatgaaagggatggaattgttttggataagagcaaaagggataaaagcagagtttcaaacccattaatgaaacgggcactgctaactacaactgctgaggataaaatgcaaaagtatggtcggtccaaagttggatctcgtgtggttccatatcatgaagatcagagtgaagactcagttcttgtcagttttgtctctaaagatctccaaaggaatggcaaagagagtgaagattcagaagcagcagtcaagtctactcaatctactgtagttgctggaaggaaggatgaaataccttcgtttccaactgatgttgcaatcaaatctcacttgcattttggagagcttgtaactgtaaaagtacaaaggcttggtatgtccctttcattgacccttgatgccatgtcattcaatatgattggggtcaattaa

SEQ ID NO: 83477 - DNA, 126 bp, Glycine max
  Peptide Sequence Number=SeqID_175162
atgtcacatgtcaatgaagtcattgaagttgaaattgtttctggattgcaagatttaagaggtggtgttgaagaagtaaaccttgctaatatgtcattaggggacgttgaccctccttgtacatga

SEQ ID NO: 83478 - DNA, 297 bp, Glycine max
  Peptide Sequence Number=SeqID_175163
atggctactaatttcctaacagatatcgagaggaagacaatacaaagaaatagaagggatgaatgggtgtggaaggaagatcaaagtaggcaatacacggcacgatctgcgtacaacctaatgaggggggtagaagttgaggggatacaggatagggcttttgaggaactgtggaagttaaagaggtcacaaataggagctgtccattttgcggaaatatggaagaggaagcatggcacttgttttttcactgcagcaagatcctccctattttgtgggaatcatcatcatggttga

SEQ ID NO: 83479 - DNA, 228 bp, Glycine max
  Peptide Sequence Number=SeqID_175164
atggcttgcacctcgcgtcgcaattttggtgcgagaccagaaatgaaacagctgagaaggaatgatggagtaaaaaaattgagagatcttgaagatccattccatggcattgtgaccgtcgaaatgcaagacctcgagcttgaggtggggttagtgatgggtgttggccgaggttgggattggtggggttttcgggaagggagtaggctgcagttgaagagagtgtag

SEQ ID NO: 83480 - DNA, 282 bp, Glycine max
  Peptide Sequence Number=SeqID_175165
atgggttcacctgaggacacttcttgcaaaagatggaatgatttgcacgcaacattccatcttgaggacaaggtgtctctcccgacggctggtgatgatagcatacccaggtcacgccccaagaagacacccactcacagacccccacacctcaaggattatgcagatgtcttggataatatcctttgtcggaaattccactatcaaaaaagaggatccttggcctcgaacaccaggatattagagggctctaacagaagatgtcaagagaatatggtttga

SEQ ID NO: 83481 - DNA, 153 bp, Glycine max
  Peptide Sequence Number=SeqID_175166
atgtgggatcggcacatgcttaaaggagcactcaaatcgggtgtatttacccccaaggcctatactcctaaaagtccgttaggacctcttcctcttgattcagacactgctcatgaattatacaatacccacgacctcacactcgtgttttaa

SEQ ID NO: 83482 - DNA, 378 bp, Glycine max
  Peptide Sequence Number=SeqID_175167
atgcctacgtccagtcctcaagcaacccgcttgagatttccagtatccttgtataaatcctttacaagcaatgaaccacaaaggacttccctcctttgtgttcagtgtttacaccaagagacaatcccgcctcttacaatgaactccaaaggaccttcctcctttgtgtttagtgattacaaccaagaggcgaggctcacgggtgcatcttccaaaggaggaaaatgcgcggagtcgccaccaacgtttatttgtggaaaacgttggaaaaaccgaaggaaaccagtcatgaaaaatatttcagattcgggagttgtatttacgtttgaggaaggtattagcacctctcacgtttgtcccaaaggacaacagccttaa

SEQ ID NO: 83483 - DNA, 201 bp, Glycine max
  Peptide Sequence Number=SeqID_175168
atggcctcaacaaatttcttattcccagaaaggaattccatcaataggcctcctatctttaatggagagggttaccactactggaaaacccatacgcaaatcttcattgaagcaatagatttaaacatttgggaagccatagaaataggaccttatgtacccatcatagtagatggaagcacaacaatagaaaaaccttga

SEQ ID NO: 83484 - DNA, 477 bp, Glycine max
  Peptide Sequence Number=SeqID_175169
gaagtagagacctcctttcagttctcgtacgtgacatccaccttatcacgcaccacaatccccaaatatgttcttaatttcttcttgtggggactgtcggccttgccggtagcaggatcaacgtggaccaatggtctctcagcaccaggtggtctagtagacaaggatcatagacgtgaggctttgcatgtctgcttcacggcagacggcgaagttgatgcgtctgaaggaggaggaggaggcgaggcaggtggagaagccatgatcctttatacatcatcaaaatgcttgtgtaaatttgaaagcatgaataagctgcaaaaccaattggagaaagtggagtctcttactcaagatcttgaagaagggcttgagtttctatttaggcatttaataaagactaagggcattgtcagatcctatggctgtcctataaattctagtgcagatcttgtggcaacaacagaaggagagtaa

SEQ ID NO: 83485 - DNA, 227 bp, Glycine max
  Peptide Sequence Number=SeqID_175170
caatcggaggaaaaactggaggaatctcaaggaatcgctagagatgctgctatcgctgtcggaagacacgtgagtccgcttagagtgaagccagtgatgaacggttgccgtcgtggtcaaacattctgcagagatgcgtcggctgctcctccgtgtagggagtcttcgccgccggcaaaagctccggaaccaccgccgatgacatcaccttcgacggcgatggcgac

SEQ ID NO: 83486 - DNA, 719 bp, Glycine max
  Peptide Sequence Number=SeqID_175171
ttttcatagcagcagaaacttcatccattacactatcccagtccctcagttacggaaaaaccctagtttccccaagtggaatctttgaactcggtttctgcaatcttggaaatccgaacaaaatctaccttgggatttggtacaagaatattccacttcaaaacatagtttgggttgcaaacggtggcaacccaatcaaggattctttttccatcttgaaactagacagttctggcaatttggtccttacacacaacaacacggttgtttggagcacaagttctccagaaaaggcacagaatccggtggcagagctcttggattcaggcaatcttgtgataagagatgagaatgaagacaaggaagatacatatctgtggcaaagctttgattacccatctaatacaatgctgtcaggaatgaaggttggatgggacatcaagagaaatcttagtacttgcctgatagcttggaagagtgataatgatccaacccaaggagacttatcatggggtattaccctgcacccctatccagatatctatatgatgaagggaacaaaaaagtaccatagatttggaccatggaatggtttgcgtttcagtggcatgccacttatgaagcctaataaccccatataccattacgagtttgtctccaaccaagaagtggtttattacagatggagtgtcaaacagactagttcaatatctaaagtg

SEQ ID NO: 83487 - DNA, 516 bp, Glycine max
  Peptide Sequence Number=SeqID_175172
atgacactgctgctcagcaatgtcttgcctagcgatcataactccgatctccctctgctaagtgccagttggtgtatgccatctgacacggatgagcttccacgtggcccaggtatgccacccatcaggcaccctctggacccgaataattctaatagggccctggggtttccagcgttgatcatgggcctctgccagtcattcggggttcccgtcacccccagtaaagtgatccgaccgccgatcacccaacccttcatcgagaagtactgcacgcccaggcaggcgcagggtgatgcacatcaggccgcagacgcaccgccaccacctcggcaggccgatcccgctggatcactaggcatggagcgttatctacaacacttggttcgacagaaggcggccaaccaccatgggcaggtgcagatacatgagtgtctttaccggttcagcctcagtcaacagggccagggttctactccttttgcatgccctactctggagcagtttggggcttag

SEQ ID NO: 83488 - DNA, 395 bp, Glycine max
  Peptide Sequence Number=SeqID_175173
aaagaaaagaaaaaggaaaagagagggtagaaataaatcaagatgagagggaacaaataagggaagaagaaagaagaaaaatactaaaagaattaagaaaaggaaaacgtgcctcctatagtagtcatgaccctagcaagagcctaagtgaaaaacatcgtgactattatgaaggaaggcataggtcacatcttagacctcactcccataggatagaaaaggaaagaaagcctcaagaggctaacattaacctctcatacttccatgggaaggacaatgtagaggcttacttagattgggaaataagggtagagcaacaacttaaaaggaagcctacttcaaatcttatggccctcactcttatccaaagaaagaccaaggtcaaagcatcttag

SEQ ID NO: 83489 - DNA, 661 bp, Glycine max
  Peptide Sequence Number=SeqID_175174
atgactgaagacatttttgtcttcaaaatgtgtgcagattaccgtataaggcgtctccacatgctacctgacttctcacaggtcggggtaacatatttgtgtgtgtgtgcggataacccctgggtatctccgcatgctacctggcttttcacaggtccgggtagcagaactgtgtgtgtatggataactgttgggtatatctgcctgccacctgactcatgggtcaggatcaacagatgttgtgtttgtacggataaccacttggggtatttccacctgccacctgacgcatgggtcaagattaacaaatgttgtgtttgtatggataaccacttggggtatttctgcctgccacatgacgcatgggtcagggttaacagatattgtctttgtacggataatcacttgggtatatccgcctgccacctgacacatgggtcaggatcagcagatgttgtctttgtacggataatcacttggagtctcaaccggaagaagctgacatctccggaaagggcacacacgaccaaattggtctgcgcttgtcaatcagacttggggtctccaaattacgaggtgcaaataaccgtaaggcgtctccgcatgctaccgaacttgtcgcaacatgcccttttgtgggcgtgcgaggcgaggctcacgg

SEQ ID NO: 83490 - DNA, 489 bp, Glycine max
  Peptide Sequence Number=SeqID_175175
aaactggaggaagctgcccagtttggaaccgctgacggcgtcattgaccctccatctcccatcagacgccacgtgaagtggaagatggtctgcatcaagaaaactgggcagatgacgtctgaggcagcaaaggaaatcgctgagaagatcgcgtcacagggatcgttcgtccctcatggacgtcaggatgtcctgactgccgccattgggcgagcagagcaccctagtcatgtctgtggtgttggagctcgtgtcaccatcaagcaatattttggatcggctccacaaacccaaatgcaatcccagatgcaatctcaggggcttgcactgcctccagagcttatggttggtccctcaagtcctcatgtcatcacaaaggagagttatgttgatccctcagggaacgatcctgagacagttcacaaaattcctttgttgcctggccaagtgaaggttggtgttgaggaggttaaagatgcacaggctccc

SEQ ID NO: 83491 - DNA, 405 bp, Glycine max
  Peptide Sequence Number=SeqID_175176
atgtctaaaacgaatgtgagaagacatgctcttgagaagtgcaggagtgtgaaagagacacagaaagtattgaaccacaactttttcaccagaaacctcaagaaagttgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 83492 - DNA, 240 bp, Glycine max
  Peptide Sequence Number=SeqID_175177
atgacaagtttaacatgctttcatcaaatctcttcacaaataactatcataaagcataaacctagtaaaactacccatcatatctcccagccccatacccacgaaaatcatgtgagaaagaagtctacccaacctgaaatttcgaagtcccacacaaatggtgaccaaaggttggagctttgttgggcaacaatggtgggtgagaaaagaaggagaaagctacgtgagagaggggagtga

SEQ ID NO: 83493 - DNA, 412 bp, Glycine max
  Peptide Sequence Number=SeqID_175178
actaaagagggtggtacgccagttcgggtacatccagaccatccctccgccgccagttactggttcgttgtcatatgaggacatagacgacaggtggatgcatttaagggatcatctagcacccgcaagtgagatttgtgttgcccacaaccaggaaggtgatgagcccagacatccacctgccccaaatgtggatgcatacgtcgagccacatatcccggaggttccagtcgcagctgatttccctagacattcagtggttgcttgtgaaggttgcgaagcgatcacagaaaggttggagcgtgtgctcaaccttaggatggtcactgtaggaacagagttatatgagatcatggaagattgcctgcggatcgctaggggtgacgcctctgatggaagtcttagggcgtga

SEQ ID NO: 83494 - DNA, 561 bp, Glycine max
  Peptide Sequence Number=SeqID_175179
atggcggaaccatcaaagaagcgaaagggttcttcgagttggagtcaatggcattccgagactcaggaaacgctgattccttcctctatttcctcttcatcattgttctcatccaaagaacaacggatacagtacacaaatcttttctcttctcgttccattattgatccaaaattcattgatatggatttcttttcaaatgagagttttgcatgcattcaagcatttgaaaactccaatcttattcctttcatgtctttaaaattgcctgtttactctgatttagttaaagccttctattcaaacctagaaatccaagaaggcactttaatttctgaagtttatgggattaaaatggtcattgaccaattcctattctatgatttaacccaattatccagtgaaggtgtaccatttgaaggtacactgattgatgattggaaatatgaattctctgtgcatgatgcccgccggttggtttgcactaaccaagcggacatgaccagaaggcttcttgccggttcattggcttttgaaagccgcatccttcattatctcatt

SEQ ID NO: 83495 - DNA, 433 bp, Glycine max
  Peptide Sequence Number=SeqID_175180
atggcctctgtgcatagtgcaggtttccatgttctgaagctgtgtaactcgagtttggcctctggtaatcgattaccaatgttgtgtaatcgattaccagaggagaaaacccttgagatcgcgatggcagcgcaattaatccatgaccgagtggagatggagtgcctagagggagtttgggagaccctcgaaggcaatgtgaggtgccgattctggggcacgattcggttcacggctacttcattggtacgtccagaggaacccgcacgcatgcttcagcgcactgtggagtggatattacctacacctactccatatcgactagtggagcccgtccaagtgatagaggtgtcgtcatctgaagaagaccctgaggaggacccagaggagttacctcctgagcctgttgtgtatgccattgactttccagagg

SEQ ID NO: 83496 - DNA, 117 bp, Glycine max
  Peptide Sequence Number=SeqID_175181
atgtggaccaccacgggggagaagcttgccgcccagctcgcccaggcgagcaaggttgcttcctccagaagcaacaaccttctggagaaatcttctagagggcccaagtgggcctga

SEQ ID NO: 83497 - DNA, 416 bp, Glycine max
  Peptide Sequence Number=SeqID_175182
atgaaagcactgccaagcgatgccaacaagaaaaggaaggaagtggtacttgaacccggtgatgatcctgaacatttgaggacaaatgtttccaagaaggagggaatgatgagaatcatgaaactggccaaatacaggctaaaggcccaagtggagaaggacggaggcctaagtggagaaggacaaagcccccaagtggagaaggatgaaggctcaagtaatccttgtggcgtctacccagacttatcttccttcactggaagtggcgtctacccagacttatcttccttaaccggaagtggcgtctacccagacttatcttccttcactggaagtggcgtctaccatgacttatcttccttcactggaagtggcgtcatccaaaccttcgtagcctgtatcaaacgatccgcccc

SEQ ID NO: 83498 - DNA, 681 bp, Glycine max
  Peptide Sequence Number=SeqID_175183
atggtggcacgggtaatgctcaggcacggttatgaacccggaatgggtctgggcaaggacagccacgagaatgccgatgtggttgacgttaggcgtaacccgcacaaatatgggttggggtatgagcccgggaaacctggaagaaggaatgcaccatcaagactccgggcagatagggcatggcccggtcatgttagccagtgtttcacaagtgccgggataatgttcgaggaagaggtggcggcgataggagaagaggctccacaagatccgccgagtttcctgcgaccgtgcaatcccaatttccaattggggaattggcacgtgacgagccagtcagaagtctataccgctgattcaatatgtgagaatcgatcctttgaggatcctaacagcgagggtttgataatcgatttcgaccgagaagtaagtcaaacaataaacaaagaagaggaagaggacgtcctttcaccagagttggaaagattgatcgctcaagaagaacgcgtgtcgcaacatgcccttttgcgggcaagcgatgcaagactcgcgggtgcgctttccaaaggaggaaagatgcgcggagtcgccaccaacgtttatttgtggaaaacgtcggaaaaaccgaagggaatcggtcaaaatgaaaattctaagttcgggagttgtatttacgtttga

SEQ ID NO: 83499 - DNA, 1113 bp, Glycine max
  Peptide Sequence Number=SeqID_175184
atgatcggcaaggtgggcatttcgctgcaggcctatcagacgcgtaccggctttagccagacggcgatggccgacggcgcttcggtgctgcgccatcgtccgcacggcgtgctggcggtgttcgggccttataacttccccggccatctgccgaacggccatatcgtgccggcgctgttggccggcaactgcgtggtattcaaaccgagcgagctgacgccgctgaccgccgaggagaccctgaagctgtggctgcaggccggcctgccggacggggtgatcaacctggtgcaaggcggccgcgagaccggcgaagcgctggcggccagtgcggatatcgacggcctgctgttcaccggcagcgccggcaccggctatcacctgcatcgccaattggcggggcagccggagaagatcctggcgttggagatgggcggcaacaacgcgctgatcgtcgacgggggcggaaggcgacgcctttatcgaacgtttggtccaggtggcgggcgaactgcgcgtcggccgctgggatgccgaaccgcagccgttcatgggcggggtggtgtcggcagccgcggcggaaaacatgctgaacgcgcagcagcgcttgctggcgctgggcggcaaatcgctgctgagcatgcgcctgctggaaccgggcagttcgctgctcagcccgggcatcgtcgatctgaccggcgtggccggcgtaccggacgaagagtatttcggccccttgaccaccatcgtgcgttaccgcgatttcgacgaagcgctacagctcgccaaccggacgcgctacggcctgtcggtggggctggtatcgccgcagcgcgcgctgttcgagcgcttgctgctggaagcgcgcgccggcatcgtcaactggaacaagccgctgaccggggcgtccagcgcggcgccattcggtggcgtgggggcctccggcaaccatcgcccaagcgccttctatgcggcggactattgcgcctggccgatggcttcgctggaaagcgaaagcctgtcgctgccggcgacgctctcgccgggcttgttgttccgttaatcgtctgcggcggcgcgatggcgccgccgcaggccatccccaggggatag

SEQ ID NO: 83500 - DNA, 1110 bp, Glycine max
  Peptide Sequence Number=SeqID_175185
agaggactacatgtcctcgctttcggagggctacacgccctcgcctttagaggactacatgtcctcgccatcagaggactacacgtcctcgccttcagaggacttcacgtcctcaccttccgagggttacacaccctcatctgcagaggactatgcgtccgccccttgagagggctacacgccctcgccttcagagggttacacaccctcatcttcagaggactatacgtcctccccttgagaggacaacacgtcatcgctttcatagggctacacgccctcgcctttagaggactacacgtcctcgcctttagaggacttcacatcctcaccttcagagggttgcacaccctcatcttcagaggacttcacgtcctcacctttagaggagggttgcacgtcctcatcgtcagagggctacacgccttcacctttgtagggcttcacgccctaacctttagaggactacacgtcctcgccatcagagggtcatgtaccttcaccttcaaaggactacccgtcctcacctccagaggactacatgtcctcgcctccagaggactacatgtccttgccttcagaggactacacgtcctcgccatcagaggactccacgtcctcgccttcagaggactgcacgtcctcaccttcagaggattgcacagcctcacatttgtagggctacacgcccttaccttcagaggactccatgtcctcgcctttagagggtcatgtaccttcacctttagaggactacacgtcctcgcctccaaaggactacatgtcctcgcctttagaggactacacgtcctcgccattagaggactccatgtcctcaccttcagaggactgcgcgtcctcaccttcagaggactgcgcgtcctcaccttcagaggactgcgcgtcctcaccttcagaggactgcgcgtcctcaccttcagaggactgcacgtcctcacctttagaggactgcacgtcctcaccttcagagggctacacaccctcatcttcagaggactatacgtcttccccttgaaaggactactcgtcctcgccttcagagggttgcacactccctcgcctttagagggctacgcatcctcgctttga

SEQ ID NO: 83501 - DNA, 429 bp, Glycine max
  Peptide Sequence Number=SeqID_175186
atggcagaacaagctaaacaagtattttatgtgaccaaggctactccacctgcctcgcctcctcctccttctcctcctcttgcagtagtatcagtgtctctgcccacccagaagtggacatgtaaagcgacacggctacaatccttggccactagaccacctggggcaaagagaccagtggtcaacattgatcctacgacaggcaaggctgacggtccccacaagaagaaattaagaacatatttgggaattgtcactcgtgataaggtcgacgtcatatacgagacctggaaggaagtccctactactcagaaggatttgatttgggaggatactcgggcagaatttgaaatccctgaagcttctgacagtaggacaaagaagaaaattcttcagatgtcggcgagaggtggcggcagtttaaattag

SEQ ID NO: 83502 - DNA, 495 bp, Glycine max
  Peptide Sequence Number=SeqID_175187
atggcgcctaccaggcaccctttggatccagataagtccaacagggccctgggatttcccgcgctgatcacaggactctgccagtcgttcggagtccccgtggcacctaccaaggtgattcggccgcccatcacccgggcttttattgagaagtactgcacccagagacaggctcaggggaatgctccacaggccgcgggcgcgccaccaccacctcatcaggctggcccggctgggtcatttgacatggagcagtatttacggcatttggttcgccagcaggcggccaaccaccgggcacatagccagggcttcgcttctttttcatgccctactccagaccagttcagggcagaggtcgcatggcccggggattggcccgaggcccaagcaggagaggcgcccccagaagctcccggcgatggagaggaggcccatgaggacgaggagatggccgatttgcttgacttcttgggagggagtggagctacatga

SEQ ID NO: 83503 - DNA, 373 bp, Glycine max
  Peptide Sequence Number=SeqID_175188
atggaggccatgaaagagcaaatggccacaatgatggaggccatgatgagcgtaaagaagataatggaagccaatgcggttgcaattgccgctaccagcattgttgctaaggtgaacccgacgtccccatccggcatcaaccaaatgaatcatccaacctcaaatatggtaggcaaagatttgggaagtatgggcggcccccattatgcgcaaagtcaaaacaagcatgccttcccaccatgtggcttgcctcctaactatacaccatccaatgtagcgtacacttccagtgagaatgtcaataactccactcccatactcattgagagccgacaaccccaaactgatcatgcacatgtctctcaacccatgg

SEQ ID NO: 83504 - DNA, 174 bp, Glycine max
  Peptide Sequence Number=SeqID_175189
atggtaaggaagctagccaaacagcttgcagaaaaatcttctagtacttttggagctaacactgagcagaatccaaaagaagaatgcaaggttgtgatgacccgaggaaggaaggtaaccatggaggaggagaagaagaaggagaaaatggtggaggatgacaaacaacagctg

SEQ ID NO: 83505 - DNA, 375 bp, Glycine max
  Peptide Sequence Number=SeqID_175190
atggggaagagaaagctggagttaggttttgaagaccagaaaattgattttgacttctttgttgaagacaagcctgctctagaacacaatgtttgcttgcaggtaatgggagaaggtcaagaggttctgaagatcattgggaacttgctgtataatctgaacattggagtatatcagcctccatttgaatgtcctttcactaagcgcctgctgctcgctaagcacataatcgttcatgcactaagccacgagtttcaagcgcttagcgcacaaccctggcatctgaggctgattatttccgctaagctagccaaggttaagctatgcccaaatcaattcaatttggattcaactaagcttcagcctgaacgctaa

SEQ ID NO: 83506 - DNA, 1839 bp, Glycine max
  Peptide Sequence Number=SeqID_175191
atgaagtacgtgctggtgactggtggagttgttagtggccttggcaaaggtgttactgcgagtagtattggtttgcttctcaaagcttgtggacttagagttactgccattaaaattgatccttacttaaacacagatgctggaacaatgtccccctttgagcatggagaagtgtttgtgttggatgatggtggtgagtctgtcattgacaaagagaggagaggagactatttgggaaaaactgttcaggttgtccctcatatcactgatgctattcaagattggattgaaagagtggcccacatacctgtagatggaaagaccagtccagctgatgtatgtgtcatagaattgggtggaaccataggagatattgagtccatgccatttattcaggcattaggacaattctcatacagagtaggtgctggcaacttttgcttagttcatgtcagccttgttcctgttttgaatgttgttggtgaacagaaaacaaaaccaacccagcatagtgttcgtgcactgcgtggccaagggctgactccacatatcttagcatgccgcagcactatgggaatccagatcctagagtacacacaaggcacaagcatatactatgatgcacaaaaagaacagaagtgcataccagcattcacactgatcttaactgtaaacatttttaagtttctaacgttcagcttttttcaggcagaaaacattgttaccctttatgatgttcccaacatctggcacattcctttgcttttaagagatcagaaggcacatgaagcaatgtttaaagtgctgaaccttcatggtgtaactaaagagcctaatttagaggaatggacttgcagagctgaatctagtgatttgcttcatgaaccagtgggttcgtatagccttagtggggaaatatacgtgcctttcagattcctacctctccgttctaaaggtggagttaacttcaacttcatggctgccttactgcatgcttctgttgattgccaaaagaaacttgttgtggactggattccagctagcaaccttgaaagtgcaactgcaaaagagaatcctgatgcttttaaggcagcatggaagttattaaagggtgcagatggtgttcttgttcctggagggtttggagatagaggagtgcaaggaaaaattattgcagccaaatatgcccgtgaaaacaggattccattccttggcatttgtcttggaatgcagattgctgtcatagagtttgcacgatctgttcttggtgtacaagatgctaacagcactgaatttgagccccataccaaaagtccatacatcatatttatgcctgagggatcaaaaacacatatgggaggcaccatgcgccttggatctaggaggacatatttccagaccaaggaatgcaaatctgcaaaattatatggctgcaaaagcttcattgatgagagacatcggcatagatatgaggtgaatccggatttagtggcacgccttgaaaatgctggtctttcttttactggaaaggatgaaacaggtcaacgcatggagattgttgaactacctaaccatccttattttatcggtgctcaattccatcctgaatttaaatcaagaccaggaaaaccttctcctttgttcttaggattcattggagcagcatgtggacaattggatgctgtcttacagcgctcttcaattgttgataatggtctctcaaaaggagtcattaatgatatctctgcagtcaaaacataccgaacaagaaccgctacaaggacaacttataggtctgctgaatatgtatatgggagttgcaatggattgcatttctaa

SEQ ID NO: 83507 - DNA, 360 bp, Glycine max
  Peptide Sequence Number=SeqID_175192
atgatacactgtttttcctgctgtctttatagaaaatgcaacgacctcgctgagttcactagcctcgctgagcgagattatcaatgcttattgaatgtctcgaaagaactcactgagcgcacatgtcacgttgagcaacgagcattcgctaagcgtgacactcagtggctaagcgcgaggaagaatccagaagaagatgagcagtcaggttcgctgagcgcaccactcgaggtcatcaagcgcaccacttcaactcatccgctaagcgagagaggcgcgctaagccaaaatccacttatgcgcactaggcgattcagatttgtgctaagcgcacgagcacagaccaacccacctatttaa

SEQ ID NO: 83508 - DNA, 459 bp, Glycine max
  Peptide Sequence Number=SeqID_175193
atggcaaggttttttcatggtcttaatagggagattcaagacattgtagagttgcaccgctatgcctctttggaagatcttattcatcaagctatcaaggtggatcaacaattaaaaaggaagcaaatatacaagaattcctcctatggctcttcaacttggaaggataaggagacattcaaaaagaagggaggatcttcatttaaatctcatgataaagacttaccacaaaagtcacatttttctatatcagactgtgacttggaggaagttatcaccttttctaagcctaagctagacttatcatggggatgccgatggaattttaaaagcatggttagagtttgtgaacttttcatgaatttcccgaattctttcgtaagacaaactacttcttctcttagtttttcaactatggaaggttcatctatcttactagcttggctcaaactcttctag

SEQ ID NO: 83509 - DNA, 318 bp, Glycine max
  Peptide Sequence Number=SeqID_175194
atgaaaaatctcgttgggcgcctaggagtatatgacaagacaaaccacacactagcaagtcaggtcactctcactaggcttaaaggagcacttaagccgggtgtatttacccccaaggcctacactccgaagagtccgtcaaggcctctccctcctggttcaggtccaacccagaaaacatttctgcacacagactctatctatgaactgtacaaaacacacaactcctcaattgttttcaaaatagttttaactcgtcgccctttaagggtcttagcattaactcgtcgccctaaaaagggtcttatagtcgtgtga

SEQ ID NO: 83510 - DNA, 315 bp, Glycine max
  Peptide Sequence Number=SeqID_175195
atggtgtctaccctgacttatcttccttctttgaagtggcgtcatccaaactctatgacttgtatcaagcgatccgctcctagtaaggatcacatcaatttgcaagaggacaaaggtctaacagtggatgtattaaaggttgaacattatgagaagaatgttaaggcaggatgttttgactgtgatggtgacttgtgcagagtgaaggagcttttcaaacatgaatgtgctaagtttaacaaaactattagtttaggcttccaagatcctaaaaagggaaaaattgttagaggggacaatgaacaagcaatttag

SEQ ID NO: 83511 - DNA, 204 bp, Glycine max
  Peptide Sequence Number=SeqID_175196
atggccaaatcgtcattcagcttcaattctaggaatgggaatatccccattggtgattatgagccagactctatattgggtggacttgtctttctagtagggatagtatgctccctcggtgatgaattgatgttggttatttgccatttggatcttttcctctacactttgttaagtgctcaacccttagaggctaagccctga

SEQ ID NO: 83512 - DNA, 165 bp, Glycine max
  Peptide Sequence Number=SeqID_175197
atgacgtcgcctattgcaagagaggtttatggtgtggtggggtttgggttgaggttgggtggaagcatggtggtctatgctgcaagtggtggtgggattgtcctactcattctctcccttttaacatcaattaaaaagaaggggatagatagcaaatttacttag

SEQ ID NO: 83513 - DNA, 426 bp, Glycine max
  Peptide Sequence Number=SeqID_175198
atgatgcttgtaggagtagcagtcgacagcttgctgctcgctggttacatcactctcttacagtgttggatatatgagcacttttcatcagttacgaagtgtatggttgatccggactacgatgagacgatagctggatgcactactcagaccatcttgcatcagcaggtgagatatgtcttgtgccaggtccccgagccaccaacaacattgacacatgcccgttctgatgtggaccagactagacatgcagtggatgcttgccatgcgatcgctgaaaggttggagcgtctactcaaccttaggatagtcacggttggcacagagacacacgaggtcatggaacaatgcatcaagattgccaggggtgtcatagaagaccacattgtgtatgtgaggtctcgacgtaggcggcgcacggattag

SEQ ID NO: 83514 - DNA, 168 bp, Glycine max
  Peptide Sequence Number=SeqID_175199
atggctagaacacgaggtttaggtcgtgttataggtagagttataggcagagatagacaggatgaccatgatgcaactgatgttcccgagaggcgtaggcctactgcatcagcccataggcaacgggttcatcagatgactcaagatgttcctgacatgactgaggat

SEQ ID NO: 83515 - DNA, 1008 bp, Glycine max
  Peptide Sequence Number=SeqID_175200
atggaactgtatctgatttttgtcctaacatttttcatgttagggactgctgaaggtgctcttaagtataagaacttgttgggttatggtgatctatgtgatgcttctttggcctatggtgccaaccaagcgactgaggtgagtgtaggggtgtatgcccctcgagttaaaggatttttgactcctattgtaacacggatatccatgctttcccaagattggcaggagtcttcctcatataaggagcggttgttgggtgcgtctcttggcttaatctcgacaaagcaccatgacttagcatacacccttggatggcgtaccttaacagatctgtcacagatgtcatccaggagaaattctactattaggccaacaaaaggatatgtttttctttccaccactcatgttggtggccttacactggatcccaggagcttgcggtttctgcgtcaggagtttgatgttcgcttttctgtcccttttgggttttacaatacagcactaaaccttgggatatctgctggtgctgtttttccatgggggaatggattcaaaaccaagccatctccccttccagaaaggttttatttgggtggtgatttttctccagtttgcaccctaggaggaccaacaaccttatggggatttaaaactagaggattaggtcctactgaacctcggaggcaaaatagagatgggtctaatgatgacaatgttgattcctctggatgggacttcattggtggtgattttgctgttactgcttttgcagatctctcttttgatcttccaattatgtggttgagagaacatggaatccacggacatgtttttgctggttctgggaatgctgctaaattaactcagaatgaatatacgcacttctctcctcggaagttcttagaatcctttcgaatgtcagtaggatgtggagtagttattcctactagactcttccgcttagagaagctcagactaaccaaaagttgggagattgagtggagttag

SEQ ID NO: 83516 - DNA, 309 bp, Glycine max
  Peptide Sequence Number=SeqID_175201
atggaggctggagggcattggaggaaggcattagaggaagccaagactctatttggtggagggacctgctatcaagtcagcagcaacaacagaaccaggaaggctctttttgatagtgaaattcaaatggcagataatttccttggagaactatcacagcagcagattcagccaaatagggaggataggtggagctggaagcatgatcaaagtggatactactcaacaaaaagcggatatgacttgatatgggaagcacagatgggagctaatcagaatttggactttgtggacatttggaagctctaa

SEQ ID NO: 83517 - DNA, 679 bp, Glycine max
  Peptide Sequence Number=SeqID_175202
ggaggaagatgaagaagtccaagctctaaagttagagctagggaaggcgagactcgccaaggagaagttcaaatcagccgctacacacatccagaaagagtgcaccgagttacaagaggaaaacgcggccactgtaagagcccttgaacaagaaactaaaagggcccgcaaggaggaatatggccgagagaaattccgcggagcattgtggggtagcaacaatgagctcaagctccgaagagaggaaagagaccggtccaagagaagtttggctcaacacttggaagccacggagcaaagcatgctagctatcatagggcaatacaaggaagagttgaaccagtctgtggcccatgaacaaaggctagtggaggattttgcacaagtgtatgccgaaaaagaagcaagagggaggttgattgatgcattgcatcaagaagcgactatgtggatggataggaatttcatcataactaagaaaacaccaagtgtcgcaacctacccttcggcgggagggcgacgcgtgactcgcgggatgcgtgttccacgaaaggaatacgcgcggagtcgccaccaacgtttatttgaggaaaacgtcgaaaaaaccggaaaagacgcgatctatgaacttttaagtgaaaggctcgggagttgtatttacgcacggggaaggtattag

SEQ ID NO: 83518 - DNA, 491 bp, Glycine max
  Peptide Sequence Number=SeqID_175203
cgaccgcagtgccgatctccccctgtggaagtatcagttggtctgtgccgtcacgacataagggtagcgcccacaagacacccagtggacccgaaggatcccaacagggccctggggtttccagctctggttacgggcctctggatcgtgcccgcaagacacccaatgaacccgaagaaggccaacagggtattggagttgccagctctaattacgagtctctgtcagttctagggagtgcctgtcgcccccagcaaggtcatcaggccccctaccaatcgagctttcatcaagaagtactgcgcccccaggcaggcgcagggcgaaacaccacagcagcattgggatggccggtagcgggcaatagacacaccgccaccacctcgagagttcacctcagctcatccacaaaaaggttagagcgttgcttacgacacatggccgaccagcaggctaccaattccaaagccaaagataagcaaaagtactag

SEQ ID NO: 83519 - DNA, 306 bp, Glycine max
  Peptide Sequence Number=SeqID_175204
atgggatcaaatcaaacacccttttctaagaaaaggttctatcatgtcaaaatcaaaagcctagaagtagcgagtttgcaagagttagggaaacggatgggccagctgcaacgtcaagctttccgcaagacatatggaaagatctggtatttggcgatgatagaagtatttgttgaagccatcgcatccctcactcaatactatgaccaaccgctaaggagtcttgggatgcctgctaggaggaaggaagtcgtatatggtttctgggttgtacccttctatggcaagagtagcgaaggtggttaa

SEQ ID NO: 83520 - DNA, 249 bp, Glycine max
  Peptide Sequence Number=SeqID_175205
atggataaatttgatcctctcaattacacatcttggcttattcaacttccattggtttgtttgctcaagcgacctgcacttctgagtgttgacttccaagaccgttcaatcagagattactcgtcctgcacgttggtggggtgtcgtaaacaacaagttgtgaaaacaaagatggatacctcagagccctacactggggccatgaggggcatcgtgaatgaacctcgagtgaacctaggggcagattag

SEQ ID NO: 83521 - DNA, 462 bp, Glycine max
  Peptide Sequence Number=SeqID_175206
gcttgtagtgagcttcaaaacaaggaaagggaaacaaggctcaaaagggctatcaaaggaattaattcaagggaagaatcaaggatttcaagtcacaaaatgtcaagaaaaacagtagtgggatttacctgccaggcattcaagcatctggtcaatgaatggcaggggaaaatggtcctttttggtaacctggttcagcctcctatagtcaatgcagactctccacctgttctgcacccgagtaggaatcagctcctccttctcatttctgatcactgtgaggccagtctttttcgggactacctggacgggactcacccattggctgtcggagataggataaatgattccagcttgcaaaagcttggttatctccttcttcactacatcaagaatcaccgggttgagtcttctctgtggctgttgtcgcaacctacccttcggcgggagggtgacgcatga

SEQ ID NO: 83522 - DNA, 417 bp, Glycine max
  Peptide Sequence Number=SeqID_175207
atgacgttgctgctcagcaacatccagcccagcgatcataattctgacctccccctgccaaagtgtatgccacctaccaggcaccctttagacccagataagtctaacagggccttgggttttctggcactgatcacgggtctctgccagtcgttcggggttcttgtcgcgcccagtaaggtgatccgaccgccgatcacccgcgccttcatagagaaatactgcatagctagacaggcacagggtggcgaccctcaggccccagacgcaccgccacctcctcaggctgacccagctggttcatttgacacggagcggtatttacggcatttggttcgccagcaggcggccaaccatcaggcgcacgtgcaaacccatgactctctatatcagcttagcctcagcctgcagagtcag

SEQ ID NO: 83523 - DNA, 282 bp, Glycine max
  Peptide Sequence Number=SeqID_175208
atgctgagagagggagggcgagaggtagatacaaggactgagatgaaaagggtgatgagaaaaagtatgtggagttggatgacctgctacataaggcgctacgagttgaatagcaaattaaaagaaaaagtgcaacaaggaggaactcacccaatacttacaaccaaaactgggccaacagatccaagaaggagggaggtaattcgtccagcccagcagcaacatccccacatggaaagtcagcagcgcccagtgttggtggaagcaaaaccagaaacataa

SEQ ID NO: 83524 - DNA, 369 bp, Glycine max
  Peptide Sequence Number=SeqID_175209
atggcttctaggaaaagaaagacaccctctacagctaccccaactagatttgatagatccagattcacttcccaagaggcttgggagagattcactaacattgtggtgcctcgtaagcttttaccaaagaggaatgaggtagtttactatacagagtttgatgagttcaaggaggaactcgagagatgccactgggatgaggagttgactgactttatggacgacaatattgatgttgccattataaaagaattctatgcaaacctctatgaccctgaggacaaatctcctaagcaggtgagggtgagagtttctgaggaagaacatggctactctagctcagacatggagtgttctttccttctctaa

SEQ ID NO: 83525 - DNA, 1266 bp, Glycine max
  Peptide Sequence Number=SeqID_175210
atggatcgcggcgcggcacgcgacgtccctgggcacgggccaatagcgcccggcctgtcgtccaccttgcggatgcggcggaaagcgtggaaccccttccgcgtttgcggcgatccgcgcgattcaggagcaagacgtggttttgatttcctcggttcgttccccccccggcgtgggcagccaacgcatccggcggcgccagccgggccgcccggcgcgatggcccgcggcgctcctggtgctggccttatgctgcgggccgctggcggccggcgcgcaagacggcctgggcctgatgtacgcgaatgcgcaaggcggcgagaaggacgatgcgcaagcggtggcatggttgcgccgcgccgccgagcagggggaagccggcgcgcagactacgcgcttgccgcgcaatggtgcgagaaagccgccgtccagggcaatgccgaagcgcagaccatgctcggccggatgtacgcccagggccagggggtggcgcgccaggaagacctggccgtgcaatggtggcgccgcgccgccgaccagggctacgccgaggcccggtatcagttgggcgaccacttcttcgacgcccctgccccgcggcgggacgatgcccaggccaggcgctggttcgccctggcggcggcccagggccacgccgaggcccagaacaacctcggcgtcatgtacgcggacggactgggcgggccgcgcgaggtcggcaaggcggtcgagtggttccgcaaggccgccgaacaggggctgcccaaggcgcagaacaatctcggcgccatgtacttcaccggcagtggcgtgcccgccgacgataagctcgccgtgcagtggtggcgccgcgccgccgaccaggggaatgccgccgcgcaggaccgcctgggcggcgcttatctgtccggccggggcgtgccccaggacgatttgcacgcctcgcaatggttgcgcaaagccgccgagcagaaccatgcaccggcccaggacacgctgggcacgctgtatgagcagggacgaggcgtgccgaaggacgaatcgcaggctgtgcggtggtaccgtcgggccgccgagcaagggctggatacggcacagtacaacctggcgcggcaatacgacttcggacgcggcgtgccgcgcgacctcgcgtcggcccgggcgtggtacgggaaagcagccgaccagggctatccgcgagcgcagttcaaccttgccgtgatgtatgccaacggcgatggcgtcgcgcaggatgatgcgcaggcc

SEQ ID NO: 83526 - DNA, 324 bp, Glycine max
  Peptide Sequence Number=SeqID_175211
atgatattgcacgagattagaaggcctaactctctaaaaacattccccagtggagtcaccaactgtcgcaacctacccttcggcgggagggcgacgcggggctcatgggtgcgtcttccaagaaaggaaaatgcgcggagtcgccacaaaattttattcgaggaaaacgtcggaaaaaccaaaaggtgtggtctacgaactttatgtgtgaaaggttcgggagttgtatttacgcacagggaaggaattaatgaagcattgggcttgaatccagaattaggcttggatttgaagaggacagactattttattctacaaaattag

SEQ ID NO: 83527 - DNA, 282 bp, Glycine max
  Peptide Sequence Number=SeqID_175212
atgtaccccccgacagcgcccaagccaacgccgtttgcatatcaaagcaataaggtcgttccgtggaagtatacccctcccgcttttggagaaagagttgcaaccgaagttgactccttgtcaaccaaggtgaccaacatcaccgaccttagtggcgtaacccgcagtggccgggtgttcgctccccctcactcggcggaattgccctccaaggcgaaagcacccatgatccaagagcccacagacgtagccaccccctcaaaagaagtggatcctcaggtg

SEQ ID NO: 83528 - DNA, 453 bp, Glycine max
  Peptide Sequence Number=SeqID_175213
atggatagcattgatcgaaaaattcttgctgagctgcagtctgacggccgcctgtcgcttaccgagctggctgagcgggtgaatctgagcctctcgccgtgccatcgtcgcgtgcgggcgctggagcaaagcggggccataacgggataccgggccagccttgaccccgccaaaatggggtttaacttcctggcgatagtgtttgcgacgctgaaagagggtgaccgcaaggcggttagcgcgtttgaagaggcggtagaggagatcccgcagatcgtgctggcccagcgcttatttggcgatcctgattatctgatgcacgtcgtgacccgcgacctttccgctttccagaagctctacgacgagaagctctccgccatgcccggtgtgcagcatcttcgctcaacgcttgttatgaaaacggtggtgcaggacaggccttttccgctgtaa

SEQ ID NO: 83529 - DNA, 259 bp, Glycine max
  Peptide Sequence Number=SeqID_175214
ggcgcgtcaacgggtgttgacggttttctggcttggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgttagggactgagggagtcaagagcgaaccagatagtaccctgggctttctagtgagagatggcctcacca

SEQ ID NO: 83530 - DNA, 351 bp, Glycine max
  Peptide Sequence Number=SeqID_175215
atggactctagaacaatttcaaggtttcacatcgacaagaaagtcaaggcaaaatgtaattccttaattggtcaaaaaaatgcatgggattatgtcattgatgcctgggggagtttggttgattgtcgttctgagcatcagttcgatgattaccttaagaagtttgaaattgcttgttcaccatggccaatggctgaatatgctcattgggctttaaaaagactattacagaatagccttggagacttatgtagtgtttgggatgccatgaacaacatgatcacactacaacacactgaaattaatgcatcctttgagacaagtacacatgtggttggtcatgttttttaa

SEQ ID NO: 83531 - DNA, 393 bp, Glycine max
  Peptide Sequence Number=SeqID_175216
atggttcttggggcaagtaatccccttgtacttgtcaaagtccagcaccttgaacttgagaggggtgatgatattggtatagggacaactcttctaggtgtagttgtgggtgatactgagaaccctccaaagggttttataggggtatactaccaactgcttgcccttcagtggcatatccgagccaaggctcgaagtcggctagattgtgatggggaatttcatgtgtctcccccacggagtggagttattgacattcttattgggagtgtacgccacattgggtggcgtatagttgagaggcaagccatatggcaggaaggcatgctcgttttgaatttgcacatcatggaggccgcccatactacccaaatctttgcctaccatatctga

SEQ ID NO: 83532 - DNA, 342 bp, Glycine max
  Peptide Sequence Number=SeqID_175217
atggcatctaagaagagaaaagcaccctctacacctacccaagccagatttgatagatgcagattcacatcccaagaggcttgggagagatacactgacattgtggtgagggtgagaggtcatttagtgaagtttgatgaggatactcttaacacattcttgaagacccctgtagtgttggaagagggggagaacttgtgcacttattccaagtttgcactcctgaggcctgatcctcaagagttggctgctaagctttgtatcccagggaggggattcgagcttaatgctgatgggctagctttgaagattctaaggaagaacatgactactctagcttag

SEQ ID NO: 83533 - DNA, 315 bp, Glycine max
  Peptide Sequence Number=SeqID_175218
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttggatctccgtgtggggcaagttgaaacatggatgccagggtggctagtgcgtcagccatctgattctcttcccgag

SEQ ID NO: 83534 - DNA, 936 bp, Glycine max
  Peptide Sequence Number=SeqID_175219
atgatgaatattatgcatccggcgctcagacgcctcgatctcaatctgttgcttgtttttgatgccatctatcgccacagttccgttcgtctcgccgccgatgagctggcgatgagtacatccgcgttgagccacgcgctgtcgcggctgcgcgtggcgctgaacgatccgttgttttttcgcgaagggcatcggatgtgcccgagcgtctatgccacgcaactcgcgccctccatcgcttcagtattgaaattgcttaatcaggaactcacgcgacagccagaatttagtgccgccgacagcacagagcggatccagatagccattaccgatttcaccgcgttatgcattttccctgcgctaatgcaaaagctgcagcatgaagcgccgggcctgcgttttgagctccgttatttgccacatagcccggcgctgacggagctactggcgggggaggtggatctggcgctgggcttcagcaccgctgaagatattcgtcatcatgaactggaggaaattgactggtttgaggatgagtatgtggttatcagccatacccgtcgcacggcgctgacgctggcggattatctcgccgcgcggcatctggtggtcacgccgtggaacgaaaagcagggggtgttggatttacgtctgcaggaattaggctatacccggcagatagcgctcaaaaccccctcaatgcttagcgcgccgtttattgtagcgcaaagcgatctgttaatggcgattcctcgttatgccgcagagaagttccttcatgccgccccgatcgcgatttttcctttgccgttcgccatcagcccgttcaccgtgaagatctattcccataaacgcggcgggcagcgaggggcaaccaaatggctgaagacggcgctacaaagcctggcgttggcagagaacgccgggagtttttaa

SEQ ID NO: 83535 - DNA, 396 bp, Glycine max
  Peptide Sequence Number=SeqID_175220
atggctagaacttttcactcggatgtccgattcatcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 83536 - DNA, 1077 bp, Glycine max
  Peptide Sequence Number=SeqID_175221
atgaatgagtggcctgtgatcaagccactcccatcatacggtagaggaagagacgcaccagcgggaagatacaccagcttcatatttggaacaaacctcactgatgttattgtcacaggggacaatggcaccatagatggtcaaggagcattttggtggcagcaattttacaacaaaaggttgaactatactcgaccctacctgattgaattaatgttctcagacaagattcaaatctccaatctaacgttcctgaattctccatcatggaatgttcatcctgtttatagcagcaatattattattaagggcctcaccatcatcgctcctgtcccatctccaaacacagatggcattaatccagattcttgcacaaataccagaattgaagactgctacatagtttctggggatgactgtgtggcagtgaaaagtgggtgggatgagtttggcataaagtttggatggcccacaaaacaactagtaatcagaaggctgacatgcatttctccacaaagtgcagccattgccttagggagtgaaatgtcaggtggaattcaagatgttagagctgaggacattacagccatccacacagaatcaggtgtcagaatcaagacatcaatagggagaggagggtatgtgaaggacatatatgttagaagaatgaccatgcataccatgaaatgggcattttggatgactggtaactatggttcctatgctaataacagccactatgatcctaaagccttgcctgagatcaaaggcattaactatagagatgtggtggctgataatgtgaccatggctgctaccttggaaggaatctccaatagcccttttactggaatctgcattgctaatgtgacaattagcatggcagacaaagccaatgaaaagccatggacatgcactgatattgaagggatcacaagtggggtgactcctaagccatgcaattctttacttgataaggggccggagaaaatcaaaacatgtgattttcccccagagattctaccaattgatttgttagagcttaagaagtgtacttataacattaagcatgcatga

SEQ ID NO: 83537 - DNA, 1761 bp, Glycine max
  Peptide Sequence Number=SeqID_175222
atgttgaatcaagattgcttccatcttgatttccataacccgaagccattttcccctgaaaacttctcaatatcgtactttgttgttcccatctttcttgatcttgacctccccacagacggcgccacttgttggttcttttcgtataaattctgctatactttaaacctgcacaagatcaaaaaacaagaaaaacacagcaagcaatacacagcaaagcaagaagcaaagatttacgtggttcggcaatgtgcctacatccacgggaaagtgcagctcctcatcatcacattgatcatgaaattactagttcaatacaagcagcagctagctttgatctttcttgagcatatgcagcaagcacatctaggaaatatggctgagaatccaattcgtgtaacgatgattccatggtctgcctttggccacttgataccatttttcaaactttccatagccttagccaaagctggtgttcatgtctccttcatttccactcccaaaaacattcaaaggcttcccaaaattccttcgactttatctcatttggttcattttgtggaacttcctttaccatcattggacaatgatatcttgccagaaggtgctgaggccaccctggacattccatttgaaaaacatgagtacttgaaggcagcatatgataagctccaagatgctgtgaagcaatttgtggccaatcagttaccagattggataatctgtgattttaatcctcactgggtggtagacattgcccaagagtttcaggtaaagttaatcttgtttgttattatatctgctactggagcaacattcataggaccaccaggtacaaggacaggtcccttatctccagaaagtctaacagctccaccagaatgggtgacatttccatcttcagtggcttttcgaaaacacgaggcaatacatttctgtgctggttcctacaaggtaagttcttccggggtaagtgatttcgaaaggattataaagttacatggtgcctctaaagctgtgttatttcgtagctgctacgagattgaaggagaatatctgaatgcatttcagaaactagttgagaagcctgtgattccaattggtttattgcctgtagagagacaagttgttgatgggtgtagtgataccatatttgagtggcttgataaacaagcatcaaaatcagttgtgtttgtggggtttggcagtgagttaaagctgagcaaggatcaagtttttgagatagcttatggacttgaggaatctcaattgccgtttttatgggcactgagaaaaccaagttgggaaagcaatgatgaatattctctacctgttggttttattgaaaggacttctaacagaggaagtgtttgtaagggatggataccacaactggaaatattggcacattcatctattggaggatctttgtttcactctggcttgggttctgtcattgaaaaccttcagtttgggcatacacttgttgtattacccttcaatatagatcaacctcttattgcaaggtttttggtggaaaagggactagccattgaagtgaaaagaaatgaagatgggtcattcactagaaatgacattgccgcatcccttagacaagccatggtattggaggaaggaaagaagatcagaaataatacaagagaagctgctgcaattgtaggaaacttgaagctgcaccaggatcactacgtagctgcatttgttcagtttcttaagaatggaatctggaaaccaatatga

SEQ ID NO: 83538 - DNA, 1422 bp, Glycine max
  Peptide Sequence Number=SeqID_175223
atgagagagcatatgcagcaagcacatctaggaaatatggctgagaatccgattcgtgtaacgatgattccatggtctgcctttggccacttgataccatttttcaaactttccatagccttagccaaagctggtgttcatgtctccttcatatccactcccaaaaacattcaaaggcttcccaaaattccttcgactttatctcatttggttcattttgtggaacttcctttaccatcattggacaatgatatcttgccagaaggtgctgaggccaccgtggacattccatttgaaaaacatgagtacttaaaggcagcattagataagctccaagatgctgtgaagcaatttgtggccaatcagttaccagattggataatctgtgatttcaatcctcactgggttgtagacattgcccaagagtttcaggtaaagttaatcttattttctattttatctgctactggaacaacattcatagtaccaccaggtacaagggcaggtcacttatctccagaaagtctaacagctccaccagaatgggtgacatttccatcttcagtggcttttcgaatacacgaggcaatacatttctgtgctggtttcgacaaggtaaattcttccggggtaagtgattttgaaagggttataaagatacatgatgcctctaaagctgtgatatttcgtagctgctacgagattgaaggagaatatctgaatgcgtatcagaaactatttgagaagcctatgattccaattggtttattgcctgtagagagaggagttgttgatgggtgtagtgataacatatttgagtggcttgataaacaagcatcaaaatcagttgtgtttgtggggtttggcagtgagttaaagctgagcaaggatcaagtttttgagatagcttatggacttgaggaatctcaattgccgtttttatgggcactgagaaaaccaagttgggaaagcaatgatgggtattctttacctgttggttttattgaaaggacatctaaccgaggaagagtttgtaagggatggataccacaactagaaatattggcacattcatctattggaggatctttgtttcactctggctggggttctgtcattgaaaaccttcagtttgggaatacacttgttttattaccctttaatatagagcaacctcttaatgcaaggtttttggtggaaaagagattagccattgaagtgaaaagaaatgaagatggatcattcactagaaatgacattgccgcatcccttagacaagccatggtattggaggaaggaaagaagatcagaaataatacaagagaagctgctgcaattgtaggaaacttgaagctgcaccaggatcactacgtagctgcatttgtacagtttcttaagaatggaatcaggaaaccaatatga

SEQ ID NO: 83539 - DNA, 1488 bp, Glycine max
  Peptide Sequence Number=SeqID_175224
atggcagctgttaggtcttcctctgtaagaaggttgccaagtgattcactgagtcatccttattacaaaagagagctacagtttgctaagaatcggtttagtaatttggcctctgaatcccttggaagtagtcatcactttggcactagagccagtgtatcggtaaaaccaacattctctggttattgttttcgtagtgcccttccttttgcttccatgagccacgtgttgaatcatcgaatgtattcgtcgtcagtaggtgacaaaggaagtagagatggtggtacagaagtttctgctggttctggtgcaactgatattaataccactggtgattctgttgttgggggtgattgggctgagaggattaaagatgcctggaagagtgtggcagaggcagcatcatatgcagggggtaaggtcaaagaaacttctgatgatctcactccatttgctcaacagttgcttgattcacacccatatcttgataaggtggttattccagttgctggtactttaactgctaccatattagcttggttcttgctgcctaggattttgaggaaatttcacaaatatgcaacgcaaggtcctgtttctctattgccagcaagcgtgtctgtggagccagttccttatgagaaaagcttttggggtgctatggaggatccagtgcgatatttagttaccttcattgcattctcacaaatttatatgacagctgactttgatttccagtggtgttatggtggctccaacaactataacctcacaatatcttgcacctctttggagggtcaaagtttacttgggcttgataaggagaaagtgcttgctctagacaaaatctcatctattggtctatttgtgattggtataatggctttggctgaggcttgtggtgtggccgtgcaatctgttgtgaccgttggtggtataggaggtgtggctactgcttttgctgccaaggacattcttggcaatgtgttcagtggtttatctatgcagttttcaaagcccttttcaattggagatacaataaaagctggctcaatagagggtcaagtggtggaaatgggtcttacttccacatcattgctgagttcggagaagttcccagtcattgtgccaaactcatttttttctagtcaggttattgtgaacaagtcccgtgctgaatatcttgccattattaccaaaattccactgcaaactgaggatttaagtaagattcccccgatatcagatgatgtgaaaagcatgctcagatcaaatgcaaaggttttcttagggaaagatgttccctactgtttcttatcccgtatagaaagttcatatgcagaattgactcttggatacaacctcaaacatatgcgcaaagatgaattatactccgcagaacaagatattctcctacaggcagttcaaatcattaagaatcatggggttgctcttggcagcacatggcaagacacgtcttctaaatga

SEQ ID NO: 83540 - DNA, 2157 bp, Glycine max
  Peptide Sequence Number=SeqID_175225
atggctcaagaaaccggggtgaaaacttcaccttctcaagaaaaatatgggagggttcaatttgcaataaggctgttagtgctggtattgtttcttggttggattttcatttggataatgtcacccacaaatacttttagacaagcatggctgcctcgatacaaagcaaaaactaataatacaacttattttggttcaaaaggtgcttatcttctgttgtacactttcccaatcttactcattgctactttgggatgtgtctaccttcacataggcaaaaaagtaaatgattccaacacagagagctgcaatgcaaagaaatttaaggcaaccatatggaagcgtccagtgcttataaaaggccctcttggcattgtttctggcacagagctagcattcttgtttatgttcattctactcctaatttgggtctttgcaacttctgtacacaacagctttgcaacaatcaccccgcaattagcagcaaaggatggcgagaaaatgtgggaagagaagctagatagtgtagcactaaggttgggtgtggttggaaacatatgtttggcattcatgttttttcctgtggctcgtggctcatgcgtgctgccactgcttggcctcacctcggagagttgcatcaagtaccatatttggcttggacacatagccatgttactcttcacttctcatggcatttgctacatcatcctatgggcagttactgatcatatttctatgatgctggaatggaaaaagaatgatatatcaattgtggctggagagatatctctgctttctggtttgttcctatggattacaactattccccgtataaggagaaaagtctttgagctgttctattacactcatcacctctacatcctcttcatagtcttcttcatctttcatgttggcgtttcctatgcttgcattatgctccctggtttctacctctttgtggttgatcgttacttgcggtttctgcaatcgaggcgccaagttcgtttggtttctgctcgggttttgccatgtgaagctgtagaactcaacttctctaagggccatggattaacctataaccccacaagtgtgatgttcataaatgtaccaagcatatctaagttgcaatggcatccatttactgttacttctaatagtaatttggagagagacaagttaagtgttgttgttaaaggtgaaggaacttggaccaagaagctctatcagatgctttcaactccttccacaatagatcgccttgctgtatctgttgaaggtccttatggacctgcttcaaccaattatctaagacatgacactcttgtgatggtgagtggaggaagtggcatcacaccttttatctccatcattcgggaactaatatatctgaacactacattcaaatgcaaaactccaaaagttgtcctaatttgtgccttcaagaactcttcatctctgtcaatgctagatatgatcctcccaatatctggcaccccatctgacatttctaatatggaattacaaattgaggcctacatcacaagagacaaggagcttaaagcagattgcccaattcaccctcaaaccatatggttcaagccaaatccatctgatactccagtacatgctatattaggtccaaacagttggctctggcttggtgctataatatcatcctctttcatcattttccttatcttgatagggatcattacccgttactacattttcccaattgatcataactcaaataaaatattctcattccctttgaatgcgttccttaacatgctagtaatatgtgtgtccatagcaagtgctgctagtgcagtttttctttggaacaagaaacataatgctaaagaagcaaaacaggttcagaacatggaagggtcaacaccgacagcgtcaccaaactccatggtttgcaatgcagatagagaattggaaagccttccatatcagtcccttattcatgctaccaatgtgcattatggtgtaagacctgacctaagaagaatgttacttgaacacaaagagtcaagtgtgggagttcttgcttcgggacccaaaaaaatgcagcaggaggttgcagccatttgctcatccggtttagctgacaatctgcattttgagtccattagctttagctggtga

SEQ ID NO: 83541 - DNA, 177 bp, Glycine max
  Peptide Sequence Number=SeqID_175226
atggaagaccatggtgatgatgacacagggataatggcagtgatagatgggccttacatcgccgttgtcgtcctctctgccgccaccgttgccgtgccagagatcatggcctccggcggcatcttgaccggagcagtaacttcttataaagcgagtgagaggctcgcctttgaatga

SEQ ID NO: 83542 - DNA, 387 bp, Glycine max
  Peptide Sequence Number=SeqID_175227
atgactatgcagaacatgcagtttctacaagagaccagagcctccattcagagcttaactaatcagatgggacaattggctacacaattaaatcaaaaacagtcccaaaattctgacaagctgccttctcaagctttccaaaatcccaaaaatgtcagtgccatttcattgaggtcgggaaagcagtgtcaaggacctcaacccgtagcacctttctcatctacaattgaacctgccaaacttcactctactccagaaaaaggtgaatcttccactggtaattctgatttgcagaagcagcacatccctcctcttccattccctccaagagcaatttccaacaaaaaaaatggaagaggcggagaaagagatcttggaaacatttag

SEQ ID NO: 83543 - DNA, 237 bp, Glycine max
  Peptide Sequence Number=SeqID_175228
atggcacgcagcgtgtttgctccgtgcccctatttaaggggcctatatgggagggagctaaaagggcttttagtgataattcccaaggcggtcatatctctcttaatggtctctagagtcccccagtggagtcgccaactgtcgcaacctacccttcggcgggagggcgacgcggggctcgtgggtgcgtcttccaagaaaggaatacgcgtggagtcgccaccaacgtttatttga

SEQ ID NO: 83544 - DNA, 348 bp, Glycine max
  Peptide Sequence Number=SeqID_175229
atggctcctccaaacaatccagtgaattccaccttgggatttaagtcactggaaaaggtttttgatttatgtgacgggaaattcaccgtgagaggtgtgccattactctctcaggtacccaataacgtcactttcagttccttctcctcaatctgtgaaccccgtgacgccccaccttccatccttcaacgtgtcattgccgtgtcacacggctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaa

SEQ ID NO: 83545 - DNA, 500 bp, Glycine max
  Peptide Sequence Number=SeqID_175230
ggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacgctgataccgctcgccgcagccgaacgaccgagcgcagcgagtcagtgagcgaggaagcggaagagcgcccaatacgcaaaccgcctctccccgcgccggataacaatttcacacaggaaacagctatgaccatgattacgaattcgagctcggtacccaatgttgcctacgacgacggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 83546 - DNA, 237 bp, Glycine max
  Peptide Sequence Number=SeqID_175231
atggattggatgcatgaacttgaggatgatgaaggccatgagggcatcatccacagaagatggttcaaggcaaatttgtcccgaatttgggggaggtattatcaaggagaatctggcagagcatcaacatcaaagccacgcgctaagcgcaagatcagtgcgctaagcgcagcaggtgccttcagcaaggctaagctcgagactggcgctgagctcgatttcacttactctcgctaa

SEQ ID NO: 83547 - DNA, 432 bp, Glycine max
  Peptide Sequence Number=SeqID_175232
atgaaggctgacatggaggccatgaaagagcaaatgaccacaatgatggaagccatgatgagtatgagaaaaatgatggaggtcaacacagttacagtcattgccgcaagtactgccactgaggtggacccgactcacccatctggcctcaatcaagtaaatcgtccagtcttgaatatggtaggtcagggaggcagagcattgggaagtatggatggccctcattttgtgcaagtccaaagcaagcattccttcccaccatatatggcttgtctcccaactatgcaccaccgaaagttgcacacgctcccaatgagaatgtcgataactctactcccatactcattgagagtcaataaccccaatctggtcatgcacgagtctctcaacccatgggggagacacatgaagtatcccgagaccccactctag

SEQ ID NO: 83548 - DNA, 267 bp, Glycine max
  Peptide Sequence Number=SeqID_175233
atggataaagctatctctagaatatgtccattggatttaatgatgaaatatgtgcaatttcagttgagcttagctcatcagtgggctaagcgtgcatccactgctaagtgtagcttcaacgcacttagcacgacagaagaatctaccagggcatcagcatcaaggacgcgcgctaagtgcgagattagggtgctaagcacaacaggtgccttcagccaagctcggtgcatgactggcactaagcccgaatccacttactcgcgctaa

SEQ ID NO: 83549 - DNA, 1165 bp, Glycine max
  Peptide Sequence Number=SeqID_175234
tcattacgacgcgctgggccgccgcagccgcaaggcggtgcgctacaagggcaaaaccgaacagacgacccgtttcctgtggcagggttaccggttgctgcaggagcagcgcgacgacggcagccgccgcagctggagctacgatccggccagcccgtggagcccgctggcggcgctggagcaggcgggcgacagccgctcggcggatatttactggtatcacaccgatctgaacagcgcaccgctggaagtgaccgacgcggcgggtaacctgtgctggtccgggcaatacgacaccttcggcaagttgcagggccagacggtggccggcgcggcgaagcggcagggcgcgcaataccagcagccgctgcgctacgccgggcaatatcaggacgacgaaagcggcctgcactacaacctgttccgctactacgaacccgaggtggggcgtttcaccacgcaggatccgatagggctgcgcggcgggttgaacctttatcagtatgcgccgaacccgctgatgtgggtggatccgttggggttatctgtagaaggagttccacatggctttaatagtttcggccaatttaaacaattcggtgaagcattacaggcaggaatgagtaaattaggatatcccggcacagtttcatatatgcaaggaagctccgtatcgggggtaagtttctctacaggtcaaccatttgatgttggccgtgttagtgattttgacgttgctatttcacatcctgagctatatcaaaaagcagaacagctgggaataggaaaaggagggcgcactggaccaattgatatgggtagtgaaatggctaagaaattaggtattgatgatacattgcaaaaattatctaaaatgtcaggaggtagacctgtgaacgcaatggtctttgagtctgctgctgaagttaaggctaaaggaaagggaactagaatacctgacaagttaaccattactgataattatattcctcactctaatgagtggttagaggaagataacaaagagtttagcacgataattaaggtgtctttcactaatgggaagaatccagaaaaactcagcaggtacaaattcttgaagaatgcgtttaatcaacttgatggattatcgatcataagtgatgagtgcatcgaagaagagtga

SEQ ID NO: 83550 - DNA, 567 bp, Glycine max
  Peptide Sequence Number=SeqID_175235
atgtgtgccaagaaagggaaggaaaattgggaagaactcttggtaggtatggtaggggcgtccgttaattggttcccccgatggaaggaaggaggggctggagttttgtgctcatatgaagggttcccaaacgtccccttgatgggaacaatgagttgtattaactataatcccatactggccatcagacaactaggctaccctatgagaggggcaccatcggaagagggtatcgcacctttcatcgcacgaggtttcagtgaaggcaatgcaaaaatgcttcaaagagtccgaaaaacgtggaataccgtggaaagaaaagataaggagcttagaggaatcagcaacgatgttagtggcggctatcataaatggttgaaggctcggacgcaagggataacttggctcccgaagctaaagatttcaagtggtgaagaagtcgaagtccctgaggagaacgaagaagtgcaagccttgaaggtggaacttgaaagaatgcgagtggttaaggaaaagttcaagatgaaagccaccagggtcaggaaagagtgtgacgagctgagggat

SEQ ID NO: 83551 - DNA, 1407 bp, Glycine max
  Peptide Sequence Number=SeqID_175236
atgacatcttcgagggctgatggtgccatcgaagtcacacaggatgctccagtgcatgggcagtcacgcgcgggccagcacctgcagtattccggctgtctcttcacgggtctgccaggcgctgttgccaagggtcagcatgcgtgcggcgaagtcgcgtgcgttgggcatgtcgtcctgcggcacgatgccgcgcaggtacgcgtagtcgggcagggcatggatgaacatgcggctggcgccgagcccgcgtggccacaggtctttcaatacggcatcgcgggcgcgctggctgggcagcagcagcatcagcatcggccaggtgccaccgctaccggcaaggccgtcgaccacctcaacggctggcagctgtgccagctgcacgcgcagctgcaatgcacgcaggcgccctgcctgcaggaaggccggcaggcgccgcgcggcacgggcaccgatgttctgccgccactggctgacccggtgctgcggaatctgcagcgggaaaatgtcaccgaccgcttcttccaggtcgccacgctgcaacgcactgcgcagcggatagccgtacaccaacgacagcagcgatggccgatagcaggcggccaggccaagcagctgcagactgcgcagcagttcccagcgcaggctggaacgcacctgttcggcggcatgtccggccagcgcggcacgcagctcgtcatcgcggctgaccagcaggccgccttcgtgcaggctcaggcccttgccggcggccaggctgaagaatccgatatcgccacgcaggccgacactgctgctgccgacccgtgcaccgagcgcctgcgcggcatcctcgatcacccaggcgccagcgccgcgcgcaacctcgcaggccagctcgacatcggcgatgcgcccgcccaggtgggtgggcaggatcgccagcgtgcgtgcgtcggccaggcgcttgagctggccggggtcgaagtcgaaatggccgtggcgggtatcgcacagctgcacgcgcaggcccaggctgtgcaccgcgatcggcaccagcgggcaggtataggccggcaggatcacggtgtcgcgcttgggcgcacgcttgcgcagcgtacgcagcgcgatcagcagcgcgtgtgtgccggaacaggtcaactgcagcggcggtgtgccgagctggctggccaggatcgcgcgcaggtcgccaccaccgggcaggaaatcgctggcctgcatcggcaggccagccgtcggtggcagttcgcgcgcgaacaggctcatcgcagggggctcacgcggcgctttcggcggggctgtgcgggtcgtcggcttccgcgcggccgaggcagacgatgccggccacgatcaacaccgcaccgagcagatggtgcagcgtcagcggctcgttcggggatcctctag

SEQ ID NO: 83552 - DNA, 228 bp, Glycine max
  Peptide Sequence Number=SeqID_175237
atgggtgaacatcaacaaaactggaaggaaatggctaacataatgatgaagattaacaaagaatcagatgaaatgttcaacgctccttatgatgaagtgagtaggtcattttctataagatggaaggatgaactagagcctacatggcatctgctacactcaagtggcaacatgcactctatcacatataaccaagatttggcgaccccaactctacttgctggatga

SEQ ID NO: 83553 - DNA, 240 bp, Glycine max
  Peptide Sequence Number=SeqID_175238
atggataccttagagccctgcgctgggtcgtgtggatttgggatgaccgaccctctcgatgagtcgatctcttgctttctcataagggtgaacccttgggtactagtaccctcacctccagaggacttcatgtcctcacctttagaggactacacgtcctcaccttcagaggacgacacgttctcgccttcaaagggtcatgcaccttcaacttcagaggactacacctcctcgccgtaa

SEQ ID NO: 83554 - DNA, 271 bp, Glycine max
  Peptide Sequence Number=SeqID_175239
acttatcttccttcaccggaagtggcatctacccagacttatcttccttcactggaagtggcgtctaccgtgacttatcttccttcattggaagtggcgtctacccagacttatcttccttaactggaagtggcgtctaccccgacttatcttccttcaccggaagtggcgtctaccctgacttatcttccttcacaggaagtggcatcatccaaaccttcgtagcctgtgtcaaacgatccgcccgcgatttaacgattcacatcaaaaa

SEQ ID NO: 83555 - DNA, 144 bp, Glycine max
  Peptide Sequence Number=SeqID_175240
atggagtataagcaaacacagattgtaactatgcaagccttaagccacataaacactactcttgatttccagggaattggaaaggaggactggtgtcatcccttaaagaatttgagtcaagaagcaacgggccaaccaccttaa

SEQ ID NO: 83556 - DNA, 438 bp, Glycine max
  Peptide Sequence Number=SeqID_175241
tgccggaaggtcaaggaagttggtgacctgatgacaggggagccgacgaccgaagccccggtgaacggcggccgtaactataacggtcctaaggtagcgaaattccttgtcggactcggtgaaatagacatgtctgtgaagatgcggactacctgcacctggacagaaagaccctatgaagcttcactgtttcctgggattggctttgggcttttcctgcgcagcttagagccatcagtgagataccactctggaagagctagaattctaaccttgtgccaggacctacgggccgagggacagtctcaggcagaagggagcttgactgcaagacccacccgtcgagcagggacgaaagtcggccttagtgatccgacggtgccgagtggaagggccgtcgctcaacggataaaagttactctacggataacaggctga

SEQ ID NO: 83557 - DNA, 219 bp, Glycine max
  Peptide Sequence Number=SeqID_175242
atggccttcatcatcctcaaattcatgcatctagtccatacatcagagattcacgcaaaaatcagctgctctggctccacaactggtgtagatggctgggtctcctcaggagtagtctcctcctctgctggtgctggtgctggtagctcctcggtcataggctcctgggctgcaaaggcttcaccccttccagaagaagagggctggtctcctagctag

SEQ ID NO: 83558 - DNA, 67 bp, Glycine max
  Peptide Sequence Number=SeqID_175243
gctacgaaggtttggatgacgccacttccggtgaaggaccgatcagtcagggtagatgccacttccg

SEQ ID NO: 83559 - DNA, 192 bp, Glycine max
  Peptide Sequence Number=SeqID_175244
atgtcttcctcccccgatacaacgaccaaatgcccctccactacgaacttcagtttttggtggagtgtagagggaacgactcccaccgagtggatccatgggcgccccaaaagacaactggaggtcgatctctcccctcacctctcgacggcttccgtcgaaggcacagaccaccatggaacttggccttag

SEQ ID NO: 83560 - DNA, 486 bp, Glycine max
  Peptide Sequence Number=SeqID_175245
atgatcaggacattaacctatgaaaataggcgtatcacgaggccctttcgtctcgcgcgattcggtgatgacgcggatgccgggagcagacaagcccgtcagggcgcgtcaacgggtgttgaagggtgtcggggctggcttaactatgcggcatcagagcagattgtaatgagagtgcaccatatgcggtgtgaaataccgcacagatgcgtaaggagaaaataccgcatcaggcgccattcgccattcaggctgcgcaactgttgggaagggcgatcggtgcgggcctcttcgatattacgccagctggcgaaagggggatgtgctgcaaggcgattaagttgggtaacgccagggttttcccagtcaagacgttgtaaaacgacggccagtgccaagcttgcatgcctgcaggtcgactctagaggatcctacggaacttgcagtatcaatgacagattttggaacagtatgctaatgatttaa

SEQ ID NO: 83561 - DNA, 459 bp, Glycine max
  Peptide Sequence Number=SeqID_175246
atgacgccgaccaggatccagatggtccccggcaggaagcccatctgtgcggccagaatcgcccccaccagcggcccggcgccggcgatggcggcgaagtggtggccgaacagcacccatttgttgacggcgatcgtccagttcaaagaccttgtcggcaatgaaccggctgtagaagcggtaggcgatgctgtagcaggcgacggcggcgaccaccagccagacggcgttgacgtgttcgccgcggctgagcgccagcatggcgaaggcgaaggcgccgaccaacgccaccagcagccagataagtccggacctgatgtttttcatgaaacaactccttggcgtacagaggtaaaaatcgacgttgttatttggaatgacgttttaacagtagaagttttgccgctgaactgcggcaggtcggatgagaaatgtgaagcaggtggggttttagtgtaa

SEQ ID NO: 83562 - DNA, 1876 bp, Glycine max
  Peptide Sequence Number=SeqID_175247
tgcggcctgtggtgcggcgagactggaggttatcgcggccaagggtgagtatgaaaccgggccgtataactcgaaggtgagccagcaatacgcggatgcttacggccagatagtgaacctgctgaatatcaccagtgttgatgcgcagagtcagcaacaggtgaaagatgcgatggtgaactatgccatggtgcagcttggcgtagataaggctacggcagaggcttacatcgaaacctatgatgggatgaagattgtagcggcctcattgactcctgtgcttggttcagcggcagcgaaacagcttggtaagattgttgatgcgaatctgaaggtcgtggcgaaagggaacgtagatggtagtaagtttactgatactaaccaaggtattagaccttcacagttagccgattttaataaaccgactcttatcaacgatgtggtacaggccaagatagataagaggcctgataaaaattaccctaatggaaatatgggcaccgctcatgcagaaataggtgtgattcagcaagcctttgataaaggaatgactcaagggcgtgaaatggcgatgagtgtagctggtaaggaagtatgtaactactgtctgagtgatgtaagaactatggcagaaaaggccggattaaagtcactgacgatatacgaagaagcaactgaagttgggcctgaaagactcagtgttgaggcagagaatggcttttatctggtgactttgcttgaatatgatgagtctgggagcgatgtaaggtctatatgggatcaaacttcttcttctggggaaaatgtcatgattcttggtaattactggccgaagcggcagcttactaaggactttgatcttgttgtcaggatctttaaagagttctttgatacaggcaatccagtcgccagcgataacctgctcgccgttctctcgcgcctggtcggcccccaaatcttgccgctgttggctggcctggcagagttcgcgccaggtggtcttatcgttgtcatgaggaccggggtaaactcgagtgtagtgatcgcgtctgctgaggcgaaaaacgccgccgccggcttgcagccgggagacagaggtgcagcacaaggcgccaccaacacggcgggggcacgaccaacgagtgatggtacagggttagtaagtgccgatggaaccagaatttaccgttcgccaaaagaaaagccaaatactccagggccagtaggggaggagggaatcaatcattttgatgtttttatctgcacccctgaatggctctgcaagcaccactggctgccggaactgatgcgtcacacgttgctggtacgtaaatacgatttggatgagataaccaaaaccatcaccgattacatcgatcaatgtgaaggcgatgactggatggagattgctcagaaactctctcgtgtttttgcttgggaattcgaagattaccagccttaccatcccgggcacgccgagggtacgacaaaagccggggtcagtgagggaacgctgatagtccgtgacaccgacaaacagcaacaggatgtggcgcagctaaaccgggataccgaacatgccaacgacggcagcatcagcccgatattcaacaaggagaaggattacgtcaagactgttattttctgcgataagccacctgctcgaactgagtggtccctgaaaatctcctatctcctatctcctatctcctacctcctatctcgtgtctttactgcacgttgtggtctagcgtcaggcgaacggcatggccgggcggaggcggatgccgccgtaaacgcaatattgcccagcggcgcgttaacggcccaaccccttaagcagcgtactgctcaagaggccggccgtttctcctaa

SEQ ID NO: 83563 - DNA, 518 bp, Glycine max
  Peptide Sequence Number=SeqID_175248
gttgggccccaggccaggctacacttgctagaaacttctcaacggtaggaatggatcctggaggtcccaccacctctgctgaagtggatgctggagtaggagttgcagatgtggaaggaagatcatctggcctcgccctcctagcccctcggatagatattgtcagatcatcaggattccaacagttcttcctaatggcggtgatcagagcaataaacccaagtctagaagagttagactgggccatggaagtcatctggctagaaatgagaactcctatgttcatgtccatgttggattatgagagaacacttcacacctgggataaggtagtcaaatctttcttgagaatcctcccaggatggccctcagcgttcaagatgaagcctcggcctgtatctggagtatgtgggcaaagtctcaccctctgccaacaccacaggtgtctccaggaatgtgttgaggctatcagcatcgatcttcactatatggcctctgaccctggcttgctttggtga

SEQ ID NO: 83564 - DNA, 192 bp, Glycine max
  Peptide Sequence Number=SeqID_175249
atggatatgaagttggggtccctcatctcaggtcaaatctctcttatggcacatcacgactcctcgaggctaggttttccatccttgattactgctttatgcaaggcccaaggagtcacatctgattctctgacctttgaatccctgagcccagccattaatttggtagcatacatcagggccaactcctga

SEQ ID NO: 83565 - DNA, 183 bp, Glycine max
  Peptide Sequence Number=SeqID_175250
atgtttgcttacagtcctttcgctaagctcaagcctcgtgctaaacgcatctttgttcatgcgctaagccacgattctcaagcgcttagcgataaaccctggcatctgaggttgattttgtccgctaagctggctaaggttgagctaagccaatttcaactcaatctgaattcggctaagtga

SEQ ID NO: 83566 - DNA, 273 bp, Glycine max
  Peptide Sequence Number=SeqID_175251
atgaaactggccaaatacaggctaaaggcccaagtggagaaggacgaaagcctaagtggagaaggacaaagcccccgagtggagaaggatgaaggcccagaggcagagacactatcaagacaattaattacttatcaaggtaatccttgtggcgtctaccctgacttatcttccttcaccggaagtggcgtcatccaaacctctgtagcctgtatcaaacgatccactcctactcaggttcacatcatctggtatcagagcttcggctcttga

SEQ ID NO: 83567 - DNA, 1164 bp, Glycine max
  Peptide Sequence Number=SeqID_175252
atgtcattagagaatgagtctgagatcacccatctcaagaaaaatcttaaagtccaaatggaaagaaatgtgtcactagagaaagaaaacaagaatcacagacaagaagtagcacgtttgaagtcacagataatgtcactcaaagcacataacatagagaggaaatccatgctgtggaagaagatacagaaagccatggatggtaataattcagatacccttcagcataaagcagcagttaaggtaacaatgcttgaaaagagtccaccaaatgagagagtgcatacaaattcagatttgctagaaacacctaaagttaaggacagatcagtaaaagtaccaccacctgcaccctcttccaaccctcttcttccttcacacaaaactgagaaaggaatgaaagtgcagccattggcattgccaagaacagcaccaccacctcctccaacaccaccaaaatcactagttggattgaaatcagtgcgtcgtgtgccagaagtaatagaactgtatcgttctctcacaagaaaggatgccaacaatgataacaaaataagtaccaatggaactcctgcagctgcattcaccagaaacatgattgaggaaattgaaaatcgatcaacttttctgtcagctgtagaatcagccacatatgcagacatttcagaagtagaagcatttgtgaaatggctagatggggagctatcatcactggtggatgaacgttcagtgctaaagcattttccacactggccagagcaaaaaacagatgcactcagagaagcttcttgcaactaccgaaatctgaagagccttgaatcagaagtctcatcatttgagaacaatccaaaggagccattggcccaggctttgaaaaagatgcaagcactccaggacaggcgagcatgtgcaaaactagaatgttcaagaagtgtgaacagtgcagagaggacaagggagagtgcaagtataagatataggagtttccatatcccttgggagtggatgctggacacaggcctcattggtcagatgaagctgagttcattgaagttatcaagggaattcatgaaaagggtaaccaaagagttggaatctaatgaagcctcaaaagaagataacctcttggtacaaggagttaggttcgcattcagagtacaccag

SEQ ID NO: 83568 - DNA, 2079 bp, Glycine max
  Peptide Sequence Number=SeqID_175253
atggagttaggttatggaaattgtgttgtgcatgattgtctcactagtgaaattgaaggggtgtttagttttttgaataatgcatggatttcagaaaccttggatttcaagttcctgttgaagcctaaggacagcaatacaccttgttttgttgaggagggtcctagccgcctgcttgtggggggagcattgcaagaggatgcaaggcttgcgttgtttaggcttgatagtggcgaggttcttgagtatcaagtgtttgttaaagcagacagggtttctccctttgaccttgcagctagttggagggcttatcaggataatttccgtccttcatctgtgagatggattccggatgtgagcataaattcagcacctcagactggtggtgaggcttactttatctttttggttcagaatggttgttctgtgggtttggaacttgatcttgagcattatgttgtcccaactcccgcaactgctgcaaattcagcacatgtatatgccgctaacatgacagagaatccaaggtcactaatttgtgggtctggcagcagttcatatcccatcaaggagatgcaggttattgtgcctgatccatctaagatttttcaaagttctggaatggttgaatccaagtcagttggaacattttcacctctgcaaaagcaagagagtcagaggggactttttgttgatagaggtgttggatctcctagacttgtaaaatcttctagttcaaatattttctctactgatctcaatttggataacgaaaccaagaattcaatgccagctgctgctggagccgtcgctgctgcagctgttgctgatcagatgctgggtcccaaggaagatagacatttgggaattatcctggtgggtctgccagccagaggtaaaactttcactgcagctaaacttacaagatatcttcgttggttaggtcataataccaaacacttcaatgttgggaagtatcgtcgccttaagcatggagctaatcagggactcaagtcccatgcattacaattggattctaacgtctatgcactaatcccaggtgaacactacaatgctggcagttccaatgtgagactcaggcattggcatgaaatagcaagtaagcagtctgctgacttctttcgagctgacaatcctgaaggcgtggaggcacgcaatgaggtagcagcactggcatttgaagatatgatatcttggatgcaagaaggaggccaggttgggatatttgatgccacaaacagtagcaaagaacgaagaaacatgctgatgaaattggctgaaggaagatgcaaggtttatgagacagttaatgaaggatcttacataaaaatgattgatatggtcagtgggcatggtggacaaatacaagtgaacaatatcagtggttaccttcctggacgaattgtctttttcttggatagtgaaatatttatatttaatagggtggggttaggatttcttgaccagattaaggtaaatacacatcttacaccacgcccaattttacttacccgacatggggaaagtcaggataatgtgagaggcagaattggaggggatactgcaataagtgaggctggagaactttattcaaagaagcttgccaagtttgttggaaagcgtctcaaatcagaacgggctgcttctatatggactagtacactgcaacgaacaattctgacagccactccaattgttggatttcccaagatacaatggcgtgcacttgatgagataaatgcaggggtgtgtgatggtatgacatacgcagaaatcaagaaaaacatgccagaggagtatgaatcgcgcaagaaggacaagcttaggtatcgttatcctcgtggtgagtcatacttggatgtcattcaaagattagaacctgtaattatagagcttgagcgccaacgagcacctgttgttgtgatatctcaccaggttgcagttttgagggcactatatgcttattttgctgacagacctttgaacgaaattccgcatatagcgttggagaaatcttcacttttggtgaatgatgatgaatatgctgaagatatctaa

SEQ ID NO: 83569 - DNA, 414 bp, Glycine max
  Peptide Sequence Number=SeqID_175254
atgttaattcttgctgggcacagttgcaagaagctgctccagttccttattgagactgaatttccatggagcagagaagcatggcaggaaacagagaacaatacacacaacaatacatggagcaaaatttttgagaatttccatggagcagagaacaatacacacaacaatacacaaaacacaaaacaagcagcaccaatgcaaaccaaaacacaaaacaatacacaatacataatatctaacggcaaggaagaacaagcatcacaggaggaagaagattcactaacctcgaagacgggagaagaagagaccgcaacagcaaggaagaagtcgcaacaccgacgaagaagaagaggccgcaaccgacaatggagaggccgcaggaggaagaagaagaggaggcaatgtggatga

SEQ ID NO: 83570 - DNA, 438 bp, Glycine max
  Peptide Sequence Number=SeqID_175255
atggtcgctaatgttgtggcaacacttgtcgatgatcaggaaaatagttgtagtcccatctttgagatccccagtcacacactgtccaagctccttactgctttaaatgaatgtacagaatgcaaggcagttgatggtcgtgagactgaaaaaatagtagaaagagctactcctcgctttcaacatgccaattgtgcagttgttctatcagttgttaagcttatcaccagtactgatgtggttcagaatctttgcaaaaagatggcccctcctattgtgacattgctctctgcagaacctaagatacaatatgtagcattatggaatatcaatcttatagttcaaagaagaccaacaatacttgctcatgaatttaatgcactgttgcaggctttaatatgtggaattggttaccttgagcagccagttttaacatga

SEQ ID NO: 83571 - DNA, 324 bp, Glycine max
  Peptide Sequence Number=SeqID_175256
atgaagattcttccactatacaaaatgatagtagggttacaaggatgtgtttacaaaattgaagaatggagaagagccatgcaagaagagatgcaatccttgcatgagaataacacctatgaattggtggagtggagaatagttatgcaagaagagatgaaatccttgcatgagaataacacttatgaattggtgaataacacctatgaattggtggagtggagaatagccatgcaagaagagatgaaatccttgcatgagaataacacttatgaattggtggtggagaagagccatgcaagaagatatgcaatccttgcatga

SEQ ID NO: 83572 - DNA, 669 bp, Glycine max
  Peptide Sequence Number=SeqID_175257
atgagctctaagttggatcacgtgcgggcagacatgctggagcttgtggcggagcagaaggagctcgcggcgcaactgcatgccgtggagagcgagcttgcaaaggtgagcacggaggctcagtttgtgccgacgattaaggccaatatagaggccatgcgccatgagattcaacgaggaaggctgagggtgcaacaatgtctggcatttcaccttgagttgctaaatgaagcagaagtggcagctgttgcagaagagaaagaaacccattcatttgaaattgatccttctcatgcactttacatgatgaatcctaataagttcagagcattctttgttgataatttgtttgctttcactgagtatgctatgaaactccgtaaaccaatgatatatggtgttacaagtcgtgttgagaggacaaaaattttgcaagcattcaaaactagcaaagatataagtactatttttctttccaaggagatgtattactcaactaagagacaacaatttttaattgatcaaggttacaactttaaggtaattactagcttgcctcctcctgatgaagggcctaatttgagctatcatcgtcttcaggatcaattggcacttcttggaaaggttaaatatgtttttacatcagtgcttccgttaaaaacgatgtag

SEQ ID NO: 83573 - DNA, 183 bp, Glycine max
  Peptide Sequence Number=SeqID_175258
atgactaatattttacccgaatgcagttctggtggcagatgcctctcagttgaatatacagacagagttaaagagttagctaagaagcatggactgaagcttcacattaatggggcccgtatttttaacgcattagttggtgagactgtacctgagacagataatctcagtcacattcactag

SEQ ID NO: 83574 - DNA, 138 bp, Glycine max
  Peptide Sequence Number=SeqID_175259
atggagcccaagtcccctaaggatatatacaaggcaatgacacttctaggtgactatatagataaagaagacacttcaatcaggattggtgtaattatgggtctgggaattgcatatgctggttcccagaatgagtag

SEQ ID NO: 83575 - DNA, 114 bp, Glycine max
  Peptide Sequence Number=SeqID_175260
atggtgtatatgtggaattatgctatgaagttagacgttctgatcatcgaaattaagagatttagggataaaaaagaggttgcagaacctgaggcagacccagaaagggattag

SEQ ID NO: 83576 - DNA, 384 bp, Glycine max
  Peptide Sequence Number=SeqID_175261
atgggagtcggtgtcacaatcaaacaatactttggaccgactctgaaaaaaccttgcacgtctacgtccatgacttctaaagacctagaacatctgacacaaaaaatcaaggaccaactggagctgttgctcactgaaaaaggactcgtactgcctcctaagcctgaggttggtccttttgttgctcctgtcaacacaaagggaagctctatcgatccctcggggcaagacccatacacagatgaatcagacaaatgtgggttttatgttgatggcattcatcctcgcctagttgcccttggaaaagtttatgaggggtcgacaatcatccacaacatccctttgggcaatcatcaagtgaaggtcggtgttgaggaagtttga

SEQ ID NO: 83577 - DNA, 519 bp, Glycine max
  Peptide Sequence Number=SeqID_175262
atggtgtgcttatgcctgacttgtggaaatgggagagttgatttgctccatcgcctgatcgccaccaaagtggtacctgaagatatgtcacgggggtcaggagaccttggggacgtcaggaggggtgctattgcccaaaaccaagcttggctaatcccgacccaacccgggcatagtcagtcagtgagaacctgtgacttgatccgtgatcgcgttgtgatggagtgcctaaagggtgtttgggagaccctcgaaggcaatgagaggtgccgattccgtggcacaattcgactcactgctacttcattagtacatccagaggaacccgtacgcacacttcaacagcctgtggagtggatactacctacacctactccatatcgactagttgagtcagttcaagtgatacaggtgtcatcctctgaagaggatcttgaggaggagccagaggagttacctcctgaacctgctatggacgcccttgacttacctgaggatgatgaagacccactccctgaa

SEQ ID NO: 83578 - DNA, 510 bp, Glycine max
  Peptide Sequence Number=SeqID_175263
atggtggcacaggtgatgctcaagcagggttatgagcccgaaatgggtctgggcaaggacggcctcgggaatgctgatgtggtcgacattaggggaaacccgtacaaatatgggttggggtatgaacccgggatgccgggaaggaggaatgcgtcgtccagactccgggcagatagggcatggcccggccatgttagccagtgtttcaccagtgccgggataatgttcgaggaagaggtggcgacaataggagaggagtctccacaagacccgtcaagttttgtgcgaccatgccatcccgattcccaatatagatatgaggatcgattctttgaggatcctaacagggagggtttgataatcgattttgaccgagaagtaagccaaacaataaatgaagaagaggaagaggacgtcctttcaccagagttggagaggttgatcgctcaggaagagcgccaaatgaagcctcaccaagaggagaccgaactgataaacttagggacttga

SEQ ID NO: 83579 - DNA, 351 bp, Glycine max
  Peptide Sequence Number=SeqID_175264
atgtactccacaaataactctgggtggagacaggagttaactccctataatcagtatgaagaggaaagagcccccgatcttgatagtgtgtttgcagaattcatggcatatcatgctagctctacggctaatcataatgcaatacaaaagcaggagattcaatgtgccaaagttggtaagctggtagaagaagtgatccaagctatgagcagaagagaagaaaatattgtagaggttgactctcaagaggagagccttgtgaatgagcatgatttagaagaagatgaggagaaagtgcaacagtggaaacagtgcttacaaacgcgtgctcaacaagaagataatttccaa

SEQ ID NO: 83580 - DNA, 69 bp, Glycine max
  Peptide Sequence Number=SeqID_175265
atggacagcagaaaccaatcaaggtgcttaggaatggatgcaagtggggatagggtcacgatcgactga

SEQ ID NO: 83581 - DNA, 261 bp, Glycine max
  Peptide Sequence Number=SeqID_175266
atgggggtgcaaatagcacccaagcccacttgggccctccagaaggctgttgcttctggaggaagcaacctggctcgcctgggcgagctgggcggcaagcatctcccctattttgctataaataggggaggaagtgaagaagaaaaggccgaggcgcttccgaaacgtttccgtaacgttttccgtgaagaattttgcaaaggtttcaaccgttcttcgacgttcttcattcgttcttcatcgttcttcgatcttcaacgg

SEQ ID NO: 83582 - DNA, 283 bp, Glycine max
  Peptide Sequence Number=SeqID_175267
atggcacgcagagacaaattatggtcattctgcgcccttttcgtcatccagaggtggcgagctccgatgaacatgtggggacaaattatggtcatttcgcaccttttgccatccagatacgatcgtgtccgatggcacgcagagacaaattatggtcattctgcaccttgtgtcaaccgagaggaacgaattcggcagtatcaggatgatgttggtcgttcggtgctgatcattttcaagatttttgcaggtagcgctggcgaggagattgaccggccgaatg

SEQ ID NO: 83583 - DNA, 258 bp, Glycine max
  Peptide Sequence Number=SeqID_175268
atggtagatgtacgccagaccacgtctcgcgtaacaggcttcgcgatatctcacgaaacactgttgcgctgcgacgacgcgccgggcatacatctacctaggcctcggcctgtggcggcccgccctttcaccaaacgaagttgccagctccgcttcgctccgccggcaactccgttcggcaggggccgggcctgcttggcctgccggcggcgatggtcgggccttcggcccgaccatttcagtctcgcgatttactga

SEQ ID NO: 83584 - DNA, 1185 bp, Glycine max
  Peptide Sequence Number=SeqID_175269
atgaaggagttttatgccaacctctatgaccccgatgataaatcacctaagcaggtgagggtgaaaggtcatttagtgaagtttgatgacgataccttgaacacattcttgaagacacctgtagtgttggaagagggggagaacttatgcacttattctcgatttgcactcctgaggcctgatcctcaggagttggctgctaagctttgtatcccagggaggggatttgagcttaatgctgatgggcaacctttgaagattctgaggaagaatatgaccacgctcgctcagacatggaacattctttctttttctaacctcattcctacttcccacacatctgatgtcactttggacaaagccaaattgatttatgggattattatgaagatggacatgaacctggggtacctcatctcccaccagatctctctgattgcacaacatgatacatccagacttggattccttgccttgatcacaactctatgcaaggccagaggagtccagtcaaattctagatccctggagaacttgagccctgccattaacttggcatatattaagaagaactgttggaatcttgatgatccaacagtgacatttagagggccaaggaaggccaggggtaagagatcagaggtccccactacttcagcaccacctgagacaccagcttcttcttcttccacaactccagtacctttctcaactctagttattcctcctacaccaactcagagaccacttccagctcctttatctgtaggaccatcagattttatttttacaccactgatgctgcacttcatgctccagagcatctacagggggcagtccatcatcatgcagagccttcagggcttgggcttgccatccatcatgagcatggaggagtttgatgtgcaggtggcctggccaggagtccagccttctccttctggagggggttgggcctctacagcccaggagcctgcttataaggagccaacagcagtagcagcagatggggaggatgagctcacccctcccgagcccttttattttaatgcagatgcacacatggttcaggaggaggggacttccacagatcagatacctgagccatctcctgcacttgttcctaaggagacccagccatctacaccaatcacggagctagagcagcctatccaggattcataa

SEQ ID NO: 83585 - DNA, 325 bp, Glycine max
  Peptide Sequence Number=SeqID_175270
ataccgctcgccgcagccggacgaccgagcgcagcgagtcagtgagcgaggaaccgggaagagcgcccaatacgcaaaccgcctctccccgcgcgttggccgattcagtaatgcagctggcacgacaggaaacagctatgaccatgattacgaattcgagctcggtaccccagtattcatagttggttccatcaagaattggtggaaaacaagttttgaggggctttatagggcagcaatagtgagctcaagctccgaagaggtgaaaggaatcatcacgggtcaaaggcatgatcttgaagaacgagctaaaggctttccttag

SEQ ID NO: 83586 - DNA, 624 bp, Glycine max
  Peptide Sequence Number=SeqID_175271
atgttcccacttggaagggatatgatatcaatcaatgttctttctacacaaagtcccaggatgataaaagtagtgtgcagaatagcggggtcagtgttgatggtcaatcgaatcacttttgcagtgctgctaacaataatcccattgaagcttgcatgccttactatggtgttattgaagagatttaggaggttgattacggtgaatttagagtacctcttttcaaataagatccatgcgactctagatgggcagtggttttgtaagggagaacaatttgcatcggtcaccttgttgatggatcaacacttgatgtcactgacatgccacctttctccaaagatattccttcaactattgttgaacaacaagagaatgatggccatggcaacaccaccaacgtcctcgccacaatcaaaaaaccctccagaggttacttcgaaaaggacaagacaatccacgaggcttagaagtctgacaactagatgcttagatggctcaaggccagttgtgaacgtgaatccggctacaggtcaacaaatatttgatcctacgatcaagtatggccttgatccaaaaacatgggcggaatttgccaaaagccacaaaacccctaattggcag

SEQ ID NO: 83587 - DNA, 642 bp, Glycine max
  Peptide Sequence Number=SeqID_175272
atggctaagtttgaccccgagatagtcctagagttctatgctaatgcttggcccatagaggagggagtgcgagacatgcgttcatgggtgaggggtcagtggattccctttgacgcagatgccctcaaccagttcttgggtgacccgctagttttggaggcaggtcagcagtgtgagttcagccagaggaggaacagggccgacgggttcgacgaggaggccattgcccagcagttatgcacaccgcgcaatgtcttgcctagcgatcataactccgatctccctctgcctaagtgccagttggtgtatgccatcctgacacggatgagcggccatgtggcccaggtgattactaacgcaatctatttgtttgcaggtatgccacccaccaggcaccctctagacccggataagtctaacagggccctggggtttccggcgctgattatgggcctctgccagtcattcggggttcccatcacccccagtaaagtgatccgactgccgatcacccgagccttcatcgagaagtactgcacgcctaggcaggcccagggtgatgcacatcaggccgcagatgcaccgccaccaactcggcaggccgatcccgctggatcactaggcatggagcattatctatag

SEQ ID NO: 83588 - DNA, 186 bp, Glycine max
  Peptide Sequence Number=SeqID_175273
atggaaatttatagttgtcatcatcaaaaagggggagattgtagaaataatgataaaaagctcaaaagtcaagatcacttcatgataacaaagatgatgacattcaagaatgagttcaagattgagtcaagagcacttcaaggatcaagaggaaatttgatttcaagaatcaagattcaagaataa

SEQ ID NO: 83589 - DNA, 630 bp, Glycine max
  Peptide Sequence Number=SeqID_175274
atggcgcgtaatcagatcttcctgattaacgaacgccagctgtccgttaaccagcaatcctggttgcgcaactacttcaaacagtatctgcgccagcatatttcgccgattctgatcaaccgcgagacggacctggttcaattcctgaaagatgattacacctatctggcggtggagattatccgcggcgataccattaactatgcgctgctggagattccatccgataaggtgccacgctttgtgaacctgccgccggagacgccgcgacgccgcaaaccgatgattctgctggataacattctgcgttactgcctggatgatatctttaagggcttctttgactacgatgccctgaatgcatactcgatgaaaatgacccgtgatgccgagtacgatctggtacacgaaatggaatcgagcctgatggagctgatgtcctccagcctgaagcagcgcttaaccgccgagccggtgcgttttgtctaccagcgcgatatgccggatgcgatggtcgaaatgctgcgcgataagctctccatctcgaactacgattcgatgctgccgggcggtcgttatcacaactttaaagactttatcggtttcccgaatgttggcaaggccaatctg

SEQ ID NO: 83590 - DNA, 1328 bp, Glycine max
  Peptide Sequence Number=SeqID_175275
cgccgggggctgtggcagatcgttgtgctgatgctgccgggcacgctgttctgggctctcgcccagcagggcggcagctccatcagcctgtttatcgatcacttcgtcgatcggtgctggttcggttggacggtgccgaccgcgctgttccagtcggttcacgcctgcgcggtgatgctgggcggcgtggcgctggcatggctggcgagcggcgacggtgcgggcgatcgcacgctgcgcatttggtgcaagttcgccttcggtctgctgttgatcggcgtcggctttacgctgatggcactcaatacgcggctgcacgggccgggatcgatggggctgatgatcgccggcctggcggtgatgggcttcgccgaactgtttatcgatccggtggcgatggcgcagatcacccggctgaatatccccggcgccaccggcgtgctgaccggcatctatatgctggcgaccggctcgatcgccaactacctggcgggcattatcgccaatcagaccgccgaggatcacatcgagggggcggcgatacaggtgtatggccgcattttcgcccagattggctggggagcggccggatgcgcgctggcggtgatcgcggtgctgggtggctggtggttgctgacgcggcgccaggcacggacggtggcagaccagttgggcgcgcagcagcggctgctggtggcgttcagcggcggcctggattccagcgtactgctgcatgtgctggcgacgttgcgccgctggcgtccgggaatgcaactgcgcgcgctgcatgtgcatcacggcctgagcgccttcgccgaccgctgggtggacgcccgccagggcggcatcgaagcggcggcgcgcgcggcgcgctatgccgccttcagcgccgcgctaacggagggcgaagcgctgcttaccgcccaacacctcgacgatcaaagcgaaaccttcctgctggcgctcaagcgcggcagcgggccggcggggctgtcggcgatggcggcgcgcaccgcgttgggcgagcacctgctgttgcggccgctgttgggttgctcacgccagaccaatcaggacacgcgcttcgatcgcaatttcctgcgcttgcaggtgttgccgcagctcaaccagcgctggccgcacttcgcctcggcggtggcgcgcagcgccggcctgtgcgccgagcaggagcagctgctggacgaactgctggcggaaccgctgcaaagcctgttggcggcggatcgctcattggcgatcgacggcctgacggactgttcgccggtgcggcgcttcgccttgctgcggcgctggatcgcgttgtttaa

SEQ ID NO: 83591 - DNA, 678 bp, Glycine max
  Peptide Sequence Number=SeqID_175276
atgctggacaagcgttacttcattaccgccgataaccagctgaagatccagaccgacttcctctccagcctgtccgcagcgctgaagcagccctggccgccacagctggagcagcgtctggcgcagctgctgcccgacaacgggccgctgctgcagcgcttctaccaggcgcatcagttgctgatccacggcgacgccgattcgttgacccgcgccagcgcccagctgagcgagttgattaaaagcgcgccggacttccactacctgctggcggaaaaagcgctggtggacctgctgcgcaattcttatcaaccgttcgacagccaggccttggcgcaactgcgcgccgatatcagtcatttggcgaccatccccgaactgaaaaacacgccaatcatgcagcaagttctggcggtagatgcattgacgcaggggcgcattgacgaggcgcaccgggcgatcgatctggggattgaattgcaaatgtcgtggctgaattatgtgctgctggggaaagtgtatgaaatgcaggggcagaatcatttggcggcggattcttatattaccgcattcaatcttcgccccggcgaggacactttgcattggatcaccaatggcgtattccagacgtcattgaccaacgtggtgccttatttaaataactatcagcgccaataa

SEQ ID NO: 83592 - DNA, 255 bp, Glycine max
  Peptide Sequence Number=SeqID_175277
atggaaatttatgtgagtgatcaactaggaaaaaatgatgacaaaaagctcaaaagtcaagatcacttcatgataacaaagatgatgacattcaagattgagttcaagattgagtcaagaacacttcaaggatcaaaagaaaatttgatttcaagaatcaagattcaagattcaagattcaagaataatcaagatcaagatccaagactcaaagattcaagaatcaagagaagacttaatcaagataagtattaa

SEQ ID NO: 83593 - DNA, 207 bp, Glycine max
  Peptide Sequence Number=SeqID_175278
atgtcgcggaacttcacagattgcttaacgatgggtgtcaagttcctcgaagcggtcaagcgaaggttgcatgccatcaaaaaatggtccccggacgaaattaggcgcgaggcaatcaattcgtggggctccagactcgatggtggaggatgcatgaatgacaaccaattcatggggctccggataagatttgagggtggaggatag

SEQ ID NO: 83594 - DNA, 297 bp, Glycine max
  Peptide Sequence Number=SeqID_175279
gcggtttgcgtattgggcgctagcggagtgtatacggcttacggttatgttggcactgtgagggtgtcagtgaagtgcttcatgtggcaggagaaaaaggctgcaccggtgcgtcagcagaatactgtgatacaggtatattccgcttcctcgctcactgactcgctacgctcggtcgttcgactgcgcgagcggaaagtttggcttacgaacgggcggagattaccttatggattcgcacccttttgtcatccaggaagagcggcgggcccgatacttaagcaggaccaagtttga

SEQ ID NO: 83595 - DNA, 117 bp, Glycine max
  Peptide Sequence Number=SeqID_175280
atgtggaccaccacgggggacgagcttgccacccaactcgcccaggcgagcaaggtttcttcctccagaagcaacaaccttctggaggaagaatctggaaggcctaagtgggcctga

SEQ ID NO: 83596 - DNA, 78 bp, Glycine max
  Peptide Sequence Number=SeqID_175281
atggtgttagttggtcggtatgggtacgaggatggggaaccaaaaatcatactggtggagatgggttttgggaggtga

SEQ ID NO: 83597 - DNA, 339 bp, Glycine max
  Peptide Sequence Number=SeqID_175282
atggtttaccaagtaggtgacattgctagtttgggaacttttcgaagaaagttcacggatcaagttgatcctttacgaatcaagttgatccgtaacactcacatctccactttcagatcaacaatctaccctatcgccgacaacaatggtggaaacgacatggtcacagcgcttacctcgacagtggacggtgacgaagctccctcgatggtggacggcggcgttgctctttgcggaagcctcctcaatgcaccacgtcaacctcctattcacggcaacaatggtggcaagctcctcaacgaagaagaagaagaacctcttcccacaacctcctcttaa

SEQ ID NO: 83598 - DNA, 129 bp, Glycine max
  Peptide Sequence Number=SeqID_175283
atgggtgaagggagggttcaagacagctcatccaatggttctggcctgtttgatcacccccatctggattgtgtgcacttgctcagttcagaggtaaatgttatcaaagcaaaaccagaatgcccctaa

SEQ ID NO: 83599 - DNA, 429 bp, Glycine max
  Peptide Sequence Number=SeqID_175284
atggctataacagagtttctgttattcatattaacagctactctaggaggaatgtttttatgcggcgctaacgatttaataactatctttgtagctctagaatgtttcagtttatgttcctatctactatctggatataccaagaaagatgtacggtctaatgaggctactacgaaatatttactcatgggtggggcaagctcttctattctggttcatggtttctcttggctatatggttcatccgggggagagatcgagcttcaagaaatagtgaacggaattgggttcaagctttccccagccccttctcatcaatggactcctgacgtatacgaaggagtgcgatgctacatagttggttctcatccttcagagactacgagtataataggagcatccgtcaacaaaaggatcaccctaagatga

SEQ ID NO: 83600 - DNA, 222 bp, Glycine max
  Peptide Sequence Number=SeqID_175285
atggatagagctaggttggtctatggcttggtgactaacatggacatgaacatcagagcccttatctcagttaacttcagaggggcaaggaaggaaagggctcgaccagctgatgttccttctttttctactccaccaactccttccacttctactactcctacaccagctcctccaggcccatctgctcaggactctcagcgctttgaatccatgctttaa

SEQ ID NO: 83601 - DNA, 558 bp, Glycine max
  Peptide Sequence Number=SeqID_175286
atggccccaaggaagcttgcctcaaagagatccaggaaggataaagcggctgaaggagccagttccgctcccgaatatggcagtcatcgttttaggagcgctgagcaccagcagcgcttcgaggccatcaagggatggtcatttctccgagagcgacgcatccagctcagggacgacgagtataccgacttccaggaggagatagttcgacggcggtgggcatcgctggttacccccatggccaagttcgacccagacatagtcctcgagttttatgccaatgcttggcctacagaggagggtgtacgagatatacgatcctgggtgaggggtcagtggatcccattcgatgcggctgctctcagccagttcctgagatatcctttagtgctggaggagggccaggagtgcgagtatggccagaggaggaaccgggctgatgggtttgatgaggaggctatcgcccaattgctgtgtataccagggcaggattttgcccggactgctgctggaagacgggtgcggatcatgcgcaccaacatgaccaccctgacctag

SEQ ID NO: 83602 - DNA, 577 bp, Glycine max
  Peptide Sequence Number=SeqID_175287
atgttggtgcgcatgatccgcactcgtctctttgcagcgggcacaggtgaaaatcttgcccctggtatgcatagtagctgtgtgatagcctccctctctggttgtgctcgcacagttggccctcctccaaatatcaggggcccattgaaagtgaggacgcgtagtcctctaaaggcgagggcgtgtagccctctgaagttcaggacgtgtcgcctttcgaaggcgagggagtgtagtcctatgatggcaaggacgtgcaatcctctaaaggtgagggcgtgtagccctacaaaggtgaaggcacatgaccctttgacggcgaggacgtgtagtcctctgaagttgaaggtacatgaccctttgaaggcgaggacgtgtagtcctctgaaggtgaaggcgaggacttatagtcctctggaggtgagggcgtgcagccctctggtggtgaggacgtgtagtcctctcaaggcgaggacgtgtagtcctctgacggtgggggtaagggcgtgcagccctctgatggtgaggacgtgtagtcctctcaaggcgaggacgtgtagtcctctcaacggtgagg

SEQ ID NO: 83603 - DNA, 207 bp, Glycine max
  Peptide Sequence Number=SeqID_175288
atggagatgacaaggtatgacattcctgtcagaggtaaaagatctttatttgagatttatcaaaggggcaatgtagttgtcttagatcctgcagaatttgaagaagctgaaaaggatgacaagtggataaatgctatgaaggaagagctaaagatgattgaaaaaaatgacacgtggaagctagtggaaaaacctcaacccaagtaa

SEQ ID NO: 83604 - DNA, 429 bp, Glycine max
  Peptide Sequence Number=SeqID_175289
atgactatgcagaacatgcagtttcagcaagagaccaaagcctccattcagaacttaaccaatcagatgggacaattagctacccaattgaatcaacaacagtcccagaattctgacaagctgccttctcaagctgtccaaaatcccaaaaatgtcagtgccatttcattgaggtcgggaaagcagtgtcaaggacctcaactcgtagcaccttcctcatctgcaaatgaacctgccaaacttcactctattccagaaaaaggggatgacaaaaatctacctaacaatttctgtgcaggcctaggatcttcttcatcaatggattcctttgcttcttggaagataaatggcagcggaatggagaaggaagagagagaggagacgccacttcaaggagaagatgagtctagaagaagctcaccaccatag

SEQ ID NO: 83605 - DNA, 969 bp, Glycine max
  Peptide Sequence Number=SeqID_175290
atgaatattgatacggactatgcttttccccttacgccgggtttctctaaagaagagattgaactgcgcttctggaaatgcctttatacttcggccagagaagcaatgctgcattactgggttgtgctgccaaaaagcctcaagccagcggaactggaaccggttgccttccctgatatcagtttaaccaatatcggacgctacttaaccacggatgactcaccctatctggaagtttgggccgcgtatgaacgctgccagtgggaaatgaatgcgtctgactggttgtttaaaaaacttgccatgatgggcgaaaaagtgctgaaccgccgtcttgtcggtaaggcatcagaaaacggtattttcgcggatgtattaaccctaaaaacgcacgcctccggtgacgacgtgatctcacgatacactgttcaaaaagattacaaccgggacagtggcggtgggaactacttcttattaaaagcgtcatgtgcggaacgcgactatccttcgcttgccaatgacatctattttacagtggttaactgggatctgctgcatcgcagtaacttagccatggcggagttgctaacctcggtgaacctggatggggaaagcgcttttagaataccggtttcatggaatgccaaggttattgctgagaacagacttatcgttgatcatactatagatggcgtaaactatggggtcattaatttttacttttattctggtgcggtatgctattccgcagaagatgcttttgaaaaatcgacgctacgtttcaaggagcatgagcattccgtcacgctggcggcaaacgagctggaacccattcctaatgatattaatgctgcgcttggttcgatattgacctgtacaggtgaactctacagcgacgaagagaaaatgcgcgccttctaccagagctacatattcaattgttcaggattgtggtgctacgttgagctg

SEQ ID NO: 83606 - DNA, 817 bp, Glycine max
  Peptide Sequence Number=SeqID_175291
atgaagcggtatagcggcgaacccaaggagaagcccatgaagcgcgtagttgccctgatgctgttgtcgatgttctcggtggccctgctggccggttgcaacaccgtggccggtgctggcaaggacgtgcagaaggccggtgaaaaggttgaggacgccgccaagggcaacgtagtgaaccattcaagcagccaaggattcccagcaatgaacaaagacatcatttccggcaagtggtcgcagctgaagggcaaggcccaggccaagtggggcgatctgaccaacgacgatttcgatgtggccgagggcaatgccgagtatctggccggtcgcctgcaggaacgttatggctgggccaaggaccgcgccgagaaggaagtccgtgagttccaggacagcgtcagcaaggactacccggactacaagatcagcgcgccggcgggtccggcacgtagcggttggggaaggcctgcggctcgcgcggcaggcgcgagggtgaatccaccaggatgccgcgtgcgcgcaggttgcgggcgctgtcgtagcgcagctgcaggacttgggcggggctgcggctggcgcgttcgaagtcggtatcgcgtaccgacgactgttcgcgagcgccgtggccggtgcccagcgcaggggcctgcgacttgctggcatagccctcgatgcggctggcactggcgtcggccgccgcttcggccgtcggggccggtgctggcaggctacggcgcagatcggatccggacgccagcggcgcgcttcctcgaacacggccacgcccaccacgccgatgttgtccgggcggccg

SEQ ID NO: 83607 - DNA, 279 bp, Glycine max
  Peptide Sequence Number=SeqID_175292
atgacgcgtggtggtaacccagtgtcgttgaatcacaacatcggttttatgaccgtctttgaaggatggcttttctacatcggttgtctagctacaaccgatgtagaatgggtaggtttctacagcggttctaaggctgaaaccgatgttgaatgggtaggtttctacatcggttatcagtcaaccgatatagaaaatgaaaggtttttacatcgtttatcgttcaaccgatgtagcatgaggagattttctacatcgttaatcactaaaccgatgtag

SEQ ID NO: 83608 - DNA, 339 bp, Glycine max
  Peptide Sequence Number=SeqID_175293
atggacaccgattctgaagtgaggaacaccaacaccgctttgaagcgatcaagagttggtctttcctcaaggagagacgggaggcaatggactcaactcgcagggcccatggctaaatatgacccagaaatagtcatggaattctatgctaatgcatggcccatagaggaaggaggggaacgttgtgagtttagtgagaggaggagtcaggctttggggtttgatgaggaggccataggccagttgttgtgtgttctagggcaggacttcacacgaagtgtgacgggaaggcgggtgcggatcatgagcactagcatgaccaccctgacacagatctaa

SEQ ID NO: 83609 - DNA, 339 bp, Glycine max
  Peptide Sequence Number=SeqID_175294
atgaacaacagcaaaaaaggtgtacgcatgatgaacgttgacatcggttttccagtaaaaccgatgttaatatctgaagcactagaacatacgaaaaaaagagatacaggacatcaaagtgtgtcattggagaataagacaggagattcaactatgctgaagatgggagattcaactaaagttgtgataaaacaagacatgaatggaagaaagcataaatatgggtttaacaacaataaacgtaagaagacaaagaataaaagggtggtggatgatgaaactggcgacaaacatcagctggatgaagtcctaaagaggcaaattgaaacaaaaaactga

SEQ ID NO: 83610 - DNA, 391 bp, Glycine max
  Peptide Sequence Number=SeqID_175295
aagtgctaaagttgatgtctcgctaagcaagctcaatgcgcttagcgagtgtcatccactaagcgaggcatcaacgagcttagcggataggaggaatctggaagggaatttgtcacgcaggcacgtgcttaacacgccatcagcttgctcagcgagtcgtttgtcaccttccaggcttagcatgagtttggcgctgagcgaaacttcacttacttgcactaagcgcgagaatggcgctaagcatgacaacgaggagcttccttgctacggaaggcaaaaccctcagttggggattcttgctgggggctttagcattgaaagatgtattgtctccttagaacttgatagagcgggattaggttaccgtatgtctggacatggagtgcggtaa

SEQ ID NO: 83611 - DNA, 327 bp, Glycine max
  Peptide Sequence Number=SeqID_175296
atggtgatgcacatcaggccgcgagcgcaccgccaccacctcggcaagccaatccggctggatcactgggtgtggagcggtatctacagcatttggttcgccagcaggcggccaaccaccgtggacagtcagcaggggcagggttttatcccttttgtatgccttaccccggagcagtttgaggctaaggtcgcatggcctggagattggctcgatgctcagacagaggaggagcctgcaggatcccccgatggggcggatgaaccccagatggatgaggatatgaatgacctgctcggtttcttgggagggagtggggccacatga

SEQ ID NO: 83612 - DNA, 453 bp, Glycine max
  Peptide Sequence Number=SeqID_175297
atgtctgggcattcctccactcgccaatttcctagtcggaaaccggaaggacatggccgtaccaaatccgatctcctcgaggagtcatcctcgcatatcgcggtgacttggccttcgcgtcttaaacccgcacttataaagcttctactgatgtggcagggcggggcctctttggcttactgtcccaactgcgagccttggcctttgttcttcctttccgagatatttttccttatgtcagcttgcgtagatttacaacctaacccaaacttcccgcgcccaaacccattctgggctcgtagccgtaccccaacatcactcgggcccccatcattgccatatcagacaggcgaggctacccagagagggaatctacggaggcaatgcttactacttcaaaagattggaaagccgtttccaatgactcctccgtggcttgcacatatggcatag

SEQ ID NO: 83613 - DNA, 447 bp, Glycine max
  Peptide Sequence Number=SeqID_175298
atgtcattggattcgccgtctctggatgacaaaaggcgcagaagacgacgttggtctctgcgcgtcaacgggctcgtctgcccctggttgacgaaaggtgcggataaccataaggtattccacgcatgtcacctgacttcatgggtcaggatgatagaaaccgttcgtacagataacctcttgggtatctccgcacgtcacttgacttcacaggtcaggatgacagaaaccgtttgtacggataatcgcttgggcatctctatacgtcacctgactttatggttctggatgacagaaaccgtttgtacggataaccgcttgggtatcttcgtacgtcacctgacttcacgggtgaggatgacagaaagtgcggaagaggacgtaaatcttcgcgagtcaatgggttcgttggccccgattgacaaagggtgcagaagacgatgttag

SEQ ID NO: 83614 - DNA, 408 bp, Glycine max
  Peptide Sequence Number=SeqID_175299
atgccgatctccccctgcggaagtatcagttggtctgtgacgtcccaacatagggatcgcacccacaagacacccagtggacccggaaaagtccaacagggccttggggtttccagctctggttacgggcctctatcagtcctacagggtgcccgtaccccccccccccggcaagggcacgtcatcatagggatcgcgcctgcaagacacccagtggacccgaagaagtccaacagggtcttggagttgtcaagctctaattacgggtctctgtcagttctacggagtacctgtcacctccagcaagggcatcaggcccccctactaatcgagctttcatcaaagaagtactgcgtctccaggcaggcgcagggcaaaactccacagcagcctggggatggtcggtag

SEQ ID NO: 83615 - DNA, 476 bp, Glycine max
  Peptide Sequence Number=SeqID_175300
atgactaggggcaatctaggtgatttacaaccctttgatcctgaaatagatagaacctttcatagattagttaggcatagtgtgcatcctggtcattctgtgaattttaagcattttgagtattttgttgctggtgattctgaatattctgattttgagcatttgactactaattttcatactgagaacatggttcaaccttcacctcatgagaggactcttagggaaatggctgcacctgatttcacttatgaaagcttgtgcattcaatatcctgatgagggtgttccatatgttatcaagactggactaatacatttgctgcctaagtttcatggtcttgcaggtgaagatcctcataagcatcttaaggagttccatatagtctgttccaccatgaagcctcctgatgtccaggaagatcatatctttcaaaaggcttttcctcattctctggagggagtggcgaaagactg

SEQ ID NO: 83616 - DNA, 249 bp, Glycine max
  Peptide Sequence Number=SeqID_175301
atgatgaattttggtgtggattttgatttgggtttctatctgggtttcaagctattgtcgttgattttgcctgagtttgatttgggtttctatctagggttaggtgcggtgaaggtgaaggtaccggtgttgagtgttgcggtgatcgtcggcaatatacgaggtacgcagaaggtggtgcctctgtcggggacgtactgttcagttactgatcaagttgatccgaaagtgagttacggatcaacttga

SEQ ID NO: 83617 - DNA, 1140 bp, Glycine max
  Peptide Sequence Number=SeqID_175302
atggcatttttgggagagacaagcagtcagacaattgtgaactccacattaggctttatttttccaaatggatccattgttcacaatgacagtgatgtttgttttcaagcttccactccagttcctattcgaatacctaatggttgtgattttgaagtgttaaaaaccaaaatacacaatacccttaagctaacagacaatcaatttttggatgaaatttactaccggaagcctttcacatatgcagatggtattttaaacttacttcaagccactatgacccctactcatgatgccctgctatattacaatgggagatggaacatgtcacgccaaaatgagtttgttggttactcgttcacaggaaaaaatcccaaaaagtttgacattccttccggatgtaccatggatgaactgaaggatttgatcaagcaagttgcgcctcatgagattaccccttatggtattcacgaaacacaaacgtcttgcctccattttcaaacttcagcaccagacagcttccgccacctctcagacatggcgagcgagggtggcaataagagcttcacgcgtcgtgaccgtctgctcctcctaataaattcaaaagtaaaaagtcaaaggctgctcctcctgaggtatactattttttctccattggatggtcaacctcgtgttgatcatgatagggctagtggtgagggagttcagcctcaagagtacactattattaagatggagttgattgctccttttcctgaaaaatttaaggtgttggagggaaagaaggtgtttcttgttattgcaactttgacagctgagacaatgtatggtcaaaccaatgcttgggtgttgccggatgggaagtatggggcttttgaaatcaatgacagtgaggtgcttgttcttgctcaccgagctacgcttaatcttgcctaccagaactgctcacggattccggagaaaccatcttgcttgcttgagctcactggtcgtgacttgattggacttccattgaagtctccactttccttcagtgaggtcatttatgtgcttcccatgttgtctattttgatggataagggtactggggttgtcaccagtgtgcccagtgattggttgagactatattttgggaaataa

SEQ ID NO: 83618 - DNA, 291 bp, Glycine max
  Peptide Sequence Number=SeqID_175303
atggttatggcgcttacctcgacagtggacggtgacgaagctccctcgacgatggacgatggcgttgctcttcaaagaaacctcctcaatgcacctcgcaacctcttcacgacaagctcctcttcacgacaacaatggtggctgaagaagaagaagaacctttctcgacaacctcctcttaatggcaacaatggtgacaaatggaaacgccggggtattacggccttttcacttcaagtgttgggtgcaccagcaaaaatgctaggtgcacctagcaatactcgtggttga

SEQ ID NO: 83619 - DNA, 1626 bp, Glycine max
  Peptide Sequence Number=SeqID_175304
atggcaatggccaacaaggagagggagaagaagttcttctttgtagggtcactagtaaactacgcagctgaactaaagcttcttctcgcaactctcttccttctttgtggtgttgccactctccttcaattcctcccttcgcgtttcaccatttcctcctccgatctccgcttctgcatctcaagggtgtccctaacacccccaccaccctctacacccccaccaccctttacatcactttctacacccccaacaccactctcttccacccaaaaacaccttcccaatggcaccatcaagcgtgtcttcaaccctcacggctccgcggcctacaacttcatcaccatgggagcatacagaggaggactcaacaccttcgccatcgttggcctttcttccaagccactccacgtttatggcaaacccacctacgtgtgtgaatggatccctgatctcccttcactgcaaaactcttcaaaacccatcatcacaaaaggcctcaagtacctccctgactggggctatggccacgtctacaccgtggtggtagttaactgcaccttcaacggcaccgctgtcaatggtgacaacaccggtggcaagttggtgctccatgcttccacctcaggagccggtgacactggcttcaacgtcaccgacagaatagaggtcctccatgaagcaccgggagctttaaacgcttcacttttcatgtcaaagcctaagtatgactacttctactgtggctcttctctctatgggaacttaaaccctcagagggtgagggagtggatcgcttaccacgtgaggttcttcgggccaaagtcgcatttcgtgattcatgatgctggtggggtgcatgaggaggtgcttgaggtgctgaagccgtggatggaactagggtttgtgacattgcaggatattagggaccaagagaggtttgatggatactatcataaccagttcatggtggtcaatgattgtcttcatagatacaagttcatggccaagtggatgttctttttcgatgttgatgagtacatttatgtgcctcctaagactactatcaagtccgtgcttcactcactttcggaatacgaccagttcaccattgaacagatgcctatgagcagcaagatttgcctctctgaggattacggcaaaacttacaggaaatggggttttgaaaagcttgtgtatagagactcaattacaggaattcgtagagatcgaaaatatgcagtgcaaccacggagtttgtatgcaacaggggtgcacatgtcaatggatctatcaggaaagacaacacacaaaactgaaggtaggatcaaatacttccactatcatggaaccatatcagaaaggagagaaacatgtaaaatactcgtcaacacaacacaagtcacccagaacaaaattccttatgtgatggacaccacaatgagggacactgctggggtaatcaagaaatttgagctcaagatgattggaacaaggaacatgggagatgggagattctgtgctgtttggtttagggacaaatctttgatgaaaggggtagcttttagggcaagtcaaaaaggacgcgtgggtgacatgagtgctctttctattggcatcgtatga

SEQ ID NO: 83620 - DNA, 312 bp, Glycine max
  Peptide Sequence Number=SeqID_175305
atggcatcaaaagctgcaaattataataaactcccctcacctatccggcaagcagcagtgactcgtggtggccactggtggtcgtgggtggtggagaagaagatctcgctttgcgagctcgtctcgctaagcaggagcggaattctcactaagcacgacaattctcgctctatgaaattccctctcgggttggaatttgcgctgagtgcaacaattctcgttgagcataattcctcttgcgctaagcacaacaattctcactcaatgcaattacctcttgggttggaattgcgcttagcatgcttctcgtga

SEQ ID NO: 83621 - DNA, 1546 bp, Glycine max
  Peptide Sequence Number=SeqID_175306
gggagaagcttgccacccagctcgcccaggcgagcaaggttacttcctccagaagcaacaggcttctggaggaaggatctggaaggcccaagttacgaatccttacggattacgtatttactcttttttagctttcgaagaagttacggaaactcacggattgcgcaagaacacctcttttcgacttccgccacattacggaatttcatggatcgcgcaagcctgcttccttttgatttctgagacgtctcgggacttcatttattgtgcaacaaaggacgccaagtatctcaaagcggctaaccaaaggttgcatgtcatcaaacttgggatctccgaattatttggtgcggataaccgtaaggtgtttatgcatgcccccgaactcttgggtcgctggatagcaaaaggaaaggatgcatatgaccacattggtctctgcgtgtcatcggactttgggtttccgaatgatgaaggtgcggataaccgtaagccggaagacgctgacagctctaggaaaagtgcagatgaccacattggtctctacctatcattggacttggggtgtccgaataacgagggtgcagatgaccacattggcctctctgtgtcatcatacttggggtctccgaatgacgaggtgagacgaaaatattctcgaccggaacctatcgacatctccaaaaagcgtgcagatgaccacattcgtctatgcgtgtcatctgactctgggtctccgaatgatgaagattaccatattggtctctgcctgtcatcgaacttggggtctcctaatgacgaaagtatggataaccgtaaggtgtctcatcatgccaccggactctcgagtcacaggatagcaaaaaactttgggtctccgaatgatgaaggttcggataaccgtatggtgtctccgtataccaccggactcttggattaccatattggtctctgcctgtcatcgaacttggggtctcctaatgacgaaagtgtggataaccgtaaggtgtctcatcatgccaccggactctcgagtcactggatggcaaaagacgctgacatattcaagaagggtgcagatgaccacattggtctctgtgtgtcatcggacttggggtctctaaatgacgataaggtgtctcatcatgccactggactctcgggacgttggattgcaaaaggtgcggataaccgtaaggtactctacctgccattggactcttgggtcgctggacagcaagaagactcggggtctccgaatgacgaggtgctaataaccgtaagaaagggtgcagattaccacattggtctctgcgtgtcatcgaacttggggtctccgaatgaggagcacatttgcagcttaacagtgaatggatcttctttcttgggagatcccactgctccttcttccaagggcaaggatggaaattcttatcctgggtcaaggtttatggcagatgagttgagattagggctcaaaaggcttgtagaaaggccggacatgatgtatgtcatggtgttggtttggccagcggttcagggataa

SEQ ID NO: 83622 - DNA, 249 bp, Glycine max
  Peptide Sequence Number=SeqID_175307
atggcttacactcacattccggattcaacaagcgattctcctcaaatttcagccagcccgtatcaattagacttcacactttatgcttcggggtcatacaatgcccaatggaatgccccggggctcctccatgataagcacacgttgcgttcgagtcgtatccttagaaaaatggaggttgaggaaccttggttggggttatggctaccattgaattatcgagtggatatgggatcaagtttagcataa

SEQ ID NO: 83623 - DNA, 219 bp, Glycine max
  Peptide Sequence Number=SeqID_175308
atgggtgcaagggataactcattcatgaacaagagattcacgcaaaaatcggtacccaatgatagttgttctctcacaattaaggttcacacaactcactgggttgtggctaatgattaccttcaccatttacctgtcaagcaagctaacatttccactcacgtccctaattcatgttctttctcttctaattactacatactcattcaaagcatgtga

SEQ ID NO: 83624 - DNA, 1093 bp, Glycine max
  Peptide Sequence Number=SeqID_175309
cgcccggctaacgactggcaggggtttgccgaaaacctgcgcgaggtcgttaagctcagccgcgaagaggcgcagatccgtgccgatgcgaaaggctcttcacgttatgatgccctgctggatattttcgaacccgatatgaccagcgcgcgtcttgacgtgctattcgccgatctgaaatcctggctgccgtcgctgctggcaaacgtcgtcgataagcaagcgcagaagacgctgctcgagccacaggggcccttcgccatcaacgaccagcgcgagctggggctggaagcaatgcgggttttaggctttgattttgatggcggccgcctggatattagcgcacaccccttctgcggcggcgtgcctgaggacgttcgtattaccacccgttataacgaaaacgatctactcagcgcgctatttggcgtgatccacgaaaccggccacgcgcgctatgaacagaacctcccgcgtaactggctcgatcagccggttgggctggctcgttcaacggcgattcacgaatctcaaagtctgttcttcgaaatgcagcttggccgcagcgaagccttcctcaaccgcctgctgcccgccgtgcgtcagcgctttggcgaccagccggcgttcagcgcggaaaactttatcgcctggaaccagcgcgtgaagccgggcttcattcgcgtcgatgccgacgaagtcagctacccggcgcacgtcattctgcgctatgaaatcgagcgggcgctgatcgacggcgatattgaagtagacgatattcccgccctgtgggacgagaaaatgcagagctggctgggcatttcgaccctcggcaactatcgtgacggctgtatgcaggatattcactggaccgatggcggtttcggctatttcccttcctatacgctgggggcgatgtacgccgcacagttaatggcggccgccagacgcgcgttaccgaatctcgcacaggatatcgccggcggcgattttaacgctctgttcgactggttgcggcaaaatatctggcagcacggcagccgctttaccacttcgcagctgattaagaatgccaccggcgaagatctcaacg

SEQ ID NO: 83625 - DNA, 570 bp, Glycine max
  Peptide Sequence Number=SeqID_175310
atgtcagccagcgatcatgccattctgcgtgacagagttcatcaacccacaaagaaaagcttgttagaactatcatcacatgacgctttattggcacagaataagttgctttctaagcaacttgagattttaacagaaacactcggtaagctgccaaccaaactatctattggtcaacctacacattcttctgttttgcagagacaaggatatactcaaggaggattctcaggcttccaacagggtccttataatcaacaaggacagtggaggtcacaccctagcaatcagttcaacaaagaccagggtggaccttcgaacaggccaatccaacaggggcctaacatctttcagaggactactaagttggaggagactttgactcagtttatgcagatagctgacaagtcatccaacagttttatggcaaatatagaaaagaatcccaaggaggattacaaagctgtgatgacaaggagtaagaggtttgtggaggctgaggatgaggatagtgttgtgcccaagaagaaagctactaaaaagaaaggtactgatgataagaaagatgat

SEQ ID NO: 83626 - DNA, 740 bp, Glycine max
  Peptide Sequence Number=SeqID_175311
atggtgaaagttggaacctcttacgtgccgatcaacgtctcattttcgccaaaaagttggcccagggcttcccggtatcaacagggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 83627 - DNA, 564 bp, Glycine max
  Peptide Sequence Number=SeqID_175312
atggcaatacctggcaggcgatgcttggtgcttccgtgctgctgtggctggtgcactggctggtgctgcgcggtgtacagaccgccgccagcatcaacctgctggcgacgctgggcaaactggtgccgctgctgctgttcgtggtgctggcgctgctggcgtttaattacgatcgcttccgttttgactttgacggcgcggcgctcgaccagccgctgtggcagcaggcgcggtggtggtctctgcccgcgcgcgctacaagaaagatgtcgggcgcgccacgctgctagcggtgctggccgcgctgctggtctacctgctggtgacgttgctgtcgcttggcgtggtgccgcgtgcggaactggcgcagatgcgcaatccgtcgatggccggtctgatggaacgcctgctgggtcactggggcgatgcggtgattgcggttggcctgattatctcagtgtgcggggtctatctcagctggaccattatggcggcggacgtcccgttccttgccgcgcagcagggcgcgtttccgcgcagcattgcccggcagaaccgccataa

SEQ ID NO: 83628 - DNA, 210 bp, Glycine max
  Peptide Sequence Number=SeqID_175313
atgggcccttctagaggtttctgggcaatttcttgcttaaggtggaagcaaccaagctcgcctgggcgagctagagttttttcgaagctggattgcttctggaggaagcaacccagctcgcctgggcgagctgggcggcaacctcctccccctttttcctataaattggctgaagggggctgttctaagggtcccggatccccctggtga

SEQ ID NO: 83629 - DNA, 319 bp, Glycine max
  Peptide Sequence Number=SeqID_175314
tcggaactattacgtgccgatcatcgtctcattttcgccaaaagttggcccagggcttccccgtatcaacagggtcaccaggatttatttattctgcgaagtgatcttccgtcacagctgtccctcctgttcagctactgacggggtggtgcgtaacggcaaaagcaccgccggacatcagcgcaggcaagctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 83630 - DNA, 544 bp, Glycine max
  Peptide Sequence Number=SeqID_175315
ggatgtttcatgctcaatttcactcccactattgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataagataccaggcgtttccccctggcggctccctcgtgcgctctcctgttcctgcctttcggttaccggtgtcattccgct

SEQ ID NO: 83631 - DNA, 366 bp, Glycine max
  Peptide Sequence Number=SeqID_175316
atggcttctagaaagagaaagagcattggtacaaggcccacatctcagtatgacacaaggagattctcttcattagatgcttggactagatacactgataatgttctgggaagaaacattttacctgagaggaaagtagagctatatcacactgagctagatgactttaaggttgagctggagaggcgtaatttccatagacgcctcaccaattttgcaaatgggagcatagacctggctttggtgaaagagttctatgcaaatttatacagttctgaggaccgtccaccaaagcagtccagagtcagaggtcatttggtgaaaattgatgttgacagtctcaacatattcctggagacacctgtg

SEQ ID NO: 83632 - DNA, 654 bp, Glycine max
  Peptide Sequence Number=SeqID_175317
atgggacaattggctacacaattgaatcaacaacagtcccagaattctgacaagctaccatcccaagctgtccaaaatcccaaaaatgtcagtgccatttcattgaggtcgggaaagcaatgtcaaggacctcaacccgtaacaccttcctcatctgcaaatgaacctgccaaacttcactatactccagaaaaagaagcagcacattcctcctcttccattccctccaagagcagtttccaacaaaaaaaatggaagaggcagagaaagagatcttggaaacattcagaaaacccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 83633 - DNA, 264 bp, Glycine max
  Peptide Sequence Number=SeqID_175318
atgggtgacaaagaggaagtacaggaacagatgaaagctgacatgtcggctttgaaagagaaaatggcttccatgatggatgccatactaggaatgagacaactaatggagaataacgcggccaccgccgccgctgttagttcagctgccaaagcaaacccaactctcctagctaccgcgcaccaccctatcccaaacgtggtaggacgagaaagaagcacactggggcacatcagcaaccccatccagggtacaaccgagtag

SEQ ID NO: 83634 - DNA, 366 bp, Glycine max
  Peptide Sequence Number=SeqID_175319
atggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcaggctaaactggctgacggaatttatgcctcttccgaccatcaagcattttatccgtactcctgatgatgcatggttactcaccactgcgatcccagggaaaacagcattccagtgttcctgcgccggttgcattcgattcctgtttgtaattgtccttttaacggcgatcgcgtatttcgtctcgctcagcgcaatcacgaatgaataa

SEQ ID NO: 83635 - DNA, 249 bp, Glycine max
  Peptide Sequence Number=SeqID_175320
atggacgatgtctgcataaccattctcttttcctcttttttttttcttcaattaccatcaatgaagagaaaaaatcagaggaaaacaaagtggaggagaaaaaaagcaaaggaagaagaaaagaaagaagaagagaaaaaaccaaaggaatcaaaagatgacaaggaatccaaggaggaatctacgccgccagaaattgtgcaagacacaaccttcacaatgcatggacactttaagcacgatttctga

SEQ ID NO: 83636 - DNA, 1876 bp, Glycine max
  Peptide Sequence Number=SeqID_175321
atggctatctgcggccgtatgctggaagcgcagggattccgcgtagggatcatctcccagccggactggaacagcaaagaagacttcatgcgcctgggtaagccgaatctgttcttcggcgtcactgcgggcaatatggactcaatgatcaaccgctataccgccgaccgtaagctgcgtcatgacgacgcctataccgccggcaacgtcgcgggtaagcgcccggaccgcgcgacgctggtctatacccagcgctgtaaagaggcgtggaaagacgtgccggtgatcctcggcggtattgaagccagcctgcgccgtactgcgcactacgattattggtccgataccgtacgccgctcagtgctggtggattcgaaagccgatatgctgatgttcggcaatggcgagcgcccgctggtagaagtggcgcatcgtctggcgatgggcgaggccatcggtgatattcgcgatgtgcgtaataccgcgatcatggtaaaagaagcgctgccgggctggagcggcgttgactccacgcgtctggatacgccgggcaaaatcgacccgattccgcatccgtacggtgaagacctaccgtgcgccgataacaaacccgtgcccccgaaaaaagccgaggccaaagccgttgtcgtgcagccgccgcggccaaaaccgtgggaaaaaacctacgtgttgctgccatccttcgagaaggtcaaaggcgacaaagtgctctatgcccacgcgtcgcgcattctgcaccatgaaaccaaccccggctgcgcccgcgcgctgatgcaaaagcacggcgagcgttatatctgggttaacccgccggcgatcccgctgtcgaccgaagagatggacagcgtctttgcgttaccgtacaagcgtgtgccgcatccttcttatggcgatgcgcgtattccggcctacgagatgattcgcttctccattaacattatgcgcggctgtttcggcggctgttctttctgctcgatcaccgaacacgaagggcgcatcatccagagccgctccgaagattcgatcattaatgaaatcgaagcgattcgcgacacggtccccggctttaccggcattatttccgatcttggcggcccaaccgccaatatgtatatgctgcgctgcaaatccccgcgcgccgagcagacctgccgtcgtctctcctgcgtctacccggatatctgcccgcacatggacaccaaccatgagccgacgattaatctgtaccgccgcgcccgtgacctgaaaggaattaagaaaatccttatcgcatcgggtgtgcgttacgacatcgccgtagaggatccacgctatatcaaagagctggcgacccaccacgtcggtggctatctgaagatcgctccggagcataccgaagaggggccgctgtcgaagatgatgaagccgggcatgggcagctatgaccgctttaaagaattgtttgatacctattcgaagcaggcgggtaaagaacagtacctgatcccgtactttatttccgcccacccagggacgcgcgatgaagatatggtgaacctggcgctgtggctgaagcgtcatcgcttccgtctcgaccaggtacagaatttctacccgtcgccgctagcgaactcaaccaccatgtattacaccggcaagaacccgctgggtaaaatcggctataagagcgaagatgtggtggtgccgaagggcgacaaacagcgccgtctgcataaagcgctgctgcgctatcacgatccggcaaactggccgctgatccgtcaggcgctggaagcgatgggtaaaaagcatctgattggttcacgccgtgattgcctggtgccggcaccgacgctcgacgagatgcgtgaagcgc

SEQ ID NO: 83637 - DNA, 144 bp, Glycine max
  Peptide Sequence Number=SeqID_175322
atggccaaagcgccagtgcaggtggcgataccagctggtgtcgccagtggctgtagcgccactgccacgtgtcgcatgcaaagaggatgcgccaatgatgttggcgttttgtgtgatattttcatgcaggccttcgagaaatag

SEQ ID NO: 83638 - DNA, 165 bp, Glycine max
  Peptide Sequence Number=SeqID_175323
atgaatacggctaactttggttacttgtcgcaacgtgccctttcgcgggcgagcgagggcgaggctcacgggtgcgctttccaaaggaggaaagatgcacggagtcgccaccaacgtttatttgtggaaaacgtcggaaaaaccgaaggaaaccggtcaaaatga

SEQ ID NO: 83639 - DNA, 210 bp, Glycine max
  Peptide Sequence Number=SeqID_175324
atgactcataactcaactatggaggagttgataaacaaaatacaactctctcccaaaataatgccaacgtcgtcacgtcagcttggctcctcaccagaatcttactccctgcaccctgctactgtcattctgctcccacgaacaatgttcgcgatcatcacagatgcaatgtggtgcgtaccaacaaccaaatcccaggaaatagcctaa

SEQ ID NO: 83640 - DNA, 284 bp, Glycine max
  Peptide Sequence Number=SeqID_175325
gttacattaagcaaaaaggcaacagaaatgaagagaaagaaggagttgtaaagcaggcccagcccaacactggcgctaagcgagcgtcaggcgctaagcgagcaaagaagacaggcgctaagcgaggcgttgaactcgaagatgcagaatccgttacgcgtgctaagccccagctatgcgctaaacgcgcgatccaacagaagcacaggctaagcctgcaaggcgcactaagcgtgcgatccgaacgcgctaagcgcgaggtgtcgcgcttagcgcaaatatga

SEQ ID NO: 83641 - DNA, 708 bp, Glycine max
  Peptide Sequence Number=SeqID_175326
atggcccagcacgactcctcgaagctcggctttcctgccctaatcactgctttatgtaaagcccagggagttcactctaattccttgacccatgagagattaagtcgtgccattaatttggcttatattaagaagaactattggaatcttgatgatccaacagtaacttgcagaggacccaggaaggctaggggtaagagatttgaggccccttccacttcagcatcagaggcaccaacacctccttcttctacagtacctccctcttcttccactcagattccagttattcctccagtacctctacagatgccacttctagcttctctctctacaggtccatcagattttatttttacaccacagatgctgcacttcatgctccagagcatccacagggggcagtccattatcatgcagagccttcagggcttgggcttgccctccattatgagcatggaggagtttgagactcaggtgacctggctaggagaccaaccctcttcttttggagggggtggggcctcagcagcccaggagcctgtgactgaggagcctccaacaccaacaccagcagcagcagaggagcaaactactccagaccaaaccccacagccttctccatcctctgcacttgctcctgaggagactcagccatcaacattggatcataatgaagaccatccacaggaggagcaggacgtttaa

SEQ ID NO: 83642 - DNA, 368 bp, Glycine max
  Peptide Sequence Number=SeqID_175327
tcattgaagatgttttggtgaaggttaaacacctgatattcctagttgattttgttgtcatagatatagaagaggatgatgacattcctctcattcttggccgcccattcatgtctactgcaagctgcatggacaaagatccaccttgccaaaatgtctatctgaaagtgcatgtgatggaggaaaagacacctgagaagaaggaggcgctaagcgccaatcccttatggttttggaactcttggaaatgcgctaagtgcgcctgttgcgctaagcctaaactactctctaaagcgctaagcacagcctgctgcgctaagccccagatgctcactggacctgacaacttcaagttgggcttagcgtga

SEQ ID NO: 83643 - DNA, 246 bp, Glycine max
  Peptide Sequence Number=SeqID_175328
atgactgtgagaatatgtccattggatttaatgatgaaatatgtgcaatttcagttgagcttagctcatcagtgggctaaatgcgcatccaccgctaagcacagcttcaactcgcttagcacggtagaagaatctggcagtgcatcaatatcaaggccacacgctaagcgcgagatcaatgcgcttgtctttagccaggctcagtgcacgactggcgctaagctcaaatccacttactcgcgctaa

SEQ ID NO: 83644 - DNA, 351 bp, Glycine max
  Peptide Sequence Number=SeqID_175329
atggcaaataaactctcggagctgaatgtggaggtttcggaagaaactggggctgaagctggagctggtaaagatgaagctggagtagatggagctgcagagaaacctcttgccctcagccttgtggggcccccgaaaagtgaccgtggggtcattgagggcagtgatgagggcaggaaaattgctgattttgagccgctcgctaagccaattctctggcttagcgagccatccgctgagcgcaacagatcatggctaagcgcgtggaagatcctagaagcagatgagttgtcaatgatgtgctcagcaagaatcaattcgctaagcgcaccgcttgaacctcctggctga

SEQ ID NO: 83645 - DNA, 219 bp, Glycine max
  Peptide Sequence Number=SeqID_175330
atgagcatgataaagatgtgcagtgaccaggttattaggagatgcattccggaccatgagattggctcggtcctacaattctgtcattcttctgcaccagatggtcatcttggcatacaaaggacagcgcacaaggtgcttgactacgagtcttgccaagtctatgtgatgtttgttttcattggtgctctgagagtaaacagtagcctagacacttga

SEQ ID NO: 83646 - DNA, 192 bp, Glycine max
  Peptide Sequence Number=SeqID_175331
atgggtgttaaacattttgaggtggtcaaacgaaggtcacatgctaacaaacaatggtccctggacaaaattagggttacagattgtatcatttgtggtaaggttcatgaaccagaccaatgtactaccactgaagaaatcactcaagaaattcattatatgggaaatcaacagcgacaagggtatacttaa

SEQ ID NO: 83647 - DNA, 474 bp, Glycine max
  Peptide Sequence Number=SeqID_175332
ccaattcagcaatctatgaacccaatgcatgagccttctagaagatttactcaagtgcaccgtgcacttgatagattaaacttgatggtcctagatgacacatcaaatgaggtttatgatgatgatgatgatccgagaagctatgaaggggctatgcgaagcttggattacaagaaatggcaagggccaatgataaggtctagagccaagcttctacaagaagagatggccatgaggatcaaggatggactactcatcaaaggcaaggaaggagaaaatcataaggagctgaattggagcactgatgcaatcctacccccaagggtattggatagaagactccaagaggattgggctagagctgctaaagaaggccctgggattctcatgaacctcaagctaagctctggcttctctaggaatcttctcatggaagcttctcaaggaagtttctcaagaaagcttcttaaggag

SEQ ID NO: 83648 - DNA, 771 bp, Glycine max
  Peptide Sequence Number=SeqID_175333
atgaaaggaccattcgcgatagcatcctctgtttcttcttcttcctcctcatcctcttgcaagaacaaaaagtctgatctgagattgcttattggcatgctgggtgctccactcgcccccatccacgtgtgcaccatgaaccctttccctcacctcagcatcaaagacatcccagttcagtacatttctgccagtggagggcagaggcttcagaatttgattaacaatgcatatgccacgggaaaggtaaggacgatagcctctgagtttgagaccacatgcaaggttttcttcatgcttgaagagggtgaagcttgctctaacttgtatagcagaattgtgaatattgccactaataagctaagctctagcttctttaggaatcttctcaaggaagcttctcaaggaggtgagcttagttatgagagggcatcctctccaagcttcttatccaaggcttatcttggtggtgaagctccttcttcgatggcttattccctagtggatgacgcctcctctcacctcttctcctttgtcttctgctatatctccatgttactttgtttgtgggctggtttaggcctaacaatattaatgtctgaagcagtaagcgagtgtgtgattcgtgccacgaaactgaacggccaaggagaggagtgggtgtgtgacccgcatcgtggagcaatcaagggaggtgttaaagacggtggcggagatgatggtggaggcggtggcttcggaggtggtggtggatgtggcggcggtcgttga

SEQ ID NO: 83649 - DNA, 219 bp, Glycine max
  Peptide Sequence Number=SeqID_175334
atggaagagaccaacgaagcgggccccactctggatgaggacgttccgatcgagagattcgctgagaaaggaggagacttctgcggaaagaaagaatcgctggttaaagctttgaatgaagcccacgtggcccaagatatctccgtggaaggctttaatggcatcgtcaacaatattacggctaataactacctcaccttcgccaaggaggagatctga

SEQ ID NO: 83650 - DNA, 234 bp, Glycine max
  Peptide Sequence Number=SeqID_175335
atggaatgtgaccgtgaggctttggttaatgatccttcattgatatctgccattcctactagcttatttcagttgagcagtcgtgctaagcggaacctgtgggctcagctcacatctatcactaagcgcaactacaacacgcttagcgtgatgagagaatctagaagagcacaagaatcaaggccacacgcaaagcgagacattcgtctcttaccaggctcagcgcatgactag

SEQ ID NO: 83651 - DNA, 252 bp, Glycine max
  Peptide Sequence Number=SeqID_175336
gaggagaaggaaatagaccaccacggaggactcttggtgactatgcttgtcaacaaggacaagcattatgacaacatagtcattcctcctttcagcaacaaggttgtggaattcaagccaacactactcagtctgattggctcacacccttttgccggaatggatcatgaggatccatacacacatttgtctaccttcatggagttgtgcagtaccatgggagcttccgaaaaaaatgttgaagctgtctag

SEQ ID NO: 83652 - DNA, 234 bp, Glycine max
  Peptide Sequence Number=SeqID_175337
atgcgacctactcacctcgatgacattaaccgctccccctccatgattggcaagcgggtcgtgatagggttataccactttgggaacagagactggaagatctttcccgggaccacaatggctaattggttggcgatgagagatggcaagagttccccatatgtcattgagatcggggcgaagatctgtgtctgccttggcgaaaagtttcctgccgtgtttgtgccaaagtga

SEQ ID NO: 83653 - DNA, 1551 bp, Glycine max
  Peptide Sequence Number=SeqID_175338
atgactcaacacacccgcatagtagtagtcggtaacggcatggtgggacattattttatgcaggagctggtgaaacgccacccagacctgcaagccgcaaacctgcaagtcacggtactcggcgaagaacctcgcccggcctatgaccgcgtgcatctttccagctttttctctggcagcagcgcggaagacttgtcactggtagagcctggcttttatgaccgccctggcctggagctacgcctgaatgcgcgcgtcagccagattgatcgtcagcaacatactgtcaccctgacagacaacactatcctgccttatgacaagctggtattagccactggctcggtgccattcgtgccatcagtcgctggccgtgaccgcgacaactgctttgtctatcgcacgattgaagacctggaagcgatgacggctgctggtaaaactgccaagagtggtgtcgttgtgggtggtggactgctgggcctggaatgtgccaaagcattaaaagacatgggtctggaaacccatgtcgttgaatttgcaccaagactgatggcagtacaagtcgatgaagccggcggtaaggtattgcgcagcaagattgaagaactgggtgtacacgtgcacaccagccgcaataccaccgcgattgtagacggtgcgacagcacgccaccgcatggtattttttgatgaaacctggctggaaaccgacatgatcgtgttttccgccggcatccgtccacgtgacgaactggctcgcgaatctggcctcgccatcggcgctcgcggtgggatcgccattgatgagttctcccgctccagcgatcacaatatttatgccatcggcgaatgtgccagctggaacgacgagatgttcggcctggtcgcgcctggttacgacatggcccgcacagcctgtgctcatttgtttggtgaaactgcctccactttccagggggcagacatgagtaccaaactcaaattgatgggcgtggatgtggcgagtgttggcgatgcgcatggcaaaacccatggttgccgtagctatcaatacaccgatgaagtgcgcaatatctacaaaaaaattgtagtgagcgaagatggcaaaaaactgctgggcgcggtgctgattggtaatgccgatgaatatggcactttgcagcagatgacggtcaatgccatggccttgccggaaaatcctgagttcctgattttgcctgccagcgatggcaaggagaaacctggcctgggcgtggatgccctgccagacacggccgtgctgtgttcctgcaataacgttagcaaaggcgctatcggcgaagcggtggcggccggtcattgcagcataggcgccatcaaatcctgtaccaaagccggcacggcttgcggcggctgcgtgccgttagtgacccaggtcatgaaagcgcagatggacaaatcaagacttttggcgaactgtttggaaaacatggcaaaggcctgggctgcgatatctgcaaaccaaccgctgccagcatcctggcttcttgctggaatgactttatcctga

SEQ ID NO: 83654 - DNA, 435 bp, Glycine max
  Peptide Sequence Number=SeqID_175339
atgacaagcggtaaaaagaattcatcagaaactcgctgcaagattctatggacctttccaggtggcggagaagatgggcgaagtagcttacaggtacagggagagttacctaaagatttggaagtgactgaggagactgatgtgtacccagacaaggtgttgggttcaagagtcataatacaggggggtaatgaggttcagcagaccttgatacaatggaaaaataaagctttagaggatgtgacatgggagcataatgaagtcttgtgttgccagtttccagaattttgccttgaggacaaggcattgtctaaggaggtgggagttgatagaaatgtgattagtgaagtggggcctaggccaagggtgtggagagtttatactaggaaaaagacaaaaggaatgaaagataatgacgtggctgtgaacgcatga

SEQ ID NO: 83655 - DNA, 225 bp, Glycine max
  Peptide Sequence Number=SeqID_175340
atgcccttttgtgggcgtgcgaggcgagggtcacaggtgcgctttccaaaggaggaaagatgcgcggagtcgccaccaacgtttattggtggaaaacgtcggaaaaaccgaaggaaaccggttgacaaaagcagggatcttgctcctacgtaccctccatcgaagaggaaatcagacctacgtagttctttcttaagagtgaatcaagcgattctttttacttga

SEQ ID NO: 83656 - DNA, 510 bp, Glycine max
  Peptide Sequence Number=SeqID_175341
atgggctcaaaaatctaccctaaggttcatgagaaccctaaggccttctttatcaactctagcccaatcctcttggagcctcttgctcatggctctggtaactggtcctttcctagggaggattgcatcagccagctcctgatcatgcagagcttgcagaatatggtccaccagtggccggttatgagcattgaagaatttctgcagaaggtggcctggccaggagtccagccttctccttcaggaaagggtgaggcctctgtagcccaggaacctcagcatgcacaggaggatgcttctgctgacatctctgagccctctccacctgagccatttatttttgaggctgatccagagccatctcctcagcctgagccagagccatctgcaccagtgccggacttgcctatttctcaagatccaccatctacaccaacactggacttgaacgagcatgcaaaggatcattcatatgatgatttactggatctttattttctttcattttga

SEQ ID NO: 83657 - DNA, 370 bp, Glycine max
  Peptide Sequence Number=SeqID_175342
tcacacgttccacagagagaggcgtgtccagctcagggaggatgagtatacggacttccaggaggagatagctcgcagacgttggatgccactggtgactcccatggctaagtttgaccctgagatagtcctagagttctatgctaatgcttggcccacagaaagggagtgcgagacatgcgctcgtgggaaggccaacagtatgagtttagccagaggaggaacagggccaacaggttcgatgaggaggccattgcccagctgttatgcacaccggggtaggatttcgcccggactgcagcaggaaggcgggtgcggatcatgcgcaccaaacgtggatgacacagctgctcagcaatatcttgcctag

SEQ ID NO: 83658 - DNA, 411 bp, Glycine max
  Peptide Sequence Number=SeqID_175343
atgacgttgctgctcagcaacatcctgcccagcgatcataactctaacctccctctaccgaagtgtcagctggtctatgctatcctggcacggatgagcgtccatgtggctcagttgatcgctgatgccatttatttatttgcaggtatgccccctaccaggcaccctctagacccagataagtctaacagggccctgggatttccagcgttgatcacgggccttttccagtcattcggggtttccgtcgcacctaatcagttcagggcagaggtcgcatggcccagagattggcctgaggcccagacaggggaggcgcccgcaaaggctcccggcgatggagaggaggcccgcatggatgaggagatgacggatttgctcgatttcttaggaggcagcggagccacgtga

SEQ ID NO: 83659 - DNA, 366 bp, Glycine max
  Peptide Sequence Number=SeqID_175344
atggtgattttccaccatggagatgtaacagaagaaaaaggagaagagaatgtgccttggataagaagcttggagaggatgcttcaatggaggaaaagaaagaaagagaaagacaaaggaggaaaagggagagagaagttgaactttgagttgtgtctcacaagactctttgtggaagcaatgcctttcaaggttattttgatgatgccaaagaatcaagagttaagcaaattccaaagattcaagaatcaagtttcaagaatcaagattcaagattcaagaatcaagtttcaagaatcaagattcaagaatcatcaagatcaagattcaagaatcaagagaagacttaatcaagataagtactaa

SEQ ID NO: 83660 - DNA, 235 bp, Glycine max
  Peptide Sequence Number=SeqID_175345
aggctttggtccaattcaaattgtagaagcaaagcttcatgatgaatcaagattgattcaaagatgttttgatgataacaaagatgatgacaaaggtgatgacaaaaagctcaaaggtcaatcaaagaatgagttcaagatgttcaagatagaatcaagaacatttcaagattcaagaggaaagttgatttcaagaatcaaggatcaagctttcaagaatcaagagaagacttaa

SEQ ID NO: 83661 - DNA, 264 bp, Glycine max
  Peptide Sequence Number=SeqID_175346
gctcaatcgatcatagtcaggtcagtaccagaggacgagccgagaagagagagagtctacgggcgggcagtgggagatgatgcagacgagtttacgagtgtaacagaccgcctgggggcggagttccgtgttcaagaaagagcgctcttagttagtgcggatcgggagcagaagatccaatctaaaccagaatgggctttagctctgaatctcaatcttctggccgggacgatcgacctcaacccgattactctaccctcttaa

SEQ ID NO: 83662 - DNA, 597 bp, Glycine max
  Peptide Sequence Number=SeqID_175347
atgacattaacctataaaaataggcgtatcacgaggccctttcgtctcgcgcgtttcggtgatgacgcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccccctccattctcaccctttttcggagccccatgaattgcgttttcgttcatgtgtcctccaccttcgagtttggagccatgcgtagtgattgcttattgcaattctccattctcaaccctttttcggagcccatgaattgcgttttcgttcatgcgtcctccaccttctaa

SEQ ID NO: 83663 - DNA, 1449 bp, Glycine max
  misc_feature (1420)..(1420): n is a, c, g, or t
  Peptide Sequence Number=SeqID_175348
ttctggaccatggcacgctgacggacaacaacggccgcaaggcggacttccgcaacgtcatcctcatcatgacgaccaacgcgggcgccgagaccttgaaccgtccgtccatcggcttcgccaattcgcgtgtggtgggcgacgaaatggcggaaatccgccgcatgttcacgcccgagttccgcaaccggctggatgcgatcatcccgttcgcgccgctggatcgcgagatcatcctgcgcgtggtcgacaagttcctgatgcagctcgaagaccagttgcacgagcgccgcgtcgaagccgtgttcaccacggccctgcgcgagcacctggccaaggaaggcttcgacccgctgatgggcgccaggccgatgcagcgcctgatccaggacaccatccggcgcgcgctggccgacgagctgctgttcggcaagctggtcaacggtggcaagactggaaacaacaagggcggcttcggccgcccttgtcctgtccggggtcagcggctgcggcggcgcgcttcgcgcttgaaccgctcggcatcgatcagctcgatgcgcgcgacctcgcagctgccgcgaccggtgtccagagcgcttcggccctcgctgcacagctcgtcagcctccttgccgtcggtcctgaagccgaggcgggtggccagcacggcagaagggcagctgttgcggaaatgcacgacatagtggtcttcgccggagcgaagcaggatgttcttgtcggcgccggcgcgaacgatctgctgttcgccggtcagtggtacgcactgcgccggcggggtgtcggcggcatgggcgggcgacgccagcagggtggcggcagacaaggccaaggggatgagcagggaagagaggttcatggcggggcagggggcggcgatccggactggatcggatcccaggatgccgccgccgctgcaaatgcgaatctgccgcaagcagggctgaccgacgtcacggtgagatcggtcacgatgacctttggcgcatcaggcggcgatcgaacggaatccctgctggcgcccctggttgccgccatcctcgatgacgaatgcgaccgcttcatgcggaatgtgcagtcgctgcttgagtgtgctgcccatgtgtgggacctcgcgctgcacggccagatacagtgggtggaatgcgtccatgctggtgcagaccaggcagggctggccgaaccaagtgccgtccgggcccttgctggcgtagcagcggctggtgacggactgcgggtccaggacgatcaggtaggtcatgcgcgcagcgccttctgtgaagaacgcgttgagtctagagtcccggcgcgatgccggatttcagacaaggacgaaaatcgaacgatctcggtgccgcgcattttcttccgcgcacgacaaagggccagcagcgaggccggncctgtcggagtggcgcattgcgccgaccg

SEQ ID NO: 83664 - DNA, 332 bp, Glycine max
  Peptide Sequence Number=SeqID_175349
ggatcatgcccgcaagactctcagtggacccggagaagtccaacagggtcctggggtttccagctctgattatgggcctctgtcagttctacggagtgcctgtcacccctagcaaggtcatcaagccccctactaaccgagctttcatcaagaaatactgtgcccctaggcaggcgcagggcgagacaccacagcagcctggggatggccggcaacaggcaacaaacgcaccgccgccacctccaaagcccctcagctcatctacaaaagctggagcgttgcctatgacctgtggtcgaccagtaggcaaccaagtccaaagccaaagataa

SEQ ID NO: 83665 - DNA, 435 bp, Glycine max
  Peptide Sequence Number=SeqID_175350
atgacagtcaggcttagggataacagtaactgcgacattctaataactgtttgggaggactatgctattcagctacatgatgctattgacaaaaaccttctgcttcaggaaccattggttgttatgttgaccctaggtaaaatcaaggatgctacagagatacacgaatttcgtcaaagtttgtctgtcccattttattctggtgggataatccatgataaagatggttctcagtcccaatctagccagagtaatgtggtggaaaaaattttgcagaatgctcaggtggtcagtataggtgaaatcaacaatctcagacagttgacgaaatcatcattgatgctctatggagttatgacaattgtcctaactgtacaaccacatttgatccatcaaaaggtggctcagcttgccgttcttgccataccagtgtga

SEQ ID NO: 83666 - DNA, 518 bp, Glycine max
  Peptide Sequence Number=SeqID_175351
atgggttatatgccatttaagcttttggacctcccaattggtgcaagttcaagaaggtgcaagttcaagaagactcgcactggacacccatgcgagtacgactccggtgcgacgcggtgtccgttgcttctgctgtcatcggacacggttgaacaaatagctcttctacgtcttctccttgctgttctcgcaagtgcctccattgctgcaaagtgtcgcgtccgtttccttcctcgcgcagagatgagtgcttctagtcctagtcaagctaaagaacaagatgatgataccaaacctttatggatctatgttacaaagataaaaagtgtaggtggtggtggaaattatgagataaaatgcaatatttgtgattttacctttaatgggtcttacactagagtgagggcacacttgttgaagatgacgggaaatggagttagagtttgtcaaaaggtaacaattgtcaaacttatagatttgaagaagatagacaatgaggttacattgagggtggagag

SEQ ID NO: 83667 - DNA, 246 bp, Glycine max
  Peptide Sequence Number=SeqID_175352
atgaccatgattacgaattcgagctcggtacccaaaggattttacaaggatagtggaaatctcaagcgggttgcttggggactggatgtagggacggctccattggagcttgtaggcctaggatcttcttcatcaatggattcctttgcttcttggaagatgaatggcagcaaaatggagaaggaagagagagaggagacaccacttcaaggagaagatgagtctagaagaagctcaccaccatag

SEQ ID NO: 83668 - DNA, 255 bp, Glycine max
  Peptide Sequence Number=SeqID_175353
atggcaaacttggcaacctcactctcattcttcaccttcaaactgttggcactagcaagtggttctagtgttggcaacattgcaatctactggggtcagaatggcaatgaaggcaccctagtaaggcatgtgccacaggaaaataggcttcaaagaacattcaaactgagtgtatttactgccaaagcctacactccaaagagtctgtcagggtttctccctcctgattcaggtccaacccagaaaatattttag

SEQ ID NO: 83669 - DNA, 159 bp, Glycine max
  Peptide Sequence Number=SeqID_175354
atggtgcttaatttgggtgaccatggttcaaaagaggctatatgtctactgaagtgtcatctttcgtctctttcgcattccatcgaaatggagaaggaagagagagaggagacaccacttcaaggagaagatgagtctagaagaagctcaccaccatag

SEQ ID NO: 83670 - DNA, 611 bp, Glycine max
  Peptide Sequence Number=SeqID_175355
agttagccgatgcttattccccggataccgtcatggcttcttctccgggaaaagaagttcatgaccctcccagtgtggctgatcatcctctcggaccagctactgatcatcgccttggtaagctattgcctcaccaactagctaatcagacgcgagcccctcctcgggcggattcctccttttgctcctcagcctacggggtattagcagccgtttccagctgttgttcccctcccaagggtaggatcgaactctccatgagattcctagttgcattacttatagcttccttgttcgtagacaaagctgattcggaattctcttccattccaaggcataacttgtatccaggcgcttcatattcgactggagttcgctcccagaaatatagcccccccacccctcgtgctcgaactgataacttccaccacgtcaagaggcccgcaccgatcgcccttcccacagttgcgcagcctgaatggcgaatgggaccgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 83671 - DNA, 144 bp, Glycine max
  Peptide Sequence Number=SeqID_175356
atgtggaccaccacgggggagaagcttgccgcccagctcgcccaggcgagcaaggttgcttcctccagaagcaacagccttctggaggaatcttctggagggcccaagtgggcctggttgctatttgcaccccctttttactaa

SEQ ID NO: 83672 - DNA, 300 bp, Glycine max
  Peptide Sequence Number=SeqID_175357
atggcctcatcaaactttttatttcccaaagggaactctatgaataggcctcctatattcaatggtgtgggctatcattactggaaaacccacatgcaaattttcatagaggctatagatttaaacatctgggaagccattgaaatcggtccttacatccctactatggtagaaggaaatgcaactatagaaaaacctagggaacaatgggatgaagaagaaaggaaaatggcatggatgaatatgttagagtatcaaactgcaagaatgcaaaagaaatgtgggataccttacaagtaa

SEQ ID NO: 83673 - DNA, 290 bp, Glycine max
  Peptide Sequence Number=SeqID_175358
atggagatgattgcacttttgatatttgatgaatgccatcatgctcaagtcaaaagcaaccatgcttatgcagttatcatgaaagtcttctacgggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcg

SEQ ID NO: 83674 - DNA, 732 bp, Glycine max
  Peptide Sequence Number=SeqID_175359
atgcgccattttaaaaatagaagtatcattgcttcggccactttaatttcgacgttttacttcgcccagtctgatactctaaaatcaaaaaaaatcgatgaggttgttcttctcggttcaagaggatcaggtagatcattaacagatactccggttccggtagacgttattaatatctcaaaaatattgaaacaaagtccggttaataatataagccaggctctaaactatattgtcccttctttttcctccacatcgcatactgtaaatgacgggacggattttgtggatcctgcacagttgaggggtttaggtcccgatcaggttttggttttacttaatgggaaaagaaggcatcagtcttcactcatcaatgtaacccttacaccaggtaggggttcggtgggaacggatcttaatgctattccggcttttgctctggataaaattgaagtgcttcgggatggtgcttctgctcaatacggatctgatgctattgcaggagttgtcaatttaggtcttaaaaaaagattggggttatccggtcagttatttttgggaggatatgcttcaccggttaccaacaatttttccggtggactggatggagaaaccatctctttagacctgaattatggattcaaacttggaaaacagggtttcttcaatattaccacatcaacccaataccgggatccttattcccgagctgggctgcccaagatgggatag

SEQ ID NO: 83675 - DNA, 588 bp, Glycine max
  Peptide Sequence Number=SeqID_175360
atgggtgacctagaggaagtacaggaacagatgaaagccgacatgtcggctttgaaagaacaaatgacttccatgatgggaataaaacaactaatggagagtaacgcggccaccgccgccgctgttagttcggctgccgaagcagacccgactttcccaactaccacgcaccacgctattccaaacatggtgggacgagagagaaacacatcggggcacatcagcaaccctcatccggggtacaaccgaggaacttacccctacggtttaccacctaattacacaccaccagtcatcctcgaaggggagcctcctcgacatcctgacgaggatcatcgagagcaagctcaaggagacgtcgactcctactccccgtttcctgccaagggacaggcacccaacgcactacctcaacctaacatcacgggagaacctcgaaaccacccaacgcagccaatgtttttgtccacgggagggccacctcgggcagcgaaaggaaaggggaaacttgatctcattgaagaaagattgagggctgttgaagggttcagagattatccgttcatagacatgaccgacctatgcctg

SEQ ID NO: 83676 - DNA, 168 bp, Glycine max
  Peptide Sequence Number=SeqID_175361
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggcatgtctgcggtcataa

SEQ ID NO: 83677 - DNA, 237 bp, Glycine max
  Peptide Sequence Number=SeqID_175362
atgcactacatcattgttcaaattttgttaccccgttcatctaatcttgctcaagcccttgaggaggacttgattctcatgtgggcttttcttaccgatcgtcagatcaactgggcccacttggttaggtaccctatgcataaggcattacagaccaatgcacctcttccgtatcctcagaaacaagatttaccaccactgattcctgacaagcgtactccgtctcctccaccatag

SEQ ID NO: 83678 - DNA, 324 bp, Glycine max
  Peptide Sequence Number=SeqID_175363
atggggtcaaacttcaacggcaagccttccgcaaagcctatggacttccagctagtgccgactgtgaaagagtttgaagaaatcctgggatgcccactgggaggaaggaagccatatcaccatctagtcggagtaccaaggaagtgttggaggaaagggcaaaggccttggaaaatcaaggcaaatgggctctcctttattgacatcttggcgcttttgatctttggagttgtcctctttccgaatattgaagggttagtggacctagcagtgattgacgctttcctcgcctttcatcatggcaaggaaagcccggtcggccat

SEQ ID NO: 83679 - DNA, 537 bp, Glycine max
  Peptide Sequence Number=SeqID_175364
atgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagaccacttctgcgctcggcccttccggctggctggtttattgctgataaatctggagccgggtgagcgtgggtctcgcggtatcattgcagcactggggccagatggtaagctctcccgtatcgtagttatctacacgacggggagtcaggcaactatggatgaacgaatagacagatcgctgagatag

SEQ ID NO: 83680 - DNA, 1406 bp, Glycine max
  Peptide Sequence Number=SeqID_175365
tcgttggtcaccaccgtcaaatcgtcacgttcaccgatctgcttcgccagcgccagcgtggtggtgccggcatccagataaatacagctattggcgggaatttgccgcgccgccagccggccgatggcgattttctgccggctgaacatcccctctttggcctggtgcgaaggttcgctcgccacccgctcgggcgcctgcacgccgcccgagaccgactgcaccgcgccctgttcctccagcttttgcaaatcgcggcggatcgtcatatgcgacacccccagccgttcggtcagctcggcaatgctgacgacgccgcgttcggataccagcgcaagaatttgttgatggcgttctacagtatgacacacccagggaattatgccgtctgcgtcattgggctgggcgcgatgggcatgggcgcggcgcgctcgtgcctccgcgccggattgaccacctacggggcggacctgaatccgcaggcgctggcggcgctgcaacaggccggcgcaaaacacgcgtctaccagcgcgcgcgacttcgccgccgaactggacgccgtgctgctgctggtggtgaacgccgcccaggtgaagcagatcctgttcggcgaacaaggcctggcgccaaagctcaagccgggcaccgcggtgatggtctcttcgaccatttccgccgatgacgccaaacagatcgagcaacggctgctggactacgggctgccgatgctggatgcgccggtttccggcggagcggccaaggcggaggaaggccagatgacggtgatggccgccggcgccgacgccaccttcgagcgcctgcaacccgtgctggacgccatcgccggcaaggtttaccgcatcggcgaggcgatcggcctgggcgcgacggttaaaatcatccaccagctgttggccggggtgcacatcgccgccggagcggaagccatggcgctggccgcccgcgccggcatcccgctggacgtgatgtacgacgtggtcacccacgccgccggcaactcctggatgttcgaaaatcgcatgcgccacgtggtcgacggcgactatgcgcccaaatcggcggtggatatcttcgtcaaggatctggggctggtggccgataccgccaaggcgctgcacttcccgctgccgctggcctccaccgccttcaccatgtttaccgccgccagcaacgccggttacggtaaagaagacgacagaggcaatctgatgctgctcggcgtaatcgcggatgattttaccggcgcgaccgatatcgccagttttctggtgcaaaacggcctgccgacggtgcagttgaacggcgtgccgcaagacgaaacgccggtcagcgcgcatgcggcggtcatcatcctgaaatcgcgctcctgcccggcagagcaggcg

SEQ ID NO: 83681 - DNA, 534 bp, Glycine max
  Peptide Sequence Number=SeqID_175366
atgagaggggcgccatcggaagagggtatcgcgcctttcatcgcacgaggctttagtgacctcaatgcaaaaatgcttcaaagagtccgaaaagcatggaatgcagtgcaaaggaatgataaagagcttagaggaagcaacaacggtgttattggtggatttcaagtgaggaagaggctgaaatccctgagcaacaacaaactcaagcttcgaagggctgaaagggacgagtcgagactggaaagtatgatattagaggacaagttaaagtataaagagaagctaaatctagctgctagccgtgagcaaaggctagaggacaatcatgcaaaagtgtcagtcatgcaatgggaaagggaagtaagggagagagtgacaaattcattacacagagaagctatgatgtggatggataggttcgctttcacattgaatggaagtcaagagcttccaagactattagccaaagccaaggcaatggcggacgtgtactcggctcccgaggaagttcatgggcttttcgattattgttag

SEQ ID NO: 83682 - DNA, 751 bp, Glycine max
  Peptide Sequence Number=SeqID_175367
catcggctaactctgtgccagcagccgcggtaagacagaggatgcaagcgttatccggaatgattgggcgtaaagcgtctgtaggtggctttttaagttcgccgtcaaatcccaaggctcaaccctggacaggcggtggaaactaccaagctggagtacgataccccagtagtcctagccgtaaacgatggatactaggcgctgtgcgtatcgacccgtgcaatgctgtagctaacgcgttaagtatcccgcctggggagtaccgaagaaccttaccagggcttgacatgacgcgaatcctcttgaaagagaggggtgccttcgggaacgcggacacaggtggtgcatggctgtcgtcagctcgtgccactgccggtgataagccggaggaaggtgaggatgacgtcaagtcatcatgcccccttatgccctgggcgacacacgtgctacaatggacgggacaaaggatcgcgatcccgcgaggccatacggcggtgaattcgttcccgggccttgtacacaccgcccgtcacactatgggagctggccatgcccgaagtcgttaccttaaccgcaaggagggggatgccgaaggcagggctagtgactggagtgaagtcgtaacaaggaaagagagggatggggtttctcttgcttttggcatagcgggccccggcgggaggcccgcacgacgggctattagctcagtggtagagcgcgcccctgataattgcgtcgttgtgcctggact

SEQ ID NO: 83683 - DNA, 453 bp, Glycine max
  Peptide Sequence Number=SeqID_175368
atgtctctcaaacttccctactttcctgaattagttaaagttttctataataatttgaaaattcaggatggtgttctttattctgaggtgcataatattcccattgttgttgatcagtccttgttttattcattgactaaactgcccaatcaaggtgttccttttgagggcactcttgtggatgactggaaatttgactattcaagtcatgatgcttgtagaatggtctacaatgaccagactgacatgaccgacagattacttgttgggtcatttactttcgattgttgcatcatgcattatatcattgtttgtatttttcttcctcgctcttcaaatcttgcccaatcctctgaggaggatttgattctgttgtgggcccttcaaactggtcgtcagatcaactgggcccatctagtttggtaccggatgcataaggcattacgagccaat

SEQ ID NO: 83684 - DNA, 459 bp, Glycine max
  Peptide Sequence Number=SeqID_175369
atgatggggtacgcaccttcaagctttgcggatttggtcttcgccggcgaaaggatcgaagtgggtctgaaaagaggcaaatttgatcatccttctttgatgaatgcaaaaaatcgggcaaatgaagaggatgagaatgagggagaaacccttgttgtgactgtcattcctacacgaccaaatttcccatcatcccaacaatgtcattactcagccaataacaacccctctcattacccaccacccaatcatccacaaaggccatccccaaatcagccgcaagacttacttgctgcacgaccaatgccaaacaccacctttagcacaaaccaaaaccccaaccaagaaatgaattttacaatgaaaaagcttgtagaattcaccccaattctggtgtcctatgttgaattgctcccatatctactcgataattcaatggttgccataaccccaaccaag

SEQ ID NO: 83685 - DNA, 264 bp, Glycine max
  Peptide Sequence Number=SeqID_175370
atgaagacaataaccagttctttcgaaggcatgtctaatcaacctgcacctcggtgggttgaaccaaagagtcatgtccaaactggagcgtacgagtgcgaatattatgtgatgcattggatgtggtgcatagtgactggtggattgaaggatgactggaacaagtggttttctgatggatcaccgttagacgtggaggccatcaccacacttcgccagaaatgggcaacattctttttaagtattaggaaaagcggatgctaa

SEQ ID NO: 83686 - DNA, 1521 bp, Glycine max
  Peptide Sequence Number=SeqID_175371
atgcctccaagaggttggaactcctatgatagctttaactggataatttctgaagaagaatacttacagaatgttaatatagtttctcagcagttacttgctcatggatatcagtatgctgttgtggattacctctggtataggagtctaaagggtgataaaaattctcttggtttcgatgtgattgataaatggggacgaatgctccctgaccctgaaagatggccttcttcaagaggagggagagggttcactgatgtaggtaataaagtacatagaacgggtttgaagtttgggattcatcttatggctggaatcagtacacaggcattcaataacaacacaccaatacttgatacacaaacgggacaaccttacatggaatctggtcgagtctggaaagcaagagacataggaatcccatcaaggccttgtaaatggatgagtaacggtttcatggctataaatacaaaaacaggagctggaaaagccttcttaagatcaatctatgagctgtatgcttcatggggagttgattttgtgaaacttgactgtgtatttggtgataacttggatttgggtgaaataacatctgtatcagagattctcaatggacttaacaaacccattgcactttctctgtctcctggagtcagtgcaacaccacaaatggctaagatggttagtaatctagttaacacataccgtgtaacaggagatgattgggatgaatggtcagcaatcttagctcattttaatatagcaagagattttgctgcatctaatttaataggaggaaaaggtttaaagggaaaatcttggcctgatttggacatgctgccatttggatggctaactgatccaggtgctcatgaaggtccatacaggtttactaggcttactcaagatgagcaaagaactcagtttcctcatatcacaagattaaatgatgtaaagactaaaagacacaatgtcacaaaagtacagtttacttactcccttggtctcactgaatgcactgatccaaaagcatatggatggtctagtgaaaaatattaccaagatcttgaaagaatttgttacaagagtccaaagcatgatcaggaggaacctttctgtgtgcacaagagagaactccccacggcatcatcaaagcagacatctatccaatctgaacagatatggaagttgaaatctaatgggactctagttaatggtcattctggcatgtgtgcaacagtagaacatgtcctagctgaaggttatcctaatcggattcgatcttggattgcaactggaagaaaaggggagacctatgttgcatttttcaatctgagtaacgagaaaacaacaatatctgcaagcataatagacttggctatagtgtatccaggtagaagaaagtttatactttgttctggaaatgaaatgtggagtggaagaaccatacgaacaaataatatgttctcagcagaagtaccaggtcatggatgcgcattatttgttctccagtgcagttga

SEQ ID NO: 83687 - DNA, 1152 bp, Glycine max
  Peptide Sequence Number=SeqID_175372
atggaacaagaagaagctgagagaaatatgcaaatattgttagacttcttgcattgcttacgcaagcaaaaagttgatgagttgaaggaggtacaaactgatctccagtttataaaagaggacattaatgctgtggagaaacatagaatggatttgtatcgtgcacgggacaggtactctgtaaaattacggatgcttgacgactctggtggaagaaaatcatggcattcatcaatggacaagaacaacagtggccttatatctagtcctctaaatctacgaggagggttgtcatcagggagccatactaagaaaaatgatggaaagtcccaaattagctctcacgggcatggagttcagagaagggatgccatcactggatccgattcacaatatataaatcaatcgggtctttctctagttagaaagaagagggttgtgaatgaacctacagatgctcactgtcctgttgtggagatgtctacacgttcaaaacttagttgcttgagttggaataaatatgctaagaatcaaatagctagtagtgattatgaaggaattgtgactgtttgggatgtaaccactcgaaagagtttaatggaatatgaagagcatgaaaagcgtgcatggagtgttgatttttcaagaacagacccctctatgcttgtatctggtagcgatgactgtaaggttggatcagcagaccatcacatccattattatgatttgagaaatattagccgtccagtccatgttttcagtgggcacaggaaggctgtttcatatgtgaaatttctgtctaatgatgaacttgcttctgcatcaacagatagtacactgcgattatgggatgtgaaggaaaacttaccagttcgtactttcaaaggccatgcaaatgagaaaaactttgttggccttacagtaagcagtgaatacattgcgtgtggcagtgaaacaaatgaagtctttgtttaccacaaggaaatctcgagacctttgacttgccacagatttgggtcccctgatatggatgacgctgaagatgaggctggatcgtacttcattagtgctgtatgctggaagagtgatcgccccactattctaactgcaaatagtcaaggcaccatcaaagtgctggtgcttgcagcttga

SEQ ID NO: 83688 - DNA, 1242 bp, Glycine max
  Peptide Sequence Number=SeqID_175373
atgtcggagaagctatgttacgcctgcttcgcaaccgcgtctgatggttatggcagcaaaatgctcaacgacttcaagaatcgcctcgtctcagagctcaacaacagcaaaccagtcatattcaaaggttggaaagttgacaaaaatgctttcacttgtgagcttagaaaactgaagatgggtttcacaggggagttggtaagaagtgtcttctccaaaaatcgttctgatgggtctcatgaaaacaaagtgaggcgcaatagtgctaaaaatagaagaatgttatctgtgaggtcattcttgtgtggtgatgaattcaattcagtccttgcagagaatgattcagcttcagttaagagctctgaagtcacggtttcacagtccgtacatgagggcttgttaaacgatgaaggagacactgaaagtgaagaaactgtggagaatgtagcacagaacaggccaagttcaaactccaaaaagtcattgaatgaggaagaagcagctgttcttattcaatcagcatttagaggcttcctgttgaggcgtcaaaatggagaaatcaaatcacaaactggaaaagatgagttcaatttagtaacagaaagtccagacaaaaagtccataggcacatcaattgatgtccaaacctcaaactctacggaagttttctctgtcgaaggagaattaaagggcatttgccaccgtattcagcgcaggaccagaactcaagcaataaagcaaaaggaagattgggatgacagcacagtaagtagctatgtttcaaaaatgaggatgcagaatagaatggaggcttcaaccaggagggaaagagcactggcttatgctttctcacaacagcggtggatggcaacgcgccttccggagacatcatcagttgaaagccatgccatgaagcagtatgacccttctaatggtagtcacaaattcacaatcatgacaagattttttgatgctgctggggaagaaaaggagagctgcgggtcaaatgaagtgccccttcattttgataactattccatcaattcacgagaagaaaaagttagcttcaaaccacatacaccaaagaccaacttcaaagctaggagaactgtttcaaggcggaaaacagtgcctagttatcaattccatgaagagcagccaaagtggggtgcggttattgtagtggttattatagcggctattgtaatggttattgtagcggttattgtagtgggaatgtag

SEQ ID NO: 83689 - DNA, 795 bp, Glycine max
  Peptide Sequence Number=SeqID_175374
atggcgtacataggcatgttgaatgccaattcgattttggagaagggagggctgccaatgtatgtagctagccgtggtttgttcaatttgaaacctccaactgtgtttgtgcctccttgcatcaaagaggatgtcgagaagctgcttgatattcacagaacaatgggccaagttgaattgaatgctgaagtggttgctttggatgtgggtatgtttcatttgtctttcgttaatgatcaggaaatatcttcaaggaatgacgtgcaaaatttcattttaggggagacgtatgagatacggaataaccttgttgtccgaccattcaaaacacaacatgttatacccagccagggttatgtagtctactcaatcaggaagaagttgaggaaacagtatgcacaccttaatgggaaacaaattgagaaattgaagaaatcaggtgttgagattaccgacatgatattatcgcctgaggtggccttcaccggtgatacaacatcggattttatgcttgacccgtgtaatgctgatgcattgagagcaaaaattcttataaccgaggcaactttcctagatgattcattcagcatagatcatgctcggcaacatggacatacacatttatttgagatcattgcaaatgcacagtggattcgcaacaaagcagttctgttgactcatttttctccaagatatactatagaggatattcgtcaagctgcatcaaaattgcagtccaggttgtccgctaaagtggttcctcttacagaaggcttcaaatctatgtactcttaa

SEQ ID NO: 83690 - DNA, 510 bp, Glycine max
  Peptide Sequence Number=SeqID_175375
atgaggaaaagggagagggagaatccttgtggcgtgtgtggccactatcacaaatatgaagaaggggaagtgtgttcgatttgcggtcaccggattccggttggatcggagaaaacttcgatacaagttagtgcttttccttccgttgttctgccggaatttctttacctaggaagctacgacaacgcatcacgctcggagcttctgaagactcaggggatttctcgtatcctcaataccgtcccttcttgtcaaaatctctacaagaactcgtttacctatcactgcctcccagatgacaaaactttgccatttgatgaagcaattcagtttcttgttgtgaagggcatgatctgtgcttcaattagtgcggcaatgactgcaactagaaatgtgatacaacggcttcacaaggagtgggacctacccatgacacactgtgatggtgcaatcatgccgcaaatgcgtgctattgactattctgtgatagacatgctatgtgctgcctag

SEQ ID NO: 83691 - DNA, 1212 bp, Glycine max
  Peptide Sequence Number=SeqID_175376
atggggaagttttttaaagaggcaaaagagatttttgggtatgctagtggggtgttgttgtcaaagttagaagcttatgagaatttgggtttgaggaaatcaactgttgtcaagcttgttgtttgttgccctttgcttttggttggtgatgtgaattttgaatttgtttccgtgcttgattggttgaagagaattgggattgagagtgattggatggtgaattacttgtcttgttcaaggacatatagttggaaaagaatgcttgatgccatgctgtttcttcataaagtgggttattccgaggaacaaatgcacaatttgtttagggaaaatcctaagttgttgttggagggttttgggaggaaagtgtacttagtttttggtagattgcttaaagttggtgttgagatgaatgtggtttattcttattttgtagagtatcccaatatcttgttgaataagtgtgcgaacgatatgttgagagtgattgactttttgggtgctattggaatgggaaaagatgacattacacacattttgtctaagtacatgcatctcctgattacacgttccttgaaaggtcataaaactgtttgccaggagttaaaagttggaaaagctgatttgtaccaaatcataaaggatgatccattgaagctaattagtttggcatcaaaacaggagcagaagggcaatggaaaggtagatagtcatgacccacgtaactatttggaaaagacaactttcttgctgaaattgggatacattgagaactctgaagagatggccaaagcattaaaaatgtttcgagggagaggtgatcaattacaagagaggtttgattgcctggtagaagctggcttggactataacagtgtgattgaaatgataaaacgagctcctatgattctaagccagaacaaagctgtaattcaaaagaagattgatttcttaaaaaatgttttagattaccctctagaaggtctcgtgggattcccaacatacttttgccatgatttggacaaaattgttgaaagactttcaatgtatgcatggctgaaggagaggaatgctgtaaatcctacattaaccctgagtaccataattgcatccaatgataaacgctttgtaaagtactttgtgaatgtgcatcctcaaggttcagccatctggaagggcttaaaaagattatcaaataaagataagaactaa

SEQ ID NO: 83692 - DNA, 322 bp, Glycine max
  Peptide Sequence Number=SeqID_175377
atgactagtgtgctttttgatgaatatgttcgttcatttaaccaaatgatgtatggtagaagagttctacttatggtggataattgtccagcacatccaagaaatattgaagggctaagaaacgttgagttgttcttcttgccacccaacatgacatcaaagattcaaccttgcgatgctgggataataagagctttcaagatgcattaccacagaaggttttgccgcaaaatattggaaggttataaggtgggacaatctgatccaggaaagataaatgtccttgatgctatcaattcggcaatcccagcttggatgatag

SEQ ID NO: 83693 - DNA, 429 bp, Glycine max
  Peptide Sequence Number=SeqID_175378
atggcttctcatctaaaagatgtggtaaaatcaactatgtcagatcaaatacgtaaggagttgtatgagtacaagagagataatcctgcaagcacacaaaaagacttgcagagatggcttgagggaaaatttgagttgaaagttagtcaaggaacaatatcaaacacacttaagcggtcagatgactatctctctgctgaaatagaaaagggaagagcagagatcaaaagacacaaaccagcaaaatatcctgacatggagaaggttgtttatgagtggtttctccaacttcaagaacgtgtgaatatcacaggagaattaattttgctgaaggcaagagatacaatgaaactcgtgtaccctcatgatgattcagattttaacttctctatggatggcttgggaaattcaagcatcgacatggcataa

SEQ ID NO: 83694 - DNA, 897 bp, Glycine max
  Peptide Sequence Number=SeqID_175379
atggtgtcgcgtcgttataatcccgaacatcgtcgtcaggaactgcttaaacgtattcagctggatatcccggaaaccgtggcgcgcgcgcttcaggaggatttaggcggtgacgttgacgctgaccgcgacatcaccgcccagctgttgccgcaggcggcgcaggctgtagcgcgcgttatcacccgcgaagccggtgttttctgtggtaaacgctgggtggaagaggtgtttatccagctgggcaataacgtttccattacctggcacgtcgaagacggccaaccgctggtggccgatcagctgctgtttgaattacggggaccggcgcggttgctgctgacggcagaacgcaccgcgttaaactttgtgcagacgctctccggcgtagcgacagccgtgaaccgctatgtggcgctcttatctggcagcaatacccagctgctggatacgcgcaaaaccctgcctggcctgcgcaccgcgctcaagtatgcggtgctgtgcggcggcgggcagaatcatcgcctgggcctgtccgacgctttcctgattaaagaaaaccacatcattgccagcggttcggtcagtaaagcggtggagaaagccctgtggctgcacccggatgtgccggtcgaggtggaagtggaaagtctcagcgaactgcagctggcgctggcgtccggcgccgacatcatcatgctggataacttcacgctggcgatgatgcagcaggcggttacgctgactgcgaagcgcgcactgctggaggtgtccggcaacgtgacggagacgacgctgccgcagatcgccgccaccggagtggattatgtctcggtgggcgcgctgactaagcacgtgcaggcactcgatctgtcgatgcgttttcgcgaagtctga

SEQ ID NO: 83695 - DNA, 379 bp, Glycine max
  Peptide Sequence Number=SeqID_175380
atggggacaaatcaaactggcaaaaggttttatcaagtcaagattaagggcctagatatcaccagcatcaaggagttggggcggttgatgggacctctccaaatgcaagcctcccgcaagacgtacggaaagatcttagatttgaccatagcagagatatccccagaagccattgcatcactcacccaatactatgaccagcctttgagatgcttcacttgtggtcagggatccggcgagaggattggaccgcgtgaagcaaactcgaaacggcatagtgggcctaccacagaagtacttagaaagcaaggcgatggatatggtgaatcaagaggagtgggtctcgtttatggatgtattagcattgctaatctttggg

SEQ ID NO: 83696 - DNA, 249 bp, Glycine max
  Peptide Sequence Number=SeqID_175381
atgctagtgcgcatgatccgcacccgccttctcgtcacgcttcgtgcaaagtcctatctcggaatgcacagcagctggcctatggcctcctgttgtaatcagtactcagtatcccaattttttgtattcaatgatcattccatttcaatttcagcaattgggctaagcgcatatccaccgctaagcgcagcttcagcgtgcttagcgcaaaggagaatttggcagagcatcagcatcaaagccacgtga

SEQ ID NO: 83697 - DNA, 396 bp, Glycine max
  Peptide Sequence Number=SeqID_175382
atggaagctacactaagaaggaatagggctgagaggagaaggaaattgttgcaagacagaacaactgcgtccattcttgaggaggagactcatttttttgattcattatcacctgattcaccatcatcaagggaatccgctaatcaacattctgaagctgttaccatggcagatgagcatgatcagaggactacccttgaggactattcaagtggctctgtaccacaatttttcactagcatttcacatcctgaagtgcaagcgcacaacatcacctacccacattcttttatccatctgatacaagggaatttattccaaggattacccaatgaagatccctatgcacacttggcaacatttatagagatttgcaatactgttaagattgccagt

SEQ ID NO: 83698 - DNA, 417 bp, Glycine max
  Peptide Sequence Number=SeqID_175383
atggtgggctacacaccttcaagctttgctgatttagttttcgtcgatgaaaggatcgaagtgggtctgaaaagacgcaaatttaatcatcctgcttggacgaataagaaaactggggcaaatgaagagggtgagaatgaaggagaaacccatgttgcgactgtcattcctacatggccaaacttcccaccagcccaacaatgtcattactcagccaatatcatctcctctcattacccaccacccagtcatccacaaaggtcatccctaaatcaaccacaaagcctgtctaccgcacttccaatgatgaacaccacctttagcacaaaccaaaacaccaaccaagaaatgaattttgcagcgaaaaagcctgtagaattcaccacaattccggtgtcctatgcaattaaatggtag

SEQ ID NO: 83699 - DNA, 153 bp, Glycine max
  Peptide Sequence Number=SeqID_175384
atggatggcgaggagctaccctcgtccgtgaactccaaggtacttagggacggatgcaaatggaggatagggtcacgaccgaccgatcgtcgtccctttcccggtgctgggcaagcggaggacgtcgctgcaaggcagcccagtatcctttga

SEQ ID NO: 83700 - DNA, 963 bp, Glycine max
  Peptide Sequence Number=SeqID_175385
atgagcgggttactgaaagcggtggcagaaaatccaacgaaagcgggcggatccctgctggcgttcagttttctctatggcgttctgcacgcgctggggccggggcatggcaaaatcgtcatcaccacctggcttgccacccatccgtcgaagcttaaatcgagcatcggtctgacgctggcctcttcgctgctgcagggaggcgtggctatcgggctggtggtggtggttctttcgctgttgcagcttcccgcgcgccagctgcacatgagcagtttctggctggagaaggggagctatgcgctggtgggcgtgctggggctaatcctctgctggcgggcgctaaaaagactgcgcgcgctgctgaaaaagccgacgttcaaatcctttacaccgcatcatgttcatgatgcccactgcggctgcggtcatcagcatctgcccacgcaggaacagctgcagagcggcgacgactggcgcgcgcggttgatgattgtgctctcgatgggcatgcgcccgtgttcgggagccatcatggtgttgctgttcagtaaagtgattggcgtgttcggctggggcatgttgtctgcgctggccatggcggccgggacgtccttgacgatttcgtcgctggctctgctggttcacagcttccgtcagctggcggtaaaactcagcggcagtaaaacgccggtgctgtggcgacagatagggtggacaacgcttgcgctggcgggaggcgtgattctgctggtggcggcggtgacgatgtggatgagcgccgtgccgcgcatcgctcagctcatcacgcatgtttgccagcatggctttaacaacgcgtgggttacctgcaacgatgttgccggtagacatatagttatggccgccggtgaaatcacacacgatcgcgccagcttcacgtgcgatcagctcgcccgctgcaaaatcccatggcttcagtga

SEQ ID NO: 83701 - DNA, 802 bp, Glycine max
  Peptide Sequence Number=SeqID_175386
catgctgtgggcggtggcgttcggcctggcgatcggcgtggtgtcggcggtgtggcgcaaccgctgggcggatcgcctcggcatgacgctggcggtgtcggggatctcgttcccggcctttgcgctcggtatgctgctgatgcaggtgttctcggtcgaactggggtggctgccgacggtgggcgccgacagctggcgacactacattctgccttcggtcaccctgggggcggcggtggcggcggtgatggcgcgtttcacccgcgcttcgttcgtcgaggtgctgcaggaagactacatgcgcaccgcgcgcgccaagggcgtgcgggaaagcgtggtggtgatgaaacacggcctgcgcaacgcgatgatcccggtggtgaccatgatggggctgcagttcggcttcctgctcggcggttcgatcgtggtggagaaggtgttcaactggccgggattggggcggttgctggtggactcggtggagatgcgcgattacccggtgatccaggccgaggtgctgctgttctcgctggaattcatcctgatcaacctgctgcattggcggcgcaacgccgcactgaaggcgatgccgcttatcgaccccaatgcggtacgcacgccgtggggcgagttttggcggcgttttcgccgccagcgggcggcgctggtcgccggtctgttggtgctgctgctgattgcggcggcgctgctggcgccttatctggcaccgttcgatgcggaaaactatttcgattacgatcggctgaacgaggggccttcgctgatgcactggctgggc

SEQ ID NO: 83702 - DNA, 1065 bp, Glycine max
  Peptide Sequence Number=SeqID_175387
atgctggtcaccgacctgacgctgcgtttcgatccggagttcgagaagatttcgcgtcgtttcctcaacgatccgcaggcgttcaacgaagccttcgcccgtgcctggtttaaactgacgcaccgcgatatgggtccaaaagcgcgctacctcggtccggaagtgccgaaggaagatctgctgtggcaggatccgttaccgcaggccacgcatcagccgacgccggatgacatcaccgatctgaaagcgaaaattgccgcttcgggtctgagcgtcagccagctggtctctgcggcctgggcgtctgcttccaccttccgtggcggcgataaacgcggcggcgcgaacggtgcccgtctggcgctggcaccgcagaacggctgggcggtcaacgccagcgtctcccgcgatgtgctgccggtgctgcagaagattcagcaggagtcaggtaaagcgtcgctggcggatgtgattgtgctggcgggcagcgtcgggattgagcaggcggcagcagcggcaggtgtcgcggtgcaggtgccgttcacgccgggccgcgtggatgcgcgtcaggaccagacggatgtcgagtcattcaacgtactgcagccgctggccgatggtttccgtaactatcgccgcgtacagggcggttcttccaccgaaaccctgctgctggacaaagcgcaacagctgacgctgagcgcgccagaactgacggtactgctgggtggtctgcgcgtgctgggcaccaacttcgacggcagcgcgtacggcgtgtttaccgatcgcgtgggcgtgctgagcaacgacttcttcatcaatctgctggatatgcgcaccgcatggcgcgccaccgatgagagcgctgagctgttcgaaggccgcgatcgtcagagcggagaagtgaagtacagcgccacccgcgccgatctggtgtttggttctaacgccatcctgcgcgcgctggcggaagtttacgccagcagcgatgcgaagcagaagttcgttaacgacttcgtggccgcctggaccaaagtgatgaacctcgaccggttcgatctgtaa

SEQ ID NO: 83703 - DNA, 224 bp, Glycine max
  Peptide Sequence Number=SeqID_175388
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttgctttgaaaggacttgacgatactccacaacctaaatccaaggctggtgctag

SEQ ID NO: 83704 - DNA, 714 bp, Glycine max
  Peptide Sequence Number=SeqID_175389
atggcccgcgtggcagagcagaagggcaaaaatgaactggcgctgcatctgctgggagagctcgacagtgccgcacagtccatcaccctcacacagtggacaccggcactgttgtttgaagtgaaatcccggcgcctcagactactacgcatgaaagccacacgcagtgaaaccgataaatcacggttacagccagagatggaccagcttctggcgggtttgattgcgctcgatccggccagcagcgcggtttttatggatgatttaaccctacgttactacgacgctgaaatgcgctacctgctggaagccggtgaagagtttgcccgtgctcaccccgagcaggcggcaatgctcaatctcgataaagcgggggcgcgcgacccgtacgtggagcggctgttcgagggctttgccttcctgatgggccggctgcgcgagaagctcgatgatgacttgcccgaattaaccgaagggctggtcagcctgctgtggccacattacctgcgtaccattccgtccatgtcggtggtcgagttcacccctgactggcgcgagatgaaagagccgatgcgcatcgtcaaaggtttcgaggtgaactcgcggccgatcggcgagaagggcacgcgctgtccgcacatccgcatgaaacgaaaacccctcatagcgccagatgggtttatgtcgcgcagcagcaacatcagccgaagataa

SEQ ID NO: 83705 - DNA, 459 bp, Glycine max
  Peptide Sequence Number=SeqID_175390
atgacgttgttacttagcaacattctgcccagtgatcgtaatgctgatctccccctgcggaagtatcagttcggatcgcacccacaagacacccagtggacccgaaaaagtccaacagggccctggggtttccagctctggttacgggcctctgtcggccctacagggcgcccgtttcccccagcaagttcatgtcgtcgtggcataggtaaggattgtgcctgcaagacacctagtggactcgaagaaggccaacaggatcttggagttgccagctctaaatacgggtctctgtcagttctagggagtgcctgtcgcccccagcaaggtcatcaggcccccctaccaatcgagctttcatcaagaagtactgcgccctcaggcaggcgcagggcgaaacaccatagcagcctggggatggccggcagcggacaacagacgcaccgccatcacctctag

SEQ ID NO: 83706 - DNA, 1234 bp, Glycine max
  Peptide Sequence Number=SeqID_175391
cggttatcacatgtggcgcatgattggtgccggcgcgcagctggtggtcggcatcgatccgatgcagctgttcctgtgccagttcgaagcggtgcgtaagctgctgggtgatgatcgccgtgcgcatctgctgccgctgggcattgagcagctgccggcgctgcaggcgttcgataccgtgttctccatgggcgtgctctatcaccggcgttcgccgctcgaccatctgttgcagctgaaaaatcagctggtcagcgacggcgaactggtactggaaacgctggtgattgaaggcgatgaaaacgcggtgctggtaccgggtgaacgctatgcgcagatgcgcaacgtttactttattccgtctgcggcggcgctgaaaaactggctggagaagtgcggttttgtcgatgtgcgcatcgccgattacgccatcacctcggtggaagagcagcgtcgcaccgactggatgaccagcgaatcgctggcggagttcctcgatccgcacgacagcagcaaaacgattgaaggctatcccgccccgctgcgtgccgtgctgcgtgcaccacagcgccaccgatccgccggccgggataaactgcggcaggaaagtgacgtaaaagaccccgactttgggattgagcaggttaccggtcaggccacgcgcaaagcaggtcagatagcgctcttcccgcttttgcccctcctgcccgctggccaccgtgctgcgcgggttaagcagcagtctgacgccgagatacagcaggtacacggcaccgatgcctttcagcagccctgcgcagccgctgaacgcagcaccagcgcggtatcgaagccgggcgtcagcgtaagcaggaacagcatacgcgacggcgcatcaattgtccgtcgccggacgatcccagtactgatatttgtaggccgaactcagatgccgctcaatggtgcctttggcaaacacttcggtctcatgcaaatagctcagcgtgcaattgcccacctcgtcccacaactggcactcatccaccgatcgcaaagtgctgaccggcgtggtcgaggtgccgtgcagccgcagttcgcgccactgattatcgtagctgtaagtatctttactgcgcgcgctggtggatgccaccaccagcccctgcggattccagcgccaggtattctcgccgttggtcagttcatcgctgccgcgcgcaatacttttttccagccggaagtgtttatcgtagcg

SEQ ID NO: 83707 - DNA, 387 bp, Glycine max
  Peptide Sequence Number=SeqID_175392
atggtggaagagtttgaagagattctgggatgccctctaggaggaaggaaacaatatcttttctcagggttctatccctccttggcaagaatttccaaaatagtcaaaatctcggcacaggaattggatcgggggaagcaagtcgaaaatagggtggttggagtaccaaggaaatgtttggaagcaaaggcaagaaccttggcaagtcaagacgaatgggctccattcatggatgtcatggcgctcttgatcttcggagtagtgctctttccaaacgtagatggattggtggacctggcagcaattgatgcttttcacgcctttcacgaccacaaggaaagctcggttgtcactatcttagtcgatctatatgacacattcaactga

SEQ ID NO: 83708 - DNA, 279 bp, Glycine max
  Peptide Sequence Number=SeqID_175393
atgccttccaagattattttgatgatgccaaagaatcaagagttaagcaagttccaaagaataaggagtcaaaaagcttcaacaatcaagttttcaagattcaagattcaagaacaatcaagtttcaagaatcaagattcaagaacaatcaagatcaagattcaagaatcaagagaagactcaatcaagacaacacaagaatttttcacaaaatcttttaccaaagagttttactctctgataatcgattaccagaaggtagtaatcgattaccagtag

SEQ ID NO: 83709 - DNA, 305 bp, Glycine max
  Peptide Sequence Number=SeqID_175394
gtatggaagctaagtgcctgaaaaaaaagggcaagtatggggaaggaacaaatgcaaaagtgaaggtgaaaaagaggctaagttttgaattgcaaaatgtagcagttgggctaagctcaacagttgggctaagcacatattcaccactaagcatagctttagcgcgcttagcacaaaggagaatttggctgagcgtgccttcagccaggctaagcttgagactggtgctaagcccaatttcacttactcgcgctaagcgcgagggtggcgctaagcgcaacgtcgcaatttcagagcctatttaa

SEQ ID NO: 83710 - DNA, 366 bp, Glycine max
  Peptide Sequence Number=SeqID_175395
atggtgacaccgccaaggtcccctccgcagtcagatggtaatatggagccactacctaagaagacaagacaaagcacacatcttagaaggctgactttaagaagtttagatcagcctagaccaacagttactgtggatcctgcaactggaagagcatcagactcagagaagcaaaagttccacagttttttaggggtcgtagctcaagaaaagatcctgattgtccacaacaattggaaaaatgtgccagaaactcttaaggacatggcatggggggacattttggcaaaatttgatatcccagaagccgaaaaggccaagaaaaaggtaatgtccacagtggccactagatggaggcaaatttaa

SEQ ID NO: 83711 - DNA, 192 bp, Glycine max
  Peptide Sequence Number=SeqID_175396
atggacgtaggcactggaagtggtagaaccagtataaatcaaagcttgattcttgtttcaagaatagtgatgagaatcatgaaactggccaaatacaggctaaaggcccaagtggagaaggacaaagcccccgagtggagaaggatgaaggcccaagtggagaaggatgaaggctcaagtggagatggatga

SEQ ID NO: 83712 - DNA, 309 bp, Glycine max
  Peptide Sequence Number=SeqID_175397
atgacgttactcgtgtcatgggtgtttgtgcatctaccaagtgttggctactcagagccagaggattatgtggtggaagacctggtagccaccagatggaagccattgagaggtaccacacatgcccttttggttagaaagagactagatgacttacagatgaatgttgtcgtctggtgtccatataagaagcataggagtgtaaggcctttcgcacaacagacccttttctctggcttcattagacgtgagactgatgtgagaccttattgtccggagagggtgctatggcagtttggccatgtatag

SEQ ID NO: 83713 - DNA, 261 bp, Glycine max
  Peptide Sequence Number=SeqID_175398
atgactaggggcaatccaggtgatttacaatcctttgatcctgaaatagatagaacctttcatagattagttaggcatagtgtgcatcttggtcattctatgcattttgagcattctgttgagggtgattctgaatattctgattttgagaattccactactaatttttatattgagaacattgctcaacctccaccttgtgagaggactcttagggaaatggctgcacctgatttcacttatgaaagcttgtgcatttaa

SEQ ID NO: 83714 - DNA, 354 bp, Glycine max
  Peptide Sequence Number=SeqID_175399
atggctgctagtgatcatgctattttgcatgatcggactcatgtacccacaaagagaaacctgttggagctttcttcacaagatgcactgttggcgcagaacaaactgctagctaagcagttggaatcattgacagagacacttagtaagctgccaacccaattgcaagtgactcaaccttctcattcaatagttatgcaggtcggaggttgtagtatatgtggaggagcgcatgaatctagttgttgtatacctcttgatgatgatgcaaaagaagttaattataagggaaatcagcacaaaccaatgcaagtggattttcagtttaccagcaaggtgccaattttaatctga

SEQ ID NO: 83715 - DNA, 627 bp, Glycine max
  Peptide Sequence Number=SeqID_175400
atggacagggcgaggttagtttacggactcgtcatgaggatggacatggacgtgggctctttcatctcaggccagatttctcagatggcccagtccaactcctctcggcttggcttcccggcccttatcactgctttatgcatcgccagaggaattgttccagactcgttgaccttcgagtccctcagccctgccattaatttggcatatattagaaagaactgttggaacccagatgatcccacgatcacatttccagggacctataagactcaggctaggggacctgacgtttctgctccttcttcgtctgctccccttgttctagctgctccagcaccaccaactcctcttccagcacccttcggcacctccgctcagagctcaaacgccatggtgtcgatgctgcaaagccttcaccatggcttatgcctgatgatgcagagcattcataacttggctcagcatcagcccatcatcagcatggaggatttcatggcccaggtggcctggtcagaagtccagccttctcctttaaggggaggtgaggctcctacagcccaagagccgcaatcagatttggaggcgacaccagaggccaaggcagatgctgaggagacaccatag

SEQ ID NO: 83716 - DNA, 1470 bp, Glycine max
  Peptide Sequence Number=SeqID_175401
atggaaatcggggtgttgctaggtgcacccagcattattgttggtgcacctagcaatttaagtgaacgaagacccacagcatccgcacgtaggcaacgggaagttgccgctgttgttgaggatgctcctcacgtggatgatgcagctgaagaggtattccaacatgttgaagaagctgttaatgatgtcgagggttttccaggcgggccttgtgacacatcagtgttgactacctatgctgatcatgttgcaatcattatttggaatgaagatgaacgtcctgaattgaagttatcctcccatggaagaaaggttcaaaaattcgggaggcctgttgctgagattgaagggttggtctctaccacaggattacgttctttggttgcatgctcattggacactggcgatcgaggacttatattcgcttttgtcgaaagttggcataagaaaacgagcagtttccatcttctagtaggagaggtcaccatcaccctcgatgatgtggcctctttgcttcatctgtccatcataggagcattccacagcttcaacactcttcatgtcgacgaagcggtattgctgttagtggagttacttaaagtcactggagatgaagctagagctgaggcagtgcagtgtcatggggcatacttgcacttgttaggttgcactatttttgctaacaagagtgcaacacacgcgcatgttgtgttcttagacgcctttcgagacctcagtcagaatggaagctacgcatggggagatgctgccttaatgcacattgtttggatttatgagaattttccatctattcctgaggcttttacgaaatcagactatgatgaaaagtcaccacgtgtctgccgctggacatctacaaaggcctctacgaaggcattacttgcatcgacgtatcacaagcgtttagatcgattgaagactgctgatgtttgttggatgccttatgagaggatggtgcgacaatttggatatgttcagatgattcctccacattgtgcgggtctaagactatgcttcaaagacattgacgatagatggattcatttctctgactaccttgcaccagtgggcccgatttgtgttgtgcctggacaatgtgcacatgactacatggagtggttctacataatttcacatccattcatgaggcctggtgatccacctagacattcatctgtcatgcaagatgggacatatatggaaccagatatgtctgagatcgcggtggcagcaacatctatggaggaagcacctgcacaagcaccttctgatgtggagcagcctagacatgcaatggaggattgtcaagcaattgcagaaaggttagagcggttgctcaacctaaggataatgactgaaggcacagaagcacatgatgtgatgcaagactgcatacggatcgctaagggtgtcactgtggatggtaatgtatatgttaggtcacgatga

SEQ ID NO: 83717 - DNA, 534 bp, Glycine max
  Peptide Sequence Number=SeqID_175402
atggaaggaagaaggaagcgcaggtgcactctctcgggagcttcctcttttataatggaaggagaccaaaaatttgaatcaagcaaaccgccagccatgctgacgattccagtcaaaacgcaaactgccattcatattggcgatttgctctgcaacccattgacacgacttcacgaagctcagccacctgagctgctgcgttccaaggcctgcaaccctcagtccatggaactcgccagtttgactggcggttcccaaagcgctgcgcatgtcaccattccaagtggcgatttggtcactgcatgcatgtatcgccagtgtcaatggcgatttgctcaaggacaccaaactcgtcactggttctggcagtttgggtcctgcatgcatgcttttcaccctgtggctatgcacggtgaagaaaaatcaaacagaaagagagaggatgagaaaagtgagtgggtccgtataacaccaacaatcaacccgtcggtggtaaaaatggaggctggagagattttatatatacagggatga

SEQ ID NO: 83718 - DNA, 1449 bp, Glycine max
  Peptide Sequence Number=SeqID_175403
atggaatcttggagttatgtccctgaagagaaaggctatttgttttctgatgaaatggagttttcacttgatgctttcatgagaagtagaaaggcattggttgaatgggacaacaaatccaactttgttgagagagatggatttaattcagacagagaggtagttaaaagcatggaatttgtggatttgggattccctgacttgttgcaaaagtcttttcatggaagcctgcctctagagacatctagctatgaactcgatagtaataattctagtaaaagagggaattcctccacacatgtcattgctttggattcttctatgggggaagaagaatccaattcaaagcatttaagttctctagttgagtccaagactcaggattcttcactgattgatctgaaactagggagattagcagattgtaaaggtgcaagcagtgataaagttgagaaagaaggattcactttaacttccatacatccgaccacgctttcgaagagagctcgcacttccagcttgcctgcacaggctcctgtatgtcaagtttatggttgtaacatggatcttagctcctcaaaagattaccacaaaagacataaagtttgtgatgctcactccaaaacagctaaagttattgtaaatggcattgaacaaaggttttgtcagcagtgcagcaggttccatttgcttgtcgagttcgatgatggtaagcgcagttgtcgcaggcgtctagcaggacacaatgaacgccgaaggaaaccccaatttgattacatgactggtaaacaacacaagattcttcagtcatatcaaggtactaagtatctggggtcttcactacagaacaaacccatgtttccctttcaagacatatttcaaagcagcatccttttccccggaaagcatgctcaaatctctcagagtggacgcgtcaaactggaagaggactcgatttacagttcccaacttactgcacccatcacacttgatcaggaatcatcaagctgtgctctctctcttctgtcagatcagtcacagtatctgtcacaccacgcagcatgcaatccattaaccagtcatcgagtctttagtggcatctgcatacccaacagagatggtcaaatttccgaaactcctttgaggataagctctgcagataaacatgcaccaaatgagtcctttccatgtaatacaacctccaaggaggttatcaagaatagatccgctgcgacattttctaacactggtcatgctctccgagtccaccacggagatgatatttgccaaccatcagagttgctcgacgtcaaacaccatttttcctcggaacatgcagccacggttgatttgttccaactgtcctcacatcttcagagggtggagcagcaaagaaattctgttttggtgaagtgggaaaatgaggactactgtttcccaactgtgtga

SEQ ID NO: 83719 - DNA, 1155 bp, Glycine max
  Peptide Sequence Number=SeqID_175404
atggcggcaaatcaaaattccacttctgctactcctacttttcatctgatttctcagaagttagatgattctaacttcttgctatggaggcaacaagttgaacctgtgatcaagtcccataaactccagcgttttgtgatgaatcctcagattccaatgcgctttctcacagaggcagattatcctattcttccgcgtgaacacctcgatgtgatacttgaaggccgaccggaggagtacagtccaatgatctcagtgatcaaaagtaattttgagccacttccgattggagaagtagagatgctactgctggtgcatgaggcacttcctcttcgaataacttcatttcgcaaaatcggtccaattattctggaaatcgcggtggaggtcaccgtggtggtggcagagatcgtggtggtcgttatgcaaactttcagtgccaagtttgctataaatttggtcacacagcagcaatgtatcattaccgctatgattctgagtatctttcaaggcaattcgtcgaacacctttggttcagaacagaatcagggaactaattccaacaaagactcccaacctagtgcaatgctagtcaactctgaaaatcagaatcccaactctaccacatggatacctgattttggcgcatccttccatggtagctttgctattcttagccgatcccaagcccggataaaaggagagggttgtgttaggctttcgacagccaaccaacgcgctgtatggctcgagtacagtgtcaaaagagcaagggccgctgcatcgccgcccggatgtagtgaaaagaggattcgctttggtacatggaatataggcacacttactggaaaatctatggaaatagtggatgttatggtgaggaggaagatcaattttatgtgcctacaagaaactaagtggacaggtgaaaaagcgaaagaattagacaactcgggatttaagctgtggtatacgggaaaaatcagatcaagaaatggggtagggattattgtggacaaggagtggaagaaggatgtcgtggatgtaagaagagtaggagatcgtatcatagtcttaaaattggtagtgggacaggacacctttaatgttattagtgggtacgcacctcaggttgggttagcagaacactttaag

SEQ ID NO: 83720 - DNA, 525 bp, Glycine max
  Peptide Sequence Number=SeqID_175405
atgaaccacgaagacaaactcaccatggacctggttccaccatctgaacacctctgctacgttcgttgcaacttctgcaacactgtcctcgcggttggtatcccatgcaagaggctgttagacactgtgacagtgaagtgtggtcactgcagcaacctctcctttctgagcaccagacccccaagttctcaaaaccaaagcattgatcataccaccctaagtctgcaggggttttacagtaatgccaaaaaggggcaagcatcatcttcatcttcctcaccaacaacatccaacgagtcagtgtccccaaaagcagcatcatttgttgtgaaaccacctgagaaaaagcaccgtctcccttctgcttacaaccgtttcatgaaagaggagatacagcgcatcaaagctgcgaaccctgagatcccacatcgagaagctttcagtgctgcagcgaaaaattgggctaggttcattccaaattcaccaaccagttcagtttctgcaactaaagttaacgctgattga

SEQ ID NO: 83721 - DNA, 876 bp, Glycine max
  Peptide Sequence Number=SeqID_175406
atgctagcaccctctcagagtttctttatgccctctctcactcgtgccaccgtcaaaggtgtccaccgccactgtcaaagttgtccaacgctgccgttgaagcctccggagaagaaggttcctcacaccatcgagaacacgaggaaacttgacaagatcatttgcaagcccgacgatgatgagcgtatagatatacagcttggaatggcaattgatagtaccaaagccactcttgttgtgaagtgtaggcttgcatgtgagatggtgaaatgttggcaacaggctcaagataacattatgaatcttccattagataatggttggggtgaaaagcattgtctttttgtgaaatggaaatatgttgaagcaaagttgtatgaatggagatcaattttctggtctaaagattaccttaagcaaataatggagatgaaggctgcaacatattattatcatggtttgattcttgatgagggaaatacagaaaaatctcatgggatggttgtagttgctttgcaagcagcaaatgagtatttcaaagaaatttttgagcaattgagtattatagctgctcttatttctctgcagggctctaagcggtctcgaacaggggtgacagagtcgttaagtatagctacaaacatttctgtgcaagatgcttacatgtctgattttggttccatggaagtgaacaatccagccattataggagtaggaaatgagccaattaggtcttattggaactgggatgatgatgatagaggcatggaaatggatattcaagccattctatcagagtttggtgttttggtgacttcttcgaaaatgatgttttgccttttggagaggtatctgaatatttatactactatttaa

SEQ ID NO: 83722 - DNA, 219 bp, Glycine max
  Peptide Sequence Number=SeqID_175407
atggtggagaatacgcattcagcgagggcattggaggaggttgaagatcgagctgcagctaggctagaaacacatctcatcaaattggctggtaatattcagaaggcgcttggatattctttgaaggattcgctgcaagaattggtcaagaacatgcaagaacataacgctacttatacgagctcaggtccaatccctcatggacaattgtggcactag

SEQ ID NO: 83723 - DNA, 654 bp, Glycine max
  Peptide Sequence Number=SeqID_175408
atgcaaatcaatttaaatgtcatattcagatcaaatagcggaagcaaaaggagtacaagcgtacctccaaccattgcagatgaaacacgaagcggtgcaagcacgaacccgaagagaagtaggtttggtgatacaaaactgagagcaccccatcctatttatagtgtctgcctatcacagagtttaaccaatttgttatcagaacgtgggcttgagaatagggacctaacttctactaaaggaaaattgcttatggagaaaacgacggcgtttaacggtttaccgtgtttggtttgttttctacaagcacatccgaagctggatgagatagagagagaaaagtgggttttcaaggggtgcctcaatgtacaaaggagtgacaaggttactgaggctcttgcatgtgcaggccttgagtcttctaatcttattgttggtgttgatttcaccaagagtaatgagtggacaggcaagaattcgttcaataggcaaagcttgcatcacattgggagtggtctgaatccttatgagcaagcaatatcaattattgggaaaagcttggcagcattcgataaggataacttgatcccctactttggatttggagatggtatctctttaaacaaatttaacttatggagtgcattattttga

SEQ ID NO: 83724 - DNA, 437 bp, Glycine max
  Peptide Sequence Number=SeqID_175409
ggaccttggggtgtgagctggagaatggagagtttgtgccgccggagaagccggtgatgatgtcacggaggagtgaaattgagaatggggagattgccggtgagagatggaagaaaggggaggcggagagggggggagtttgtttctggaaaatggagaaaggaggagctactgtaaggttggtttcaaacttcttaatattacaagacaggttagtagcaaaaatccggcaaagtgctactgagtctcctaatccaaaacctaaggttggagagattgacactagcccaccttttcagtctgttaaagatgctgtctctctatttggtgaaggtgctttctctggtgaaaaacctatctttaagaaggcaaaaccttattctgctgaggagacacttgactctgttaacagtgcatacttgttgtccttgtcatag

SEQ ID NO: 83725 - DNA, 423 bp, Glycine max
  Peptide Sequence Number=SeqID_175410
atgacttggctcgctccaaaagcaaagtttgcatttggaaggaatcttttctttctttttgcctttatagtttcatttctcatgagtgtgtttgtgaaggttcttcgagatgatgctcgacttcttgaaggggatcctttgaaaattgatcaatctgtacttaccggtgagtcactgccagtgaaaaagggtcctgatgatggagtatattctagttctacctgcaaacaaggagagattgaagttgtggtcattgctactggtgttcataccttctttgggaaagctgctcatcttgtggatactactaatcaagtgggacactttcaaaaggtcttgactgcaattgggaacttctgcatatgttcaattgcattagggatggttgttgaaattattgttatgtatcccatccaagattga

SEQ ID NO: 83726 - DNA, 438 bp, Glycine max
  Peptide Sequence Number=SeqID_175411
atggactcatctaatgaaaagatgtcaggcaaaagaaaagttttaggaaaaaataatgaggaaacaagaagttattttacatgggatttggagatggaacgtatattggctgatgtactgagagatcaaaggaatttgggtaacaagggcgacggagaatggaaaaggtcaacattgaatgctgtagcggtagtgttgtctacaagcttcattgttaatgtcacattagataattggcataaatcggctaaatcgttccgattcaaggtgcttcaaaattgggatgatatagtcgatttgtgtgctaaagatagagccactagtcatggagctgaaactgctatggatgctgatgaagcgatgagtagagaaacaaatgaagtggaattcatgggtttaggtgccaatgctactatagacagaagaaccaagctctaa

SEQ ID NO: 83727 - DNA, 402 bp, Glycine max
  Peptide Sequence Number=SeqID_175412
atggatgctacaagattacatgctgcactcgggtctaaagcagtagtaggtgatgagcgagggagagagaaacctaccagtgagaggaagaaaagctacggagagggaggtggtagtgtgctgagaaggagaaagcgctgcgaagagagtgttagtcggttaattaggcaagctttgaaaagtgttgttttccatctcctcgctaagccaatctgttggcatagcgagcgccacctatttaagcctgaaatcagattttgtgaagagagtttggactgggattcagagctttgcatgtctagggtttctagagagcgaaaggtccaagtttcaaagagttttgagagattttgttgtgtgaagatctgcatagaccagagcttgaagcaggaacccgtttga

SEQ ID NO: 83728 - DNA, 704 bp, Glycine max
  Peptide Sequence Number=SeqID_175413
aaattcatgaaggtgttctaatgtctgaaatctatgggattaagatggtcattgaccaatccctattttttgacttaaccaaattgcctagtgaaggtgtgccttttgagggtgcactaattgatgaatggaaattcgatttctctgtgcatgatgcccgccggttggtttgcaccaaccaagcggatatgaccggaaggcttcttgccgatctcattgtcatgtgggcctttcataaaggtttacaaattgattgggcacatcttattagatatcgcatgcataaggcattgcgattgaatgccccattgccttatcctcaccttgttaccctcttccttcaacatttcaacatccctcttgattctgaaccttatgttccaatcaagagatcattccttataggcgcttcagtcatagcatcctttggttatattaaggagcatgatggatcatgggtaaagaagggtgctagaaatattggtgaagaaggacacgagggagaagattcatatcttctttcaaagattttggaaaggtttaatggtcttcaaacctttgttggtgagaggtttgatactttggaactgcaagtggatatgcgcttcaatgaaatggagtcaagaatgactaaggttgaagaagatgtatcttacatccggttaagctttgatcttccaccaccgccgccaccatcatcttag

SEQ ID NO: 83729 - DNA, 210 bp, Glycine max
  Peptide Sequence Number=SeqID_175414
atggattgtcacctttcatgggcgcttaggatcaaggaagttttttggcagctgctcccatcgggatggatcaagttgttctatgggcaaggaagttgctctatgggaaatttcgccattaagttaggtgttaatactgtgtttgaagctgagatgttaggagctatcaatgcagtggaaatagcttgcaatatgaattggaataattga

SEQ ID NO: 83730 - DNA, 360 bp, Glycine max
  Peptide Sequence Number=SeqID_175415
atggagaagttcttcaagagagtcgcatggggggacatgttggaagttgtgatagctcgccagacgagtggtgtatcgggtatgttcgctgacttgctatctcttggggatatgactggtcaaatggcaacacccgtggaggttatagagatctcatcttctcctgcttcaccgaccttatctttgtcaccacctacgtcagatgcacctacagaggcttcttgggatctcattgagcatgtagtggaaaccacgaagggagaagctgagtggcttattgaggaaagtagtaagaagaattccaagaaggatctcgatgaggatatgagggatgtttcctctcaagagtctcattgttag

SEQ ID NO: 83731 - DNA, 273 bp, Glycine max
  Peptide Sequence Number=SeqID_175416
atgcttccaccttttcttattctgctgcgtatgctcttcatgagaaagacacgacaccgcgatgaagacggagaacagtggtgtttgtgtggtcatattgctgagatgcttaatctactggcagtgttacagaaaggtaggttaaatccaagattctacattgctgctgctactgataatatgagtcttcaaaaagctcagttgttggagaattccctggctgctgaggttctattttttgctatgtctctcgaagtaccttttattcaatga

SEQ ID NO: 83732 - DNA, 357 bp, Glycine max
  Peptide Sequence Number=SeqID_175417
atggcagaaaatatgcaaattgaagaacctagttcacaccaaccaacttcacaatcttcagaccatcctactccgctatcttcacaccaaccaactccagtagaaagttctaccggtacagttgaaggtcctaataatgaacctatgcaacaaccacctagcatggaggtggatgaccatggtgtatcatcaacaaaaactggaggagggaggctcaaaagtattgtgtggaaccattttggtaagattaaaactgttgatgggcaagacaaggcccaatgtaaatactgcaaaaagcttctcgggggagcatcaaagaatggaacaaagcatttgcatgcccatatggagaaatga

SEQ ID NO: 83733 - DNA, 255 bp, Glycine max
  Peptide Sequence Number=SeqID_175418
atgcagcagcagcagcaaccatcaggcccaatttcatccttttgctgtaaaatcttatttttctttgggctttgtttgaaacgaagtcaaagattagagcagcatgcaaaggattttggttatgtgcaaacaacatccactgaggatttgaagtcatatgttttcaatgagccaatagtgattgatgctgcacggatgcctccacttggccctgcttccatattattggttgtcatgcatgattctattgactag

SEQ ID NO: 83734 - DNA, 314 bp, Glycine max
  Peptide Sequence Number=SeqID_175419
atggctgtactgggatgggtggtaaacgtacaagaccacgtggtggttgtccctcctccagtggaacgacatagggggaggtggctagtctggaatcttgtacatggccaaactatctcaacaccctcttcagacgataaggcctcacttagtcctacatttggtgaagccaaagaaaatggtttgttgtgcgaagggcctcacacccctgtgctccttatgtggacactagatgagaacatccctctgtacgacaatgcagctactccccatgtgtacttatggcaagcatccaggttcctgacttactggag

SEQ ID NO: 83735 - DNA, 363 bp, Glycine max
  Peptide Sequence Number=SeqID_175420
atggtggttccaaagtcagaaaatgatgcaaggataagcttaaactaccaaggaacaagcttagaatcacgattacctcaaagaaaaccggttcctctcagtgtggggtttcaacggaaaactatggtggttcgtggtggctactggtggttgtgggtgatggaaaagaagtttgggacgctagaaatggttttggaagaaggaaggagaaggaaatggcgtttttccaaggctacacgaaaagcaaagtctaaaacactcaagtgcttctgctcgcgagaaaggaagcgttcctcacacgccagatgtcttatcgaagattgcaatggtcagatcgtggacatttgtcctatgaacctctag

SEQ ID NO: 83736 - DNA, 375 bp, Glycine max
  Peptide Sequence Number=SeqID_175421
atgtctgtcacaaagatgatcatcactttagatgatgtgtcttgtctactacatttgcctgtgacaagcaaacccattgatgatgtcctctcacagtttgatagagaagcgatgaagatccttccaatgactcatcttggcattccaatagagacagatgttgcaacggcggcacacacaagtgtcagggaggtgagtttagttattagaagggtgttagtagttaaagtgttagcttctcaaagaagcctctcaagaaagcttctcaaagaagcctcacaaggaagcttctcgaggaagcctcttaatgaagctgccccaaaccatctcggtaaaagcaccctcctgcatccgttaaccgttagatcttcttga

SEQ ID NO: 83737 - DNA, 357 bp, Glycine max
  misc_feature (255)..(255): n is a, c, g, or t
  Peptide Sequence Number=SeqID_175422
atgacgtgcgaccattctttggtcctcgtgaggtgcttggcacccatcattaggcaatttgtgaaattccaggacatgccgaaaaaccaaaaaaatattgatgcacaatcccacccaggcccacttgggccctctggaatattcctccagaaggcggttgcttctggaggaagcaaccctgctcgcctgggcgagctgggcggcaaccacctcccctattttgctataaataggggaggaagtgaagaagaaagngggttcagcccctttggcacttctctctctttcgaatttgcttggaaaaattgtttccgtgaagaaaatctaagccgaggtgcttgcgaaacgtttccgtaa

SEQ ID NO: 83738 - DNA, 414 bp, Glycine max
  Peptide Sequence Number=SeqID_175423
atgtggctatccaagaaatatggctatgtcttcacttggaggctcctcaaggacaggctccccactaagggtaatctcataagaagaaatgtggctatccaagaggctgtttgtcctctctgtggtcaagtgcaggaggaagtgggtcatctcctctttaattgtaaaaggacaataggcctgtggtggaaatccacgagatggattcaggctgtaggacctcttccagcttccccagcaagccattttgcccaattttgtgatgggtttggtgcagaaataaatcatagcagatggtgtgggtggtgggttgctctaactagtgctatatggcagcataggaacctcctgatctttcaaggaaatccttttgattcctctaaagtcatggaagaggctatgtttctagtttag

SEQ ID NO: 83739 - DNA, 378 bp, Glycine max
  Peptide Sequence Number=SeqID_175424
atggctgctagtgatcatgctatcttgcgtgatataactcatatacctaccaagagaagcctgttaaaactctcttcacaagatgcatttttggcacaaaataagctgttagctaagcagctggaatcacttacagagacactcagtaaattgccaacacagttacaagcgactcagccctctcatttagttgttatgcaggttggaggttgtagtacttgtggaagagctcatgaatccggatgttgtataccccaagatgattttgctaaagaggtaaattacacgggaaatcaaaatagacaaggatttcattcaggcggtttttcaggttaccagcaaggagggaatttcaatcaaaatcaagggcaaggatga

SEQ ID NO: 83740 - DNA, 444 bp, Glycine max
  Peptide Sequence Number=SeqID_175425
atgacttggctcaacatcgacccatcatcagcatggaggactttatggcccaggtggcctggtgaggaatccagccttcttctacggggggaggtgaggctcctacagcccaggagccgcagccagagctggagggaatgggaagaatcaaaagaattctcagactgtgtcgttttgaattctttgacaagggagaagggagacacaaaagaattcaggcggttagtcccttgttcttttggaaaagagagaagagagacacaaaaaaaattcaggcggttagtccttggcgaattctttttggcaaagggagaagagaatgaaaagatgaatagcacaagttttcaaggtttggaaaaccagaaaacttcagaaagcttttggttcaaagaagaagaagaagttcaaagagattcaaggcttgtaaaggattgtatgaaatga

SEQ ID NO: 83741 - DNA, 198 bp, Glycine max
  Peptide Sequence Number=SeqID_175426
atgaatgagagaggcaaaggtatcgagcagggtgtggttgcttgcggtggagagatggtggttcatgatgcggtgttgcgtggaagagaaaagctacaatgttgcatgggagagggagatggagctcgaggacaagtgttgtcggaacggtgtctcattgggggtgtagggcttttgaaggtacaagggaagttttag

SEQ ID NO: 83742 - DNA, 1515 bp, Glycine max
  Peptide Sequence Number=SeqID_175427
atgtcgccaattttgaagtatcctttgggtttttcctcttttcacactgcttcaaattcctctgtagagcactcacaagaagaggaagtagtgattgctctgggaagtaatgtaggtgacaggctgcataacttcaaggaagccttgaaattgatgaggaactcaggcattaacatcacaagacatgcttgtttgtatgagacagcgccggcatatgttactgatcaacctcgctttatctactcagcagttagagctgttactaaactaggtccacatgaactattgtctacactcaaaagaattgagaaggacttgggccgtacagatggtatgagatctgatatcctcactatacctcatgaaagaatttgggaaaggccatttgtgatggcccccttgatggacttattgggatcagctattgacagtgacacagttacttcctggaattcattttcaggccattctcgtggactctctggattatgggaagatttaggcagtgaatcccttattggagagtttggaaaggaaggaatgtatagggtaatgcctgttgcaaatggcttacttgactggtcatggagaacttccgtcatggggatccttaatgtgactccagatagttttagtgatgggggacattttcagtctgtggagtctgctgtttctcaggttcggttaatgatttcagaaggagcagatatgatcgatattggggctctgtctactcggcccatggcatctaggatctctgctgaagaagaattaggtagattaatccctgtcctggaagctgtagtgtcaatgcctgaagtagaaggaaagctcatatccgtggatactttctactctgaagttgcttcagaagcagtgagtaaaggggctcattttataaatgatgtatctgctgggaagttagatagtaatatgtttaaggtcatggctgatcttaatgttccttatgttgcaatgcacatgagaggggacccatctacaatgcagaatagtgaaaacctgaaatatgataatgtttgtgaagagatatcatcggagttatactcgcgggttagagaggcagagatgtcaggaatcccgggatggaggattatgattgaccctggcgttggattctcaaagaaaactgaacacaatttagacattctcatgggactacctgatatcagagaagagattgcctcaagaagtttggccatctctcatgctcccatgcttattggaccctcaagaaagagatttttaggtgaaatttgctctcgttccgatgcagctgagagggatcctgctaccattgcttcagtcacagctggtgttttgggaggggctaatattgttagagtgcataatgtcaaagataatctagatgctgtgaagtatttggatttttgcagcaacaactctgttagtgttgttctttgccatgttactcctactccaaggtcatatgtagaacacaacaatgctgtcaaagccggaacaaagaagcatcaa

SEQ ID NO: 83743 - DNA, 1023 bp, Glycine max
  Peptide Sequence Number=SeqID_175428
atggcgtatctttcttttccccagtttctctcgcttcctaggtaccacatgacttggtcctattgctgcacttcttttaacacagtgcaacttgggaaactcgggcctgggtgtaaatggggtcatgtcgcaatggctaggaaaaaggcctctctagactcttctatagaagaagagcccagtgacaatgaatctgtggtggaaaagaagacgactaggtcatctaaaattaagaagacaacagtgaggactaggaagaaaacaaaagatgagtcccctggagatacagatgatgcctctattgaaggaagctcagcggccgctagtgatgattccaagaaaactcgaaggactcggaaaaaaggtgcatctagttctgctggcctggaagaaaagaaggaagtcaaggaagagaaaaaggttagaagacgaaagaaaactgaagaggagaaattaattgtagaggataaaggtagtgaagctgaaatcagtgaccaagatgagccttcatttcttgaaaatgtggaggacgatagtgacagtggcttggaactgataaaagatgatggagaggacattagctttacttatggatggcctcctcttgtttgttgctttggagctgtgcagcatgcttttgtgccttcagggagacccgccaataggcttataaatcatgaaatccatgaaagcatgaaggatgccttatggagccctgaaaaatttgttagggctccagggggctctgctggtagtgttgctattgctcttgctaccttgggtggcaaggttgctttcatgggaaaacttgcggatgatgattatggtcaagcaatgctatactatatgaatgcgaataatgtccaaacccgatcagtacgtattgatagtaaaagggcaacagctgtatcactgatgaaggttggtaaaaggagtcgacttaaaatgagttgtgtaaaaccctgtgctgaagatagtttgacaaagtctgagctaaattttgatgtgctgaaagaggtatga

SEQ ID NO: 83744 - DNA, 330 bp, Glycine max
  Peptide Sequence Number=SeqID_175429
atggaggctctgtcatttgcctcacaagttcttcaagggaagattgcggagaagcctcaattgttatctgtttctggggttgttgttgtggttgttgttgctgctggattggggcggaatgtatggattcgaccatctaagattgggatgattcctccacccgggattgtacctgttgctggagagcataagcttcaaactgttcaattgcttcagattgtttcacaaaagggcaaaggtttgtgtggtggtcgacaaagaagcataaaccacagagtcttgcgacaggtacagacttctaattcaaggccagctgggttaccaggttaa

SEQ ID NO: 83745 - DNA, 87 bp, Glycine max
  Peptide Sequence Number=SeqID_175430
atgagcaagaggctccaagaggattgggctaaagctgctgaagaaggccctaggattctcatgaacctcaaggactccataatgtag

SEQ ID NO: 83746 - DNA, 267 bp, Glycine max
  Peptide Sequence Number=SeqID_175431
atgatcgtcatttttgtcattgctgcttttgtcgccaccaccgtcaacgactttgtgcaatttatggaaggtttggaggtgttcctttcacaaaggagaaacaagaggtggcaaattcgctcaggcttgagaggcaattggacaacattttcattggcaacaataagttgtatgcaaatttacctgaatttgggaaaagaggaacaaaagagaagatcagtctgcaatgagggagtaaagagacgaagcaagtacaacaggaaataa

SEQ ID NO: 83747 - DNA, 1215 bp, Glycine max
  Peptide Sequence Number=SeqID_175432
atggtttgcaaggatgttgagctggaagggagggaacttcaagttataaactcagcgagaggtcttctttgcatatggaggaaaggtatatttgaaattgatccagttttctcaggcaatggttttttgggtattaagggtttgtggaaggaagaggattttaactttgcaaagaggatggaggaaatgaggaactccaataattatttgacaagagaaaaggactttgaggagtttaatatgcttattagggatatagatattgaagatactcctatggtgggtagaaaatataattggtataggtctactgagcattccaagaatggactatacaggttcttgtgtcaaaatggtggatgcatgaatggacaatggatcaatgagttggatactttggatgcagctgatgggcttcaggaggatggacttaaaaggaggggaaggctcatgaaggagttttggaagcatggaaaatttcccaaaggtggtaatccttcttttattcccttgattcctaaaaagaataatccacagggccttgatgactttatacctatctccctcattaggcgtgtcattgccaaagttctatcaagaggtggtagaggattcaaagataaaaaaggaataagtgcttattgtttaaagtggactttgagaaagaggttgggtttctatgagagatggattacatggattagaggatgtttggagtctgctactatgtcagtccaagtaaatggtagtcctactgaagagttttctactagatataagatgggtgcagatgaggtggagatatcccttatgcaatttgcggatgacacacttttcttggacaaccctgatcatgctaatgtcttatgcattgatacactatttggggtgggttacaatcttgtaatcatttttgtgatagtgaaatactttttgagtcagttccgtggacgtaggcaagagattgattcaaggagttttgatgataacaaagatgatgacaaaaagctcaaaagtcaagatcacttcatgataacaaagatgatgacattcaagaatgagttcaagattgagtcaagaacacttcaaggatcaagaggaaatttgatttcaagaatcaagaatcaagattcaagattcaagaataatcaagatcaagattcaagactcaaagattcaagaatcaagagaagacttaatcaagataagtattaa

SEQ ID NO: 83748 - DNA, 435 bp, Glycine max
  Peptide Sequence Number=SeqID_175433
atgacgcacattctaagacggttattaataaccgccttagaatgtgacacgggttcaagcacgaggtttacgacgacaacaagaggtggtggtggtgaacaacgaggagattcacctcgtttcaatgccgagcaagaggaagaagttctcgtgcttctgacgctcatcgtggcgaacacgacgaagtattttgaggataggattgaggccttgagggggtggcttttccacgagattgatccgttacgggtccaggggatgtcctcggagcttaagaggtacctcgaggaacggttgttgctgaagcagtatgcagagagtgacactgttgttgataacgagaaggagaggaatattgtcctcacgaggattaatcctgagatcaaaatctgtgaggtttgccagttgaagagcgaagctaaaaagttgaactag

SEQ ID NO: 83749 - DNA, 96 bp, Glycine max
  Peptide Sequence Number=SeqID_175434
atggatgtgccaagagggaagacacctgctgactgcaaacagtatttcaaaaaggaactaacaactttcacagagacaatgacatacaagacataa

SEQ ID NO: 83750 - DNA, 1941 bp, Glycine max
  Peptide Sequence Number=SeqID_175435
atggccacccccaccctcataggcccacctgaactctacaatccctaccccacccaaaccccagccccaaccccaaccccaaccccaacccaaccccaaacagtcacaagaaccactccaattgaccctttcatagatcaaatggtggtcaaattcaacaccatgtcatccccaccacccccaaacatgaccctaacagaaaacatgtctcccacattcttcacaacgggaaatccatgtctggacttcttcttccacgtggtccccgacaccccaccagagactatcctccaaagactcgaacttgcctgggccctcaacccccttaccgccctcaaactcgtctgcaacctccgcggtgtccgcggcactggcaagtccgaccgtcagagcttctaccccgccgccctctggctccaccgccgtcaccccaaaaccctcgctgccaacgtctcctccctcgccgaatttggatactttaaggatctccctgagatcctctacctccttctagaaggatccgatgcccgcaaggtccaaaaagaagcgtggcagaatcgcaagagaggggctcacaataacaaaaagaaaaaccctaggacccagaagatgcagaaggtgaaaacgaaatctttggcccaaagggtcaacgtagaaaaggaaaaggagtcttccgagaaggagattgcgcatgttgccagagaagagaaaagggttgcactggcgaagaagcttgttgaacgttatgcaaaagacccagattttcgtttccttcacgatcgtgtctctgattactttgctgagtgtctgaggaaggatcacgagtttttgaaatctgggctggtgacaaaagtcagtcttgcggcgaaatggtgtccctctgtcgattcctctttcgatcgtcacacgttgttgtgtgaaactattggcaagagggtttttcctcgtgatgagtataaggagtatgagggggttgaggaggcttattatgcttacagggttcgcgatcggttgaggaaggaggtgttggtgcctttgaggaaggtgttggagttgcctgaggtgtttataggagcaaatcgttgggatttgattccttataatagggttgcttctgttgctatgaaattttataaagagaagtttttgaagcatgataaggagaggtttgaggcttacttggaggatgtgaagtcagggaagagtaccattgctgctggtgctctgcttccccatcagattatagggtctttgaatgatggggatggtggggatgtggctgagttgcaatggaagaggattgtggatgatttgttgaagaaggggaagatgaagaattgtttggctgtttgtgacgtgtctgggagtatgagtggggtccccatggaggtttctgtcgcattggggttgttggtgtctgagttgtgtgaggagccttggaaggggaaggttgtaactttcagtgaaaaccctcagcttcatttgattgaaggggatgatctcgggtccaagactgaatttattaggaacatggagtgggggatgaacactgattttcagaaggtgtttgatctcttgttggaggtggctgtgagtgggaatctgaagcctgatcagatgatcaagaggttgtttgtgtttagtgacatggagtttgatcaagcatcagcaaacccttgggagacagattaccaagcaatcactagaaagtttggtgagaaagggtttggtgatgcagtgcctcagatagtcttttggaatctgagagactcaaaggctaccccagtgccagccactcagaaaggagtggcactgcttagtgggttttctaagaatttgctgacactgttcttggataaggagggggagctgagccctgaagaagccatggaagcagctatttctggcccagaatatcagaaactagttgtgctggattaa

SEQ ID NO: 83751 - DNA, 2094 bp, Glycine max
  Peptide Sequence Number=SeqID_175436
atggagttcacagttgccaccacaactttcacgaagaagctctcaaacggcagtggctacggcgtctccggaagatccgcgtatgacggcgtcttcgccactcctatcaagctccacactccaaaattctcctctcagttcgacgactaccgcgagattttctgcgctgctgctggaacgtccattccgatcctcgaacttccggagctcaacaatagaaaaaacaacgacgttcggtactccaagttcgattactcaaatgtcttcggcgggcttgagaatctaggcgctgctgcggtgcctttcccggagcttgttgctgagcctaagaagaaaaatagcttcagagcaaggagcaaggtcaaaggagaaaaccaatcttccagggaagatcaaactaattgttcaaaggaaattccagtggcatcatggtcatctaatgataccagaaggatcaatatgtcatatcacaaagttaaccaaggaagcgaaaatggaacaaatgggacgacacatattgctcaactccgtgctgtccctgcttacactcaattaattgaagaagtcaatccggtgaagatgaacagggctaataagtctataccagtagcacaggatactacttgttctggtagtcatggcaatgaggggaaaaaagaagctgcacattctactaaatcatttactggtgcttcacctgataattctaagaaacagtcttccaacaatggagtgaaagttacaagtagatccgattctattgatctgttttttgatgcatgtgagattagcaatggaagtaatggaacacattatgtcaaagttcctctatccgagactacagaaggtaacagtgaagctatgaaatcaatgccaaccaaatgccaggcatctaaaagtagctcatccgaaggtgttgctggtgctgattcgccttcatacttagatgacatggtagacttaaattcagaggtagctgcttctgtagctgctttaagaaaggcaatggatgaggctcaagtaagaatgaaggttgcaaaagagttgatgagaagaaagaaagaaggttttcctgatcgtgtcaaacaaaagtctaacattgaattgaaagctgagagaaaaaaagaggctaaagtcacatataaaacaaagaaaattgatacaaggcaaacatttagagaaatggatgcttttcaaaatgcttcttctgaggtagggaagtcaacaatgagaatagagcaagtgaggccagatctgggggcaaaagaaacaagtgttgctaaagtagctgtacaaaaagcacagaagaaattgaaatcaactcaagtgaaatatgagaaagaggttgaacagaaagaagcgaatcataaaggaaaaattcttgagcttaaacaggcagaaaataacaagaaagagctgtacgttaaaaacacggataagaatgccactgataaaccagaaggacctgatcaaacaatagaaattgttacgaaatattgggggctgaggaataatgaagcaagtgtgtgtgaagaacttgtccaggaaactagacataggtgtcaagaagtagtagatgaaacaaaactagttcaagagacacttgaatgtggaacaatggacaagagtttgaagtttaatgaaactggggaagttgaggataaggctacatctttttatgaacttgaagactatgaaagcaaccttggtgggcaagggttaataacaagaaatgggaaaaaagttgcttgtaagccagaagaagatggcaacaaatttgaagggtcctttgagctggaagaatgcaaaataaatttgagagctgctcaggaactgggagaggttgagaagaacattacccaagagcaaaaaggaagtgaggatagagttgctgtgtccaatgagctggaagaatgcaaaataaatttgagagccgctcaggaactgggagaggttgagaagaacattacccaagagcaaaaaggaagtgaggatagagttgcagtgtccaatgagctggaagaatgtgaattgacagagattctggagccacttaacaatgagagtgtgcacagtcaacatggctcagatttc

SEQ ID NO: 83752 - DNA, 333 bp, Glycine max
  Peptide Sequence Number=SeqID_175437
atggttatcaatctcagattggcagtgcgagaacttggagcagcagtccagcacgacgcgagtagctcaggagaaaatgagggctttcgacgagtgttctacgatggcgtggaccaacagtctaacacgacgcgagtcagacagagtcacgagaaagggctagcgatgatgaagaccaccacgatgccgatgcgactttgcaccagcacaacgccgttttgggttttcgtaaactcgcggactcgaagtagaatcccgagtctacctagactcgcccgagtctgcgctaaatcggacgagtctactccgtttttgattctgcttccgatttaa

SEQ ID NO: 83753 - DNA, 204 bp, Glycine max
  Peptide Sequence Number=SeqID_175438
atgggcgagaaaaaactagaggaaaacaaagtggaggagaaaaaagcaaatgaagaagaaaagaaagaagaagagaaaaaaccagaggaatcaaaagatgacaaggaattcaaggaggaatctgtgccgccagaaattgtgttaggcacaacctttgcaatacatggacactttaagcacgatttccggcatcttttaaattaa

SEQ ID NO: 83754 - DNA, 333 bp, Glycine max
  Peptide Sequence Number=SeqID_175439
atggcacttgaatcattgtttcatatgttgaaagattgtgttagagtaagggaagtgtggggggagcttttgaatgggagaactattactaattttaatagtgatgttgtgtgtgataggatcgagactaatgtcaatccgtgtaggaatacgcagaaggattggctagttatttttgtgataaccattgactatatatggctcctcagccaaattgcattaagcttaatgcagatacgagagttaatacgggagacgatgaagcttcatatgatagggtgttatgagaccatgcttcagaatttgtactggttttgtagggaggattggtga

SEQ ID NO: 83755 - DNA, 435 bp, Glycine max
  Peptide Sequence Number=SeqID_175440
atgaaggtgagtctcgctcaaatttgtatggagaatggtaccatccatttctttaattccttgttgttggactacgaaaatctgacatgggaggatctgaaacatgaattgctggagagatacgaatgggttagtgaaggttctgtgtttgagcaattcacatcgttgcgtcaaacaggaacgatggagaaatatatttatcgatttaagagtttggtggtgcaagtacctcgattattggatgagccattgaggcagaactggcgcgtgggttgcgtagggcgtgtagatatgcgaggaggaggttccggatttgggttggtgcaaaaaacccatggaactaatacgggtcatggagtaataaggggtgttgggtttcagggtggaactaatgggccatgcccaaatgaaaaagaggtggagataagaaactag

SEQ ID NO: 83756 - DNA, 1041 bp, Glycine max
  Peptide Sequence Number=SeqID_175441
atggctcgactgcccttggatcctctttattccaaagctcttattttagctagtcagtttaactgcctggaggagatgttgataactgtggcactgctgtctgtggaatccatattttatagtcctcgtgacaagttagaagaggcaagaactgcaacgaaatgcttctcaagtccagtgggagaccacatcactttgattaatgtgtatcgagcatctaatgatttcttggagaagagatcaatggaaatgaatatggcaaagactgaaaaggtttatagaaaatggtgcaaagaaaattttattaatagccggtctcttagacatgctcgtgacattcacaggcagattcagggacatgttgaacaaatgggtctgaatctttcttcttgtggagatgatatgcttcaattctgcagatgccttgctgcttcctttttcatcaatgcagctgtcaagcagcctgatgggacatacagtggagttggttttgcttgtgaaaaaccaagctttgaaaggagaccgtgtagccaaataatcttagagcatgtagcagacatggtatggtattctgttttagtggatgatttggagaccgagtcttgtttcttgcatttccaagagattggagcttcccctaagaacatacaccagcctatagtggattttcgtgtgtctggacatccagccctatcagaatcactaggccagtttgtcgtcgccgtcgccgtcgcgcaccagagcactgtcgtcgccgttggtcgtcggtcgtcagtctctctcgtgcatcgtctgctggtctactgccgttgcgctcgagaacatcgtcagcggttgtcatgtgcgtcaccggcgcccgcgctatcgttcgtcgcactggagactgctgctggtcgcgtcgctgaagaggagaaactcgggtatggttggctcggcgccgccataagcaacccgcgacgccaccgctatttggtggcgtttttccaaaattccgtgacatcattccgccatggccgctttttaataacactgcaaaggtga

SEQ ID NO: 83757 - DNA, 192 bp, Glycine max
  Peptide Sequence Number=SeqID_175442
atggctattggaaatgaattcctcaagaagattgctcccacttggatgaatgtttctcttgcaatcaagaaagatcctgaaactgatcaagcttttggatgggtgcttcaaatgtatgcttatgctgttgcatttgctcttcatggtgttcgtaacatattacacaaggactttatgattcaggttcaataa

SEQ ID NO: 83758 - DNA, 1252 bp, Glycine max
  Peptide Sequence Number=SeqID_175443
atgacctggagattaactctagcagaggttaggcatgtattgggtctgctagttgattttaaactagaagcaatagctgctgtgaagttgtacaagaattatattatcataaaagggtgctctgagaagaaacgaccttctccaccttacattttgtggatgaaagaccaacggaatgagatcaagaaagtgaacccagaggccggatttaaggaaatttcaaccatgctaggtgttaaatggaagactgttactgcagaagagaagaagccttatgaggggatataccatgcggagaaagaagcttatttgcaggtgattgcaaaggaaaaacatgaaactgagtcaatgaggttgttggaagacgagcagaagcagaggactgcgatggaattgcttgaacagtacatgcaattcaaacaagaggcagaaaaagatggaaagaagaacaagaaagagaaggatccattgaaaccaaagcaccctatgtcagcctatttcttgttcactaatgataggcgagcagctcttgctgccgagaacaagaatttcttggaggttccaaaaatcacattcgaagagtggaaaaacatgacagaagaacaaaaaagaccctatgaagagatggcaaagaaaaataaggagcaatatgccctagaaatggaggcttataaacagaagaaagatgaggaggctggccatttcatgaaggaagaggaggaccatatgaaaggtttgtctgtgtgtctgcgtgtctcatcagggggtgtgtgtgtgtgtgtctgtgatgaggaggaaacacaacaaggccaggtttcacgcagttgcgttgtttactgtcttggtgttgtcataattgagatactgacagcgaggttcccttctcagtatgtcagcaatggaaagggctctaggaattggcttgctgagatggagcaactcctcctcattggtgctgcttgcactgaaagtaaccctcagcagcggttagacatggcggaagccattagaaggataatggagattaaattcgagtgtgataatgttaaagctgtcaaggctattcttagaagttatgagatggtttttggcctgagaatcaattttggtagcagtcaatttggagatgtcgcaacctaccattcggcgcgagggcaacgcgagggctcacgggtgtgtcttccatgggaggaagatgcgcggagtcgccaccaacgtttattcgaggaaaacgtcggaaaaaaccagaaag

SEQ ID NO: 83759 - DNA, 600 bp, Glycine max
  Peptide Sequence Number=SeqID_175444
atgggacaaggaaataaaaagacatacataattcactacacttatggctgttactatacaatgaagttctacaaagatctcaagcttgtgagagctgaagacttcttcagacatgtagaactggggaagactgacaacccaataggttcaaacgtgactcaagtgtttgttgatcaactatcacgactaaacacgttgggtttgaacgctccccacactcaccctcgaggcactgagatccttatagtccttgagggtactctctatgttggatttgtgacttccaatcaagatggaaatcacctcttcaacaaagtgctgaacaagggtgatgtgtttgtgttcccaattggtctcattgatttctgcatcaatgtgggatatggcaatgttgccgccattggtgttatgattactcatggaaacattgtagcaagaacaactgttatgaaaattattccaaatcttggtagcaaggatgtgtacatggtctacttgccccttgctcatgcttttgaaatggtagcagagcctacacttatggcagctgtaccagctattgtcgatcatattggagatggagttgcaaaaaaggtttga

SEQ ID NO: 83760 - DNA, 327 bp, Glycine max
  Peptide Sequence Number=SeqID_175445
atgtctcttaatcaagatcctgtgaaaagaaagaaagcaaaatggtctgataaaaatattgagattatgttgaaagtgtgcatagaagaggaatggcaattatgggctaagcttattgggaaggacacaggtcttggctgggatggggagaagaaaaccattgcagctagtgatgaatggtgggaagccaaaattcaggaggatcctgaagtaacaaagtttagaaagcaaggcctcaaattcttacctgagatggaattcctttttaagggtactattgctactggttttgcagcatatgcaccatctgaagattcaagacaatag

SEQ ID NO: 83761 - DNA, 255 bp, Glycine max
  Peptide Sequence Number=SeqID_175446
atggatgtgcttgatacaaacatgattgaggggaagatccaatgctctgatcaaacaacattactctatgaagaatctggagatgaattagacagaaagaaagcatgttatttcagaaatccaggggcggggcgtgcaatgcacaatgcaaaacagccaaccgcgacacaagcaaccacggcggggcaggctatggcacaatggtccggcgaggctgacaacggcacaacggatgttagcttcgaggtcctttga

SEQ ID NO: 83762 - DNA, 546 bp, Glycine max
  Peptide Sequence Number=SeqID_175447
atggccccaaggaagcttgcctcaaagagatccaggaaggataaagcggctgaaggaaccagttccgctcccgaatatgacagtcatcgttttaggagcgctgagcaccagcaacgcttcgaggccatcaagggatggtcatttctccgggagcgacgcgtccagctcagggacgacgagtatactgacttccaggaggagatagttcgccgtcggtgggcatcgctggttacccccatggccaagttcgacccagacatagtcctcaagttttatgccaaatgcttggcctacaaaggagggtgtacgagatatgcgatcttgggtgaggggtcagtggatcccattcgatgcggatgctctcagccagttcctgggatatcctttggtgctggaggagggccaggagtggcaggattttgcctggactgctgctggaagacaggtgcggatcatgcgcaccaacatgaccacgtggctcagttaatcgttgatgtacgctatcctgacagggatgagcattcacgtggctcagttaatcgttga

SEQ ID NO: 83763 - DNA, 234 bp, Glycine max
  Peptide Sequence Number=SeqID_175448
atggatgagattgagaatgagatagctcagaatgcaagagctaagctaggtttcaacttatttgtgattgctagagtaagatatcagcctgttttgtatgatagaggggttgtgatgcaatcctaccccccaagggcattggatagaagactccaagaagattgggccaaaaatgcaagagaaggccctagagttctcatgagccttagggtagatttcgggcccacgggctaa

SEQ ID NO: 83764 - DNA, 327 bp, Glycine max
  Peptide Sequence Number=SeqID_175449
atgaaggcaaaaagtagagaagcaggtaatggaagcacagtgcagatgaatgccaatgattgcaagagaagcttttgccaacctgatgcaagctccattggagcttgtaggcctaggatcttcttcatcaatggattcctttgcttcttggaagatgaatggcagcggaatggagaaagggaaagagagaggagacgccacttcaaggagaagatgagtctagaagaagctcaccaccataggaggccatggataagagcttggaggaagaaggagatgaatgaagggagagggagagaagagcacgaaattttgtgctctaaatga

SEQ ID NO: 83765 - DNA, 147 bp, Glycine max
  Peptide Sequence Number=SeqID_175450
atggcgtctatcattgtccctattgtagaagcaaagcttcatgatgatgacaaaggtgatgacaaaaagctcaaagatcaatcaagaacaattcaagagtttaagataagaatcaagaagaattcaagactcaagaagaaagtctag

SEQ ID NO: 83766 - DNA, 201 bp, Glycine max
  Peptide Sequence Number=SeqID_175451
atgggggcagaagaagaagaagaaaaacttgttttgtttgaaagaggaagaaaaaggagagaaaagatgaggtcgctgtcgagggagggagagacacgtgtcaaattcagggtgggggcagacggggcgccacgtgtcggtcaagatcccgggatgggaaaggggacgcgtggctttaacgttaataatgatgatgattga

SEQ ID NO: 83767 - DNA, 1077 bp, Glycine max
  Peptide Sequence Number=SeqID_175452
atggcacgtgctcctgataacatcaagtctattaatggatcaaaagagccacttaaagttgctgtaagaattactgatctttggtttgttgggactccaaacagatttgaacaagcagaaatggtcataattgattctcatggagatacaatccatgttgtctgtaaacaagatcagttaaaatcttggaaggctgatttgatcgaaaattgtacttatgtaatgcataattttaaagtcatgaagaatgacgaccaatttagaatctgtgatcaccagtataaattagtttttactagagttactgttctcaggaaatccaatttggaggatcttccctttaagaaatataaatttgctgatttcaccaatatcattgttgggctcttcgaacttaaactgttggttggtggtctatcgtcatgtgggatcaaagaatacaagggttgttttcaaactcaaggatttgagtttatagactacttgaatcagtctgaaaacgatctccctatcattattatattgacgcatgcacgaatcaaagaaggccaaggcattcaggtccagtcagttttcacagctggtgaccaggggagttcccaggtttcagttggtttggatttgacgcctatctttttttgccaagaaattgtttgtgttactatcggcaccattaatagaattgttacggataaccattcatggtattattcagcttgtagttactgctacagaaaaaatgatgttgagacagccgcattcatatgtgcatgtggcaaacataatgatcaaccagtgctgaggtatagagtcgaggtgatggtcacctacaaagaacaaagcacaaaattttttatgtgggaccgtgaatgcactgagctgattggacaatcagctaatgaagttaacaggctgaaaatagaatttactatcaaatttgattacagatactcgaatgacttagatttgatcaatgttgtggtggacatgctgcctgatgctgaggcatgttccaacgttcatgctcctattcttgactctgatgatccttcccaactcgaatctaatcttttttaa

SEQ ID NO: 83768 - DNA, 183 bp, Glycine max
  Peptide Sequence Number=SeqID_175453
atggtgaagttcggtaattttttcattgccggagaagaagagatggacgaagaacaatggaggtatgatatcatcatgtctgaagaagttgatatgaatgttgaaaatgaggaagatgctagcatgaaagtagaacatgttgattgctctgatgcctttaatacttctatgatgtttgtctaa

SEQ ID NO: 83769 - DNA, 1335 bp, Glycine max
  Peptide Sequence Number=SeqID_175454
atgacggttggtggtgttgccatcaagggagaaagagaaagatcgctagagagtgaccaacgagagacggcatgggtcctcctccatgcagctcacgccgtccaccaacaccacccgagccttcaacgaagcgacgcagtgctcgtcgtcgccgtagaagcagaggcagaggaagacgcagcgcacagagagctcgaaggcggcaccatcgaagaagaggttctgctagcggtgggtgatgatgtgaaaggggagagtgcagttaggattttacgaggagagaccaatgcgatgggccttggaagagggatcttcgccatcgcgatccagctgacggaggagagcagcggtgccagcgggggcggtggtggtggtggcggaggcattgcagcggcgagcttcctcgagttcttctttgtcttcaatcttgactttgatttcaattggctttcttctcagcattttgtaactatgatgctcatttctctttctacgccaatttcgattttggatttggttggagagtcagtggtctattacctgggtattgacaaatccatattcatcaagcctaaaacctttcaccttacaatactcatgcttaagctatggaacaaagagcgaattaagacagcctctgaggtcttgcagagtatctcctcaaaagttatggaagccttggataatcagcctctctctataagattaaaaggactaggatgcatgaaaggttctttggcaaaagcccgtgttctgtatgctcctgtggaagagactagcagcataggaaaaggtgctactcgatctactcgatcccctataagtgtgttacaagacattgaaaaagttgataaggccattgatgggcgtaacgtgtacaacatactagagccatgctaccatttccccgatgctgccacagccaaagaaaatggaaccttaccaaagagtttcaagcaattaggggttattgagaggcatctcctagtgagaaagagaatgtttggtagagcttggccttttagagcaccagtcaaacctggtctttttacattatggccccaattggctcaaactagcatgtcgcatagtgatgaagtagcgaattcatggctaaacaacgttgcagtcaggaaagccattcatgttgaattgggctctttccatagccatggtaatctggttcatcagttatctgctgatggcactgcttaccacaaagcatgcttcaagtgctcccattgcaaaggaaccttgaagagtggccaaaatgaccgtgttcttgggattcctagcagcagtgttaatagtgtgaactacatgccaaatgattaa

SEQ ID NO: 83770 - DNA, 987 bp, Glycine max
  Peptide Sequence Number=SeqID_175455
atggcctctaggaagaggaaatctacctcctccagaccccaggagtcctatgacaacactaaattcatattggagggcgcctgggagagatatgcacagaatgttcactctcggagcatccttccagagaggaacatcattttatacgtcacggagtacgacgagttccaccgggagctcaagaggcagagatggcatagagccttgaccaggcagcctgatggtcacattgatgtggccctggtcaaagtccaaggcaagcttataaagtttgatgctgagaccctcaacaccttcctagagacccaggtggtcttggagactggggagcactacatcacttactccagattctgtcattcacatccagatacccaggagctggcttccagactttgcatttctgggcgaggatttgttctgaacgctgagggcgcgccttggaagcttcttaggaaggacatgatgaccctaaccttgacctggagtatgttatcatactctaacctcgcctccacctctcacacgcccgatcttaatatggacagagcgaggatagtctacggactggtcatgaagatgaatatggacatgggctcgctcattttaggccaaatatcacagatggcccagtccaactcctctcggctcgactttcctgcacttattacagccttgtgcgtagccagaggagtagtatctgactcccttacctttgagtccctgagccctgccattaatttggcatacttcaggaagaactgctggaaccctgatgatcccatgatcacctttctggggacctgcaaagctagggctcgaggaccatcagacgcttccacttcagctccctcttcttccgctcctccaacaccagctccaacagctctagttcccactcatgccactccagaactagagccatctcagccagcccaggatgctccttcctcaccttatgatgagcctacaccagcacaggattga

SEQ ID NO: 83771 - DNA, 150 bp, Glycine max
  Peptide Sequence Number=SeqID_175456
atggagaggtatgaacgtcctcagctgaagctatcttcccatggaaggcagatggctaagttcggtaggcctgctctagagattgaaggccttgtggctgccaacggactaagtcctttgatcgcatgttccctagatacgggcgattga

SEQ ID NO: 83772 - DNA, 450 bp, Glycine max
  Peptide Sequence Number=SeqID_175457
atggcttcgtctggtccagttctctccttctccggaactccaaccatcacaacagctaaactcaactggaaaaattatctatcttggtccgcttcagtggagctgtggtttctcggccaaggtcaccatgatcacttggagaaagctgctgaggaggttccaatcgataaaagacctgaatgggagaagctggattatcagctttgtgcagttttatggcaatcagttgagccagacgttttggagatccttagatcattcaaaacatgttgttctttctggaagaaggctcgagaaatctttgccaatgatattcagagtctgtttgatgcaaccatgaaggttacagctctcaagcaaaccaaccacgatatgattgcacacataggtaaagctcgggctgcagtggaagagttgaagaggttccttgtggctgactcgctggaggaa

SEQ ID NO: 83773 - DNA, 828 bp, Glycine max
  Peptide Sequence Number=SeqID_175458
atggcattattccgcgcacttgctcactccaaaaacagcacactgtcactcaccaggtcatgccataccgtcatcacattcaccccctcttccgtgtgccggcggcggagcaactctccggcaccgccgcaatctccgccgtcaccaaagaaggtgccgttcacagtttcggttcacgggaagacttggcaggacccctatcactggatgtccaacaccgacgacccgaatctgttggaccatctcaaccgcgaaaacggctacgccgatgcgttcatggccgacaccgtcaaactccgttccgttctgtcgtcagagatgaaagcgcgattgccaccctccgtttccactccccctgagcgttggggaccctggctgtattaccagtatattccagagggaaaggagtatcctgtgctgtgtaggagtctggaaacagagactggttggctgaagaatgctgttcttcgctatggaatgacaagatcaaaaagggaggagattttacttgactggaatgaactcgcagagaaatatgggtatgtcaacgttggatcatgcagagtttcacctgacaacaactaccttgcatacacacttgatatttccggtggtgaacgattcactctccagataaaagacctcagaagtggattaatagatccacaattggaagttgatggtgcttactttgtggaacatcactctggtttattttatattcttaccaatgctcctattcctgatgctgaatggtctggtcaaggttattacctggttagatgccgagttgaagatgtagagtcagctaagtttcaggttttgtga

SEQ ID NO: 83774 - DNA, 192 bp, Glycine max
  Peptide Sequence Number=SeqID_175459
atggctccacctaaagaaattgcgaccatcatttaccacaatggtcacattgtagacgacccagttcaaggatcgataggcgcgatggaaaaaattctccagaatccacaattgaattctgccgaattctatgctgttactgaccttattcctcaaccacaaccatcatctccacaaccctcatgtccataa

SEQ ID NO: 83775 - DNA, 120 bp, Glycine max
  Peptide Sequence Number=SeqID_175460
atgtcgctctcaatggctctacggtccaatggaaaaatagtggtacctggagatatgtcgcgggggtcaggagaccttggggatgtcaggtggggtgctattgccccaaaccaagcttga

SEQ ID NO: 83776 - DNA, 390 bp, Glycine max
  Peptide Sequence Number=SeqID_175461
atgcccttgagcgtttttgtcaaacttcttccatggagtcccgcggaagaattcttccacgagtgtcaactgaagaagaactacggaagaaccttcttccgtggaattccgcagaagaatttcttccgcgagagtcaacggaagaagttacacacactccagtcacacacttcttcctctctccatttctctaactctgaccatgcaattggcgttggtctcattgcattctttgtagaaatgacgaacaaggccaaaggaaaaggcaaagaggtcgccggaaaaggttctgctgccaagcgcaagggcgcctttgacgatgacaagaccggtggcggccgcaagagaaacaagcgaggtgtccttcagttttttctgacgatgaattaa

SEQ ID NO: 83777 - DNA, 183 bp, Glycine max
  Peptide Sequence Number=SeqID_175462
atgggggagggatattgtacgcagccttacccttgcaaatgcaaagaggctgtttccggattcgaacccatgaccaacaagtcaccaaggcacaactttaccgctgcaccagggctcgccctctttaaaaacttcccttacccttgcatatgcaaagaggctgtttccggagctaaggattaa

SEQ ID NO: 83778 - DNA, 588 bp, Glycine max
  Peptide Sequence Number=SeqID_175463
atggagaagatcttttttccattgttagctccctattcctctctctcggttcatagctcttttcccttgtattctctttattgcttatgcatgtatgtcagtcgacggatggtggtcgatggttgcagtaggggtgtttggttcgacagtggtattgggtggaggtgggacttgcttgggagaggcagggggctttcgttaccttcttcttccgccatcgaggttgaagatgaagttcttccgcgagaagaaccttcttctgcgcgtgtgaaagtggacgaaaatgtagcctacagaagaaggtgttcttccgcgggttccagcggaagaaggttcttccgcttgatccagcggaagaaccttcttcaccttcttccgctggaacccgtggaagaacctttcacttttctttcacaggagctcgcggaagaacaccttattccgcaggctacattttctgctcgcggaagaacctgcggaaccttcttccgcaggctttcaatccttctcgcggaagaacctgccaaacttcttccgcaggctacattttgctgtatattagttttttttcttgaaaattatgtctga

SEQ ID NO: 83779 - DNA, 438 bp, Glycine max
  Peptide Sequence Number=SeqID_175464
atggcctctaggaaaaggaaagcaactgtctctcgacctcaggaaccatatgacaatacaagattcatctctgaggtcgcatgggaatgctacaagcagaacgctcactcccgaaacatcatttcggagaggaacattactttatatgtcacagagtacgacgagttccgacgggagctcgagaggcacaggtggcataaagccttgaccaggcagcctgatggtcgcattgatgtggccctgacctggagcgtcttgtcatactctaactttgcccccatttctcacacgtccaatttgaacatggacaggggcgaggttagtctacggtctggtgacgaagatggacatggacgtgggctcgttcatctctggacagatatctcagatggcccagtccaactcctccaggcttggtttccctaccctcatcactaa

SEQ ID NO: 83780 - DNA, 300 bp, Glycine max
  Peptide Sequence Number=SeqID_175465
atggaactcatagagaacatggctggtagtgatcatgctattctgcgtgatagaactcacaacaagctgctagctaagcagctagaatcacttacagaaacacttagcaagctgccaacacagttacaagtggctcagccttcccattcaatagttatgcaggttggaggttgtagtatatgtggaggaacgcatgaatctggttgttgcatacccctagatgatgctgcaaaagaagtgaattacatggggaaccaaaacagacaaggattccattcagacggtttttcaggttactag

SEQ ID NO: 83781 - DNA, 387 bp, Glycine max
  Peptide Sequence Number=SeqID_175466
atgagacgtcagttgaaagcttataatctctgggagtggagaatgctgaaccaccagctttggaagaaaatcccactgttgctcagaatagatcccatatatttcaaatttggatacaacaaaggaaatttgggagaagattcaagaagagtttttttaaggaatcaaaggaccaagcaaatgcaagttctcaatatgaagagggagtatgaagccttgaagatgaatgaggctgaaagcataaaagatttcatgaccaaaatgatgaaggttgtgaatcaaatcagatcagattgcaaaatagttgataaactcttggttgtcttacttgaaaggtttgatccaagatttcttcacttgaagagtcaaaggatctctccaagataa

SEQ ID NO: 83782 - DNA, 348 bp, Glycine max
  Peptide Sequence Number=SeqID_175467
atggctgcggagttagggcaacagatgatggagttatccaccctcgtcacacgtgccgctcacgataagtcctccgattttttattccttcttaatctactttttcttcatcgaccagttgacttaggaggttgcagacccagggacagtgctactgataaagggtcttatgagaagagaccatcatcatttgcccccaaagcctatgagatggaaggctcttgcagctccaagattaacaacataaaaaatgacaccaacttgatgtccaattcttccaacaaagacatgttcctagacagctacaccactagttggcaagagccttgcctattgtcccatatatga

SEQ ID NO: 83783 - DNA, 477 bp, Glycine max
  Peptide Sequence Number=SeqID_175468
atggctccagaagaattagagcagctgactcaacaaatcaaggaccaactggaggagtcgatcacagaaaaaatccattcacaaggacttgcactgcctccagagcctaaggtttgtccctcagcttctcgtgtcggcacaaaggggagttgtgttgatccctcaccgaccgatccagacacgggtgactcagacaaatgcgggttgtacatcgaagaaaatccttcccgcctggttgccctaggaagagtttatgagggatccacagtggttcacaacatccctttgttgcatggccaagtgaaggttgctgttgaggaggttaaagatgcagaggctcccattcctgtacccactgacgaggttattttagtggggcaggcacttaacaccttccttgcttggtcgaaacatctcgtgaagcgtttatcagaacaagtattttactctcattatatgcttctttttttcaattga

SEQ ID NO: 83784 - DNA, 669 bp, Glycine max
  Peptide Sequence Number=SeqID_175469
atggtgaagaagtttggaaaatttctcaaaagatccaaagatagaaaattctctaaaccttcaaagaagatagaaagtaacaaaaacatcttcactttcttcgaatgtgggaagcaaggtcacatcaaatctgaatgtcctatctaccttagaaaacaacttgctgaaaagaaaagaaagaatgatagaaaacataaaaaggcttacatagcttgggaagacaatgcatccacatccttcgactcttctagtgaagaagaagtagcaaatgtgtgcttgatggcagattcaatggatgactcctcaaccattgaagaaactgagttgcaaactgagctttcctatcttaaagatctgtttagaaaaatgaacataggaaaaagtgatcttagtcacttgcttaatgtgcaaaatcgtactatcaataagaccggtttggggtataacaagaaaactatcttttctaagaaaactaagtttgcatcctccaaaaaggtgaacccaaacaaagtctccaaaaagaaaaacatggtgcattctaagcctaaagcaaagacctgtcattattgcatgaaaagagaacacatatcttataaatgctatgttaggagatttgaatttcctagaggtgtgcctaaaagcaagaaactcactatggtacttggatag

SEQ ID NO: 83785 - DNA, 849 bp, Glycine max
  Peptide Sequence Number=SeqID_175470
atgtttgattgtgttgtcagagaggagaacatgtcattactatcagagcgcaacgaatgggaagtgcgaccaaggaattccatagatacaatttatagcttcaggaaagaaaatgagcaccagttgtttattttgaagcatgaaaatgaaatgatgtcaaatgcttataagcaatcacgtcaaatggttaatagtttatctcaaaggctacactgcttgcagattgcagtggaaagtggagttcaagagaggaaaaaacaagaagaatatatacatatgttgcaggttaagatagagctacaagaacagaacaagtgtgtcgaaaggcttacagtagagctggataagaacactcaatttcctcggagaataactgaagaaacaaaacaaaaattagtcaatgctttaagtgaaatagcagctattgaatccaatgctaattgtgttgagagtatgtttctgactttctggtttgctaatgactgcagttattggatccaatcaatcaatgtggctactctgatctcagtaactgcagagactatgatagatgccataaggtctgtgaagtccattccaagactgcacaggtcacaattggagcccagaaacaaaggttctgccagcagtgtagcagaagaggttcttactagggtaatttctgctttagtggagaaagggttgctaactcctatggctagtcctaaaaatttcaccactcattctcacgattcagcatgttgcttccttactgagattcaaccatggctttctacctttcatctatctaggggtacttatttttcaagtcaagccacaaatgatgcacttgcagcaactaaaaagtag

SEQ ID NO: 83786 - DNA, 393 bp, Glycine max
  Peptide Sequence Number=SeqID_175471
atggaaagcctaaggaagccaatgggaagtgagcagtgcatctactcagggagtaggatgagctcgcatgtagaggccattggaacggggaaccaagaaggcaataaggagtggctggttggtgggggacaaggctggggggaaggtggggaacaagaagcactggttgtggctggggggggggggggaagagtggcttggagggggggcgcgggccgtgtttttaaggtagctggacgcgcctgggaccctagcgcgacccgtcgcacctgcaacggcaacgctaacgaacgcgcctgcacgcagagcgcaaaccaaagctccaacaccgccgacgcatccaatcctgaagcgccctcgtcagcagcgcatccagacctgtcccaccgctag

SEQ ID NO: 83787 - DNA, 225 bp, Glycine max
  Peptide Sequence Number=SeqID_175472
atggtggctctgggcattgtcggagttttcaccctcacttatacaaggcgagaagaagaaacagttaaaggctttctctttggtcaaaaaagaaccctgaaatcgcaagttgtagagtttgtagacttgttgggcaagttgtatgatgtgaacctgactaggagcggatcgtttgatacaggctacggagacttggatgacgccacttccagtgaaggaagataa

SEQ ID NO: 83788 - DNA, 273 bp, Glycine max
  Peptide Sequence Number=SeqID_175473
atgaagaacaagcaaatcgatggggttgtgagtgatcaccctataggcaaatacacattagtgacaaagactaaggataaggaaggaagttataaaaaaaggctaaacatagctacctcaagaatcgcaaaaaataaggttgcaccaaaatacctgggtatggtggtaaggtggcacgctgtcacaggggcagcagatgttgagatagagtcgcgaacacgaaccttaaacagagaagaagagagcgcaaggaaaatagggctcgcgttctaa

SEQ ID NO: 83789 - DNA, 603 bp, Glycine max
  Peptide Sequence Number=SeqID_175474
atgagaattttccttgaatccgttgataaaagagtaggtgatgcaattgtaaataatccttacattcctaaggttgttgttgatggaaaagaggtagaaaaagactttaattcttggacaccggaagaaaatatgcatgatcaatataatgttagtgctaaaaatattttcgcctccattttaaaccttgataagttttattgtgcttctcaatgtgcaaatgccaaagaaatttgggaaatcttggaagtaactcgtgaaggaactactaaggctaaggatgaagaagaagttgacaagaagaagaagagattagccttaaaaacaagcacttcacatcatgaagctagtgatgaagaccctttagaaaattcagataatgaaaatttgaattttcttcaagatcacataaaagtggattgtccaacctaccttatgaaacaacaaggaggtggtaagaagaaaaagaagcaatttaagaagagaagagcatatatagcttgggatgataatgatgtaagttccttaagtgactcaagtgagaaagaagaagcaaatctaagtctcatggtagacattgatgaggatgagaccaaaagcaat

SEQ ID NO: 83790 - DNA, 255 bp, Glycine max
  Peptide Sequence Number=SeqID_175475
atgaagaataagaaggttgttgtggctggtgtctcgctaagcgaggcttgtgcgcttagcgagaatcatccgttaagcgagacactcaacccacttagtaagttgggagaatctggaggagaatctgccaagcatctgcacgctcagtgcgtcatcagctcgctcagtgagtcgtttgtcttctctcgtgctaagcgcgcccagctcgctcagcggaaaatcacttgctcgcgcttagcgcaaaaatggtgctaa

SEQ ID NO: 83791 - DNA, 1452 bp, Glycine max
  Peptide Sequence Number=SeqID_175476
atgtcggaggtcaacatgagcttctctcactacatggatgatgaatatgagaaactcttccggagaatgaaccctcccagggttgtaatcgataatgaagcctgcaagaatgccaccgttatacgggttgatagtgcaaacaagcatggaatacttcttgaagttgtacaaatcctcactgatctaaacctcatcataactaaggcttacatttcttctgatggtggatggttcatggatgtttttaatgttactggccaagatggaaacaaggttactgatgaagctattttggattacattagaaagtctcttggtcccgaatcttgtgttacatctcctatgagatctgttggggttaagcaaacaacggaccacattgcaattgagcttatggggactgataggccagggctgctttcagaagtgagtgctgttctgaccaacctcaagtgcaatatagtgaatgcagaggtgtggactcacaacactcgtgctgctgctgtaatgcacgtgactgacgaagaatccggttcggccattactgatcctcagaggctttctataatcaaggagcttctatgcaatgttcttggtggtggcaacaagaagaggggggctaagactgttgtcacagatgaagccacacacactgagagaaggcttcaccaaatgatgtttgctgatagggattatgaacgagttaatgatgatgatgactttgatgagaagcaaaggccaaatgtgaatgttgtgaattggtctgacaaggattattctgtggttactattcagtgtaaggataggccaaagcttctcttcgacacagtttgtactttgacagacatgcagtatgtggtttttcatgcaaacatcgatgctgagggtccagaagcatatcaggaatactacatcaagcacatagatgggtcccctgtgaaatcagatgcagaaagacaaagagtgatacaatgtcttgcagctgcaattcaaagaagagtttctgagggtttgaagctagagctctgcaccaccgacagagttggattactatctgatgttacacgaatctttagagagaatagcctcacagttacaagggcagaagtggccacaaaaggaggcaaagctgtgaacactttctatgttcgtggtgcttctggtttccctgttgattctaagaccatagaatccataaggcaaacgattggcaatacaatccttaaagtaaagggtagtcctgaagagatgaaatctgttcctcaggattctcctaccagatccctctttagtggtcttttcaaaggctcttcgttatgcgaaggtatgggggagggatattgtacgcagccttacctttgcatatgcaaagaggctgtttccggattcgaacccatgaccaacaagtcaccaagacataactttactgctgcatcagggctcgccctctaa

SEQ ID NO: 83792 - DNA, 348 bp, Glycine max
  Peptide Sequence Number=SeqID_175477
atggacattggtgaagaaggacaagatattgttgacatgatcggagaaagcatgaaagaatgtgatggatttgatgagtcaacatatgatttgggggagaatgaagatgttgttggagagaaagctttggaagagtcaacaaatgattttggagaggacgaacatggtgatgggaaagaagttttggaggctgaagacaatgttgagtatatttattggttttcggtgtataaaagcaaggttcttaagaatttgaagggtgagaaaacacaacagacctttttttgttctagagaaggagaaagaaaagatagaggactaagaatagaagcacggaagtgggaatag

SEQ ID NO: 83793 - DNA, 207 bp, Glycine max
  Peptide Sequence Number=SeqID_175478
atggtcacgagcatctctgagtatggatggccagaaaaatccagcctaaagtatcctgacagctgtcctatctccactgtaatggcctccataagatcaatggcagtggaatggagaatgatgaaaagtgattggagatgccacttcaaggagaagatgagtcaagaacaagctcaccaccataggaagccatggataagagcttga

SEQ ID NO: 83794 - DNA, 1044 bp, Glycine max
  Peptide Sequence Number=SeqID_175479
atggcaccaaaaaggagtgaagctgttgtgatccctggaatcaacactgaagatgaggccaagaatgtcttccctttcttccttgagaaatttagttcatggcattatgatcaatatgccttgttatgggggattgcaaggcaaaatgatgttaatatgagaggcaccatcaaagggaaagaagtggtgatcttgccaacaaccattgttgctacgtctagttatgttgaagaaggccttcaaggacaggttcaaccccaagcaaatgaaaacatgctcaagcgattagaagaaatttatggagcaccagaatctgtctccataaaagtaatgaaggagcagctaaaggcatggaaagagttgatgatgtctgaaaagcccataaggttcatagaactctttcatagacttaactacagactgatgaagccagctgaacaggaagccacaacatggattttgccttcaagaccacctattcagaagcaacaagacattaaagtgcatccaaatcttcacaccatatggtatcatggtttcaaaggatacagagttctggaatggcaaacttgcaacaaagtctggaaagaaagtgaaaatgaagctggaaaagctcgatctcaccaagatctagaagaagaagagtatgcactgggcgtatatggagatcgggaaccagtgatcaaagagttccctccaaggcagaatgctactcctaaccctaataaggctaagtttgctgggatgcatttcttaactcccatggatcttcagcagttgatgggtctcatttgtgccctcaatgttgttcttccatgggattgcaccaagattggagagatgtttcagacaacgaagatcatcttggaggcacttgaagaaagtttgaattttcaagactgggagttatcagaccatggacttgcgcttagaatgaagctatttacctataaagaagagatcaaattaaggcaagcttcatttcatagaattcaaaagctaaacactcatttgcctttcatgctggggtcacaattgatgtga

SEQ ID NO: 83795 - DNA, 1683 bp, Glycine max
  Peptide Sequence Number=SeqID_175480
atgggaaaacatgtctcaagagagcactttcaacccagggcgtgttctgggaagaaagagaatttaaaacataccgtgtttattgatgtagatgatcaagttgatgatgtggatgtggatgtgacgatcatagattacgaagagttcatgtctaaattgcatggatctagtgcgccgagtacagacagggtatgtacgccacagagtgttattagcattgatgatgacgacagcgacgatgaaagtgatgatgcagagattcccggagttgttgctggaggtgttggggaattggatagcgatgcctgttctagtgaaaggtcttctcctgacccaagtggcatgcggaattctgtacacgtggatgttgatgatgatagtggtgtctgtgaaaaggtgactgaatctgacaagctaaaaagtaggaaagcaagttctgcaaatggtattggcggatgtcgccatggtattgattggggtgacagtgagtcatcagagagtgattgctctgattgtgaactcatggatcgtgaacagtgggaaaagatttcacttaagagaaagcgcagtgcgtttaatgatcaaccttgttatgatgagcatggtagttcttctggattacattgtaataataatgtatacgttgatgttgatgaggaaaatatgactgaagagaatgctggaggcccagcatattctggtcccacccatggtgaatatgttaaggagaatcaatcttccttttctgttagaggtgatagtcaagtagataatcaatcttcctttcctgttaagggtgatagtcaagtagaaaattttttcatggattctgatgagaaagccgagtgggaaacttttaaatcttctttgtttgaatctacagaggaaatgaaatcattgcatcaaagttctgatattgagcatggaagaagtactagaagcaaagatttctctacctacacccagtataataataactacaatttctgtagagctgttactggtgtttcaaggagccaagaagcatgtgaaaggcagtttagcaatactggatctacactgaagagcaacttatttgatttgaattctgaatgtgcctctgatgatgaaggacaggttaattgtgatgggcttgcttcaagtgatcaagattgtggtcttattgcttcaaatgatcaagattgtggtcttactgcttcaaatgagaaagatataattaatgaaagagaaaagcttaaggagactgatgaatataaacaagcaatggaagaggaatgggcatctaggcagcgacaattgcaaattcaggcagaggaagcacagaggttacgcaaaagaagaaaggctgaaaagcgtttactggatatgcaaagaaggcaaaaagaacgcattgaagaagtgagagagacacagaagaaggatgaagaagttatgaacctgaaagagcaattgcgggttgaaatacagaaggggcttaatcaattggagatgcgatgccatgatatgccctcactgcttcgtggcttaggaatacaagtgcatgcagcctataaacgtgccttgcttaagtttcatccagaccgtgcatcaaaaactgacgtacgtgcacaggttgaggctgaggagaagttcaagctcatctctcgctggaaggaaaagtttgcgatgacttcatgtcactaa

SEQ ID NO: 83796 - DNA, 399 bp, Glycine max
  Peptide Sequence Number=SeqID_175481
atgaagatagtaggagtgccagaagacgccatccgcctcaacttattatctttatccttggccggtgaagcaaaaagatggctttactcgttcaagggtaataacctacagacatgggaagaggtggtggagaagttcctgaagaaatactttccagagtccaagaccgttgagggtaagctactcgatgcctccaccggtgggaagatcaagctcaagactccagaagaagccatggaactgatagagaatatggcaactagtgatcacgccatccttcgtgatcgagcctacacgcctacaaagaaaagtcgtcttgagctcacttctcaagatgctatgttggctcaaaacaagctcttggccaagaccttagactcttacagcaactctgagtaa

SEQ ID NO: 83797 - DNA, 444 bp, Glycine max
  Peptide Sequence Number=SeqID_175482
atggctcctccttccatcactattatgcctttgcttagtgctggtgcggcgaatacgagtacttggtggccccgcctcattcttcttcagcttcaccagttccaactccagctatcttgcaatggatgctgtcttcctcctcttctcacccacataggatacagaccagagcaaagaactctgactgactttgtgtcttccgtaccatgtcaatgctacctccttaaaggatggcagatcggcgttcataattcgatcaacaaaaggatgtcactgagtcatccttccctcatagtgatgcagagtactcgttgccctaaagcgtctcacataagcctccaaatggtcgtagtcagccttcagctttttgagttcctcctcatggcatcactccatctccgtaatatgtgtttagagttgttggagagtgtcattgtctattag

SEQ ID NO: 83798 - DNA, 438 bp, Glycine max
  Peptide Sequence Number=SeqID_175483
atgggatgttacgtactctgttttacgagaatgctccaaccttatgggatcaacataggcctaaaggagcattcaaaccaagtttttggcatcattgtggtatcagagcttcgacctcacacctgtgaagattatcaatggcggattacaatactagatcgcaaaaagtttgaagattcaatcaaagaaacattgaaggagatgagcgaaaatattaggaaaattgcagattgtgtatatgggcaagaaactcacgtttcagctcttaataatcaaaatacagtgcttatggagaggctgaaccaggaggtgcatcatggtggtagttcatatggatcgggttcgttccaaagtaatcgcagttacatggctactcgtcaagcgaagattgattttccacgatttgatggcagtaatctcaatggttggctattttga

SEQ ID NO: 83799 - DNA, 624 bp, Glycine max
  Peptide Sequence Number=SeqID_175484
atggttgtagtctgcaaattcgaacaaatagttgatgggtacaacaagatgcagacctataggggaatgcttcttgacccatcaaggaatttgaggaatctccttggagtaggtggtctgacaatggtatacagtctgaaattaggtatcaagatgaatttggtacttttgattgaagacattatgttaaagagacgtcggttagtggactacaaatttccttatgtcgtgcttgcctcaagattcattgactacttcaatgtcgatgtatctaatgagatagtggattttaccaaagcatctagtgagattaccaaaaggcatcttaagaagcttggaatgaggtttgcagaccataagtggattatggctggagagccaatagtaggaaactcggaacatatggatgaagaagttgaagctaaagctctacaagagcctgcacatcaatggagtcattttgagtctctcatgattcagaagatggacgctatgcttcacctccatcaagagcactcagctgaagttcacagtttgctggagaacatcactactcggctggaaaacatagaaaataggttgacccttagtaacctccttaaccccgatgaggatgaagcttag

SEQ ID NO: 83800 - DNA, 336 bp, Glycine max
  Peptide Sequence Number=SeqID_175485
atggcttttccttctcctccttccaacgcatcagcttcgtcgtctgccgtgaagcggacacgtaaagcctcatgtctacgatccttgtctactagaccacctggtgctgagagaccagtggtccatgttgatcatgctactggcaaggtcgacggtccccacaggaagaaattaagaacatatttgggaattgtggcacgttataaggtggacgtcacgtacgggaactggaaagaggtccctactgctcagagggacttgatttgggaggatagtcaggaggaatttgaaatcccacaggcttctgacagtaagatgaaaaaaaagttactttaa

SEQ ID NO: 83801 - DNA, 753 bp, Glycine max
  Peptide Sequence Number=SeqID_175486
atggaggaaaaacaaaagaaacgattggagcaagcagcccaattcgggagcacaaaaacaaccgttgatcctccatctcccattggaagacacgtgaagtggaagatggcttgcaccaaaaaatttggaaagatgacatctgaggcagcacgtgaaattgcaaataggattgaaaagcactctggttgtgcccgtgttgctggagccggtgttacgatcaaacaatactttggaccggctttagcaggctcctgcatatctgtgtcgattaacctcaaagagttgcatcgattaagaaaaaatattacaaaatgtaatcctagggactcgtactacctcctgagcttgaggctggtccttctgttgctcgtgtcagcacaaagggaagctgcgccggtcccttggggtaggacccagacgtgggtgaatcagagaattatgggttgtatattgatgacaatcctccccgcctgtgtacattggcaactggtcattatatgtcctaaggacgatgttgtcgcctggttttgttccatgcacaataagtctaagaactacttgaaaggaattattaatagtgctttgaagggattcaatgatattcaaggaagtaagtccaaggctactgctaaatgcattctagttaaatattttactgatccaagaccattggaaccaaagagattaaagacaatttgtattcggtgtgcaagatgttatctcagagttaaaaatgaaacactgggtgtttaa

SEQ ID NO: 83802 - DNA, 732 bp, Glycine max
  Peptide Sequence Number=SeqID_175487
atggcgtcgcagcagaatgtgggggagcaccttccgtacatcctttggggtacaagtagagcgtacatctacttgggttgttatactgagaacaagagatggtacatctcttgtggatcagttcaagtggagcgtacttccacttggttgttcaaagagaacaagggagggtacatcccttgtggatcttttcttgtaaaggattttacaaggttattggaaatctcaagaaccggtggttgcttggggactggatggaatggtagcccaaggaacatgaaatggaacttcaacgtctcaatcaaaaatgaagagaccgacaaaaggaaaagaagcatagcacttaaagcctcctcctcaatgcaagaagaagaagaaaaagaagaatctgatgatgaagaggacttttcactctctgtgaagaagtttcataaatttgttaaaaatagaagaatggagagaccccataacttcgacaatggcaagagatctcaagaaggttccctaacacttaaatgctataagtgtaatcgacccggtcacataaaggcacactgccccacaaatgaatcatggccagagaagaatgagaagaaaaaccatgaagaaagaagatccaagaaggcatatattgcttgggatgacaatgactcatctgatggttcggagaaggaaatcaaccttctatccaaagactatgagagtgatgagaacatctctcaagaagattaa

SEQ ID NO: 83803 - DNA, 1299 bp, Glycine max
  Peptide Sequence Number=SeqID_175488
atggatttcttttctgatgagagtttcgaatgcattcaagcatttcataactcaaatctcattccctttatgtctttaaaactgcctgtgtattctgaattggtaaaagtcttttattctaaccttgaaattcaagaaagtaccttgatttctgaggtctatgggataaagatggtcattgaccaatccctcttctatgatttgacccaattgtctagtgacggtgtaccatttgaaggtgcactggatgatgattggaagtttgatttttctgtgcatgatgcctgtcggttggtttgcaccaacctagcggatatgaccggaagactaattgcctcgtacatcctttgtggtataactagagcgtacatctacttgggttgtaatactgagaacaagagaggttacatctcttatggatcagttcaagtggagcgtacatctacttggttgttcaaagagaacaagggagggtacatcccttgtggatctttgcttgtaaaggagtttacaaggttattagaaatctcaagagccggtggttgcttggggactggatgtaaatttcctgaagataaatcgctatttgatctggaaattaccaagactaaaaggaagaacaagaagaaaaagaaacaaacaacaaataagccatcatgtgaatgttcttctactgattatccttcaactaaaaagccatttgtaattgataacatggttgatcgagaaggaggtggaaataaaccaccaagaaggactcttgatgaatatgcttaccaacaagaaccaaagtattacaataacatagtcattcatcctttcagtaataaggttgtggagttaaaaccaacattgcttagtctgattagtacacatccttttgctggaatggatgatgaagatccatacacacaattgtttaccttcatggaactatgtggtaccatgggagcttctgacaaagatgctaaagctatctacctcagagctttcccattctcattaacaggtttgacgaacctctctatgaaacatgggagagattcaagactttgttgcgaagttggaggtactatgatgtctaagagccctgaggaagcaattgtaatcattgactccatttcaaccaattattgtcagagtcaccatgataggcgtcctattcaaagaaagggtataatggagttggatactcaaaatgcatttctgactcaaaacaaattcttgactcaagaaataaaggccttagctaaacatataggccaacctcctcaacaatttcaaaatgttggatcatag

SEQ ID NO: 83804 - DNA, 825 bp, Glycine max
  Peptide Sequence Number=SeqID_175489
atggcatccaggaagaggaagagcactgcttctagacccataactctgtatgataccagatacactaacaacattctcggccggaatattcttccggagagaaatgtgaagctttatcatactgagtttgacgagttcaaggtggagttggagaggtgtaatctacacaaacgcctcaccaacctccaagatggaagcatagatgtagctgtggtgaaagagttttatcctaatctatacagcccagaggaccaagctcctaaacaagctagagtaagaggacatctgattaagatcgatgcagacaggctgaatgaatttcttcagactccagtggtgttagaggagggggaatctttacccacctactctagattttgcaggttgaggactaaccaccaggagattgaagccaggctttgtattcaccgcaaggggtttgttttgaatgctgagggccaaccatggaaacttctcataaaagatctgatgacactggcccagacatggagtgtcttctcttactccaacctagctcccacatcccacacctcagatttgaatatggatatagctaggttggtctatggcttggtgtctaacatggacatgaacatcagagcccttatctcaggtcagatttcttctattgctcagagtaactcctctaggctcggatttccagccttgaacattgccctatgcagagctagaggagttatctctgacagtatgacttatgagagcctgagcccggcaatcaacttggcctacattaagaaaaactgttggaatgtgttaatcaagtggcctcagaaatcttaa

SEQ ID NO: 83805 - DNA, 585 bp, Glycine max
  Peptide Sequence Number=SeqID_175490
atggtgctttgccaaacttggaaatcgaagcaacttgtagaaggaacagagcagaaaggcatagaattttttttgcaggatatagaagcagcggcaattcttgaagaacctcagtcttcagagtcatcttctagttttccagagtcaagagaatcagatacaacattgcttgaagctaacacaatggctgatgagcaacctagacgagtaacccttgaagactactcaagttcaagtgtgccgcaatttttcactagtattgcgcggccggaggttcaagctccgaatatcacatatccacattctttgattcagcttatgcagggcaatcaatttcatggttttcccaatgaagatccttatgcacatctagcaacttacattgaaatttgtaacatagtcagaattgttggacttccaggcatgcaagcttggcactggccgtcgttatttacatacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 83806 - DNA, 210 bp, Glycine max
  Peptide Sequence Number=SeqID_175491
atgggcgaggaagagaaaaaaccagaggaaaacaaagtggaggagaaaaaaccaaatgaagaagaaaagaaagaagaagagaaaaaaccagaggaatcaaaagatgacaaggaatccaaggaggaatctgcgccgccagaaatcgtgctaggcacaacctttgcaatacatggacactttaagcacgattttcggcatcttttaagttag

SEQ ID NO: 83807 - DNA, 549 bp, Glycine max
  Peptide Sequence Number=SeqID_175492
actcatcttctccttgaagtggcgtctcctctctctcttcctttctccattccgctgccattcatcttccaagaagcaaaggaatccattgatgaagaagatccttggcctacaagctccaatggagcttacatcacatttgcagggggaaaaatcaagttgaagacaccgaaggaggcaatggagctgatagagaacatggcggccaaggccttgacggagacccttagcaagctccctcaacaactacaagcggagctcagaatcgccacggattccaaggctataaccaaggaggaccgctgggattcaacaatggaggactttcaaacagggctcaagctggaggaatcatttgcgaaaccagttcaacaaggagcagagaagtcaaccggtccagaattccaaccaagggggaagaggaagaatcaaaagaattctcaggaggttagtcctttgaatcttttggcaagaggaagaaggaagaatcaaaagaattctcaagcagttagtcctttgaattcttctggcaagagggagaaggaatga

SEQ ID NO: 83808 - DNA, 417 bp, Glycine max
  Peptide Sequence Number=SeqID_175493
atggagattgactatgtggaatttgagcggcatgttgctggtggttccaatatgcattattttgacctttccatcagactaaaatctgaacaagaacatctctgttgtaatattcaaagaaatgagtaccacaatttgtatgaatttatcaggagatgcctaacctactgttggtataaagaaggctcattgtttgaggatgatgatgttgttgatccacatcttgagcgcataaagaatgaagctggtggagatgaaagtgatgaagagaagcctgccaaaaaggaatcaaagaaggatatgccttctaaggcatctacttctaaaaggaaatcaaaagatgatgaagatggaaagaagaaaaaaagactcaaatgcacccaagaggacaatgtctggtttcatgttcatttctga

SEQ ID NO: 83809 - DNA, 231 bp, Glycine max
  Peptide Sequence Number=SeqID_175494
atggtgacctatggttacaacattaaatcctcatgtacccctaccttcaatcatggagtcataacgactttgaggaacccaattggtgtagcgcttgtaggcctaggatcttcttcatcaatggattcctttgcttcttggaagatgaatagcagcggaatggagaaggaagagagagaggagacgccacttcaaggagaagatgagtctagaagaagctcaccaccatag

SEQ ID NO: 83810 - DNA, 942 bp, Glycine max
  Peptide Sequence Number=SeqID_175495
atggggcattacagagcacaaaaggcatcactcaaaattcaaaatgaccgtgatgggtgcgaaaagcggtcttgcaaatatcttcttcattcatgtgtatctgagggtacccttggaaaagatctaacttcgaaaaacaactggcgccacccaattcatccagttttgaacttgtgtgggaagttgagagctgggaatttggttcaaagggaactcagagggagtgattgtgatgtaaaaataggcactcgctccctgtttctagaccatacaacgaagctggggtggggtcttgagccactgcacgcccaggaccatgttggcaccacaccggggcaagacatggaggtccatgacaaattgattacgctggatagtgatggtgactgcttcacagaggtggtcacagtgaagggtctcaagcgccaaatgacccgagagagagtggagtatgatctggacctgagtcgggttagtggtatcagggagagtcgcttcagaggcaccgatgatggggttttcgctgggactagaagcaatggggtcgcgactgacgacaggggtcgcgggggtggcacgacgagggtgggtggtcgcgcttggctcagggaattcaaccccgagataaagcaactcaagagaaacagcggaggtaatctgacaatacggttcacaagatcttcaaactccgaaaggtacatggaaacttggccaggatgtgaattgaccattattggtcatccactgaaaccaggccaaggcgcgcccctccatgtagaaggaggtgatggtcagtctatcatgctcgggcgtggcatggtattcgaagaatttgttgatcttaaagatccaaccaagggtttcggtaccatcaaaccggggagcatcgagtttcaagcggtgaggggtggaggtggccatgggtggagtggtattggatga

SEQ ID NO: 83811 - DNA, 513 bp, Glycine max
  Peptide Sequence Number=SeqID_175496
atggtagggtttcccatggaggcaaggcgtactggtttacaaaaaaggaaaaaggtgagctttaaagcattagaagcaaagcttcatcatggctgggagaaggaagggtggatacacgttgatttgtctcaacatttttatgttttgcaattcttacctccggttaggagaatgacactatctttgaaatatgaaggccttcaactagtctatttttcatgtggtagatatggaggtcgccaaactatatgtttggatggacctatcctagaggtgaaagttgatgctatcactattggtgagaaggtctctaaagaacatgtggtgatggaattagcaacattgttgattgtggctaaagaaggaaataacgatgaaggtgttaaggcggatttagcaggcatgctctttgtgtgccctaacctcgaccaccatatcaacgacacaatcattggcgttcttcacaaccacaacgaagcctctgagacgtatccacttcccgatggcgattga

SEQ ID NO: 83812 - DNA, 306 bp, Glycine max
  Peptide Sequence Number=SeqID_175497
atgactgagaaaagaatccaataccgcgttttaactttcaaatgtcttcgtgttgatgctgattcgcttgatgccattcagctcctggaagatggttgtagccagcaacacccgtgcaataagctggttgaagaggatatcggtgatgtggttggttgcattgcgcaggaaacttggaatagtgcttttagagacgcgagttgtgttgcggatgctatgggaaaacaggctttaagcattaatatggattatcatgtatttgaattggcttcagattgtatttctatgctttgggagctgatttag

SEQ ID NO: 83813 - DNA, 984 bp, Glycine max
  Peptide Sequence Number=SeqID_175498
atgactgttcaatcaactcaacatcgagtattacaagacatcgacctagacattcctaaatttgcaaggttgaaaggcagcagagagaatccaaactctattattaatgttcattctagggagtacactcgtcgaagacctttagcagcacttgatacaaacctaagagccctgtccattggccctggtactaggttgacctactggattggccatatgtgctctcatccttgcactaggacaaagtggacgaaagtgcctgtgagttctttaaacaactccaagagacaagtagtcggattgaaaggtcatcaaatcccctaccatggaaaacatacatatatgggacgttggatatgtggatacacggaaactacaatggggatgcatacactggattatctaaaaggaaaagaaaaaaaacactcatccccttcccccttccttgaccccaacaggcaaccaagtgaccttctcttcatcatcaatcccaaccattcctctgtcggaaaccaacattacccattattaattttcctctcaatcaaggcacataacagtgctagtgtgacggcaaggaaattactagttgctttacggggtgccgccatcaccaatggcgagaccattgatgccgtcatcaccactggcgagaagggtgctgacgtggctgccaggcaagggtgccaccagcaccaactgcagaataggttccacgtacgcaagccgccaacagcaatggcgagacatgcacaagccgccaacaccaatggcgagacatgtgccaacgtggaatgtgtcccgccatcgcttcctgcgagaccaacgtggagcagtcccgccattgcttcctgcgagacaggtgcaactaggctagttagggcactgtttgctagggctgagccatttacaggccaggagttgcagctctgcaagggtcacatgcatacaatgtggcttgcagatggtcacatgcatgcttaa

SEQ ID NO: 83814 - DNA, 356 bp, Glycine max
  Peptide Sequence Number=SeqID_175499
atggtcattgaccaatccctcttctatgatttgacccaattatctagcgacggtgtaccatttgaaggtacattggacaatgattggaagtttgatttttctgtgcatgatgcccgtcggttggtttgcaccaaccaagcggatatgaccggaaggcttcttgccggttcattggctcttgaaagccgcatccttcattatcttattgttcgcattttacttccaagatcttcaaaccttgcacagggtactcaaccaaatgatgatgaaggacaattaccgattgaaggagactcttctctccttcaaagtattttggacaagttcgatggactccaaacttatgttggtgaaag

SEQ ID NO: 83815 - DNA, 981 bp, Glycine max
  Peptide Sequence Number=SeqID_175500
atggttgttaggagtatgtttgacttgtccctattgaaggtcttgccaactagtcaagggtggtgggtcgtcttgacttacaaagctactcctctgatggttatgaggagtaagcatgactttgatctgattaaagaccaaaggggtgccttgggttttgtagaagtatgcaccaagggcagaccttgggttttggaggaatgtgtaccaagggcggaccttgggtttttgatgtacttgtattccaagggtgaaccttgggtttgtcgagccttggaccaaggacgtgtttgccctggattttgtcaagcctacggagctgtgtcgaggcttactaaagacgggccttggattttgatgagtcttgtgtgtaatgcaagtgttgtgctcttgcatacatggcattcgccgtgggtggcatgtactggaggcgtaatgacggcgaaccttaggttttgcgagccctttggaggattgatcaggaaattgtctgacttgggttttgggcactgtgctcttgcatgcatgccactcgctgtgggtggcacacactatagacatggtgcgtacgtgtttcttacaaactggctcgtactggagacatggtggtatgctcttgcgtacatgtcacttgtcgtgggtgacatgtactggagacgtagtagtatgctcatgagcacatgtcactcgtcgtgggttggctatgaccctgaatgggccttcctagttggggccaagctttctcgccaggttgaaagctttgaattgaacatcgttgtccgtgacaatggtatatgggaggtcatacctgcaaatgatatgtttccagggccaaggggagctcaagctataaagattatcgggaggagtgcgtgggatgtctgcaaactcttggcattgtttgcacctcatggtaaagttgaggatgtctgtcctgagtgttggctagtagtagctggctcacaccactttggtggctag

SEQ ID NO: 83816 - DNA, 198 bp, Glycine max
  Peptide Sequence Number=SeqID_175501
atggagtatgtggttggtgaagtagataaggagctggtggttctcttcctcttgaagcagggttgcgcgatccgtgaaattcgtaatagtggcggaagtcgaaaagagaaggctgttgcttctggaggaagcaaccttgctcgcctgggcaagctgggcggcaagcttctcccctattttgctataaataggggatga

SEQ ID NO: 83817 - DNA, 855 bp, Glycine max
  Peptide Sequence Number=SeqID_175502
atgcaggaaagtggcaatgacaaatttcttattgatggttttccccgcaatgaggaaaaccgtgcagcatttgaaaaagtgacaggaatagaaccagcatttgtcctattttttgagtgccctgaggaagagatggagaggcgactacttagtaggaaccagggtagagaagatgacaatattgagacaataaggaagcgatttaaggttttcttggagtctagtcttcccgtgattaattattatgatgcaaagggaaaagttcgcaagattgatgctgcaaggcctatcgaagaggtatttgagacagtcaaaggaatttttggtccaaagaatgagaagataatgattagaactagaggtgttggtcttgttttaggccgaacaattgaaaaagttatggggaggagagacacgagtaacgatgatgcccccaacagcgaaggcctactgcatttgcccccagaagcacctgttgaagaagctgttactgatgttgaggattttgaaaatcacattgctttgagagtctggaatgaagaggaacgtcctgagctgaagttatcttcccatggaaggaagatgactaggttcgagagacttgctccagagattgaaggccttgtggctgctagtggactaaattcttggatcgaatgttccctagatatgggcgatcagagactaatgtttgcttttgtggaacgcaagcataaggaaactagtagtttccatttgcctgttagagaggtgactatcaccttgggtgatgtcgcgtcgttgttacatctgcctatcgtaggggcgttccacagcttcgagcaacttcatgtcgacgatgcggtcgatatgttg

SEQ ID NO: 83818 - DNA, 798 bp, Glycine max
  Peptide Sequence Number=SeqID_175503
atgtcgtatattgacttgacaaaggtcattaagtctattgggtacaaagcattcaagtgcttatggtacaggcacccccgaaaagcactttgcaaagggttgaagccactgaattatgactttaatactttgcaattggctgaacatgttactgggtttgatgtggtggaagtgtatgtggaagatggggtgattgacaaatgtgataaaaagttgaatgattttaagggagatgaagttgttgtaattgatggagtggaggctgaaccagttgtggagggtgaggttcaggtggagggtgaggttcctgtggaggttgaggttcaggtggaggctcaggttgatgtggagcctcaggttcagcttgatgaggaaggtttggttgaggttgaggtgcaggttgaagatgaggctggtgttgtgggtgagatggaggttgttgttgagcgtatggatgatattgatgttggggttgacaaagatgatgatgatgcggggtctaaaaaaagtgatgaggattatgttggggatgaggaagatcatgatgatagcagcgactgtagtgaagtttcagatactgaatattctgatgagttggatactccacctggaagtgaagatgaaggtcccccaaaagttagacttcctcattttaaggtgcctaaaaatgatgaagatgtaaaggttgaggttgggttgcaatttcagactcaaactcaagtcacaatacttaatttcataacattcacaagggacgattgtacatttaggattatatcatcaacatcaaaagcttga

SEQ ID NO: 83819 - DNA, 174 bp, Glycine max
  Peptide Sequence Number=SeqID_175504
atgaggaattacaccttgagagtaaaacctagaaaaaatgatgaggaaggcgagcatggtgatgaagatgaggtagctggagagaataaggtcaaggtgagggacgagaatgagtttggggtgagagacgagaatgaatttggtagaggtggtgctacagaggtgcctagttaa

SEQ ID NO: 83820 - DNA, 444 bp, Glycine max
  Peptide Sequence Number=SeqID_175505
atgacagtcaaagtttcaaccaccacgaccactaaaaaaccgatttccagtataatcattgaattaggagtaaaggaattctccagagacgaactgccaaagagaggatcaaatattgtactaatcactgatggacgagtcatactcattaggaagactgtcaagaatcaaattcagatgttcaaagaaaaacatagattcgccaatcgaagtgagttcattaaccttattctgaacataaagaagataatcaatgatggagcaattactgagggagagatatcaaagttcgttgcgaagctaacgaacacgagtccaaaaatcaaatgcgaaaaatactttgaagaagtttctaagaaatcaaatgcgaaaaatactttgaagaagtcgctgacaaggaagatggcaaaggggaggaaggaggagaagaagcggaagccatga

SEQ ID NO: 83821 - DNA, 249 bp, Glycine max
  Peptide Sequence Number=SeqID_175506
atgaaaggtcagattagagctttgttctctaccgaagcgcgagccaagttggaagattccgcttcggttgaagggttcctctcggtgtggggtttcaatggagaacaatggcagtttgtgatggctactggtggctactacaaagctcaaaacgcacaagtgactaatgctctcggaaacggaaacgtcacgcacactccagaagtcttctcaaagatcccaacagttagatgtacaagtgttctgtga

SEQ ID NO: 83822 - DNA, 519 bp, Glycine max
  Peptide Sequence Number=SeqID_175507
atgggaatggtaactgatttgggattgcagcagcatcgtcttgatggggatgattatcttgctgtagttgatgaatttatggaggctgtctttactcgctggccaaatgtgattgtgcagggaacagctggagttgcaattgctggacttctaggtgctgtacgggcgcaaggaagaccaatgattgacttcccaaagcagaagattgttgttgctggtgctggaagtgctggaattggggttcttaatgcagcgagaaaaacaatggcaaggatgttgggtaataatgaagtagcttttgagagcgcaaagagtcagttttgggttgttgatgcacagggattaatcacagaaggacgtgaaaatattgatccagatgcccttccttttgcaagaaatttgaaagaaatggatcgccaaggactgagggaaggagcaagcctcgtggaagtggtcaagcaagtgaagcctgacgttctcctaggattatcggctgttggaggattattctcaaaagag

SEQ ID NO: 83823 - DNA, 150 bp, Glycine max
  Peptide Sequence Number=SeqID_175508
atgggtagtcaaggaactaaaggtaacccatcaaagttcaagaaagactattacgcgttctacgacaaggaatgttcgaggattgcagagcatgtgtacttggggagtgacacgatggcgaagagtgtcgagcttctgcggcagcactga

SEQ ID NO: 83824 - DNA, 240 bp, Glycine max
  Peptide Sequence Number=SeqID_175509
atgattcaactggtctttcattaccttcaagttctgcgtcaggaattcgaggacgacgtcaatatacgatgggttatcttcgagtctgctcaagtggaggtacattggcatgaagtaataatgtctgagcagtctcaacaagatgcctattcttcctttcggcaatgtcattctattgaggagtatgaggacaagaagattgatggagaatgccctgtgctgacaaaaaggaagaaatag

SEQ ID NO: 83825 - DNA, 1710 bp, Glycine max
  Peptide Sequence Number=SeqID_175510
atgctacctgggagattctcgtttttcggaggcggcggggattccggcgcggtggtggacaacgccaattcgtcaccatcaaagggtggtggagacgaactcgctgttgttcaacccacactgaagctcgagacggataggcaggtttaccggcccggcgatcctgtgattgtgaccatccagatctcaaatcccgcaaatgggtactcgtttctcatggaaagactcggttttgagatcaggggcatcgagaaattggacactcagtggttcgccacgcagaagctgatgcccggctcgaaacaacggagagggtgcccatggtgttatgttgcgcctgttggaagtgttatggccgttgaagtgactaatacattcgagccaagtcacaacttcgatgggaagtggtacagcaagcaatcactgtggaatgggccaccaaggcgaagggacgcgggaaagagtaacgggagggatgcaacagatgtgcactccttttacttcacaagattcccagaggaaatgggggagaaggatatgtggatgaagtttaagaaatggggagacgtgagggaggttttcatcgcaaagcatagaaatagagatggtcggaggtatggctttgtacgtttcaaaggagtgaaggaggatgtgaagctacttgaacaacagctggatagtatggttatcggcggcctaaaactccatgctaacctaccaaagcacggaaaggggaggatgaatgatggtaaacctaacttagaggaggaaggagatggcatacaaggcaagggaagcagggtcgtggaaccaatacccacaatagcggacaaaaccaacgacgtacgcaagcgtagtgggctgagcacccccatggaaaaggcgaagtggctcaatgatgcgtgggtagggagactgaaaaaactgtcgatgtttgatagactagaagatgagatcatgactgtgcagcaaggatgcagaaaatggatgatccttgttccattcgctagagaagtggaacttgggttggcatggatcatgtgctggggaatcccattgcacgcatgggatgtcgataatatttcgaagattgcggcgactgtagaggaagtggtggaggtggaggaattattgaggcttgatagggcaagggtgctcataaaaattccacgaaaaccttccattcagcacacggtggcagcattgattaacggggaagtcttcacgattcacttggtcgaggagacatgctactacccatgtaggcacaaatgcctaacagggtgttcacttgggtcctttgacgatgtcatcatcggtgtggaaaggacatcgagcagtagaagactgatggacaaagaaacatgcgtggacacggtggcagtattgattaacggggaagtcttcacgattcacttggtcgaggagacatgctactacccatccactcactcaattactaacagtcaaaaaaacgcagctggtatagctgtgtctcgaagtcaaacatcgtcaccacagactacctatgttgagaggttatcgaaagacagaacaggtggtagccaagatatggtggaaataggaaatgcagctggaataagggaagaggaaatgaacaacactgtcaagagtggaagaaagggacttgaagagagggacaggtcagccggctttgctaatgacaccaatgtggagtctcacatatag

SEQ ID NO: 83826 - DNA, 321 bp, Glycine max
  Peptide Sequence Number=SeqID_175511
atgattataacaaaagatgatgacaaaggtgatgacaaaaagctcaaagatcaatcaaagaataactcaagtgaatcaaagatcaatcatagaacaactcaagtaaatcaagaagaattcaagactcaagaagaaagtttagagtcaagaatcaagattcaaggttcaagatctcaagaatcaagattcaaggttcaagatctcaagaatcaagattcaaggttcaagatctcaagaatcaagatcaagattcaacaatcaagagaaggctcaatcaagataagtatgaaaagtttttctcataaattgaatagcacatga

SEQ ID NO: 83827 - DNA, 114 bp, Glycine max
  Peptide Sequence Number=SeqID_175512
atggaggtgcaccatgtcaatgtgggtacctttgttgttgaagtcagaaatggggaggaaggtgtaagctaccggagtggtggttgtgttgttgagaatgggaagctgaaatga

SEQ ID NO: 83828 - DNA, 177 bp, Glycine max
  Peptide Sequence Number=SeqID_175513
atggaggatatacatctccatgtggagcttgtaggccttggatcttcttcatcaatggaatcctttgcttctttaatatcaatggcagcggaatggagaagaaagaaagatgattggagacgccacttcaaggagaagatgagtcaagaagaagctcaccaccataggaagctatga

SEQ ID NO: 83829 - DNA, 739 bp, Glycine max
  Peptide Sequence Number=SeqID_175514
atggccaccgggcgcctgatcgccatcaacggcaagccgccgctgcgcgtggatcgcgagcccggacaggacgggcaaccggcgcagggcggccagcgcgatgacgatgacgagaaccggccgttgaacttcagctggcgcagcaccttcccgccggccaatacgctgcaccgcgccggaagcctcggtggagatcggctgggccaaacgctacggcgtgcatccgggcgaccgcatcgccattgccgtgggcgaacaggagcgcgagttcaccgtcaccagcgtgcgcaaggcggactggaacaccttccggccgaacttcttcgtgctgctgaacccgaatgcggtgggcgacaccccgcacaacctgctgtcggcgttccatctgccggccggcaaggcagccggactgggcgagctggtacgcgcgcagcccaacctgtcgctgctggacgtggatgcggtgatctcgcaggtgcgcgatgtgatggaacgggtggcacaggcggtgcagctggtgatggtgttcagcctgctggccggcgtactggtgctgctggccgcgctgcaggccacggcgggcgagcgtcgctacgacagcgcggtgctgcgcacgctgggcgcgacccggcggcagctgcgcggcgcggtgctggtggaattcggcgcgctgggcaccctggccgcgttgctggcggtgggggcggcggccgccatcggtgtggcggtctcgcagaag

SEQ ID NO: 83830 - DNA, 108 bp, Glycine max
  Peptide Sequence Number=SeqID_175515
atgggcgcagatcagcttagttttcacgcaaccttcgcgttgagtgcacttgtcgcgctgagcaagtatgacggtaacgcctcgcgcttagcgcgtgggacgtgctaa

SEQ ID NO: 83831 - DNA, 291 bp, Glycine max
  Peptide Sequence Number=SeqID_175516
atggctccgaaaaagatttccacgaagaggtctaggagagatgtcgcggcggaagggtccaatgtcgcccccgagtttgatagccaccgtttctggagcgccgagcaccagcagcgcttcgaggccatcaaaggatggtcgttccacagagagaggcgcgtccagctcagggagggtgagtatacatattttcaggaggagatagcttgcagacattggacgtcgctggttactcccatggctaagtttgaccctgagaggagggagtgcgagacatgcgttcatggctga

SEQ ID NO: 83832 - DNA, 558 bp, Glycine max
  Peptide Sequence Number=SeqID_175517
atggtgccctataaaactgccgtggagctgtgcgccattgagcgcggcggaccggcgcagtgtcaggccggcgagcgcggtattcccgccgccaaaggctcacgctatgtggcgaacctgagcgtggcgcactcagctggcaacgcagctgcaccagcgacaacaccagcctgcgcgacagctgtctcgagcagttccgctttgccgacaaggaagaaaacaatggataagccggatagcaccctgcaggcgctgtgtgcccgctatcaggccgtgatactgcaccacgacgccacgcacttgcgcgtggcggtcgcggacgcgccagacccgctgttgttagaggcgctgcagtttgccagccagtgcgcagtcgaggtcgaatgctggcccgccgcacggctggagcagctgctgcaccagccagaaagcagtgcggcaccgcgcgaacaggccagcgccgagtccgccattcacgcggtggatcagattctgcgccaggccatacagcgacgcgcctccgatgtgcactttgaaccgcagcgtcacgggctgcgc

SEQ ID NO: 83833 - DNA, 249 bp, Glycine max
  Peptide Sequence Number=SeqID_175518
atggcgtttttccaaagctacttggactacaaggctcaaaatgcacaagtgagcaatgctctcggaaatggaaatgtcgcgcacactccagacagcttctcaaagatcccaacgctgcagaccaaatttcgagaagatccaacagttaacgaaggttgggcaacatttttaccgaggcagcttcatgtagcttccttgagaagcttcattaagaggcttcctcgagaagcttcctcgtggcttctttga

SEQ ID NO: 83834 - DNA, 363 bp, Glycine max
  Peptide Sequence Number=SeqID_175519
atgccgattcagggacataatatatcgagacgctcgaaattgaacaacggaagctctcgagaaattctgaatggtcatatctcttcacacggatgtccgattcgaggacataatatatcgagacgctcgaaaattgaacaacggaagctatctacaaatttgaatggtcataacttttcacacagagagccgattcggggacataatatcgagacgctcgaaattgaacaacggaagctctcgagaaattccaatggtcataacatttcactcggatgtccgattcggggacataactatatcgagacgctcgaaattgaacaacggaagctctcgagaaatttgaatggtcgtaacttatga

SEQ ID NO: 83835 - DNA, 192 bp, Glycine max
  Peptide Sequence Number=SeqID_175520
atggtatcaaggtacgctttaaatgaaattgctgctgagtatgagcgtgtagcttatgcaggaaaaaatccttcatgttgtggatgtgtcatgagggctacccacggtcttccatgtgcatatcaaggcttatgtgaggctgaggtgaccataactgagaagatgaaaaccatatcgaaacgatttaagtag

SEQ ID NO: 83836 - DNA, 207 bp, Glycine max
  Peptide Sequence Number=SeqID_175521
atgtaccctctacttgtaccacaaaggatgtaccctccaatgtgttgggacaaagaattctcaggcggggaagggaagaatcaaaagaattctcaggcagttagtcctttgaattctcttggaaagagagaagagagacacaaaagaattcaggcagttagtctttctattcttttggcaaagggagaagagaatgaaaaagaatag

SEQ ID NO: 83837 - DNA, 153 bp, Glycine max
  Peptide Sequence Number=SeqID_175522
atgaaagacatcttaggggggattgttgggttccatataacagaacaccaactaacagtaggcttgacacctctaatatttgacagtgactggaaaaagattgaagcatttgttgtatcaaagacagtcatccaggcattttatagtttttga

SEQ ID NO: 83838 - DNA, 145 bp, Glycine max
  Peptide Sequence Number=SeqID_175523
atggctcctaattatatgggtcatcaagtttatcatgtgctgacaatagcggaggagcccgtggatctcctcgggggcagagtaggtgtccgccatagctttggcctttgccagcaatcgagggagttcttgactcccgttcaaa

SEQ ID NO: 83839 - DNA, 866 bp, Glycine max
  Peptide Sequence Number=SeqID_175524
agcagcagcaggccacgcggcgacaggcagcgtttggccacctcgaagaagctggcgtagttcttgtcaccgacgtgctcgaacatgccgatcgagaaaatcgcatcgaacggttcgtccagttcccggtagtcctgcaggcggatttcaatcggcagccccgcgcacagctcgcgggcaaactcggcctgttcctgcgaaatggtcacgccgacgccgctgacgccgtagcgctcggctgcgaacttcagggcttcgccccagccacagccgatgtccagcacacgctgacccgggcgcagccccagcttgcggcacaccaggtcgagcttggcttcctgcgcggtgtcgagatcgtcggcattgcgccagtagccacagctgtagaccaggcgctggccgagcatggcctggttgaacaggcgcgcttcagggcatcggccacttcgcgccaaccgtgcacccgttcgtccagtgcgcctgcatcaggtcggcgaggcatccaggacgttggcatcccaccaaccctccatgtagctctcgccgaggccgagcgagccttggcccatgacccgcgttcgaagaagcgcgggtcatgcacctggatatcctgtggctgggtaccgccgatgcggaccccggcttcctgcagcaggccggcgacccgctcctgcaaccctgtatcgccaccggtgcctcgctctcacgcggtcaaccgcgtgccagaacagctccacgtacctaccacgtgcggcaacagcaccgccgccggaacatcggcggtctggtttccgagtatggaccttcatcgggaaaacagcgcagtgccctgttcatgtttgtacatcatcgcctgccatggctga

SEQ ID NO: 83840 - DNA, 1494 bp, Glycine max
  Peptide Sequence Number=SeqID_175525
actgttgcatctgcggagtgccagagcgagcagcccgaccaacaaaaccctcttacgagcagcgagtggcagcagagccccgcgcccagccggttccaggcattgatcacgagcaatgcccatgctcaggtcactgatgcccctctcatcgaaatgcggcgccaacgcatcgaacgccgcctgcgacggcgcaccgtcggtcaagcgagtcagcgcctcggcccagcccagcgctgcgcgttcgcgtgcatcgaagaagcggctttcgtgccacgcgggcagggtgtccagcttgcgcggctcgatgccgcccttgcgcagcgcggtgccgtgcatgtccatgcagtagccgcagccgttgagctgcgacacgcgcaggaacaccagttccatcagggtcgggtcgatcgaactgtcatgcaccgcctggctggtggccaacaggcccttgaaggcctcggcggccaggcgggtgtaggggacgcggggagaggcgtggtcggacattttcggctccatggcggccacgttggccgcctttcattaccaggacgccgcaccgccatcgcgcgtgacaaccgacggcagtttttccggattcagcacgctgtacacgttggcgatgcggccatcggccacttcgatggtggtgaccgagtgcagccgatcgccatggaagcgcaggatcgccggctcgccgttgacgtagcccagctgcgccggatgcaccgcgccacgacgtgcgatggcccagaacaggcggccgatgcgctcggcgcccagcagcgggcgtaccgctgcggtgaccacgccgccgccgtcggagaccagctgcgcgttggtgtgcagcagggcctggattgcttcgctgtcgccgcgctgcgaggcatccatgaagcgcgccagcagctgccggtgctggctggcatcggcattgaagcgtgggcgcccggattgcaggcgctgccgggcccgatgcaccagctgccggcagttggcttcgctgtggccgatcaggtcggcgatttcgcggtagtcgtggtcgaacgcctccttcagcaggaaggcggcgcgttcctcggggccgagctgttcgagcagggtcaggaaggcgaccgagacatcgttggccagcgcatgcagctgcgccgggccgggcgccgggtcgggctccagggtgaccgccagtggctcggccagccaggggccgacgtagtgcatgcgctcgcgcttggccgcgcgcagccggtccaggccaagccgggtggtggtggtgaccagccaggcttcggggtcgcggacggccgccgggtcggcgccggaccagcgcagccaggcatcctggaccacgtcttcggcgtcggcgcggctgccgagcaggcggtaggccagggccatcaggcgcgggcggtgggtctggaaagcggtttcggcgttcatgtgggcaaggacgccgcagtggcgcatggcgtgacagagggcttgcgcggatag

SEQ ID NO: 83841 - DNA, 405 bp, Glycine max
  Peptide Sequence Number=SeqID_175526
tttccagcattgatcacgggtctctgccagtcgttcggggttcctgtcacaccaagtaaggtgattcgattgctgatcacccgagctttcatagagaagtattgcacgcctagacaggcacagggtggcgacccgcaggccccagacgcaccgccgccacctcatcaggctgatccagcagggtcatttgacacggagtgcctcaacctgcaaagccatggtttcgctccttttccatgccctactccggatcagttcagggctgaggtcgcatggcccggagattggcctgaggcccaggcaggggaagcacccgcagaggctcccggcaatgcagatgaggcccgcatggacgaggagatgacaaatttactcgatttcttgggagggagcggagccacatga

SEQ ID NO: 83842 - DNA, 297 bp, Glycine max
  Peptide Sequence Number=SeqID_175527
atgaaactacacgagtttctgtgggagtcttacacaacaactgttatgtcagcgttgcctccaatttctttggttggaattgtagcgtggcgaaaaacgaagatgtttatcgacccaaagaatgcaaacacaactacatcggctgaagttgcagagacattacagtatatggtgtcaccacaagggaggaacacatggacaattgatgatctcgtgccttatgtggagaatataacgattttatctaaagagcaagagagaatcactgaggctgtggcacatggtccagcatcatag

SEQ ID NO: 83843 - DNA, 981 bp, Glycine max
  Peptide Sequence Number=SeqID_175528
tctccatggaaccaattgcctccctcgcccagtattatgatcagccgttgaggtgcttcatctttgggggcttccagctatcaccaatggtggaagaatttgaagagatcctaggatgtcctctagggggaaggaaaccatacctcttctcagggttctacccctcattggccagaatttctaaaaaggtccaaatctcggcgcaggaattagaccgccaaaggcaagtcgaaaatggggtggtcggaatactgagaaaatatttggagggagtcctctttccaaatgtggatgggttggtggacctggcagcgatcgacgtttttctcgcctatcataaccacaaggaaagtccggttgtcgctatgctagccgacctatatgacaccttcgaccgaagatgtgaagaaagcaatgcaaggattgtttgctgtaccccagctctctatgtggggctggtttcacacctttttctccagaaggtaggcccgtctatccgctacaaggaaaggaagaatcgagattctatcttcatgcgaaggatgtccaaatgttcccttgatgggaaacaagggggttgtattaattataatctcgttctcgccataagacaacttggctaccccatgagaggagcgccattagacgaaagcatcacgcctttcatcgcacggggttttagtgaccacaacgcgagggacagagagcttaggggaagcagtaatgggatcatcggcggctatcataagtggctgagagttcgaacacaaggactggattggctcccaaatctaaagactgtgagagacgatgaggttaaagcttcggaagaaagtgatgaggtacaagccctaaaggcagagcttgaaagagcctgggtagtcgaagagaagttcaaggcagcaatagtgagctcaagctccgaagaggtgaaaggaatcatcacgggtcaaaggcatgatcttgaaggacgagctaaag

SEQ ID NO: 83844 - DNA, 336 bp, Glycine max
  Peptide Sequence Number=SeqID_175529
atgaccatgattacgccaagctggaaattaaccctcactaaagggaacaaaagctggtaccgggccccccctgaaggtggacgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcctcaacagttgcgcagcctgaatggcgaatgggacgcgccctgtag

SEQ ID NO: 83845 - DNA, 351 bp, Glycine max
  Peptide Sequence Number=SeqID_175530
atgaaactggccaaatacaggctaaaggcccaagtggagaaggacgaaggcccaagtggagaaggacaaagcccccgagtggagaaggatgaaggcccaaagtttctctctaggttccttgttgaaccaattatcagacttatcaaggtaatccttgtggcgtctaccctgacttatcttccttcactggaagtggcgtcaaccctgacttatcttccttcactggaagtggcgtctacccggacttatcttccttcaccggaagtggcgtctaccctgacttatcttccttcactggaagtggcgtcgtccaaaaactctacagcctgtatcaaacgatccgccccgtaa

SEQ ID NO: 83846 - DNA, 923 bp, Glycine max
  Peptide Sequence Number=SeqID_175531
gtcaaggcgaatgggtttcattcattgatgtctgggcgctattggtatttggaatcgtcctttttccaaaggtggatgggctagtgaatttagcagtgatcgacgcattccttgcttatcaccatagcaaagaaagcccggtcgttgctattttggccgatgcttatgacacatttgaccaaagatgcaagaaaagtggcacaaggattgtctgttgtacacccgttctttatgggtggctggcctggcacctcttttgtcatgaaagtagacccatttatcccctgcaaggtcaccacatgtgcaccgagaaagggaagacaaattgggagcaactcatggctagtatggtaggggcatccattaattggttcccccgatggaaggaaggaagagtcggggttttgtcctcatgtgaagggttctcaaacgtccctttgatgggaacaaggggttgtatcaattataattccatccttgccataagacaacttggctaccccatgagaggagcaccgtcggaagaaagtatcacgcccttcattgcatggggtttcagtgaccccaatgcaagaatatttcaaagggtccaaaaggcatggagcatgatgcaaagaaaggataaggagcttaggggaagtagtaatgggatcatcgacatctatcacaagtggctgaaggctcggacgcaagagctagattggctcccgaagctaaagacctcaagagaggaaaaggttgaaacctcagaggagagtgaggaggaaacaaagagggcccgaaaggaagaatggggtcgaaacaagttccgaggggctttgtggggcagcaacaacgagcttaagctttggagggccaagagagaccagtcgagagtcgaaggcatgatattggaagacaagttgaaggcttgccaaaggtaa

SEQ ID NO: 83847 - DNA, 375 bp, Glycine max
  Peptide Sequence Number=SeqID_175532
atgggtagggaggaaccaagaccaatgctaagaaagagtgaggtggcaccattagaggatgatgatgcatcttgtgtagagcttaaaagggtaggctccatggccgctccaatggtggctgcgaatatatgtcagtaccttctacaagttgtgtcacttatgatggttgaatttgtggatggaactatctcacagccagtcattacacatcctttgcattctgcatggaaaagatgcaataatatggtgatatcatggatcattcactcagtctcaagctctattcgccaaagccttctctggatggataatgccagagacatggaaagatctgaagtccagatactctcaaggagatttattgagaatctttga

SEQ ID NO: 83848 - DNA, 411 bp, Glycine max
  Peptide Sequence Number=SeqID_175533
atggagaagaataccaatatgagactcagagatcttagtgaaaccaaagatgaagaggttcctcaacttcaacgaaagaggaaggttgttgctcgaccacaagctcttctttctcctaagaaagataaagttgttatggcaactccctctagcaaggaactaatattttcgtatattatgcccagaaagatgaagataagggaaataagagaaaacttggcattcttgagaagaactggaatccaccctctccatctcatgaatctaaacaattcaagagttcaagataagaatcaagaagaattcaagactcaagaagagagtctagagacaagaatcaagattcaaggttcaagatctcaagaatcaagatcaagattcaagaatgaagagaagactcaatcaagataa

SEQ ID NO: 83849 - DNA, 216 bp, Glycine max
  Peptide Sequence Number=SeqID_175534
atgacacatagaagtgtttgcaaacgaacccaacaatgtagtgaagctgaacttaaactaatccactacgttgtggatggaaaagacgaagttagccctcaacttgaagaagaagaagatggtcatggtggtgatggtcgtggaaaagacgaagttagcattaccaagaaatcagttactaaactaaccattaaactaacacgtaccttgcattga

SEQ ID NO: 83850 - DNA, 414 bp, Glycine max
  Peptide Sequence Number=SeqID_175535
atggtagatttccatttgattgacttgcctttagaaggatatccatatacgtggtctaaaagcttaaggacgcctgacagggtaaaagagaggctagatagagctctgagttcaggtaattatctcgggatgctagaggtaaggaggccagtgattatggaggatgataacttgatgctttgctcaacattcttgaaggatgagttttgtgatgcattgttccaaatgatcctagataaatctcctgggacttcatctcacacttgtacttcaataatctccccctcaagtgcgagtctcttccacatggaaacctcccctagagcgaaagccatttttcaatccatgagtattcaatggttacccttagagcttaatcgtgattacctcaactcgtctagccattactgttaa

SEQ ID NO: 83851 - DNA, 213 bp, Glycine max
  Peptide Sequence Number=SeqID_175536
atggggtttctatttttcacttttcgtgtgatccgactcaataaaaatggcacctttcttgcgactggagaagggagtgtagggagtgagctaggaagtgagctcgttgagggagagagaagcaaagtggtttttgtagaaggagttggggtcgaggtggaggatggttttgctgatgacagaggcggtagtagcgatgacgggtttcaatag

SEQ ID NO: 83852 - DNA, 1068 bp, Glycine max
  Peptide Sequence Number=SeqID_175537
atggatgaggattgggtggacatgtcacatgttggtacaggacatggtgctctcaccaaccatggatatgactttgctctagtcaagaatgccaatcgaagaggtagccactccatacccttcgtcctcgccttcttcctcttcctcgcgtggatctcactcagcctccagcgtgcgtcctactcctacgtgccccctcactcctcccacacagacatcagggccaacctcgtcaggttcggcgtttccgaggtcgcaaaggacaagcgtggttggatctttgatcctatagctctggccctcgcttccggcatctcagttatgtcaacacttgcattgcttttcagtttcatgcaaccatggcatgatttacattgcaaaattgaaggccgtgctgcatatgatatactcactagttttgagcagcgctggagaaaagccaccaaatggtctgagatgggtcggaaactcaagagagtatctaactggaacgatgattctttgatcaagatagaacgcatttcttggattcttagtccttcggaattaactccagttgatgatcctaaactatgggtttcaaaggaagacgatcctgaaaattggcatgttcaagtttttcgatccatagattatggttctttgaaaggattccctaaggatgtagttgttgccaagactcagccttatattgaagataatgaagtgatgaaagggagagatggagacgggtgggaggaagagaaaaaaagaagagacagaaaagcctacactgttgttggaactgtgggtcaaagaaaaccctacactgctcttggaatagtcgtgggtgctcaaaggtcaaagctttctacgctgccagttaacaagttgattgtgctttacgtcgttttcaagcttgacgagagttacacgctgagcaaagtttccatccatgccggtgatggttttcacaacttgaaggagattaagaccgtggaactcatgaagccaactgggtgggtttatctatccttgtctggagccgatcctagtatgactgtaagagagctatgtgggagaatgtga

SEQ ID NO: 83853 - DNA, 420 bp, Glycine max
  Peptide Sequence Number=SeqID_175538
atgtcgtttctggttcatacggaggattgtcgtgatttcattcgaatgggtccacaggaatccattcaattatgtcacaaattaagaggcaccagaatagttaaggataacatgcggtccactgtggaggagcaagttgctaagttttgcatattgttggtcacaatgtcaataatcaaagagttgctagtccaaccatcaggtagggacatcccaagtaacatagcaagccattcaagatttcatccatttttcaaggatgcgggatttatgcataaacttcagatccttacaccttatcgtggtgtccgttaccccttgaaagagtattctgctagagggcaaaaaatacctaaagagttgttcaaccgtagacatgcatcacttgggaatgtaatgagagaacttttggcattttaa

SEQ ID NO: 83854 - DNA, 753 bp, Glycine max
  Peptide Sequence Number=SeqID_175539
atgtcaacggatggtattattcgctctgaggtgcatggtatttctatgatcattgatcaatctctattcttttcattaactaaattacccagtcaaggtgcaccttttgagggcaccattgttgatgactggaagtttgactattctagtcatgatactcattgtatggaggacttgattttgatatgggctttccttaccggtcgtcagatcgactgggctcacttggttaggtaccgaatgcataaggcattacaggccaatgcacctcttccgtatcctcaattggtcaccctttttctctgtcattttcaaattcctcttgatgatgaacctcttgttcaagtcaagcgatcttttgccattggtgctggtgtaaaggacacagtacctccacaagatgagcgtactccctctcctcctcctcagcgagatgattcctcagcccttatgaatgaagttctttcgaaattatggagcctccatacctatgttggcaaacgctttgattccttggatggtcgctttgaaggaatggatacccgcatcacccatcttgaagaagatggattaaattgtcatcatcaaaaagggggagattgtagaagcaaagactttgactttgatgttttgatgatgccatatgattatgatgttttgatgccacgtgaacatgtgcttctcaagttaagatcaagacaaaaaatccaagagattcaagatacatcatcaagaagatctctagtgatttag

SEQ ID NO: 83855 - DNA, 252 bp, Glycine max
  Peptide Sequence Number=SeqID_175540
atgggggttcaaatagcaaccaggcccacttgggccttccaggatgttcctccagaaggggaagaacaaaaatgttcaaccttcctggtatctgagatccacttaaaaattagtgagaaaaattgttttcgtgaagaaaatccaagccaaggcgcttctgtaacgtttccgtgggtgatttcgcgaagattttcaaccgtccttcgacgttcttcgttcgttcttcgtcattcttcggtcttcaaccggtaa

SEQ ID NO: 83856 - DNA, 906 bp, Glycine max
  Peptide Sequence Number=SeqID_175541
atgattgccaccgaactggcgccgccgcagattaacgcgctgtatcgcctgccggacgacttctggccgcggctgcgcagcgcgccttacaagcacgatctgtttcagctgctgcgccgcatcgacgcccagggcggccagccttacctactggggcgcgcgccgctgccgcgccacgagatgctgcgtctgggccaggagccgtcgctgtcgttcgcgccctccacgctggcgcaggtggcgccgcgcgccaacagcccgctgcacgacgtctcgatcttcagcttcggtctgttcggccccaacgggccgctgccgctgcacctgaccgaatacgtgcgcgaacgggtgtaccaccaccaggacaccaccctgctggcgttcaccaacctgttccatcaccggctgacgctgctgttttaccgcgcctgggccgacgcgcagccgacggtgtcgctggatcgcccggacaaccggcgcttcgacgaatacctgtcgagcctgatcggcatcggccagccggcgcagcaggaacgcgacagcatcaacgcccacgccaaacattttatggccggtcatctgattcgccacagccgcgatccggaaggcctgagcaagattttgcagcagtatttcaaggtgccggtgcgcatcgtcgaaaacgtgccgcactggctgcgggtggaaccgcgcgagcaagctcgcctcaaggctgggcgcggcgcgccgcggctcggcgagtcggcctttctcggcatcgcggtgcgcgatattcagcacaaattccgcatcgagctggggccgatgccgcagcaagactatgaccgcttcctgcccggcgccgacctgtgccggcagctgcgcgactgggtgcgccaatatctgggcatcgagttcaactggtaa

SEQ ID NO: 83857 - DNA, 612 bp, Glycine max
  Peptide Sequence Number=SeqID_175542
atgcaatctcagggacttgcagtgcctcctaagcctctaattggtcccttcgatcctcgagtgagcataaaggggagttgtgttgatccctcaggaaatgatcctgagactggtgactctgaccggtgtggcttgtacatagaagcaaatcctgcccgcctggttgccatggggagagtttatgagggatccactgttgttcataacactcctttgttgcctggccaagtaaagacacttcacaccttccttgcttggccgacacatctggtcaagtctttatcacggcaggtagttgtgtctccgtcaaaaccaccttcgaagctcgatccggaggttgatgatccgctttatctgatgacattgaccatctcagagcttttcttgaggccttatcaggttagatgggatgccaccgtgttcggggtctttaatccagatttccccctctatataaagcacaaagacctcttcaaaatcgcacacggttgtggattctgcatctcactgaaacatgtatgcgagtggggaattctgatatttatggattcctcgagccacagtccattcattggtctaggcaatcgcagtttgagtctgaaaattacataa

SEQ ID NO: 83858 - DNA, 372 bp, Glycine max
  Peptide Sequence Number=SeqID_175543
atgcgtcaagctaatgacgttaaagaagcgcttcctgggaggcaacccagttttaatttctgttatctttgtttgtttttcatgcatttaatcatttggaacttactgtataatctgaactttggagcatatcaaccttcctttgaatggactaagtttaaaacttcgaaaatctttttgaaaattaatccttttgctaagcgcctgcttctcgctaagcgcataatcattcatgtgctaagccacgagtttcaagcgcttagcgcacaaccttggtacctgaggttgattatttccgctaagctagccaaggttaagctaagccaaaatcaattcgaattgaattcagctaagcttcagcctgatcgctaa

SEQ ID NO: 83859 - DNA, 96 bp, Glycine max
  Peptide Sequence Number=SeqID_175544
atgacatcttccaacaagcagacatcaactaatttcctcgggtcaaaagatgctgagaatattaaaagtgatgaatttaggatgcttagtgagtaa

SEQ ID NO: 83860 - DNA, 705 bp, Glycine max
  Peptide Sequence Number=SeqID_175545
atggcttccatgatggatgccatgctgggaaatgaaacaactcatggaggggcagactcgactctcctaactgctacacaccaccctattccaaacatgatgggaggagagagaagcacatcggggcacatcagcaacccccatccggggtacaaccgaggaacttacccctacggtttaccacctaattacacaccaccagccatacgtgacgacgcgggtcacgttcctcccctcatcctcgaaggggagcctcctcgacatcctgacgaggtccacgaggatcatcgagagcatgctcagggagacgtcgactcctactccccgtttcctaccgaggggccagtgcccaacgcactacctcaacccaatatcacgggagaacctcgaagccacccaactcagccaatgtttctgtctgtgggagggccacccccggcagcagaaggaaaggggaaactcgatctcatcgaagaaagattgagggctattgaagggttcagcgattatccgttcacagacatgactgacctatgcctggtgctggatgtcgcatccctccaaagttcaagggacgagaagttattgatgcatttctttcaagatagcttggctggggcagcattcatcaggtacactaatctagaagcttcccgcatccacacctggaaggatctgattactgccttccttaggcagtattag

SEQ ID NO: 83861 - DNA, 111 bp, Glycine max
  Peptide Sequence Number=SeqID_175546
gaagaggtaggacctgcagatgctcaaggagctacccaaggagacgaagatggagctaagaatgatggagacatggcatatctgcttgattacttcattagaggaggctga

SEQ ID NO: 83862 - DNA, 741 bp, Glycine max
  Peptide Sequence Number=SeqID_175547
atgaaagataccgcgcgcgtactgggacgcatgtatgacggcattcagtatcgcggctacggccaggcgctggtggaaacgctagccgaatatgccggtgtgccggtgtggaacggcctgaccaccgagttccatccgacgcagctgctggctgacctgctgactatgcaggagcatctgccgggcaaagcgctgaacgagatgacgctggtgtacgtcggcgatgcgcgcaacaacatgggcaacagcatgctggaagcggcggcgctggtggggctggacctgcggctggtggcgccgaaaggctgctggccagaagaggagctggtagcgcagtgccgcgcggcagcacagcacaccggcggcaaaatcaccctgacagaagagattgccgaaggcgtgcagggtgctgatttcatctataccgacgtctgggtatcaatgggcgaagcgaaatcagtgtgggaagagcgcatcgccctgctgcgtccctatcaggtgaacagcgcgatgctggcgctgaccggcaatccgcaggtgaaattcctgcactgcctgcccgcgtttcatgatgaccaaaccacgctcggacggcagatggccgaacagtatggtctgcacgacggcatggaagtcagcaacgaggtgtttgaatccgaccatagcgtggtgtttgaccaggcggaaaaccgcatgcacaccatcaaagcggtgatggtggcgacgctgagccagcgctaa

SEQ ID NO: 83863 - DNA, 303 bp, Glycine max
  Peptide Sequence Number=SeqID_175548
atgatccgccccacttatcaaggtaatccttgtggcgtctaccctgacttatcttccttcactagaagtggcatctaccctgacttatcttccttcactggaagtggcgtctacccggacttatcttccttcactagaagtggcgtctactcggacttatcttccttcaccggaagtggcgtctaccctgacttatcttccttcaccggaagtggcgtcatccaaacctccgtagcctgtatcaagcgatccgctcctactcaggttaacatcaaaagtggattttctggaattgtggtttaa

SEQ ID NO: 83864 - DNA, 231 bp, Glycine max
  Peptide Sequence Number=SeqID_175549
atggcatctgtcaaagcagatgggttagatgatgaagggatgtcctcagttctcactctctttcttgatgccatctgcaagaaaagaattgattcagcctcgcttagccacaaggatttcaacaggaggatgagtattcatcctcacaagatgaactcgcttagcgtggtaggtgcgcttagcgagttcatctggaaacacatgttagacaagtggcctcagatatcttaa

SEQ ID NO: 83865 - DNA, 231 bp, Glycine max
  Peptide Sequence Number=SeqID_175550
atgataaatgatggaacatacggatttggggatcccacggtcctgtggctccgcatgccaccggactcttgggacacgcatttcgtttctaaacgaccatttagaggaaacactgggtccaacaaagataggagagaatcactcaaagtgtatcaatctcacacaggattgacattctcaccctgggtcaaggtttatgataagttgggattttggctcaaggctttgtag

SEQ ID NO: 83866 - DNA, 482 bp, Glycine max
  Peptide Sequence Number=SeqID_175551
atggcattgaagaaaaagcacaggcgagttatggctaacctgactttgttaggcaaaatgtctcgtataggcacgactaacaattattgcatcaacactgctaaagttgatgtctcgctaagcgagctcaatgtgcttagtgagtgtcatccgctaagtgaggtatcaacgcgcttagcggataggaagaatctggaagggaatatgtcatgcaggcatgcgctgagcgtgtcattggctcgctcagcaagtcgtttgtcaccttttaggcttagtgtgagtttggcactgagcaaaagttcacttactcgcgctaagcgcgagaatggcgctaagcgcgagatcgaggagcttccttgctctggaaggctgaaccctcagttggggattcttgctgagggctttaacattgaaagatgtattgtctccttagaacttgatagagcaggattaggttaccgtatgtctggacacggagtgtg

SEQ ID NO: 83867 - DNA, 165 bp, Glycine max
  Peptide Sequence Number=SeqID_175552
atggagaaggagaaagatgaatggagacactatttgcttccgacaagtgcaccgaatcgcacaagtagtataaaacgcctaatcctgatcaagcatcatccgcagattcctcttgttggactaaactcgactaggaccgcattaagacaaacatacaacaactag

SEQ ID NO: 83868 - DNA, 198 bp, Glycine max
  Peptide Sequence Number=SeqID_175553
atgacttgttggtcacggacctggttatggcggtgcgtctgttgcccgctgccggccatccccaggccgctgtggtgtttcgccctacgcctgcctggggacgcagtacttcttgatgaaagctcgattagtagggggcctgatgcccttgctggaggtggcaggcactccgtagaactgacagagacccgtaattag

SEQ ID NO: 83869 - DNA, 506 bp, Glycine max
  Peptide Sequence Number=SeqID_175554
acgctttacgcccaatcattccggataacgcttgcatcctctgtcttaccgcggctgctggcacagagttagccgatgcttattccccggataccgtcattgcttcttctccgggaaaagaagttcatgaccctcccagtgtggctgatcatcctctcggaccagctactgatcatcgccttggtaagctattgcctcaccaactagctaatcagacgcgagcccctcctcgggcggattcctccttttgctcctcagcctacggggtattagcagccgtttccagctgttgttcccctcccaagggtaggatcgaactctccatgagattcctagttgcattacttatagcttccttgttcgtagacaaagctgattcggaattctcttccattccaaggcataacttgtatccaggcgcttcatattcgactggagttcgctcccagaaatatagcccccccacccctcgtgctcgaactgataacttccaccacgtcaagtga

SEQ ID NO: 83870 - DNA, 171 bp, Glycine max
  Peptide Sequence Number=SeqID_175555
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttggataacttagctccatgggatctggagatttaa

SEQ ID NO: 83871 - DNA, 838 bp, Glycine max
  Peptide Sequence Number=SeqID_175556
ggtttgtgttgagacaatttacggtggtgacgccagtgtcccgtttccaacttcagagattcagtacgtcagggacgcgagtagcacattcattgcatggcccatacatctagtgaagcctataactgatgattcaaatcataatgcgtgtttgccacttggacgtcttggtgaggctgaggttgcagctgaagctgatccgttgggcgaattgatgaagacattattttacgtgtacaagagtccagtggaagtgccatgggaggcaacgcaatttggacttcctgatgttggggcaaaatttttcatcacacatgttgatctagcggaaataatatcagctgacaagtgtttgaacatatctatcctgcagctgtggaccatcaaagttgatcagtcactgtatggtctgttggagcctcaatctatacacaatgctaaggacagacgtgaacaatgccaacaatacattcaaacatgggtcaaggaatcacaaaggcagttgtacttaggagtttacttgcatcagaagaagccagatattaacatcaaagccacaattaacaggttctattcaaatatacaaatgatggtttgtggaggcatgtctaatcaacctgcacctcgatgggttgaaccaaagagtcatgtccaaactggagcatacgagtgcggatattatgtgatgcattggatatggtgcatagtgactggtggattgaaggatgactggaacaagtggttttctgatggatcaccgttagacgtggaggccatcaccacacttcgccagaaatgggcaacattctttttaagtattaggaaaagcggatgctaa

SEQ ID NO: 83872 - DNA, 447 bp, Glycine max
  Peptide Sequence Number=SeqID_175557
atgggtgccaagcacctcacgaggaccaaagaatggtcgcacgtcatcgaaagatcttttgcaggtgatttgattcccattgatttggagattaatgccacttgtagaaggcgtaatcaagagagaattagaaattttttgcaggccttagaggtagcagcaattccagaggaagaacctcaatcttctgaggaatcttctagttttcctattgcagaacattctcatttagatcctagtgaagactacatcattgctgaagagccaagaagaattactctggaagattattcaagttctaatgtgccacaatttttcaccagcattgcacaaccagaagttcaagcacaaaccattacttatccaccaccattgattcaattgattcagaataatttgtttcatggattacccaatgaagacccatatgcacacttagtgatgtaa

SEQ ID NO: 83873 - DNA, 104 bp, Glycine max
  Peptide Sequence Number=SeqID_175558
ggacagatgcaagcggggatggggtcacgatcgaccgatcattgccccttcttggcgctaaacaagcagagaacgtcgctgcaaggcagcccagtatcctttaa

SEQ ID NO: 83874 - DNA, 534 bp, Glycine max
  Peptide Sequence Number=SeqID_175559
atggtggagagggaaatgatcacaatgatagtagacactttacctgtgttctactacgagaagatggtgtggtacatgtcctcaagtttcgcagatctggtatttgcgggtgaaaggatcaaactaggcctaagaaagggtaaattcgattatgctgcttcaacaagtgctggcaataggaggattggaacaggtggagcaaagaaaaaggagggagatgcccatgccgtacaaaggttgaatgatactggatggcttacatttcaagaggatagtccaaatgtatggactaacccacttgccaatcatggaagctcggtggtgaacgcaatggaagaatggaagcagttcacattagaggcattgcgcgaggctggtgtaattgaccttgatggtaacaaaggagatccatccttgatgcatccaggggggtcgcacgatgtggaaacgtgcctaatagctgaggagttgctgctgggactgataagcaggggtcaaattgaaatttgcagtgcaaagaaggaggaaggagag

SEQ ID NO: 83875 - DNA, 300 bp, Glycine max
  Peptide Sequence Number=SeqID_175560
atggaatgtcaaggagaccctgaatctgaagcatccaaacagtgggattcaaggttgtcagagggaacaacggttattgtgttcaatgaaccttcgatttatatttaccattttccaaactttgtaagatcagtggagccatgccattggcagcatgaccacagaagcattagctcttctaccatgttttttggattggcacgttctcccaagaaatgtttattccccatcggttgctgcatacgccgggctttactccgtcactattttgatacaccctggtggcatcatccccattga

SEQ ID NO: 83876 - DNA, 381 bp, Glycine max
  Peptide Sequence Number=SeqID_175561
atggctccgaaaaagctttccgcgaagagatctaggagggacgccgcggctgaagggaccagtgccgcccccgagtttgatagtcaccatttctggagcgccgtgcaccagcagtgcttcgaggccatcaaaggatggtcgttccaccgagtgagacgcgtccagctcagggacgatgagtacaccgattttcaggaggagatagctcgcagacattggacatcgctggctactcccatggctaagtttaaccctgaggtagtcctggagttttacgctaattcttggcccacagaggagggagtgcgggacatgcgttcatgggtgaggggcagttttattacttgggcccattcagctaattggatgtttttaatctaa

SEQ ID NO: 83877 - DNA, 279 bp, Glycine max
  Peptide Sequence Number=SeqID_175562
atggccactgccgaagctttggagcgagaaactaagagagcccgaaaagaagagtggggctggaacaagtcaaagaggagcttgaccgaacagctgagtaggacagaagagaatatgtggacaatcattgatcactataaagtgaagctaaacctagcagctggccttgagcaaaagctaaaggacgagcatgcaaaagtatcggctctgcaagtggaaagggaagcaagaaagagagtgataatcattgcacagagaagctatgaaaaggatggatag

SEQ ID NO: 83878 - DNA, 237 bp, Glycine max
  Peptide Sequence Number=SeqID_175563
atgaagagcagtaccttgttcgctctctttctacttagtgccatcttcacctcttacctaccttcagccaccgctggtgatttggtcgacactgatgggctgatggcaaccctcttgaaaatggaggaacatactaattatgttgtggttcatttcgaccaattccggaacaggcgcttggtagtgattgaggttcaggagctgcaatgggttgtggattatgtttcggaaacttga

SEQ ID NO: 83879 - DNA, 108 bp, Glycine max
  Peptide Sequence Number=SeqID_175564
atgacgggagcagtgtgttgctgcggtgtggaacaggactacgccaactttcactcaaaacccgaacctaaaaagattatggagaagtacgaggtggatcctggttag

SEQ ID NO: 83880 - DNA, 390 bp, Glycine max
  Peptide Sequence Number=SeqID_175565
atggatatgctcagctgttcagtcattagagggattttacaccagtgccgggtgcattgtttgttcaacggagtggaagatgcaattagagaaaatgccactagatctgatatagctcagctaattgcccatttgaataaacattcccaaggaagtgtggtgaaagagagaacatggacaaaggaagtagcagttatgcttaagaacagaacaatgctatgcagacataattcacataaaaccaaaatgatcagcccacttgagaaacttctcattttgtatatcagcatcacatttcaggcagagatacatgcttcatttgaaacacctaatcctcttagtcctaggatccatgctgccactttcaaaatatgcaatgcaaaacattaa

SEQ ID NO: 83881 - DNA, 2121 bp, Glycine max
  Peptide Sequence Number=SeqID_175566
atggagcagaaaaattggaaccttctcgatgaagctttagggcttaacaacaacaatgcgaagccatggcctctgtgtggtcgcttcgtgcttgtggaagattgtgttgacacaagcgccgctttcgttcttcaccaaatcctcaaacgctccttctcttctcacccttcttccgccgtcgtcttcctcgctttctctcaccctttttcccactatgatcgcgtcctcagaaagcttggttgcaacttagctgctcaaagagataatggaagattgtttttccttgacatgcttatgttgcagtgtccaggaaaagccaatcatgatgggcttgcttctgtatttgagcaaattgaaagagtgatcactgcattacatcaagacaagaaattcatctctatcatgatagatgatatatcctttcttgaagttgctgctaatggctcttccaatgatgttttaaacttggtgcattattgccatacgttaacatctgattcagaatatggttgtgcatttattgcactcgaccataaggacatttatttgaacggagacaggactgctgttatgttagagatggagttccttgctgacattttggtcaaggctgaaccattggccactggtttggcaaaagatgtgcatgggcagaagaaatcagaggttcagatcggaaaagaaagcgtaggcgtctcttccgatttcaatccgcaattccaaaaacacccctaccaccgccaccagcaattctacccccaaatcgaaatcgatatatctccccaatccccaccgcagccaaccacacctcctcctcctcctcctcccccttcactctccaaacagaaacacatcttcaagccccagaacgccgccttcttctccgtatccgtcgccgcgaagagcgccgcgttccgcgcgctgcggcgcgtgaggcgccagcgcgcgttgctcctactcgcggtccccttcctctacctctacttcctcatctcgcgctccttcctcctcgacctcctctccgccatcgccttctccgccgcgctcgtgttttctcttaacctcgctttccctttgcctctccgttcggttcgcctcaaggcggcgaagaattccgcctcccgtcccgcgcccgctcttccggtgttctggacgatcgggtcgaggccgaagacggagaagcgcgccgcggcgtccgggtgctgggtgcaggtgtttggaaacggcgacgtttacgagggggagtttcatcgggggaagtgttcggggagcggggtgtattactatagcaggagtgggaggtacgagggggattgggtggacgggaagtacgatgggtatggggtggagacgtgggcgcgtgggagccgctaccgtgggtgttactggcaggggctgaggcacgggtttggggtctataggttttacaccggggatgtctatgctggagagtggtctaatgggcagagccatgggtctggggttcacacttgcgaggatgggagtcgctatgttggggagtttaagtggggggtcaagcatggccttggccattaccatttcagccttaaggatgatagcatagataggaatagaatgagtcagttttgctgcaacagtattgacagtcagttagggagtgagaaacagaaattacaggacaagatgcatggttttggcatatatcattttgcgaatggccatcgttatgaaggagcctggcatgaaggcagaaggcaaggacttggaatgtatacatttagaaatggtgaaacccaatctggtcactggcaaaatggagtccttgacattccaagcacacggaacaccacttctccagtttctcctgttggtgtctattattccaaagtactcaatgcagtgcaggaagcaagacgagctgccgagaaagcctatgatatggctaaggtagatgaaggggtgaacagagctgtagcagcttctaatagagcagccaatgcagctagagtagctgctgtaaaagctgtacaaaaacagaattatcataagaaagcagcttcactaggtggctacactagtttaagcagcttcatgccgactgcaacatttgcttttggcattatgctttctttgatttga

SEQ ID NO: 83882 - DNA, 3594 bp, Glycine max
  Peptide Sequence Number=SeqID_175567
atgtatgttgctgacaggacgcgtagcaagcggggaggggtggttggaagtggtttaataatgggtgagaagaagaaaagggtgcatgactaccatgaagagattgtcttggaagataatgaagaaggtgcaagtgtgaaagttgaacctgggcctggtgcttcttcatcgtcatcatcatctggtgctcgtgctttgaagcgggaaagggtatctgaacatggttttcagaatttgggagggcgtgcagatgaccctattaaaatcagtgacagtgaagatgatgatggtgaagaggggttgagtgattttgagaagaagaggtttctgggtgaagaggaaaaggaaaggaagagcgaggagggtaaaggttgtggcggtgagaagaagcatgctgtggctgagagtggttcaaatgatgagggatatgattctcttttgtctagtttatcggagagtgagaatgctgtgaccagtgatgaagattttcaggttgatgatgatgggaatgagagtcattactactcgagcagtgattcttcttcatatgatgatggtgagaggggtggatgcagaaagatggtgaaagagagggtgagaaaggtggagagtgaaactgaaagtagtgtagtttacaaaagaaaaggtgaaaggaaagatattgagcttgtagaggaggaagagccacggattggtgctgattgttctagtgcaacctctaataaatctgagatttataaggaggaaccagggcatggagcacagaagcataaagtaaagagggtggagagtgtcaatgccgatgcctttggtgatcactcggagagttcagatcactctatgcagtctgaagctgaagcattggaacatatgaaaaaaagagatagagaccatcaaaatgtgtcattggagaataaggcaggagattcagctgtggtcaagatgagtgagaaaaatgataatgttgatgccggcaaggtaggagaacataaatatgagtttaacagcaataaacgtgagaagccagagaaggtaagggtggtggatgacgaaactgacgacaaacatgagctgtatgaagtcctaaggatgccatctagaacaaaaaaccgatgcctcaagttttttactgaatgcttttggggcgagaatgattctgttaaagatgattcaaatcagttggaagaaaaggatgatgatattgatcagggtcagactcagccactagcttctagggagacagtccttgtgaattggaactttacgaagaaagaactcattgaaaaatcagagtttgagaaggagttagataacttgtggggtgaaatggatatgctccttcgagttgaagaaattgggtctcagattgataaagtaggggaaaatgaagaaaattcagcctcacagtgcaagcacgacactattttcaatgaggagattgggatatactgcagatggtgtggttggattcacactgaaatcaaatatatcacgccaccatttcaaagcacactgcttcctgtgagaaccatagagcttaaacaattttttgctacttatgtttgttctgactcgattgtcaagcttaatgaaataggttggtatgaagtactgatgtatgtgtccttgttggctttgtgcataacacaggtggataatgaaagatctggtcgagaggcgttatctggtggagggaaaacttcacaatttgatggggttctgtttaatgattctgttgatgactcggaggcagtttggtctcacaatgaaggcacggtttgggatcttattcctgacataaaagaaagcttgtttcctcatcaacaagaagggtttgagtttatttggacaagtttggcaggaaccattgaccttgctgagttgaagagggttgacatgcatactgagggagggtgcattatttcacatgctcctggaacaggaaagacaaagttgaccatggtgtttcttcagacatatttgcaactgtttccaaagtgtctacctattatcattgctcctgccaacatattgcttacttgggaagatgagttaaggaagtggaacctaggaattccctttcataacttgaacaatgctgaattatccggaaacgagcaagacattaatgaagttgacttgtctggcaatcaaaggcagaataaggatgccatccgaatggtgaagttgtgttcgtggtacaaggaaaagagcattctattaatcagctaccatttgtatgagaggctagccagggggttgtgcgaagatgatgggaaaaaagagaagaaaaataaaaagatgaaaaaagggaagaaacgtgcaaggactagggagtacattgaaactgcaatgggaaaggttttgcgtgactatcctggtttgctaattcttgatgaagggcacacaccacggaatcagcgtagctatatttggaaggttctctcagaaagtagatctcaaaagcgagtccttctttcagggactcctttccagaacaattttctggaactctacaatattttgtgcttaatgaagccatcctttcctgacagcataccgcaagaactcaagaagttttgccaaagtagactaaggaaggaaaggaaagcttcaaaatatgcgagttatgaacccatttattctggaaattcagctgatgagaaaataaagcagctgaaatcgctgatgaatccctttgttcatgttcacaaaggtagcattcttcagaagaaccttcccgggttgagagattgtgtgctggttttgaagccagacaggctgcagcaagaaactttggacatcattgattcttctcaaaacatactgaactttgaacataagttggcgttggtatcagtccatccatctctttttctaaactgctctctgtcaaaaaaagaagaatctgttcttgacaaggatcagttggaaaagcttagattgaacccttatgtaggggttaaaaccaattttttgttggagcttgtgagactatgtgatgcagttaacgaaaaagtccttgttttcagccaatttattgataccttatgcttaatcaaggaccaactcgagtcagcctttcattggtctgtggggactgaagtgttgtatatgtatggcaagctagaccaaaagcaaaaacagtccctcattcatagtttcaatgatacaaatagcaaagcaaaggtgttgcttgcatctataaaagcatcttctgaaggaattaacttaattggagcttcaagggtcgtgcttcttgatgttgtttggaatccctcggtggaaagacaagctatttgtcgagcatatagactcggacaaaaaaaagttgtttacacttatcatcttcttgcacaggacacccctgaatgcatcaaattttgtaaacaagcagaaaaggaccggttatctgaactggttttctccaataaaaatgctaaaagtgataagcttaacagttgtggagcagcgcttgaggatgcagttcttgatatcatggttcagcacgaaaaacttaaggatatgtttggtgaacttctggttcaaccaaaggagagagattttggagactttgggcccctgatgctttga

SEQ ID NO: 83883 - DNA, 201 bp, Glycine max
  Peptide Sequence Number=SeqID_175568
atggagaagtttgacaagaaaaatttcaaagacaacaaagcaaaaaaagcttacatcacttggaaagataaagatatagattcatcaggagattcagaaaatgaagtcgtgaatctgagtctcatggccaaaaactatgatagcgaagaagagatgaatttaatgacttgcataaagaatcagtcaaacttgccaaactag

SEQ ID NO: 83884 - DNA, 222 bp, Glycine max
  Peptide Sequence Number=SeqID_175569
atggagcacactgaaaatgagtacgcacagccctctaaaggtgagggtgtgcagccctctacaggcgaggatgtgcagtcctctggtggcgaggacatacagtcctctaaaggtgatagattgactgtccttttgaaaatggtgataattcatgcaaccctatcctatcttttgcaaatctctccaggaactccctcagagtgtatgttctgtttgatttag

SEQ ID NO: 83885 - DNA, 489 bp, Glycine max
  Peptide Sequence Number=SeqID_175570
atggcacctaccaggcaccctctggacccagataagtccaacagggccctgggatttcccgccttgatcacgggactctgccagtcgttcggcgtccccgtcacacctagcaaggtgattcggccgcccatcacccaagcttttatcgaaaagtactgcacgcagagacaggtccagggtgatgtaccacaggccgtggacgcgccgccacctcatcaggctggcccagccggattgtttgatacagagcagtatttgcggcatttgatgagtctcagcctgcagagtcagggctttacttcttttccgtgccctactccggaccagttcagggcagaggtcgcgtggcctggggattggcctgaggcccaggcaagagaggcaccagcaggggcaccagcagaggctcccgatgaggcagatgaggcccacgaggacgaagaaatgacagatttacttgatttcttagaagggagcggagccgcatga

SEQ ID NO: 83886 - DNA, 393 bp, Glycine max
  Peptide Sequence Number=SeqID_175571
atgacagaaaccgtttgtatggataaccacttgggtatttccgcacgtcacctgacttcacgggtcaggatgacaaaaaccgtttgtacagataaccgcttgggtatttccgtacgtcacctgacttcacgggtcaggatgacagaaagcgtggaagacgacacaaatcttcgtgtgtcaacaggatcaacagaaatcgtttgtgcggataaccacttgggtatctccgcatgtcatcggacttcacgggtcatgatagcaaaaggtggggcggtcgacaaaagcgaggcttttgctcctacgtatcctcaatttgtgatgaggaactcagacctatgtagttcttgcaaaaaatggtgtgagactaaaatagtccctaccggaagatgctga

SEQ ID NO: 83887 - DNA, 252 bp, Glycine max
  Peptide Sequence Number=SeqID_175572
atgttaaaacgggttgttcctttgagtcagaagcattctcttatcctgggttatggagaatcatccataacagtcaaccaaatgttcgtaatatacttgcgcagtaacagtaacgattggggggggaaaactgccaggaaaccacattacaagcgaaacctcaaagagagttgggcttcgtcctcaaaaggaaacaacaccagaaaatctagccttccatggattcaaatagaaaatgcaaatgaaacatga

SEQ ID NO: 83888 - DNA, 423 bp, Glycine max
  Peptide Sequence Number=SeqID_175573
atgaagcacttcactgacaccctcatcagtgccaacatacctaaaacatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 83889 - DNA, 718 bp, Glycine max
  Peptide Sequence Number=SeqID_175574
atttactacctctaatgtccaatcttgtcaatttgggatgatcgaccttctcgatgagtcgatctcttgctttctcataagggtggacccttgggtactagtacctatcgccttaagagggttgcatgccctcaccttcagagggctgcacgtcctcacctttagagggctccacatcctcgccttaagaggactgcacgccctcaccttcagagggctacatgcccttgccttcagaggactacaggtcctccccttcaaaggactacatgtcctcaccttcatagggctgcacgctctcacctttagaggactacacgtcctcgccttcagagggctacacgccctcgccttcagagggctacacgccctcgccatcagagggctacacgccctcaccttcagaggcctacacatcctcgccttcaaaggactacacgtcctcaccttcatagggctgcacgccctcacctttagaggactacacgtcctcgccttcagagggctacacgccctcaccttcagagggctacacgccctcaccttcagaggactacacgtcctcgccttcagagggctacacaccctcgcctttagaggactacacgtccttgccttcagagggttgcacgccctcgcctttgtagggctgcacgccctttccttcataggactccacatctgcgccttcagagaattcaaggtcctccgcccttaa

SEQ ID NO: 83890 - DNA, 252 bp, Glycine max
  Peptide Sequence Number=SeqID_175575
atgtatcagcaaccgatagcggcagcggcacctaataaggcagacattgatgtgcatcatcttcgacatgcagtggatgactttgtagcaattgctgataggttggacatgctattgaacctgaggatattgactgaaggaacaaaagtctataccgttgttgaagaatgtgtgggcatcgcaagatgctacattggccaaccaattgtaggtcacaaatcaaagcaaaggtggcgtacgaacgatcattga

SEQ ID NO: 83891 - DNA, 83 bp, Glycine max
  Peptide Sequence Number=SeqID_175576
ggatcgcgcccacaagataccctgtggacccgaagaagttcaacatggctgaccagcaggcaccctaccaccgggacaggtag

SEQ ID NO: 83892 - DNA, 483 bp, Glycine max
  Peptide Sequence Number=SeqID_175577
atggtcatgtcggtgcgcatgatccgcactcgtctctttgcagcggcacgggtgaaatcttgccccggtatgcatagtggctgtgtgacagcctccctctctggttgtgctcgcacagttggccctccaccaatatcagggggtggcctaggaaccattaaaaggaaactactggtgcggatgtggagcacactgaaaatgaggacacgtagccctctaaaggtgagggcgtgcagcgctctcaaggcgaggatgtgtagtcctctagaggtgagggcgtgcagccctctgttggtgaggacgtgtagtcctctaaaggtgagggcgtgtagcccttcgaaggtgaggacgtgtagtcctctaaaggtgagggcgtgtagcccaatgatggtgaggacgtgtagtcctctcaaggcgaggacgtgtagtcctctcaaggtgagggcgtgtagccctcggagccgaggacatgtagccctttaa

SEQ ID NO: 83893 - DNA, 588 bp, Glycine max
  Peptide Sequence Number=SeqID_175578
atgggggatttcatcagcagactctccttccccgcatgtttgcattttagcgaagaaaacaccgagactttttcaagtctcacaagttatctggaactacgtaggtctgagttcctcattggaggatacgtaggagcaagagcctcgcttttgtcgaccacaccgccttttgttgccatgacccaagagctggtagcccgcggagacaccttacggttatccgcacctcgtcattcagtgaccccaagtgtgattgacgagcagaggccaatgtggtcatctacgccctttccggagatgtcagcattttccgatggagacttttcaagtctcacaagttatccagaactacgtacgtctgagttcctcattggaggatacgtaggagcaagagcctcgcttttgtcgaccacaccgcaccacgtttgttaccatgatccaagaggcggcgggcccgatgatacgtggagataccttacggttatccgcaccctttggtcatccagaggcggcgggcccgatgacaagcagagacaaaatttggtcattctgcacccttgtatcatccagaggcggcgggcccgatga

SEQ ID NO: 83894 - DNA, 555 bp, Glycine max
  Peptide Sequence Number=SeqID_175579
atggggacaaatcaaaacggaaaaagattctatcaagtcaagattaagggcctagatgtcaccaaccttaacgagttgggacggttgatgggacccctccaaaggcaagccttccacaaagtgtatggaaagattttagatttgaccacaatggaggtatttacagaagccattgtatccctcgcccaatactatgaccagccgttgagatgcttcacgtttggggacttccaaatagtaccgactgttgaagaatttgaggagatattaggatgccctcttgggggaagaaaaccgtatcttttctctgggtttcttccctccttgagcaagattgcagctgtggtcggagatttggcgagagagttggatcgtatgatgcaaactcgaaacggcgtagtgagcctaccgcataaatacttggaaggcaaggtgatgcaatcctaccccgcaagggcattggatagaagactccaagtagattgggctagagatccaagggaaggccttagggttctcatgagccttagggtagatttcgagcccatgggctaa

SEQ ID NO: 83895 - DNA, 485 bp, Glycine max
  Peptide Sequence Number=SeqID_175580
gggcaactgtcataccctaatttcgtccagggagcattgtttatcggtatgcgacctttgtttgaccacctcaaaatgtttaacacccatcgcggtggaatccgtaaagttctgagatgtttcggggagaaaccggccaaaaacacaaaaatggaagtgcttaacactcatcacggtggaatccgtaaagttccgggacgtttcagaaagaaaacagccaaaaacacaaaagtcggggagaacttatcaaatatggggggtgcgctcaggaatcttcatccagaacattctaagggggggagggggactgtttcaaaaatgttcatgacccctaggctatgcatttcaactgttttgggtgaaaaaacgtgtttccgtaaagaaaatccaagccgaggtgctgccgtaatgcttccgagaggtttccatgagaaaatctgtgaagattttctgccgttcttcgttcgttcttcgatcttcaaccg

SEQ ID NO: 83896 - DNA, 301 bp, Glycine max
  Peptide Sequence Number=SeqID_175581
atgctggaaagttttaaacaacaacaagaaatgtcagttctagaattgtacatagaaaaggatgtggctggtggttcaatgtttcattctgcaaattcggttacatcatgtgaaaattatttatctaatgatgacacacaaccgccaacaaatatgagcaatttacatcttgacgaagatgatgatgatgattattattatcttgtatctaactcatacgttgaagagtctttagacgaagatgaccgtgttgacggtatatctgatacagaccatgaactccccgaaatgattccaccca

SEQ ID NO: 83897 - DNA, 670 bp, Glycine max
  Peptide Sequence Number=SeqID_175582
ggatcctcctctaccaccaccattacaggccatcgccgccatagaacctctggtgacccatcatcaccaattcctccttctctttcatccccccgctcatccactttgttttccttcaatgatcaacgtcagaggtactactctcaattttgcaatcgcactattcttgaccctaagtacctagaccttgaattctttgatgtcttctataacaatttgaaaattcaggatggtgttctttattctgaggtgcataaaattcctaccattgttgatcagtccttgttttattcattgacaaaactgcctagtcaaggtgttccttttgaaggcactcttgttgatgactggaaacttgattattcaagtcatgatgctctcaaaatggtctacagtgaccatgctaacatgaccaacagatttcttcatttcaatgtccccttggatgatgaaccttttgtcaaagttaaaagttccttttctattggtgtcggtgctcttacatcttttggttaccgaaaagacatggatggtcagtgggtccgtaagcatgacctgccccctcctattcccgacgagcgtacaccatctccaccaccacaacgggatgcctcttcttctctgctaactgaagtcctcaccgagctccgcgatcttcgagtgattgttg

SEQ ID NO: 83898 - DNA, 111 bp, Glycine max
  Peptide Sequence Number=SeqID_175583
atgaacgcgctaagcgcgttcatccctactgatgaatcactaagcctgacctgtcaggctaagcgccactttgcttctgctaagtgccagtctgctgcgcttagcgcctga

SEQ ID NO: 83899 - DNA, 216 bp, Glycine max
  Peptide Sequence Number=SeqID_175584
atggatggtttcattgaaccgatgaaagaacataatttggaaatgttgggtttgtttgtgaaaacccattttttggtggttcttcctttgggattgccattcaaagtcattctcgactggcgatatcctgtcccacttaaacaaagaggaaaagaccgaaacacccagtttcctctccaaaaacactaccctcgagaaaatccaattgatccgtga

SEQ ID NO: 83900 - DNA, 471 bp, Glycine max
  Peptide Sequence Number=SeqID_175585
atggagatgcatgtgtggttaggatcattcaatagtggaaactggcaaatccaacaagggcttaacatctttcagaggactactaagctagaggagactttgactcagtttatgcaggtgggacaactggccaagcagatagctgacaagtcatccaacagttttgtggcgagtacaaaaaacaatcctaaggaggaatgcaaagctgtgatgacaaggagtaagaggtttgtggaggcggaggatgaggatagtgtagtgtccaagaagaaagcgactgaaaagaaaggtattgatgaaaagaaagatgatatgataggtgaaaaaaaagaaaaagaaggagaaaaagaaaaagaaaatgaaaaaattgaaaaagatgaaaaaaataagaatgaagaaaggagtagaagtgaacaggctagagagaagaaaagagaaaaagttgtgaatgaaggtgcggggatcctctag

SEQ ID NO: 83901 - DNA, 425 bp, Glycine max
  Peptide Sequence Number=SeqID_175586
cggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccctgtgactcatagcgactcagtggttgttgtgatgaggaggaagaaccattttgaatttgagtag

SEQ ID NO: 83902 - DNA, 582 bp, Glycine max
  Peptide Sequence Number=SeqID_175587
atggcgaaggcgcggataaccatgaggtatctccgcatgctatcagaccctcgagtcacgatagcagatttgtgtgtatggataaccataaggccggaagacgttgacatctccaggaagggtgcagaagaccacattggtgcagataaccataaggtatcttcatatactaccagaccctcgagtcacgatatcaaaggtgagactttttcgcagtctcggccggaagacgctgacatttttgggaaggataaccataaggtatctccacatgctaccggaccctcgagtcacgatagcaaaggtgagactttttcgtggtctcggccagaagacgctgacatttttgggaagggtgcagatgaccacattgatacactcaaatgcgggcgagaaagttatcagcgcacaggattttggttggtgatcaaagggagaggaccacttcaggtcgtgggcgaggatggacattctcaccctgggtcaaggtttatggtgagttgggattttggctcaaggcttgtagaacggctggacatgatatatgtcagggcgttggtttggccagcggttcagggataa

SEQ ID NO: 83903 - DNA, 367 bp, Glycine max
  Peptide Sequence Number=SeqID_175588
atgactagaggcaatacgtctaacttacaaccctttgatcctgagatagataggacatttcatagattagctaggcatcattttgtaccttttgagcatccagagcattttgttattggtgagtctgagaattctgtggttggtaattttgaacatcctaattttgagcattatagttttgaacattctgattttgaacattctgagaacatggcacaacctccacctcgtgagaggactctaagggaaatggctacacctgatttcacctacgaaagcttgtgcatccaataccctgatgaggatgtcccatatgttcttaaaactggattgatccatttgcttccaaagtttcatggccttgcag

SEQ ID NO: 83904 - DNA, 357 bp, Glycine max
  Peptide Sequence Number=SeqID_175589
atgattatcgatgttgaagtttggaaggcagtagccaaactggacatgagtagagtccaaaagtttgaagaatctactaataggtacaacaagatgcaaacttttagagcctcaagattcattgactatcttaatgttgatgtatatgatgagatagtaaatttcaccaaagcgtctagcgagatcaccaaaaggcatctcaagaagcttgggatgaggtttgttgaacatgattggattatggctggagagccaccagcagtaggaaacaaggatcaaatggatgaagaagtagaagctgaagttccacaagagtttgcacatcaatggagcccttttgagtctcttataatttag

SEQ ID NO: 83905 - DNA, 657 bp, Glycine max
  Peptide Sequence Number=SeqID_175590
atggacatgaaaatcgaagccctaatctcaggtcagatttctaccattgcccaaagtaactcctctagactcggatttctagcctcgatcactgccttatgcagagctaaaggagttacttctgacagtctgacctatgagagcctgagctcggccattaacttggcctacattaagaaaaactgttggaatgtggatgatctgatagttaacttcagagaggccaggaaggtaagggctcgaccagcagatgttccttcttcttctgcaccaccaactcctcccacttctgccacgcctacaccacctggaaatataccttctgctggagcttttgatttttcaggtgcaggaataaagatgagacctgatgaggaggctgctactcctgagaggacaccacataccccagaagatccatcctcactaggggtggagctatcttttgctcaacaggtagtagatcctcctacaccagtacatgagagactagctgatccctctacacccatcatggagatgccaaaagaccctaccatgccagtcctgagactatcgtccactcctccagctacccaagttttacatttgatagatgaggaggatatgcaggaccaggacacacagggcacacaggaccagtcacaggaattctaa

SEQ ID NO: 83906 - DNA, 201 bp, Glycine max
  Peptide Sequence Number=SeqID_175591
atgcttgctcagcctagaggttcaagcggtgcgcttagccaattgattcccgctgagcgcatcattgacaactcatctgcttccagaatcttctacgcgcttagccatgaacttctgcgctcagcggatggctcgctaagccagagaactggcttagcaggcggatcaaaatcagcacttccaccaaacatgcctaattag

SEQ ID NO: 83907 - DNA, 159 bp, Glycine max
  Peptide Sequence Number=SeqID_175592
atgggtgccaagtacctcgaagtgatcaaacgagggtcgcatcccaacaacggatggtccccggaagaaattaggccgtcaaacagaatggtgattggagatgtcacttcaaggagaagatgggtcaagaacaagttcaccaccataggaagccattga

SEQ ID NO: 83908 - DNA, 1155 bp, Glycine max
  Peptide Sequence Number=SeqID_175593
atggcatctaagaaaaggaaggctccttctacacttcccaagtcagatatgaccggtctaggttcacctctcaagaagcttgggagagaggaattaatgagaagacattgggacaaagagctcacaagctttgatgaaggcagcatcaatgttgccgttgtgaaagaattctacgcaaacttgtatgaaccagaagatatatcacccaagcaggtgtgggtcaggggtcatctggttaaatttgatgaagataatttaaataattttttgaagatcccagtgattgtagaagatggggagaatttatgtgcttattcgagatttgcactcctgaggcctgatcctcaggagttagctgctaagctctgtatcccagggaggggatttgagctgaatactgatggtctccccttgaagatcttaaggaagaaaatgactactctcactcagacatgtagcattctttcttattgtaacttggtcccgaccttccacacttctgacatcacattagaaagggccaacttaatctatggcatcatcatgaagatggatatgaatatgggggccaaggaaggccagggtaggagatcagaggcccctactacttcagcagcaccagacacaagtgcaccttcttcatccacagctcaagcacctcctagttcaactccatcacataccccagctatttctgctccatttccatttcagcttccaactcttacatcttctggaccatcagaggggcaggccattataatgcagagccttcagagcttgggcctgccatccatcatgagcatggatgagtttgacacacagccttctccttctagagggggtggggcctccgcagcccaggggcttgagccagaggagcccgtagtagcaattgaggagccagcagagggggaggatgagctcactcctcctgagcccttttattatgatacagatgtacacatggcccaggaggaggaagcttctacagatcagatgccagagccatcccctgcaccaggtcctgaggagaccttgccatcagtaccaacaataccagcattggagcctgagcccaccattcaggattcatcagcagctctagtattggatctgaatgaagatcaaccacaggaggatcaggacatttaa

SEQ ID NO: 83909 - DNA, 471 bp, Glycine max
  Peptide Sequence Number=SeqID_175594
atggcatcctcctcatcggtcaaatttagcacaggcgtgcctactggtgatccctgcggggtgttcagctccagcactggtgtagatactggtgatgcctatggaatagcctccgatatgaagggctctggggagtggcctctgaatcctttgaatcatcctccgagtcgggctaaggctcctgggctgcggaggcctcacctcctccaaaaggataaggctagactcctggccaggccactttcctggggagcaaatgaagatggaccctcagatcttctagctctggccttgcgggtccctaggaagttgattgtggggtcgtccaggttccagcagttcttctttatgtatgccaaattaatggtttggctgagggactcaaaagtcagagaacctgaggtgactcatcgggccatgcataaagcagtgatgaaggctggaaattcgagcctcgaggagttggactga

SEQ ID NO: 83910 - DNA, 579 bp, Glycine max
  Peptide Sequence Number=SeqID_175595
atgttgattgatgttggaaatgcattggcatgtacatgttgtgtatgttcgtggggggcactatgcactgaccttccagggtctttggcactagcttttggccacgatcatacgtcgtatggagtgtatgtcatgggggggggcttgtcacctggtagggaacacctttgggctctcaggatgatcacctatgggaggggggttgttacgtgcacaaccgtgtggtctcgacaaactcaacatagttccctaagtttgatacctgtgatgatcacgaatcttgtttgtgggagcagaatgatagaggcagggtgtagggacgacgaggcgggtcgttacagctcttaccttgccttggcggctcttgctgcttgtggtgatgtgcttcaaaatgataaaggtgattttctaaaagtgttttctaggagacttgggcattctaccattctagaggctaaactttggaccattctatttggtatgaatatggcctgtgatttgggttataaagcaattattgttgagactgattatgtatcaagcttgtggaggatctcagatatcatgaaggttaattag

SEQ ID NO: 83911 - DNA, 204 bp, Glycine max
  Peptide Sequence Number=SeqID_175596
atgaatcattatatggatgaattgcaacaatacattttgaggattgttgatgtcgcaccggatggaaattgtgcttacaaggaaattgtagttttgctaggccaagtacttgctacgaagtggatgactattcccaacatgggttatgtgattgctagtcggtataatactgtattgttccacttatctaggatgcaaaattga

SEQ ID NO: 83912 - DNA, 231 bp, Glycine max
  Peptide Sequence Number=SeqID_175597
atgtcgcgggggtcaggagaccttggggatgccagtgtagctttcagtttccaatgtgcaaaggctgttgtaattcgtttttgggcactgatcgcgatggcagcgcagttgatccatgatcatgttgtgatggagttcctagagggtgtttgggagaccctcgaaggcaatgagaggtgccgatttcgtggcacaattcgactcactgctacttcgctagtacatccgtag

SEQ ID NO: 83913 - DNA, 423 bp, Glycine max
  Peptide Sequence Number=SeqID_175598
atgacgatgggtgtgaagcctttcgaagcgatcaacaacagtccccagatgaaattagggtgtaacagtctatttacacacccctactttgctaactacacttccattttcgtgtttttggccgatttctctccgaaacatctcggaactttacgaatttcacggcgatgggtgttaaacattttgaagtggtcaaacgaaggtcgcatgctgacaaacaacggtgcccggacgaaattagaattaatggcagtggaatggagatggaagaatgatgattggagacgctacttcaaggagaagatgaatcaagaagaagctcaccaccataggaagccatggataagcttgaaggtaggagaagatgagaggagggagaaggagagaaggaacacgaagttttgtgcctcaaaagaggtctaa

SEQ ID NO: 83914 - DNA, 972 bp, Glycine max
  Peptide Sequence Number=SeqID_175599
atggatgtcatggtatatgagaaagatttgaaatgtttagagaacctagtccatgtgggatatgattctccatgtgacgtgataagtgaaaccatggagggcatgaatgaattgaactatgcctctgcccttggggggtattcaatttggaatctctgtgtggctcatgttgattgcatgggtcagagtatccttgcaagatcgggtaaccctgaagcaaatcttaagctatgccacggtaatactcttagagtgttacacgatgaaagatacattgaccttttggagatcaaagaatgtggtttggacattcttttttttggaaagaagcaaaactggacgggcttctttgaagtttacgaaccaatctatcctagattggttgttgatgacaactcaaggctttatgaagactggctgaaggcaaagagactcagaaagaaaaaagtccagaggaagtttctagagaataagaaagatgatttcaagtccaagtctatgaaatcctttggacggattgtccattggatttgcatgcactttgtgctgcctagagttggaacctttcaacgaccttttggagtctccctagatggtgaactcgttgataatgatgttttatcttgggatgccaagaatgttgttgctttgaagttgtctccacaacctgctgagagaagtccactaaccaaggacaaggtggaagaagagaagacaccttatgagcagcaacccatttcgttacccgttcctgaaggtgtgaaggctgaagatgttcaaaaccatgtggttcctgatccttctcaagctgacctcaatgttgaggacattgcagatgtcttggccaaactgaggattgtcgactctagtttggaacaaggaagttcaaagaaagaagaagaaaagaaggaagaaccatatgagataggaggagaagatgaacccactcctagtctcgctcagaatgcctaa

SEQ ID NO: 83915 - DNA, 150 bp, Glycine max
  Peptide Sequence Number=SeqID_175600
atggaggctgaatctttgagcttcaataagaataagccatggaaggagaggcttcaccgccaagagagtgccttggataagaagcttagagaggaagcttcaatggaggaagaagatgagagagagagagagagtggtgtggaagattga

SEQ ID NO: 83916 - DNA, 213 bp, Glycine max
  Peptide Sequence Number=SeqID_175601
atggtgggtcagctggttctggatcaaactgcaaaggtgtgggctcaggtggagcagcctcgttgggtctcaccaatggaactttgcagcaaaaggactaaagtttgtgagccttggacctcctgtcctacaattactgacgaaggagctggagtggatgatgaagggatgtcctccgttctagctctttttctcaattccatctgtaactaa

SEQ ID NO: 83917 - DNA, 474 bp, Glycine max
  Peptide Sequence Number=SeqID_175602
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagcttcactcaaaggcggtaatacggttatccacagaatcaggggataacgcaggacaacaacat

SEQ ID NO: 83918 - DNA, 252 bp, Glycine max
  Peptide Sequence Number=SeqID_175603
atgctagaaattgaaaatagatgtgtcgcaacctacccttcggcgggagggcgacgcgtgactcgcgggatgcttgttccacgaaaggaatacgcgcggagtcgccaccaacgtttagttgaggaaaacgtcggaaaaaccggaaaagacgcgatctacgaacttttaagtgaaaaggttcgggagttgtatttacgcacggggaaggcattagcaacccacacgtccgtcccaagggacggcagcctttaa

SEQ ID NO: 83919 - DNA, 411 bp, Glycine max
  Peptide Sequence Number=SeqID_175604
atgacggtgaaacctcggacacatgcagctcccggagacggtcacagcttgtctatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggtggcatccttagaggtagaggtcgccaagtggagggttgctgctcggactctatggcaagtggaccgccctaaggtggccaatgccaccgttgcttttactaacattgtaagggcaaaccgccaactatctcctaaggttggtggtgcactggacaaattgttgcacacccagtcagatggtgatgacttgtttagatgttgctag

SEQ ID NO: 83920 - DNA, 2223 bp, Glycine max
  Peptide Sequence Number=SeqID_175605
atgactaacggctacatttcatttccccaattcgatccggtgatcttctccatcggaccggtttcgctgcactggtacggcctgatgtatctggtaggctttgtgtttgctatgtggctggcggtgcgccgcgccaacaaacccggtagcggctggaaaaaagaagaagttgaaaacctgctgtacgcgggcttcctcggcgtgttcctcggcggccgcatcggctacgtgctgttctataacctgccgctgttcctcgacaacccactctatctgttcaaagtgtgggacgggggcatgtcattccacggtggcctgattggggtgatcgtggtgatgctgatcttcgcccgccgtaccaaacgcaccttcttccaggtctctgatttcattgcgccgctgatcccgtttggcctcggtgctggccgtctcggcaacttcatcaacggcgaactgtggggccgcgtggcacctgacttcaaattcgccatgctgttcccgggttcgcgcagcgaagacctcgcgctggcggccaataacccgcagtatcaggaactgctgaacacgtacggcgtgctgccgcgccatccgtcacagctgtatgagctgtgtctggaaggcatcgtgctgtttatcatcctcaacctgtttattcgcaagccgcgcccgatgggcagcgtctccggcctgttcctgattggctacggcgcattccgcattatcgtggagtttttccgccagccggatgcccagcttggcctgttcgaaggcggtatcagtatgggccagattctgtcgatcccgatgattctggccggagtgattatgatggtctgggcgtatcgtcgtcgcccgcagcaacaaacgcgtgaggacggttttccgctggtcaccaccaagaaggtgcatctgcgctcaatcattcatgagctgctgtggttcctaaaaggcgacaccaacatcggctacctgaaagagaacaaggtcaccatctgggacgaatgggcggatgaaaacggcgatctgggaccggtctacggcaagcagtggcgcagctggggcaatgcttccggcgaagagatcgatcaaatcagcaaggtgattgagcagctgaaacgcgatccggattcgcgccgcattatcgtttcggcatggaatgtcggtgagctggatcagatggcgctggcgccgtgccacgcgtttttccagttctatgtggcgaatggcaagctgtcgtgccagctgtaccagcgttcgtgcgatatcttcctcggcctgccgttcaatatcgccagctatgcgctgctggtgcatatggtggcacagcagtgcgatcttgaggtgggcgatttcgtctggaccggcggcgatacgcacctgtacagtaaccatctcgaacaggcgcgactgcagctgacgcgtgaaacgcgaccgctgccgaaactggtgattaagcgtaagcccgcgtcgatttttgattaccagttcgatgattttgagatcgaaggctacgatccgcatccggcgatcaaagcgccggcgcagagtgccggttatgaacagaacccaaaacgccggctttacgctgccggaactgctgctggttatgcgtactgcagctgcagagctttttgctgcggctgcgcgcgcacgccagctggcataaccgcgacctcagcctgtggctgcagccgggcgaaaacggctgcctcggcaccgggccgcagcccgcagaagggtgtcagctgccgtcgcgctggctgttccggccaccttatagcgaagtgcgcatcactgcgctggtcggcgagccgggcttttacggccgacgcgatgtggcccggcccggcagtatcgaactggagagcgcagctggccgctggcgcgtcatcctctccgcccgggcgcgcatccgggtctgccagccaggagagaagggatgcgaatagtgcagggaggcttcagtctgctggagatgctgatcgccatggcgattggcgcggtgctgatggtcagcgtcggccgctttctgccgctgctgctggagcagaacctgcgcctgcagcagcgggtccagctgcaacaggagctgcagcaggttgccggctcgctggccaaagcgctgcgccgtgccggttactgtcacggtcagtgcagcggtgcggcgctcacgctggtgagcggcggcagctgtgtactgctgcgctgggacgaaaacagtaa

SEQ ID NO: 83921 - DNA, 525 bp, Glycine max
  Peptide Sequence Number=SeqID_175606
atggagaccgaggtctgctcggtttacctcgccgatcacgatcggcgttgctactacctgatggcgacgcgcggcctgaaaaagccgcgcggccgcacggttacgctggcgttcgacgaaggtatcgtcgggctggtgggccgcctggccgaaccgatcaacctcgccgatgcgcaaagtcatcccagcttcaaatacattccctccgtcaaagaagagcgctaccgctcgtttctgggtgtgccaatcatcagccggcgtcagctgctcggcgtgctggtggtgcaacagcgagagcatcgtcagttcgacgaaagcgaagagtcatttctggttacgctggccacgcagatggccgcgctgctgtcgcagtcgcagcttggccagctgttcggtcagttccgccagacacgcgtcaaagcgattgccgccgcgccgggcgtcgccgttgcacctggctgggttgatgaaacgcagccgctgctcgacaagtgtccgccgcctctacgctcgatccgcaggtga

SEQ ID NO: 83922 - DNA, 150 bp, Glycine max
  Peptide Sequence Number=SeqID_175607
atgaacgcgctcagtgcgcctgtgcgcttagcctgttcatcgcagctgtcaaaatttggatttccagatgaacacgctaagcgcgccttgtgcgctaagcctgagtgtctttctgtggaggctgagctaagcgccagcatgctgtgctaa

SEQ ID NO: 83923 - DNA, 492 bp, Glycine max
  Peptide Sequence Number=SeqID_175608
atggttaggaccagaggaataggtcgtgccttaggtcacgttactgacaaatgtgtgggcaaaggagatcgtgatgattccgatgatgctccgcagcgtcgatggcctaccgcatccacatggaggcagcgagtacctgtgactgcaacgcacgatgagccagtgctccctgcgccagatgtagaggctgacgtattttcgaatgacccgatggcaccagctgatgtagaggacactggggtagacattcctgcagacacaggcgcccaggatgctgaggatgagcatgagggatttccgggtggtccgagcgacccatccgtgctgacccagtatgcggatcacgttgcttgtagcgtatggacgggagaagagtgtcctgagttgaagttatcatctcatgggaggaaggtccatagtttaggaaggcctgtccctgccatcgagggactagttgctaggacaggactaagtcctcttatcgcgtgttcg

SEQ ID NO: 83924 - DNA, 477 bp, Glycine max
  Peptide Sequence Number=SeqID_175609
atgcggcagtttggatacacccagaccattcctgctctgcttgccgattcatgggtgtcgtttaatgatatacacgataggtggatgcactactcgaaccatatggttgtagcaggtgacaaatgcgttgtgccaaggcagtgtgccatcgactacatggactggttcttccgcattttgcatccattcatgacaccaggccagccatcagatcctcgggcagacggtcatgctacgcagcctagagttgccactcaggatccagacacagatatccgtgcggtcatggagccaacaacaccgtcgacaactgcaaggtccgatgtggccgagctgagacatgcaatggaagcttgccatgcgattgcgaagaggttggagagccatctcaacctagggttggtcacgctaggcacatcgacacatgagttgatcgaagaatccctcaggattgccaggagtgtcatagaagactga

SEQ ID NO: 83925 - DNA, 481 bp, Glycine max
  Peptide Sequence Number=SeqID_175610
atgccaggttaccatctggtcggttcatgtaatgggttgcactgtggggttagcgaaataccagaaggataccgtgtttgtttttggaacaaggcgacaagggtgatatccagagaatcgccaacgctgtctttttccccgggcattggtcgtagaacaatgtttgggtttggctatgatccgtcaagtgacaaatacaaggttgtagcaattgcattgactatgctttcacttgacgtatctcaaaagactgagatgaaagtttatagcgcgggtgacagtagttggagaaaccttaaaggttttcctgttctttggactttacctaaagttggtggagtgtatctgagtggaacccttaattgggttgttattaagggaaaagaaaccattcattctgaaatcgttcattcgccactaccaatcaattgcttgcttgaatcgctgtttggaggtttggagagcgagacacctattcacg

SEQ ID NO: 83926 - DNA, 210 bp, Glycine max
  Peptide Sequence Number=SeqID_175611
ctcagcatcagtcaacagagccagggttttgctccctttgcgtgccctactccagatcagttcagggctgaggttgcatggcccagagattggcctgaggcccaggcagggaaggcgcccgcagaggctcccggagatgcagaggaggcccgcatggatgaggagatgatagatttactcggttttttgggagggagtggagccacatga

SEQ ID NO: 83927 - DNA, 969 bp, Glycine max
  Peptide Sequence Number=SeqID_175612
atggtgacactggaagatgtcgcggcgctggcgggcgtttcgcgcgccaccgtatcgcgcgtggtgaacggcgacagcaacgtcaaggcgccgacccgcgagaaagttgaacgcgccgtcgcccagcttggttacacccccaacccggcggcccgcgcgctcgcctccagccacagcaatacccttgggctggtcaccacctcgtaccgcggcggctttttcggcgcgctgatggacttcgtgcagaccgaggccgaatcccacggcaagcagctgctggtgacccagggccgcaacagcgccgaaaacgaatggcagccggtacagaggctatttagcctgcgctgcgacggcgtgatcctgcacgtgcgttttctcagcgacgatcggctgcgccaattggcggcggagcaacgtgatttcgtgttgctcgatcgtctggtgccggggctggaagaccgctgcgtcaccttcgatcacccgctcgccagccgcatggcgacgcagcagctgctcgatgccgggcaccggcgcatcgcctgcatcagcggcccgcgtgaacgcccgtcgagcctcctgcggctgcagggatttgaagaggcgatgcaggcggcgaatatcgaaccggtggcctgcctggagggcgtttacgatctggaaagcggttaccgctgcgccgatcggctgctgcagcaagccgcgcggcccagcgccatctactgctgcaacgaagagatggcgatcggcgcgctgctggcgatcaacgaacaccgcctgcgggtgccgcaggatatctccttgatctgctacgacagcggcgaacgcgcgcctttcgtgcgcccggcgttgagcagcgtacattttcccatcagcgagatggcccaatacgcggcgcgcaggttgatcgaccccgccaccccggcgcaccggtttgagccgacgatcgtcaaccgtgattccgttgtgacg

SEQ ID NO: 83928 - DNA, 232 bp, Glycine max
  Peptide Sequence Number=SeqID_175613
atgagggaccccaagttcatatccatcttcatgacgagcctgtatatcaacttagccctattcagagtaatgtcagaagtgtgggatatcggggctaagtttgaaaaggatagaacacttcagacgagctgcaagctcttgaggaacagacctcagattagtaaacctggagtaggcgggcaagctctccccttcctctataccactggtgtcttcaagaagggtcatagag

SEQ ID NO: 83929 - DNA, 791 bp, Glycine max
  Peptide Sequence Number=SeqID_175614
atcgattcgctgttcctcgacgaaggcttcggcacgctggacgccgaaaccctcgataccgcgctggacgcgctggacagcctgaacgcctccggcaaaaccattggcgtgatcagccacgtcgaggcgatgaaagagcgtattccggtgcagatcaaggtgaaaaaggtcaacgggctcggcgtcagccggctggaggcgcacttcaggctggaatgatcacgccgtgcgcggcgcagaagtgtgaccgcggcggcactccgcggcataacaggattgttactgtatcccctccgccgctcaggccgcaggacagaaacataaaatacaggcaaaacctggcgcccgggatcgctcccgggcgtcaggaagagacggtggtaatgggaaaaggaatcggctttaaaaagaagcccggcgacacgctggacgaaagcctgatcgaaaaggtattcacccataacggcggcgaaatcgccgagcgctataaagagctgctctccgagatcccgctggcctgcgtcaccaccgccgaccggattattaccctcgcccgcgaacggctgccgggcaagttgcataacatcgtctacatcacgctgaccgaccacatccatttcgctctgcagcgccacgcggaaggattggatatcaaaaatgcgttgctgtgggagattaaaaagctctatcaggccgagttcgccgtcgggctggaggcgctggccttgatcgccgagcggctgaataccgcgctgccggaagacgaggccggatttatcgccctgcatctg

SEQ ID NO: 83930 - DNA, 405 bp, Glycine max
  Peptide Sequence Number=SeqID_175615
atgcggggttaccttatggttacccgtacctttcgtcgaccaagggcaaatgagcccgttcatgcgcagagaccaacatcgtcttctgcaccttctgtcgtcctgacccgtgaagcaggtgacatgcgaggttaccttatggtcacccgcacctttcgtcaaccaggggcaaacgagtctgttgacgcgcagagactaacatcgtctcctgcaccttctatcgtcctgacccatgaaggatggcgagtcaggtggcaggccgagataacttatggtcatccgcgcctttcgtcaatcgaggggaacgaattcgacggtatcaggatgatgttggtcggacgatcgagtgcaatggcgaagggaagtgtcgtggttggtccaactttgtcgttttcaagacactga

SEQ ID NO: 83931 - DNA, 327 bp, Glycine max
  Peptide Sequence Number=SeqID_175616
acttatcaaggtaatccttgtggcgtctaccctgacttatcttccttcaccggaagcggcgtctacccagacttatcttccttcaccggaagtggcgtctacccaaacttatcttccttcattggaagtggcgtctaccctgacttatcttccttcattggaagtggcgtctaccatgacttatcttccttcactggaagtggcgtcatccaaatccttcgtagcctgtatcaaacgatccgctcctactcaggttcacatcatcttggtatcagagcttcggctcttgataaaggttctatcttatcctattatttttctttgtaa

SEQ ID NO: 83932 - DNA, 582 bp, Glycine max
  Peptide Sequence Number=SeqID_175617
atggagaggcgtaatttccataaatgcctcatcaatttagtcgatgggagcatagacctagctttggtgaatgaattctatgcaaatttatacagttctgaggaccatccacaaaagcagtccaaagtcagaggtcatttggtgatgattgatgttgatagtctcaacgcattcttggagacacttgtggtattagctgagggggagaccttacctgcttactccaaatactgcaggttgcctacagactacagagagatagagggccatcctgggaagattctcagaaaggatctgactacactagctcaggtgtggaatgtcctcccatactccaacttggccctcacatcacacacttctgacttgatagtggatagagctaggttgatctttggcctagtctctcgcttggatatgaacataggagcgctgatctctggccagatgacctctatagccgagtctaacacttttaaacttgggttccttgctctaatcaccgcattatctagatccggaggggttgtctctgatagcctcacttttgagcgcctgagcccagacactttttgctttttg

SEQ ID NO: 83933 - DNA, 133 bp, Glycine max
  Peptide Sequence Number=SeqID_175618
atggaggccatgaaggagcaaatgacaatgatgatagaagcaatgatgagcatgaggaagatggtggaggttaacactactacagttggtgctgcaagcatcactactgaggtggacctgattcacccgtctg

SEQ ID NO: 83934 - DNA, 189 bp, Glycine max
  Peptide Sequence Number=SeqID_175619
attttagggttgaggatagaggaacaacgcttggcaatcaattcgtggggctccggactcgatggtggaggatgcatgaatgataatcaattcatgggacttgggataagatttgtgggtggaggatacatgaacagcgctaggcaatcaattcgtggggctccagactcgatggtagaggatgcatga

SEQ ID NO: 83935 - DNA, 171 bp, Glycine max
  Peptide Sequence Number=SeqID_175620
atgaccaagacgatgaccagtcccacaaggtggtggacgccgattacatcgcggatttcttctttccagtatgactggttctcccacgtcatgatgatgttgttgttctatctgaagaactttgaccttgttctccaaatgaatgcggtgcatcaaactattgtaaagtag

SEQ ID NO: 83936 - DNA, 258 bp, Glycine max
  Peptide Sequence Number=SeqID_175621
atgacgaacgacgaagaacggttgaaaatcttcgcgaaatcacccacggaaacgttacggaaacgcctcggcattggattttcttcacggaaacaatttttgtcactaattttaagtgaatctcagataccaggagggaaaaaggaaggagatgcttgccacccagctcgcccaggcgagctaggtcgcttccttcagaagcaactgccttctggaggaacatcctggaaggcccaagtgggtctggttgctatttga

SEQ ID NO: 83937 - DNA, 345 bp, Glycine max
  Peptide Sequence Number=SeqID_175622
atggtggaagggcgtttggtcattgtctttggggaagaggacattttagtaagctgcccttcttctatgtcgtatgctgaagctgtagaagaatccttgcagacgacttttcagtcctttgaggtagtgagaaacgcttcggtggaatccctctcgatgcgaccccgcatgtccgataccacgatgatggtggcccgtgtgatgttaggacatgggtataagcccgaaatgggtttaggacagaacaacgatggaatggccagctttgtagaattcaaggaaaatcgcgggaggtttggactagactataggcccacgcgtgctgatgtgagaagaagcgcctag

SEQ ID NO: 83938 - DNA, 249 bp, Glycine max
  Peptide Sequence Number=SeqID_175623
atggaagggagtaaaaattacttaccgggaaaaaggaagaaggaagttgttgaaagagtgtttgctgcaagtgaagaagtggacaaacgatatacattctcactttataaatggggaaggagtaaggagtattgccctaggagatttggcgcaacacacccctcacatgcgtacttgcatcctgtgcagcacttgcgccctaccctgtgcctatgctcacaaaaaatggttgcgccactgcatgcgtag

SEQ ID NO: 83939 - DNA, 288 bp, Glycine max
  Peptide Sequence Number=SeqID_175624
atggtgtcccaggacaagttacaacgtttgacgctgcaaaggtgcagaaacatgtcatggttgagtggcctcagagaactgaagcctttgcttcacttgttgctgccacttagcatccattgggtcgctggtgagatgacagtttttgttctcgttgatgtcacaacctctgctttgtgccctggagagtcaacttgctccaaagttatttatatcaatgggatccatcaaacgaaaattggtgttatgtcagaggacattggaagaaatcatcaaggaagaccttag

SEQ ID NO: 83940 - DNA, 1573 bp, Glycine max
  Peptide Sequence Number=SeqID_175625
atggagggctctgcagaggatctcggagcccccgagtcatgggaggtcgctgatttggacgagtccatgaaccgcttgaacctcatggtcttttccaacaacgattctaagcaacctcaccagcgtctcgccgattataatgacgatgatgctccgctgccgccgcctccttcgtccagttgcgacgaggtttccgatgacgccatcaatcaggttgatcagttccttcgcgaagccattcagaaccctcgcgaacggctttcaagtagatctaataagctgtatgttcttagaatgatatatcttgcccaactgattaaggcttctaatttgatgaattcagtcttgaggatggagcaagatgttgagaattttattcgtgatcctactcaacagcagcttgaatttaagcagcttccaacatcctatttaaggctggccgcacaccgggtggctcagcattactcattgcagtcaatggttttactggataatagtttaccagatggttctgggtcaagaattattgttcgcaaaacctctgaatgtaagcttccagttatccgccttgcagacatcccagtaaaattatcaccagaaaacagtgctgtcatgaaggttgcaatcaaacagaggccgcagaagtggacacagattctcagcaatgcaaattcaaactcaatgaagaataatagctctaaaagtgtggaggagagaaaagaggaatataatagggctcgagctaggatttttaattcaagtaataatgatggtactgtaggtgggaagccagaatgtgagtcaaggcagcaggataactcattgcatagttccttggttgttcctcgggtggaagataaatcagcttctgtatctgatgtcacttctggtagggggctggttgagtcttcaactaataccaatagggctagaagtaggatagagaaggagccagttggtaggtacaggcaaaataatagggtggctatatttcgggaccgagaggttgaccgcaaagatcctgattatgacaggaactatgataggacatctatacctgatttgatgttggaattggggatcacaatgaattgtgattttctgttcttgtatatgcaaagatttgatcctggttttgggttcaatggaggatcatatgcaatacagccaatgtatacagcagtattgaattacaagactgagtttccacagcttggatccactcacagaccccacctttctgctgaacaccaaccacggcctcttccacagcatatatctgggccctgggctgcacaatcagcacctgctggaattggatatggacatcccgagaccatgatgccaccatttaatcctaatcaagttggtgcacactcatcatcagccatgtatctgcattcatctcagtatccctgtcagcgccctggaatgccatttatccatcatgaacatgttcaccaaccctttgcacaggagcttttagagcttatattgttgttcatgaagagaaaattgaggacctcttcagaggaaatggagccaaagaagtttgtgcttgacttggataaag

SEQ ID NO: 83941 - DNA, 1062 bp, Glycine max
  Peptide Sequence Number=SeqID_175626
atggacaatggaccctctcgccgggccaaatggtggtattcaacattccacactgtgacagccatgataggtgctggtgttctaagcctgcccaatgccatggcatatctaggatggggtccagggatcttgatgttgttgttatcatggtgcctgaccttaaacacaatgtggcaaatgatccagttacatgagtgtgttcctggaactcgttttgatcgctaccttgatcttggtagacatgcttttggaccaaaacttggaccatggattgtactcccccagcagctaatagttcaggttggatgtgacattgtctacatggttactggggggaagtgcctaaagaagttcatggagatagcatgcactgattgcacacaactaaagcagtcttactggattctgatctttggtgccatccatttctttctgtctcagcttcccaatttcaattctgttgccggggtttctttagctgcagctgtgatgtcattaagctattcaactatagcctggctggcttgcttggctagaggacggattgaaaatgttagctatgcttacaaaagaaccagcaatacagacttaatgttcagggtcttcaatgcacttggtcaaatctcgtttgcatttgctggccatgcagtggcccttgaaattcaggctacaattccatcaacccctgagaaaccatcaaggataccaatgtggcacggtgctcttggcgcctatttcatcaacgcaatatgctatttcccagttgcacttataggatactgggcttttggtcaagctgttgatgataatgtgcttatggcacttgaaaagcctgcatggcttattgcctctgctaacttgatggtattcatccatgttgttggtagctaccaggtttatgctatgcctgtttttgacttgattgagaggatgatgattagaagattgaacttcgctccaggactagcactcagacttgttgctcgaactgcttatgtaggtgggagacatgtcaaaactcaactaatacatgctatcactgcaaaacatttttctgtttag

SEQ ID NO: 83942 - DNA, 378 bp, Glycine max
  Peptide Sequence Number=SeqID_175627
atggcctttcactcagcaaacatgcacaactcatccttcttccagattcttcctcgcgctcagtcgaggagtgttgcactcagcggatggctcgctaagctgacaggttggcttagcaagagggtgaaaaagaggctatgttttgaattgcaaaatgtagcagttgggctaaacgcatatccaccggtgccttcagccacgctaagctcgagactggcattaagcccgatttcacttactcgcgctaagcgcgagggtggcgccaagcacagcgtcgcgatttcagagcctactttaagcctgtcttttgcagaattagggtacaacttttacatcttttacaacaccttttatgacagcttctatagagcggccatg

SEQ ID NO: 83943 - DNA, 147 bp, Glycine max
  Peptide Sequence Number=SeqID_175628
atgtatgatattagaggacgagttgaaggtttgtcaaaggtttgctttcacttcgaatgggagccaagagcttccaaggttgctagccaaagccaaggcaatggcggacgtgtacccggctcccgaggaagttcgtgggctctttga

SEQ ID NO: 83944 - DNA, 420 bp, Glycine max
  Peptide Sequence Number=SeqID_175629
ttgccagcttggtggttgatgcgctcgtttatagtacaccaccagcattgtctagtagtccactcggtactgcagcaatgtctagtagtagttcagtagtggttcggccatcgaggagcagggctggccaagttgatgatgaggctgggggccctcaagacagcgtcgtcgtacgagttggggttagcagctgcatcgatagtaccatcgatcgtagtagacagcttggtcgtccaccctttgaaacaaggttgaggttgctagtaggtcccagtagtagtaccaaaggcaatgggagtagcagactgtctgtgatcgaggctccaggtcgttccaaagaggtgccagttggtagtagtagccatggagttgcagctggtagtacggagctggtcgtcccacctagtaatagaggctggg

SEQ ID NO: 83945 - DNA, 699 bp, Glycine max
  Peptide Sequence Number=SeqID_175630
atgacccaggaacaggctcaggcgctggtcatcaacgcggatgaaaacgtgctgcagggctggctggatctgcagcagatgtggtttaacaaccgcagcgatccaaaaatgctgaaagccggtattaccgactggcagacccgctacccgcagaacccgggcgcgaaaatgctgcccactcaactggttaacgtgcagaactttaagcctgcctccaccagcaaaatcgccctgcttctgccgttaaacggccaggcggcggtatttggccgcaccattcagcagggttttgaagcggcgaagaacggtaccacacccgtgaccggcagcgcggtgcccgcccaggcggcacaggcggcgaacgtgagcgacgttgtcagcccttccgccgcagagaccagcgacctgaccacagcgcaaaccccggcgcagggcacgatgcaaaacccggtgacggccccgacaacgcctccagccgcgacgccagagccagccacgccggatcaggctccggcagagacacaagccgcgccgaccacggcgcccgcgacagcggaacagccgcaggcgcagaccactcagcccactgctcaacctgccgctcagccgcaggccgtggcaaccgccagcgctaaccctggcgctgagctgaaaatctatgacaccagctcgcaaccgcttgatcaggttctggcgcag

SEQ ID NO: 83946 - DNA, 566 bp, Glycine max
  Peptide Sequence Number=SeqID_175631
ctcctgggccaccccctgatcctggaggaaggctaactatgcgagcacaaccagaggaggaggctatcgcgcagctactatgcatatcgatgcaagatttcacctgtgccgctgcaaagagacgagtgcggatcatgcgcaccaacatgaccactcttacacagatatggatgacgtttctacttagcaacattctatccagcgaccacaatgctgatctcctcctgcgaaaatatcagttggtctggatcacgcccacaagacacccagtggacccggaggagtccatcagggccctggggtttccagctctggttacgggcctttgccagtactacagggtgcttgtccccccagcaaggtcatggcatcgtgacatagggatcgcacccacaagatacctagtggacccagaggagtccaacagggcactggggtttccaactttggttacgggcctctgtcaatcctacaaggtgcccgtcccccccaacaagggatcgcacccgcaagacacccaatggacccggagaagtccaacagggtcttggggtttccagctctga

SEQ ID NO: 83947 - DNA, 123 bp, Glycine max
  Peptide Sequence Number=SeqID_175632
atggcagaatcaaccaagggatggaggcgaatggaggataggatcgcgaccgaccaatcgtcaccccttcccggcgctgggccagcggagaacgttgctgcaaggcaacccagtatcctttga

SEQ ID NO: 83948 - DNA, 620 bp, Glycine max
  Peptide Sequence Number=SeqID_175633
atgggcggcaccgcggccttcatcgatgccgagcacgcgctggacccgatctacgccgccaagctgggcgtgaacgtggacgacctgctgctgtcgcagccggataccggtgagcaggcgctggaaatcgccgacatgctggtccgctcgggttcggtcgatatcctggtgatcgactcggtcgccgcactgaccccgaaggccgaaatcgaaggcgagatgggcgatcagctgccgggcctgcaggcccgcctgatgagccaggcgctgcgcaagctgaccggcaacatcaagcgctccaacaccctggtggtcttcatcaaccagctgcgcatgaagatcggtgtgatgatgccgggccagagcccggaaaccaccaccggcggcaacgcgctgaagttctatgcctcggtgcgcctggacatccgccgtatcggcgcgatcaagaagggtgacgagatcatcggcaaccagaccaagatcaaggtcgtcaagaacaagctggcgcctccgttcaagcaggtcatcaccgagatcctgtacggcgagggcatcagccgcgagggcgagctgatcgacatgggggtggatgccaagctggtcgagaaggccggtgcctg

SEQ ID NO: 83949 - DNA, 144 bp, Glycine max
  Peptide Sequence Number=SeqID_175634
atggcgaaaatgccactgccattggcagaatgcagtggtgtcgccagtgctattagcgatttggccatgcaagggcaagtggtgttggcgagatcatgcaatatggatatagccattggtgctggcgagatcatgcaactttaa

SEQ ID NO: 83950 - DNA, 629 bp, Glycine max
  Peptide Sequence Number=SeqID_175635
cactttctgtcggtcgcggactccactgctgatcaggagtacgacgaggattctccgcgtgcgtgtaggtggattgcgaccaagaagattgtgaagagaattcgtatgccggcgtacagggagcgcctggatcgactccagattccgaatgtctgttggatcccttatggggagcaccgagaggtccgggacttccatgtcagatcatgctattccggtctcttgcgctgggggcctgttgctatttattaccgaccggagagggtcgtgcggcagtttggctacacgcagaccattcctgctcctcctgatcatatcattccagcaggtgatgtgtgcgttgtgccaggccagtgttccagtgactacatggactggttcttccgcatctcccatcctttcatgacaccaggccacacattagatcctctgcctcatggtcacgccccgcagccccaagtcgtccctcaggccccgcagacggatatccctcgcgtgccggagccaggagcatcgtcgacatctgcggaggagcctagacatgcagtggaagtttgtgatgacattgctgagaggttggagcgccatctgattctaggggtggtcacgcctggctcatcgacaatgag

SEQ ID NO: 83951 - DNA, 234 bp, Glycine max
  Peptide Sequence Number=SeqID_175636
atggttacctcaaaggaaatgaaaggtcagattagggtttcgttctctatcgaaatcgcgagccaagttggaagattccgcttcggtcgaagggttcctctcagtatggggttgcaacggagaacaacgatggtttgcggtggcgaatggtggctgtgggtgatggagaaagtgcttgggacgttagaaatggctttggaagaaagaaaggagaagaaatgggatatttcctaa

SEQ ID NO: 83952 - DNA, 270 bp, Glycine max
  Peptide Sequence Number=SeqID_175637
atggaagccaatgcagttgcagttgccgctaccagggctgttgctaaggtgaatccgatgccctcatctggcctcaaccaaataaatcatccaacctcagctatggtaggcaaagatttgggaagtacgggcggcccctattatgtgcaaattcaaaacaagcacgccttcccgccatatggctcgcctcccaaggaggatacacatggaatgcctcaccacaatctagccgactttgagccttgcctcggatatgccactgaagggtga

SEQ ID NO: 83953 - DNA, 778 bp, Glycine max
  Peptide Sequence Number=SeqID_175638
atgaaacgcccggattatcgaacgcttcaggcgctggatgctgtgattcgcgaacgcggctttgagcgtgccgcccagaagctgtgcatcacgcagtctgcggtgtcgcagcgcattaaacagctggaaaatttatttggtcagccgctgctggtgcgtaccgtgccgccgcgcccgaccgagcagggacaaaaattgctggcgctgctgcatcaggtggaactgctggaagaggagtggctgggggatgataacggtggcaccacgccgctgctgctgtcgctggcggtgaacgccgacagtcttgctacctggctgctgccggcgctgaaagatgtgctggccgactcgccggtgcgcctgaatctgcaggtggaagatgaaacccgcacgcaggagcgtttacggcgcggtgaagtggtcggcgcggtgagtatccagccgcagccgttgccaagttgcctggtggatcagctgggtgcgctggattatctgttctgcgcctcgccggagtttgccgcgcgctatttccccaatggcgtgacgcgctcggcgctgctgaaagccccggcggtggcgtttgatcaccttgacgatatgcatcaggcctttttgcagcagaactttgatttatcgccgggcagcgtgccgtgccacatcgtgaactcgtcagaggcttttgtgcagctggcgcgtcagggatcggtgtgctgtatgattccgcacctgcagattgagcgcgagctggcgcagggagagctggttgatttgacgccgg

SEQ ID NO: 83954 - DNA, 480 bp, Glycine max
  Peptide Sequence Number=SeqID_175639
atgagaattatcgaaattggaaatgtaaggttcattgaaaaaggtgaaatcagtgggagtatagttccacgagatgtgaaaattaaagaagttagagtgcaagtccttttagcttgtgcctctagtaaggagcaacacaataatgaacccatgatacataatgaacatattgtggaagaaccacaagaagtagcattaaggaggtctcaagagaaaggagaccaactatttcgaatgactatgtggtatacctatatgaaacagaaagacttaagcattaatgataatgatctaatttcattttcacaagctggttgtaaaagagttggttgtaagtgggtcctcaagactaaacgtgactttcctgacaaacttgaacattacaaggttagacttattgctaaaggatttactcagaaagatgacattgagagacgttttcactggtctcatgaaaggattatttcaggattatcatga

SEQ ID NO: 83955 - DNA, 567 bp, Glycine max
  Peptide Sequence Number=SeqID_175640
atggcgacttactatagcaacgattttcgtgctggtcttaaaatcatgatggatggcgaaccgtatgcggttgaagccagcgaattcgttaaaccaggtaaaggccaggcattcgcacgcgttaagctgcgccgcctgctgaccggcacccgtgtagaaaaaaccttcaagtccaccgactctgcagaaggcgcggacgttgtcgatatgaacctgacttacctgtacaacgacggtgagttctggcacttcatgaacaacgaaaccttcgaacagctgtctgctgatgctaaagctatcggcgacaacgcgaaatggctgctggatcaggctgagtgcatcgttaccctgtggaacggtcagcctatcgctgtcacgccgccgaacttcgttgaactggaaatcgttgaaaccgatccaggtctgaaaggcgataccgcaggtactggcggcaagccggcgactctgtccactggcgcagtggttaaagttccgctgttcgttcagatcggcgaagtcatcaaagtagatacccgctccggcgaatacgtatctcgcgtgaagtaa

SEQ ID NO: 83956 - DNA, 878 bp, Glycine max
  Peptide Sequence Number=SeqID_175641
agacacctgtggtgttggcagagggtgagactttgcccacatactccagatactataggctgccttcagatcctagggagattgaggctgccctgtgcataccaggcctagggttcatcttgaacgctgagggccatcctgggaggatcctgaggaaggacctaacgactctagcccaggtgtggagtgttctctcatactccaacctgacccccacatctcacacatctgacctgacagtggatagagctaggctgatctttggcctaatctctcgcatggacatgaacataggagctctcatttctggccagatgacttctatagcccaatctaactcttctatacttgggtttcctactctgatcaccgccctatgtagagccagaggggttgtctctgacagcctcacttttgagcgcctgagcccagtcattaacttggccgacatcaggaagaactgggctaggagggcgaggccaactgagcttccttccacatctgtagctcctactctagcatccactttagcaactccttcagttccagctcagagatccattctttccattgagcagtttctagagagggtagctagcttggggcccaaccttctcttcatagggaagatgaaggaagctgctgctactcctgagaggtcacgagaggtcacatcagatccacccacaccaatggtggacctatcctcacctcagcatgcagcagacccctccactcctatacttaagatgccagaggacccgactacaccagtcctgactctgaatacttctcctccagctacttcagtacttcatctgacagatgaggagggtggccagacacaagatactcaggaccagtcacaggaattctaa

SEQ ID NO: 83957 - DNA, 291 bp, Glycine max
  Peptide Sequence Number=SeqID_175642
atgcctcaagaggttaacattagcctcccatatttccatggaaaagataatgttgaggcctacttagattgggaaatgaaggttgaacaactctttgtttgtcatcatattagcgaagagagaaaagttccattggctacctttagctttgtaaaagcaagcttcatgatgaagaaccaagcaattttgatgattccaaaagcccaagtgattgcttcaagacttcaagatcaagcatcaagaatccaatccaagattcaagattcaagagaagaaatcaagaagcaacaa

SEQ ID NO: 83958 - DNA, 465 bp, Glycine max
  Peptide Sequence Number=SeqID_175643
atggccccgaggaagcttccctcaaagagatccaggaaggacaccgcggccgcagggactagtgccgctcccgagttcgatagccatcgtttcaggagcgctgagcaccagcagcgttttgaagccatcaagggatggtccttccaccgagagagacgcgtccatctcagggacgacgagtacacagatttccaggaggagatagctcgccggcgttggacgatcgctaaggagggcgtacgggacctccggtcatgggtgaggggccagtggattcctttcgatgcagacgccctcagtcagttcctgggatatccgctagtattggaggagggccaggagtgcgaatatagtcaaagaaggaaccgggccgatggatttgatgaggaggccattgctcagctcctatgcataccagacatggatgacgttgctgctcagcaacatcctgcccagcgatcataa

SEQ ID NO: 83959 - DNA, 754 bp, Glycine max
  Peptide Sequence Number=SeqID_175644
atgacaccgttcatcaacagactacttaaacaggaattcagtatgcccccaaccagccgattcacgctcaaacccaccgcaaagcgccgcaccatgctggcactctgcatggcattactgacaccaccggcctggtccgccagcacatcccccaccatgacagcaccgactgcggagttcgtctataaatacctgcttggtgaagtagcggcacaacgcggtgagtttgtgctggccagccaactcttcctcgaccttgccaaacaaacgcgcgaccccttactggcagaacgcgccacccaggctgccaccatcgcgcgcacgccgcaacttgccctaccatcggcagagttgtgggcagaactggcaccagactccatccctgcggcgcaagcggccagccagcttttaattgccaatggcaacctgaaaaaagcggtgccacaaatccagaaagtgctcactaacgacaatatccgtgccaacgcctttatggaactcaacagcctgttcatgcgcgtcacggataagactgctgtactggaagccatccaacaactggccaaaccttatccaaaactgcctgaagcccactttgccatctcacaagcggcctattttgcgcacaatgaaagcttgatggaagccgaattaaaagaggcctcaaaactgcgcccgggctgggagcctccggcacagatccgcggacaaatgttgatcgagcaagacccgcaaaaaggcattgcttactaca

SEQ ID NO: 83960 - DNA, 1005 bp, Glycine max
  Peptide Sequence Number=SeqID_175645
atgaataggttggcagggtccgatcaatgcaagaagttgagggccccctttagtctccaagctttgaaacaggctattgggttgatttctagttcaagtcgcctttctcccaccagctctcagggtccaccttcatcctctttggttgttcaagttgttgttgccaccacgattattttcgatcctccagtacctccatctccacctgctcagggtccaccttcttccaccacactggctatgtcagcccccttggctgctcctccttcttctactgtcgtgtcattacttagtgctagtgtggaaactacaaagactgaggtctctaaatggagagccactgctcagactgtatggcaagtagagcatcccaaggtgtccaatgctactatcgcccttgctgaagtacaagcaccaagatggacggtgacaaggtgtttggagaagaatgaattggtgggcaaggtggagtgtactgctaaagagaaagaagagcttgcagcaacagtggtcaaattttccaagactaaaataaaggagtctgagctcaaagtggaaaaagagaaaggaaaaaacaaggagcttgaggaggagctcttaatgctaaaaaagaaagtcatagagaagcacgagaaggggttctttaaggcctttaggcaagctagattctttaataagggtttcgaattaggtctttttgacctgtttaaggatgtgaaggatgatgaattgcttgacgaggaagagattgctaccggggaggaggatgtcgaagaagaagacgatgagccaatgtttaggttgtgctctctatgtggacttgcatgttgccgccttatgtctatacaatgtttagcctttgatgcttgtcgtagaataatgggagtagtcctttgtgttatgctggttttaccttacttgacggatttgtatgaaataaagaacgagatgacatctgatcatctcgagtttgatttcaaatttgttgaaggtcttaccaattaa

SEQ ID NO: 83961 - DNA, 507 bp, Glycine max
  Peptide Sequence Number=SeqID_175646
atggctgaggagccaagaagagttactctggaagactacttaagctcaaaggctaaaaggtggcttcatttgttcaaaagaaatagtctcaagacttgggatgaagtagttgagaaattcttgaagaagtacttcccagagtctaagacaactgaagggaaagctgccatttcatccttccaccaatttccagatgaatctttgagtgagagcccatattcctaccaagagaagcttgctagagctttcatcacaagatgcattgttggcacaaaacaagctgttgtccaagcaattggaagcattgacagaaacactaagttgcaggttgtgtcatatgtggtggagcacatgagtctggctgatgtatttcccaagaagaaacaccacatgaagtcaactacatggggaatcagccaagacaaaatttcaatgctgggacaatggaggaatcaccctggaaaccagttcaacaaagaccagggtggtccttctaataagccataa

SEQ ID NO: 83962 - DNA, 318 bp, Glycine max
  Peptide Sequence Number=SeqID_175647
atgtctcattttcaaggttttttcaaaggaagtgtaaaaacaccctattacagtacccaaaacataagagacactaagagaagctcaaacaaactaggagaaaggcttagaagtcaagattacctcagagaagctacgaaagaaaagattgagggattgttctccaccgaatccttaaggtggattttgaggattccgctccgattaaaatgttcctctcggagtggtggttcaggggcaagcaatggcagatcatgttggccaccggtggtcatgggtggtggaggaggaggtgttagggattgggtggtcgtttga

SEQ ID NO: 83963 - DNA, 1440 bp, Glycine max
  Peptide Sequence Number=SeqID_175648
atgcacaacctcttgccagaatctctccgacaagccttgagagcttgtgtcacttccaccttgaggtccttcctctccaattccgaaccagaactttgcttatcagaactctctcctcgttctgtcgagccttctgctgtgcttcctccgcaagagatagagattcaactcggcggagtgagaggtgaacgagttaacaagttgcgcaatcgagtttgtggcgttggtgatccacggctaaagcttcctccagcagtcagcactgaaacctccgaagagaatgagattggtgttctatttctgtttcttgaaaccccttcattctttagtgttccaactgacccatatttaggattttggggtctagcttttgcgaaatttgggatacttcactaccaagcttcactgggcttggatggaccaccaataaggtggctgaatgtgaagttaaaactaaattcagctgggatggttggaattgatactcaggcactaggagcatgtaaactttgtgcaactgggttcacggctgagtctaaaatcttcaaggatgatgggtttggtcctccaccagcaagatggaaaggatcttgtggccactatgcaaatttctcaggctgcaataagagaacaacttccttccatggacgctatgagaatgacagccatatatgtcctgatgtcgctgtaactccaattgttaacaatcatagttctcggggtttggatggtttggtgaacaatcatactaattacacaggccaaatcatcaagtcttccaactgcatggatgtagatattgacgatgatgatgatgccatacttgagtcatgtatgaaggttgcattggattttgtctctccagaaaatgttggggagtgctttcgtttgatagaggaatttcgcacacttccaattagccatgcgcctagtgaggacaaagtggagatgataacgaaagatgatgacaaaggtgatgacaaaaagctcaaaggtcaatcaaagaatgagttcaagatattcaagatagaatcaagaacacttcaagactcaagaggaaagttgatttcaagaatcaagaatcaagattcaagagatcaagatttcaagaatcaagattcaagagatcaagattcaagaatcaagagaaggcttaatcaagataagtgtgaaaaagagcatgatggctcttgggtgaagaaaggtactcgacatgttggtgaagaaggacgtgatggagaggattcatctctcctttcaaagattttagataggtttgatggttttcaaaccattgttggtgagaggtttgacaatttggaattacaagtggatatgcgcttcaatgaaatggagtcaagaatcacaaaggttaaagaagatgtgtcttacattcgttcaagtttcgatcttccaccaccgccgccaccatcatcttag

SEQ ID NO: 83964 - DNA, 468 bp, Glycine max
  Peptide Sequence Number=SeqID_175649
atggacatgaatataggagcacttatatctagacagatctcgctcattgctcagttcaactcctcgaggcttggatttccagccctcatcattgccttgtgcaaggcccgaggagtcacctcagattctctcacttatgagtcactcagcccagccattaatttggcttatattaagaagaattgttggaacctggatgacccttcagtcacttttccaaggacccaaaaatccagggctagaagatttgaggccccatgtccttcagctgcccctactccccttacttctggtccctctacttctgctctcccttcagcaccagcagccccagttcttccatgccctccgctcagagctcaaagcctttcattgaccgtagagggtgctcagcaggcatctctagcaggcactcctgcactggacttgaatgaggaggccatggatcaggacccaccatcaccatag

SEQ ID NO: 83965 - DNA, 441 bp, Glycine max
  Peptide Sequence Number=SeqID_175650
atggccttcatcactttcaaatttatgcatttcattctaaaatttagagactggtacaaagaatattactcaatgctagtcattaactcacaatttaagatcacactctcaccggggctagcagaaggagtagtagctcatccagatgctgactctatagagtcttcagagataataataataggtgaagatgagggagctgcttcaagcttggaagaagatggatctgccactggagatggtggattagttggcactggttcgacctgtgcaggtgtctgggctgtaaagcttccacaatctctcacaatcaaaagtcgagctccagaccaggctacctgctcaaggaactgctctacatttctctgggcatctggtcctgttgatgcagatggaggagatggagtggatgatgaagggatgtcatttgctctggccctg

SEQ ID NO: 83966 - DNA, 288 bp, Glycine max
  Peptide Sequence Number=SeqID_175651
atggaagcttgcttgtggaacttctatggaggttggatctttgagcttcacggaaggcaaaggagaagaagagaagggaggcaccatccactagggaataagccatggaagaaagggcttcaccaccaagaatgtgctttggataagaagcttgaagatgatgatttaatggagaaaaagaaagagtggggggaacacaaaattgaaggaataaaagaggaagagaagtggaactttgaagtagcttccttgagaagctttcttgagaaaacttccttgagaagctag

SEQ ID NO: 83967 - DNA, 783 bp, Glycine max
  Peptide Sequence Number=SeqID_175652
atgccgaccaaagaatcatcgccgccgcttattgagaagcacaccattggctatattccgccagaagatcgccacggtaaaacccgcgatctctttaccctgtggtttggcggcaatatcgcaccgctgccgatcgtcacaggcgctctgggggtacagatctttcatctgaatctgctgtgggggatcgttgcgattttagtcggccatctggttggcggggcgctgatggcgctgcactcggcacaggggccgcagatggggatcccgcagatgatccagagccgcgcgcagtttggatcttttggttcgctgctggtggtggcgatcgccggggtgatgtacgtcggtttctttgcctcgaacatcgtgctggccgggcagtcgctgcacggcatcgcccctgccgtcccactgccggtggggatcgtgatcggcgcggtgggatcctgcgtgattggcattatcggctaccgatgtattcacattctcaaccgaatcggcacctgggtgctgggcatcggcattatggtcggctttggctacatcttcacgcatctgcataccgccgatttcttaacccgcggcggcttttccttctcgggctggctggccaccgtgtcgctggcggcgttgtggcagatcgccttcgccccgtatgtttctgattattcgcgctacctgccggcggatgtgcccgtcgccgcgacgttctggaccacctatcttggcggggatcctctagagtcgacctgcaggcatgcaagcttggcactggccgtc

SEQ ID NO: 83968 - DNA, 381 bp, Glycine max
  Peptide Sequence Number=SeqID_175653
atggattttgctgatctgagggaggcgttttacggcgtgacgcgcttcgaaaccatgcgtagccataccgggatcacgaaacaaaccttagcgacgcgtttgaaactgatgacggagctggggctgctctcccgaataccttaccgggaagaaggagcacgggaacgctatgagtaccagcttaccgaaaaaagccgcacccttgccccggtacttctggcgctgatggaatggggacacagacaggtgttacacaccgcaccgcatttaacgctggtggataaagcgacaggcgatccgttgcatattggctatgtgaatacgcatggtcatgaggtgaaaccccaccaggtgcagattgtgccgacaccaaaggggtaa

SEQ ID NO: 83969 - DNA, 426 bp, Glycine max
  Peptide Sequence Number=SeqID_175654
atggatctcattgaaaatatggctgcaagtggcattgctattttgagagatagagcccatattcctactaaaaagagtttattggagctaacctcccaagatgcattgttggcacaaaataagttgttgtctaagcaacttgaggcattgactgaaacactaagagctcatgaatctggatgtgtcgcaacgtgcccttttgcgggcgggcgaaggcgagactcacgggtgcgctttccaaaggaggaaagatgcgcggagtcaccaccaatgtttatttgtggaaaacgtcggaaaaaccgaaggaaatcggtcaaagtgaaaattctaagttcgggagttgtatttacgtttgaggaaggtcgacaaaagcggggctcttgctcctacgtaccccccatcaaagaggaaatcagacctacgtag

SEQ ID NO: 83970 - DNA, 627 bp, Glycine max
  Peptide Sequence Number=SeqID_175655
atggattgtcatggtcattatatcaccgagttttacatttgttgccaaatgcctaacacaaccctcatcctttatccgggcttggggactcgctatgagaccatagccagagttcctgcacaagtaccagactggaaccatgcctttgcagacccaacattgccactcatggtggacattggatgtggtaacctgaatctcaatgataatttatttgatgcatttagtgtgtctgttaaggactggcacagatcatgcataagtgcacttacttgttccagcttatctgttgttgtaaacaatgtcaggcagtggcagatagtcaagcgtgctgagtcatgggcaaaggatctggctcttgataacatgtactatcctaaatctacatatatagatggtggaacttttcttgtttgcaaacgcgacaatttctttcaagcagttggtagaatcatatcccgggcccttggtcttagtttcagtattggatgtcatctacatttttatagtactaagctggtaggccccattgagcaacctaaggctgttcaacaggagggggagtgctttcaggggcaattgagacccctatggagcactgcaaggcaagaagggcttgttgactaa

SEQ ID NO: 83971 - DNA, 1591 bp, Glycine max
  Peptide Sequence Number=SeqID_175656
cgccggtctccactcgcgcctgctggtattagaagacaagcagaccgcaccggcagcgggcgccagcgccaccacccagctgcatattctgtttggttcccagaccggtaacgccgaagcgctggcgcagaccgcagccaaggcggcgcgcgctaaaggcctggtgccggtagtgcaggcgctgggtgaagtggatctggatgtgttcgccaccatgcgtcatgtactgattgtcacctccacctacggcgaaggcgaaatgccggataacgcacagctgttctggcaggccatctcagccagcaccgcgccgcgtctggagcagatgcactttgccgtgctggcaatcggcgataccggctacgacggtttctgccaggccggtaagttcattgatatgcgcctggagcagctgggggcgaaacgcgtggtggatcgtatcgactgcgacatcgattacgaagagccttccagcgagtggattggcagcgccatgccacagtttgccgccagcgcgggcagcagcggcacggtgctggagagcgcgccggaagcgccggtgatcccgggcagcaacaagcaaaacccgtacgcggcggcgctggtgaccaataagcgtctgtccggcgagcagtccgccaaagatatccgtcacttcgaatttgacctgagcgacagcggcctgaaatacgaagccggtgatgcgctgggcgtgatcccggtgaacgatgccggtctggtgagcctgctgctgagcgagctgaaagccgactacgaaaccccggtgccgggctttgaccgtaacctcggcgatctgctgacctatcagttcgagatttctgagccgtcgcgcaagctgattgagtgggtcggacagcacaccaccaaccaggagctgctgcacgtcctgcagcacgacgataaagacacgctggctaactggctgtggggcaaagatacgctggatctgctgcagctcgaactgaagcgtaatctgtcggtgccggagctggtggcgatgctgcgtccgctgcagcaccgtgcttactccatttcgtccagctcgaaggcgcaccctaaccaggtgcatctgaccatcgcttctgtgcgctatcacagcggtggccgtgagcgtaaaggcgtgtgctccacttacctggctgaacgcgtgcgtcgcggagagaagccggcgatctttatttcgccgaacaaagcgtttcgcgtgccggcgaacaataacgccccgctgatcatggtcggtccgggtaccggcatcgcgccgttccgcgccttcctgcaggagcgccaggcgaccggtgctgaaggtaaaaactggctgttctttggcgaccagcatcaggaacatgattacatttacgcggatgagctggcgggctggcagcagagcggtctgctgacgcatctcgacctggccttctcccgcgatcaggaagagaagatttacgtgcagaaccgcatgctggagaaaggcgctgagctgtacgcctggctgcaggaaggcgcctacttctacgtctgtggcgatgcctcacgcatggcgaaagatgtcgatgccgcgctgtatgaagtg

SEQ ID NO: 83972 - DNA, 207 bp, Glycine max
  Peptide Sequence Number=SeqID_175657
atggggacaaatcaaaacggaaaaagattttatcaagtcaagattaagggtctagatgtcaccaacctcaaggagttgggacgattgatgggacctccccaaaggcaagccttccgcaaagtgtgcggaaagattttagatttgaccgcagcggaggtatttacggaagctattgtatccctccccaatactatgaccagccgttga

SEQ ID NO: 83973 - DNA, 117 bp, Glycine max
  Peptide Sequence Number=SeqID_175658
atgaacaacatcaaagcggaatggagatggaagaaagatgattggagacgccacttcaaggagaggatgagtcaagaagaagctcaccaccttaggaagccatggataagagcttga

SEQ ID NO: 83974 - DNA, 279 bp, Glycine max
  Peptide Sequence Number=SeqID_175659
atgcgcagttctctgaaggcgagggcgtgtagccctctgaaggtgaggacgtgcaatcctctgaaggcgagggtgtgtagccctctaaaagggaggacgtgtagtcctctgaaggtgagggtgtgtagccctctgatggcgagggcgtgtagccctctaagggtgaagattgactgttcttttgaaagaggtgataattcatgcaaccttatcctatcttttgcaaatctctcctggaactccctcagagtgtatgttctgtttgatttagtcacttga

SEQ ID NO: 83975 - DNA, 866 bp, Glycine max
  Peptide Sequence Number=SeqID_175660
atggccgaagagctgactcagcatgccgaaggggcgcggccgggcttcgctgcggcgatcagcgcgccgctggtggcgatcctgctgctgtcgctgcggccgatcgccggcatcgccgtcgatccgctgatcgcgctgccggccggcggcttggcgggcgcgctgctgatggggcgcatccgccagtgcaatcagtttatggtctccggcctgtcgcgcatggcgccggtggcgatcatgctgctcggcaccggcacgctggcgggcattatcgccaactcggcgctgaaggatgtcttgattaacggcttaacgcacaccgggctgccggcctggctgctggcgccgctgtccggcgcgctgatgtcgatggcgaccgcgtcgaccaccgccggcaccgccgtggcttccggggtgttcagctccacgctgctcgagctgggcgtgagcgggctggccggcgcggcgatgatccatgcgggcgccacggtgctggatcacctgccgcacggcagcttcttccacgctaccggcggcagcgtcaatatggcggtgcacgagcggttgaagctgctgccgtacgaaacgctggtgggattcaccattgcggcaatctcggcgctgatcgcgctcggcgtcgccgacgccatcgagcgggggttccgccaaatttacccgcaggcgcactacgtgaagctgccgatggcggacggcggcgaaggcacggtggagtcgatggtggcggccaccggcggcgaaatcgtccaggtgacggtcaccgggccgctgggggagccggtgcaggggttctatggcttgctgggcgacggcgaaaccgcggtgattgaaatggccgctgcctcagg

SEQ ID NO: 83976 - DNA, 681 bp, Glycine max
  Peptide Sequence Number=SeqID_175661
atggttcctgggtcaccccctgatattggaaggcgaccaactgtgcgagcacatccagagagggaggctatcgcgcatctactatgcataccggggcaagatttcacccgtgccgctgcaaaaagacgagtgcagatcatgtgcaccaacatgaccacttttacatggatatggatgacgttgctatttagtaacattctgcccggcgaccacaatgccaatctccccctgcagatgtatcggttgggatcgcgcccacaagtcgcccagtgggcccgaagaagtccaatagggccctgggatttccagctctggttacgggcctctgtcagtcctacagggtgcccgttccccccagcgaggtcatgccatcgtgacatagggatcgtgcccacaagatgcccagtggacccgaagaagtccaacggggccctggggtttccagctctggttgcgggcctctgtagtcctacaaggtactcgtttcccccctgcagatggggattgtgcccgcaagacacccagtggactcgaagaagtccaacagggtcttggagttgtcaagctctaattatgggtctctgtcagttctacggagtacctgtcacctccagcaagggcatcaggccccctactaatcgagctttcatcaagaagtactgcatccccaggcaggcgtag

SEQ ID NO: 83977 - DNA, 795 bp, Glycine max
  Peptide Sequence Number=SeqID_175662
atggctccgagaaagctttccgcaaaaatatctaggagggacgccgcggctgaagggaccagcgccgctcccgagtttgatagccaccgtttcaggagcgccgaacatcagcagcgtttcgaggccatcaaaggatggtcgttccaccgagagagacgtgtccagctcagggacgatgagtacactgactttcaggaagagatagctcgctggcgctggacatcgttggtcactcccatggctaagtttgacccagatatagtcctagaattttatgctaatgcttggcccacagaagagggagtgcgggacatgcaatcatgggggagggggcagtggattccctttgatgcagatgccctcagccaattcctgggtgacccgctggtgttagaagaaggccaggagtgtgagtttagtcagagaaggaacagggccgacggatttgatgaagaggccattgcccagctattatgtataccgggtcaggattttgcccggcccgctgcagggaggcgggggcggatcatgcgcaccagtatgaccaccttgacacagatgtggatgacgttgctgctcagcaatgtcctgcccagtgatcataactccgaccttccgctgccgaagtgtcagctggtgtatgccatcctgacacggatgagcgtccatgtggctcagttgattgctgacgacatctatttatttgcaggtatgccacccaccaggcaccctctagacccggataagtctaacagggccctggggtttccagcgttgatcacgggcctctgctag

SEQ ID NO: 83978 - DNA, 480 bp, Glycine max
  Peptide Sequence Number=SeqID_175663
atggaaaaatccgacaagatgaatttcaaagagaagaaagaaaagaaaggatatatcacttgggaagataatgtcataaattattcaagtgattcaaagaagaaaatcataagtctgggtatcatgatgaaagactatgaaaatggagaagagcaaagtcgatacattgatagcaatttctccaaacacatggcatgcatcaaattggaagttggaagtggaagttactggaagttggaagttggaaatgaaagttattggaagttgaaagttgaaaatggaggttggaagttggaaggggaagtggttgtcatcatcaaaaagggggagaatgtaaatcatgaagattttgatgatatcaagaagaatttgcttgagaaagagggagatgtaaatcatgcaagctttgatggtgtcgagaagaaatcacatgtttgtcatcatcaaaaagggggagaatgtgaatgtatgtatacatga

SEQ ID NO: 83979 - DNA, 717 bp, Glycine max
  Peptide Sequence Number=SeqID_175664
atgctcggcttactgctgctggccgctgccggcagcacatggctgattgccggtgggctgtttatcgccggtctcggtgccggactggcttccccggcgctcgccagtgctgtgagccggcaaattgacgcgtcgcggcaaaccgccgctaacacgctcatcaacgccggcaccggcgcgggcatcattgtgtcacctgttgctggcacgctattgtctgcccgccggtcgtgccgatccaccgggatcgccggttggctggcgcgatcgactgcacaaccgcgcgctgctgcggcgcggcgtggtggtgttttggaccggatgtgttacgccagtcacagccgcctgaacgaaggccaggccagtatgctgtggctggttagcggcgcggccggcattctcggcgcgctgaccggcccgctggcacgctgcatcggtatgcgtcaggtgtactggctggcgcagctggcgatggccgcaccactgctgttgctggcggcgctcactcactttagctactggctggtaccggctgcggcgctgtgcggcgcgggatacgtcacgctgtcggaatgcggccctggcgtggcggcggcgtttctgacgctggcgattgggcaaattggcggggcgatactctttgcgcaaatctacagcagcagcgccgctgcggcactgctgctgttcgctgccatcccggttgcgctgctatttctg

SEQ ID NO: 83980 - DNA, 452 bp, Glycine max
  Peptide Sequence Number=SeqID_175665
aaaagacacttgttcgcattgccacacctcttaggcttgagtttattcctcaagtaaaggagttgttggatgagggtttggttcgcaagagcttaaatccttgtgctttgttggtgcccaaaatagatattattaggcaccaaatccctaaaataggtggtatgatgaatgctttgggtggtgcaacactcatttgtaaaatcactcgtgcacccaacatcttcatgatttgtgtacatagggactcattaggtaggaataatcaacatgaaaatacagaaaaaggggttcccatgaaccctaagagaataaaggtcattcctgagtggcccgctccaccaagtgtgttgaggaaaaaaagcccagagtttcaagaacctcgggatttgaggtcaaatccttttcaagggggaaggaatgatgcaatcctaccccgcaagggcattggatag

SEQ ID NO: 83981 - DNA, 372 bp, Glycine max
  Peptide Sequence Number=SeqID_175666
atgacccgcactcgtctctttacagcggcacgggtgaaatcttgccccggtatgcaaagtagttgggcgatagcttccttctctggttgtgctcgcacaattggtcgccttccaatatcagggggtggcccaggaacggttgaaggaaattacgggccccttaaccgggagctcaagtctcgcacactgaaaatgaggacgtgtagccctctaaaggcgaggacgtgcagtcctctaaaggtgagggcgtgcagccctctgatggtgagggcgtgcagccttctaacagcgagggcgtgcagccctctgaaggcgagggcttgtagccctctaaaggtgagggtactagtagccaagggtccacccttatga

SEQ ID NO: 83982 - DNA, 333 bp, Glycine max
  Peptide Sequence Number=SeqID_175667
atgaagtcaggtgacatgcgggggtaccgtatggttatccacacctttcgtcaaccaggggcaaatgagcccgttcacatgcagagactaacatcgtcttatgcaccttttgtcatccagggacagcgagtcaggtggcaggcggagataccttatggtttttactctcgtcgtccggagacattcaagccagatgacgcacaagattcttctctgttgggcggggggcgatcaagttcgatggcgtggggaaatgtcatggttgtcccactttatcgctttcaagacactgaagttttgttgacgcttctgatgccttttctttccttctaa

SEQ ID NO: 83983 - DNA, 204 bp, Glycine max
  Peptide Sequence Number=SeqID_175668
atggaaaaagaattctggagaaacaatagcagctggaagatagcaaatgcctcaagcgatgatggtgtaaatgaaggttcaaatgaaaatttcgttggagtagatggtgccaactcgagaagtggttaccaaggtagaggtggctttaaaggtcaaggtttccagggtagaggagaatacgaaggctttggtctgacaatatag

SEQ ID NO: 83984 - DNA, 630 bp, Glycine max
  Peptide Sequence Number=SeqID_175669
atggctggtgcaaacggatcttcatgtgcaattcctggttgtgattctaaggtgatgagcgatgaactttgtgctgatatttttccattaaaaacaggaggtgggatatgcccaggatgcaaggagccatatcagaacacagaactagatgaagtggctatagataatgggcatccccttctacttcctccaccaagtggaatgtctaaaatggagaggagattgtccatgatgaagtcaacgaagtcagcactgggaacctatggctatggcaatgctatatggccaaaggaaggtggttttggaaatgaaaaagaggatgattttgttcagccaactgaattgatgaacaaaccatggagaccacttactcagaaactgaagatacctgctgccgttttgagcccatatcgtcttatcatttttattcgtttggttgtcttggcactgttcttggcatggaggatcaaacaccaaaatactgatgcagtctggctatggggcatgtttgttgtttgtgagatatggtttgccttttcctggctgctggatcaactgcccaaactatgcccactgaatcgttccactgatcttaatgtccttggggatttcaatagcattagaagctag

SEQ ID NO: 83985 - DNA, 462 bp, Glycine max
  Peptide Sequence Number=SeqID_175670
atgaaggaagaagaaccgagattcttgtcttatgtggaggatttccaaatgttccctttaatggggacgaggggttgcattaattataatcccatcctcgccataagacaactgggctaccccatgaggggggcaccatcagaggaaggcctcacaccttttattgcacgaggtttcaatagccccaacgcgggggtgcttcagggggtccgcaaggcatgggaaatggtacaaaagaaggacaaagaacttaggggaagtagcaacggggccatcaacggctaccgtaggtggttgaaagcctacgcacaaggtctggattggctcccgaggttgagagccgctaaagaggtggaggttgaagccctgaaagaaagcgaagaggtacaagccctcagaacagagcttgagaaagcccaagcggtcaaggaaaagttcaagtcaacggccgttaggatctga

SEQ ID NO: 83986 - DNA, 387 bp, Glycine max
  Peptide Sequence Number=SeqID_175671
atgattcatgggaagcctccaaactggagaaagaaaggaggaagtgatggacttgcacttcaagctagtaaccaaaaaattaagattgcagatggctcttttccagccattgcaggaaaaggttgtgttgtcatatccccaacactcattctccaaaatgtcttgcatgttcctaacttatcttgtaacctattgtctgatttgaacttagggaggacaattggcagtgctaaggagagtggaggactctacctttttgaaaatgaaatagcaaacagactcattgattgtgaccgaatttggaaaagaaaggtttacatgaggagaaacaaggaagttgaatatgcgcaaactctcctgttggacaagtggcctcagatatcttaa

SEQ ID NO: 83987 - DNA, 531 bp, Glycine max
  Peptide Sequence Number=SeqID_175672
atgggagggtacatcccttgtggatctttgcttgtaaaggtttttataaggttgaaaagaaatctcaaggaccgcagggcacttgatccaacaaagggatcctcctcctccactgcggcaactacgacacctcatcctggagcccttggagcatccccgacaccaattccaccctctttgtcatcctctacactgttttcatctgatgaacagcgtatccggtactactctctctttcaatctcatcaaattcttgatcccaaatatcttgacctagaattctttgatagggaagcatttgattgctatcaagtgtttcaaaacactggtctgattccatttatgtcattaaaattaccacattatcctaaattagtccgagtcttttattcaaatttgcaaattcagggtagcacatcaatttctgaggtgcatggcatatcaatggttattgatgaatctgttttcttttcattgacacatctgccaagtcaaggtgcaccttttgagggcactattgttgatgactag

SEQ ID NO: 83988 - DNA, 147 bp, Glycine max
  Peptide Sequence Number=SeqID_175673
atgtacttcaaggtggcagaagacactgttcattatggcggatctcttatgatatgtctagctgggccaactcgagcacttttggctgcaacaattgggaacatcctaggatattcttcaagtgctagtggaaagtggaacaagtga

SEQ ID NO: 83989 - DNA, 477 bp, Glycine max
  Peptide Sequence Number=SeqID_175674
atggataagagcttgaaggtaaaagaagatgagaggaaggagagggagagaaagggggatgaaatttatgcctcaaatgagataagtgggctcatacagaacttagcccatgggtccaaaatctaccctaaggctcatgagaaccctagtgccttctcctgcatctctgggctaatcttggtgttttctatccaatgccctcgagaggtaggattgcatcacatctactccaatacttgcaaaattgattgcaataacataaatgagataagggaagagagaatgcaaacacagttttatactggttcggccacaacccgtgcctacgtccagtactcaagcaacccacttgagatttccactatctttgtaaaatccattacaaagtctgaaccacacaggaacaacccatcccttgtgttcaggaatcctttacaacaagagactcacagtctcttaaccaatctcattgaataa

SEQ ID NO: 83990 - DNA, 339 bp, Glycine max
  Peptide Sequence Number=SeqID_175675
atgggtgttaagcatctcaactcggctggcaagattttaaatggttgtaaacaaacgtccccagacgaaattagggtattgtcataccctaatttcgtccggggacctttgcttgatgacatgcgacttttgtttggtccttgcaggggggtgtacttagtaaaaatgggggtgcaaatagcaaccaggcccacttgggccctccagaagattcctccagaaggctgttgcttctggaggaagcaaccctgctcgcctgggcgagctgggcggcaagcatctctcctattttgctataataggggaggaagtgagaaggaaaagggttcagccccttag

SEQ ID NO: 83991 - DNA, 297 bp, Glycine max
  Peptide Sequence Number=SeqID_175676
atggtgacaaaaagggttaagaaatatgagaaaatgatgacacatggccagttcagcatcatgtatgagggccccaagaaagaaattctacagaaaggagttgattggcttgcttcagtgattaaaggaactattttcaaagaggaagaaaggggtcatccaaagccaggtgatgtgaccattggttatgatccatatactattggattccctacaccagtgcgcacacctaagcttttaagttgttggcgtgctggggatgccacttctaaagatgttgttggggtcattcagtag

SEQ ID NO: 83992 - DNA, 216 bp, Glycine max
  Peptide Sequence Number=SeqID_175677
atgataaatgcaggaatgatatgttcattacgatgccatgaagagatgcatgatgcaatcaaggaacaagccagaggactatcaacgacaatgcatcacaaaaataggaaaactctagatgaggcttcactattatcaagcgagtcgaagactcagcaagaccacagatcgacctccactccttatggctcacatagacctgggtataggtcctaa

SEQ ID NO: 83993 - DNA, 825 bp, Glycine max
  Peptide Sequence Number=SeqID_175678
gagagctcgcccgctcggcatatcttctcaggacattgccgcagcccttcaacggcgcaataccgttacgcccgctggctcaatagatacgcagggtccgcaggtgttcattcgtctcgatggtgcctatgacagtgttcagtctatcgctgatacgcccatcgtcgcttccggccgcgcgttgaagctttccgacattgctgaggtacgccggggttatcaggagccggcaagctatgtcatccgtcatgacggcgagccggccatcatgctcggtgttgtcatgcaacagggctggaatggtctggagcttggcaaggctctcgaggagcgctccagccggatcgcacagtcgttaccccttggcataacgctgacgaaggtcagcgatcaggccgtcaacattgatgcggcggtgggtgaattcatggtgaagttcgccatggccctcggcgtggtgctcttcgtcagcctcattgcgctcggctggcgggtgggcatcgttgtggctctggccgttccgctgacgctcgctgtcgtcttcatcatcatgctcgagacggggcgcttcttcgaccgcatcacgctcggtgcattgatcctggcacttggcctgcttgtcgatgacgccatcatcgccatcgaggtgatggtcgtgaaaatggaagagggcatggaccgcatcaaggcggctgcctatgcctggagccacactgccgcaccgatgctgtcgggcacgcttgtgaccattatcggcctgatgccggtcggattcgccgcctctgcacccggtgaatatgcgggcaatatcttctggatcgtcgg

SEQ ID NO: 83994 - DNA, 174 bp, Glycine max
  Peptide Sequence Number=SeqID_175679
atgaatttgtggtttcacatcaacaagaatgtcaaggccaaatgcaaatcctcaattggtcaaaaacatgcttgggaatatgtcatggatgcctggggtagtctgattgattgtccttctgaacaacaattcgctgagtgccttcagaagtttcaaatggcttgttcaccttaa

SEQ ID NO: 83995 - DNA, 258 bp, Glycine max
  Peptide Sequence Number=SeqID_175680
atgaccaaacttggtctctgcttgtcatcgggcccgccgcctctggatgacaaaaggggagtgcgaataaccataagaatgaccaaacttggtctctgcttgtcatcgggcccgccgcctctggatgacaaaaggggtgcggataaccgtaagaatgaccaaacttggtctctgcgtgccatcgacactactgtgtctgaatggcaaaggggtgcggataaccgtaaagtatctccgcgtatcatgggtgcagaatga

SEQ ID NO: 83996 - DNA, 167 bp, Glycine max
  Peptide Sequence Number=SeqID_175681
ggagaccagtcaggatcacgctgtttgcgagaatgctccaaccatgtgggatcgacataggcttaaagaaacactcaaaccgggtgacccccaaggcctacactccgaagagtccgttagggcctctccctcctgattcaggtccaacccagacaaaaaacatttga

SEQ ID NO: 83997 - DNA, 330 bp, Glycine max
  Peptide Sequence Number=SeqID_175682
atgcaatcacagggacttgcactgcctctggagcctgaggttggtccctcagctactcgtgttagcacaaaggggagctgtgttgatccctcagggaacgatccagagataggtgactcagataaatgtgggttgtacatcgaagaaaatccttctcgcctggttgccttaggaagagtttatgagggatccacaatggttggtgttgaggaggttaaagatgcagatgctcccgttcctgtacccactgacgaggttcaactagtggggcagacactgaacaccttcctagcttggccgacacatctcatgaagtgtgtatcagaatag

SEQ ID NO: 83998 - DNA, 760 bp, Glycine max
  Peptide Sequence Number=SeqID_175683
tcttccaaaatccattggtaagctccagaatttggagaccttggatataagagccacatatgtgtcggagatgacagaggagattacgaagcttaaaaagctacgtcatcttctggctaattctagctgttcaattcaatggaatggtattggaggcatgacatccctacaagaggtacctccagtgaaaatagatgatgatggagtggtcattagagagatgtcactcttggagaaactacgtattggtaccgctgatgagagtgaagtaattgacttgtaccttatgtcacctatgtctacacttaggaagcttgtcctatgtgggacgttaacaaggttgccaaattggatttcacagttcccaaatcttgtgcaactgtatttgggcggctccaggttgactaatgatgcattgaaatcactaaaaaatatgccaaggttaatgtacctctgtttcgctcacaatgcttatgaaggtgaaactttgcattttcaatgtggagggtttcagaaactaaagctactgttccttgcatatttggataagttgaagtgcatccttatcgacagaggagcactgtgttctgtggaaaaaatttctttagcagacctctcccaactcaaaaccgttccctctggaattcaacacttggagaaacttaaagatctcataatccactccatgccaactgaattggagcagcgcattgctcccgatggaggagaagaccactggatcatccaagatgtgccccat

SEQ ID NO: 83999 - DNA, 267 bp, Glycine max
  Peptide Sequence Number=SeqID_175684
atggctactattgcattattgagtaactatgggaggtggtgtttggccttggatatacaacaagcgggttttgtggccgatttaggggtgacctttgtggatgattggatgttcttggttggtagggtggtagccttgtttcaagattcactaaagatcaagccttgccttaaaacaaagtgctttcaagacatgcaaggctctggtaatcgattaccaggaagtgtaatcgattaccagaagacaaggttgagaaatagctattga

SEQ ID NO: 84000 - DNA, 216 bp, Glycine max
  Peptide Sequence Number=SeqID_175685
atggcttccatctcggaggtcatgttaaaactccagaaaaccatagaggataaagccaccacaaccgcctccagtacagttagggaagcggagctggtgctgcagctcgccttgaatccgggcctagacagaaacacggccatgttcggtcgaagatatgagggtcgattctttgaggatcctaacaacgagggtttgacaatcgatttcgattga

SEQ ID NO: 84001 - DNA, 621 bp, Glycine max
  Peptide Sequence Number=SeqID_175686
atgagaaaatctgttgagagggaggatcccacttatgagtgccaacaggtcccttggaggatattaaaatccccttggccggaagcagatatacttatttgcaatcgtatgcaacaacaacaattattgttgagaagtcttacagtcattgcgaatagccaattagccgccaacaaaatgataatattctataaaaaggttgaatatgtgcttgaagattgtaatgaggttctcgtcaaaatcaacaaatttgtcgtcaacaaagaaggcttagtatgtgtggaaacgttgtgtatgcctgttactaaaccagaaagatttgagttggatgcttttgagttagatgaacctgaagatgctggcagtaaatgtaatcttattctatgcaaaagacatagttcgtttccctttccaacagaatgccaccatactttacttattgcacactgtgtacagaggcagagagaatctcccattacttactgtgcactatgttgccttgaaattgtggaaactccaaggatgttagatgtacctgaatctcaggattttgacattccaatttttattgagataaaatccttttggaatctcccgaaacaaatgaagtgcctcatttga

SEQ ID NO: 84002 - DNA, 255 bp, Glycine max
  Peptide Sequence Number=SeqID_175687
atggaaacaactaagcttgttggccttcctcaaagttgtcatgactgcagacaagaagtgtcgcaacatgcccttttgcgggcgtgcaaggtgaggctcacgggtgtgctttccaaaggaggaaagatgcgcggagtcgccaccaacgaaggtattagcacctctcacgtcgacaaaagcgggtctcttgctcctacgtaccctccatcaaagaggaaatcagacctacgtagttcttccttatgtgtgaatcaa

SEQ ID NO: 84003 - DNA, 317 bp, Glycine max
  Peptide Sequence Number=SeqID_175688
tgggctaagcgcgcatccatcgctaagcgcgctgaagctacgcttagcgcgacagaagaatctggtagggcatcaacatcaagggcgcacactaagcacgagatcaatgcactaagcgcagcagactttaagcagaggattggcacagattctagagcacaccgtagtgtctacttcgggaaaagagctctggaggcagcaagaggagcaacttttgcaaagatacctaggattcacaatgtcggatacaatgtccaggacatcctgcctgaaaatactggaattgctaaaagcattgaagctgcaggatccacgat

SEQ ID NO: 84004 - DNA, 474 bp, Glycine max
  Peptide Sequence Number=SeqID_175689
cgaagtgtggatactcgaggcttagcgcaacgtcgggaaactgttgatgcagcaccatacagtttccctccgatgccagaacgacaacatgaaatgtattgcacaccgcagacattcacccaagaattgttgcagatgccgccgatgtattcatacacacatgatttacaaccagggtacaatatgacagacatatttgggtcctctcctccttcaaggggaactccttcatttacccaaagtgatgaactatcaaccccaaatgccccacttggtggtccgtggaatgtacttggaaatatactcgacatggatgacttattaggggtcgatttacgtcatgatttctctgttgaggctgaccaagtggatgaaagggtgaatcatagaagaagaaatcctgatagggcagctaggaattggggccggccatgtgggactttgtcgcggcatcacagacatagtgatgattga

SEQ ID NO: 84005 - DNA, 477 bp, Glycine max
  Peptide Sequence Number=SeqID_175690
atgaccatgattacgccaagctcgaaattaaccctcactaaagggaacaaaagctggtaccgggccccccctcgagttctccctgtctgggcactcaccacatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 84006 - DNA, 414 bp, Glycine max
  Peptide Sequence Number=SeqID_175691
atgggagtgctgtggggcgctaagctttgggaggagcgatacgtgagacggatgtggccagatgaatttgcctttctgctggacgatgcggaagaggtcgacttgcatattccaccggtggcacatgaggatggatcgccgggaaaaaccatttccaggaaagccttgaaagttcgtatcagccagcaggacttcgagaaaatttggccgcttgccgaggctcgctatcggttgaacggcaggtttgcgggcaaggccattacgctgatcgccaataatccccattaccagaagtggcatccctccgatggcggcagtgtcgaaagcgtgtcggatagcggtcaaaaatataccacgccttatgtgatcgtgcactttctgctggatgatgtccgcgagcctgtcgaggtttag

SEQ ID NO: 84007 - DNA, 156 bp, Glycine max
  Peptide Sequence Number=SeqID_175692
atggaccctaagaaaataaaggtcattcctgagtggcttactccaccaagtgttgagggaaaaattaatgagtttcaagaacctctggatttgaggtcaaatccttttcaagggggagggaatgatgcaatcctaccccccaagggcattggatag

SEQ ID NO: 84008 - DNA, 261 bp, Glycine max
  Peptide Sequence Number=SeqID_175693
atgaaaaagagtttacatcaactactcaataagaatccccaactgagggttttagcctttcatggaaaaaaagctccttttacactgaagaagaggaatcaagagaaattgcttgcttacaaaggagtggggatgtctcctccacctctaggaatctcacaatcactcaaaaactcactaatctccctaaaagatgaaaacttggcccctttctctgctctacgctctttgaaaatcacactctttcaggcctctgagtag

SEQ ID NO: 84009 - DNA, 189 bp, Glycine max
  Peptide Sequence Number=SeqID_175694
atggggagctcaattggtgtttggcgcacaatggttaggtgcatgggaactccaatggggttgccgtccccaccgttgtgtagtttggtggatggcaatgctggtggtggggtcactggctggaaaggagttcggcgagacagaggggcagtgggtctacccggcaaaatcagagacatattagactga

SEQ ID NO: 84010 - DNA, 519 bp, Glycine max
  Peptide Sequence Number=SeqID_175695
atggatttctcttcgttaattagtctaacccgcaaaaaggcctacataacttgggaagacaatgtgttagcatcctctgactattatagtgaagaagaagttgtaaatctatgcttaatgacggattcaaaggatgactcatcaaccattgaagaaactgaggtaaattataaatttgaggaagttttggaagcctttaatgaaatgcatgaggaagcgcaaaagcttgttgtttcaaacaataagttgagaagcgatctaaaatggcatatcactaaactggcttcaacacaaagtgagcttgataaattgaggcaagaaaatgagaaacttgtttcaagttataaagccactggttgtgtttatgcttctacttctcttaacatggatgattacaaatctatgcaaaatgagtttgaaaagtttaaaaaggatcactatgaagaacatatgaagttgcaaattgagctttcttatcttaaagatcttttgagaaaaatgaataaaggaaaaaagtaa

SEQ ID NO: 84011 - DNA, 405 bp, Glycine max
  Peptide Sequence Number=SeqID_175696
atggataagagcttgaaggtaggagaagatgagtggagggagagggagagaaggagcagcaaattttgtgcctcaaatgagtataggtgccctaaaatacaagggctgaaaaatcctacattccgagggtaccctacctacattatggagcccttgtctaagcctttggagcttgtacataagctccctttcatagtaggagggaatgtgcctcttcctaagggcactcttaagatcattccaatactctaccggaggatccccgtgcatccttcattccctaacaaggaaagtccaccaatagaaggcatacccttgaaagctaagggtagccaatggaatttttctctctttgctaatatgatggcaaacaaagagttgtttaaccttcatttcccaatctaa

SEQ ID NO: 84012 - DNA, 1908 bp, Glycine max
  Peptide Sequence Number=SeqID_175697
atgaggttctatcaagtcaaggtcaagagcctaaggaccaccaatctaaaggagttagggcagttaatgggtcagctccagcggcaagcttttcgcaaagcttacggtaaaatctgggacttagccatggtagaagtctccacagaggccattgcctcccttgcccaaccacagaaagcaagtaaaaaatggggtggttggaataccgagaaagtgtttggaggcaaaagcaagaatcttggcaggggagtcttttttccgaatgtggatgggttggtggacctagcagcgatcgacatttttctcgcctatcataaccacaaggaaatcccggttgtcactatgctagccgacctatatgacaccttcgaccgaagatgtgaaaagagcaatacaaggattgtttgctgtactccagctctttatgtatggttagtttcacacttttttcgccaagaggagcatctgccaactggttccctcgatggaaggaaggaagaaccggagttcttttcatgcggaggatttccaagtgttcccttgatggggacgaggggttgcatcagctacaatcccattcttgctataaggcaacttctctaccctatgagaagggcaccactagaggaagagctcgcgcctgtcatttcacgaggtttcaataagaccaacatggagacgcttcagaaggtccgcaaggcatgggaggttgtgcaaaagaaggacaaagaactcaggggcagtaacaatgggcccatcggtggctatcgtaagtggttaaaagcccacgtgcaaggtttggattggcttccaagtttgagagctgctaaaagagaggaagttaagacaccggaggaagacgaagaggagaatgccgaactgagagatataaatatagctaccaccaaggctttggaacaagagaccaagagggctcatagggaagagcacgggcggaacaaattccgaggggctctgtggggtagcaacagcgagcttaaactccgaagagaggaaagggaccaatcacgagtagacagtttgatcttgaaagatgaattgaaggtttgctcaaagtccaaaagaagtttgtctcagcggttatgcgagacagagaccaacatgttagctattatcaccaagtaccaagaagaactaaatctagcagcggcccacgagcatagagtggcggacaagtatgcccaagtgtacgcagaaaaggaggctagaagaagggtgatcgactcgttacaccaagaggcaacgatgtggatggaccggtttgctcttaccttgaatgggagtcaagaacttccccgattgctagccaaggccaaagcgatggcggacacctactccgcccccgaggagatccacagacttctcagctattctagactaatgagtgaagtagaggaggtgcaagaacagatcaaggctgacatgaaggccatgaaagagaaaatggccacaataatggaggccatgatgagcatgaagaagataatgaaagccaatgcggttacagttgccgctaccagtgttattgctaaggtgaacccaatgcccccatctggccttaaccaaatgtatcatccaaccttagatatggtagtcaaagatttggaaactaatgtggcgtacactcccaatgagaatgtcaataactccactcctatactcattgagagccaacaacctcaatctggtcatgtccatgtctctcaaaccgtggagcagacacatgaaattccccaccacaatctagccgacttcgagccttgcctcggatatgccactgaaaggcaagcagttgcccctcctgctatggctgaaaagggaaagttggatcatatagaggaaaggctcaaggacgttgaaggaggcgaagattatgccttttgctaa

SEQ ID NO: 84013 - DNA, 1116 bp, Glycine max
  Peptide Sequence Number=SeqID_175698
atgggttgcctttctgggtttttgttcatccctacttctagaagtgcacggttcttttggcttaggactgatcagattcgttgcaatttatcgatgataactttcaggtggtttactcgtgcaatcctttatgcaaatcatatgcttgttatatttgtggctttgttgtggatcacccctttggctgggatttttataaataagggaaatggtgtggtaaagagtggatttggtaatgtcgagaaattggcagggaatgtgggttgccttctgattttggtagctttaggaagtggagcttgttggggtctggttcctgacttggattatagtagggcaaagatgtttctgcataatcgctacttgtgccttgtggttttgcaattcctttgccctcctgtgttggcgcttctctttcttggattgtctcatattgatgatgaggatacaatagctttaccagtagtgtactacaatggggaggtgatcaccaacgaggctaaaaatgcagctcctaatggaaaaatggtgtcagaacctcattttcgtttccctgctgtaaagggaaacttgtgcatcaaatacacatcaatggacttgttgattaatgataatgttgatcttggatgcgagttaaacgagttggtagtccttattgatgttatcggagagggctatttcttcatcaacattgaaatgtattttgaagatggcaaacctgttccatattttggatgtgctaacagcaccacaaaattggtgaattctctcgaccctgagttcgatcaggccaacactcgcggaaggaacaatgggcatcaacatcagccatctctaaggtggagagtcttcgtcgattctacaatggtagagttgaaactctctgagagtcgcgatctgatccgcatagagcacatagagcactcgcacattcgtggccttggcctggactcctccctagagtcatgcaccatcttggacgacatgggtggtggattcatgaatggaggtctcccaatcggcgacaccgtcacggagggagtggcggtggtgggaagaggaagcagaggatggcgagggagatcccaagaagaagagtacaatgaagctaagtaa

SEQ ID NO: 84014 - DNA, 189 bp, Glycine max
  Peptide Sequence Number=SeqID_175699
atggggtggttggagtatcgaggaaatgtttggaagcaaaagcaagagtcttggcagccgatctatatgacaccttcgactgaagatgtgaaaacagcagtacaaggattgtttgctatactccgaccctctacgtatggttggtttcgcaccttttccgccaagaggttagacatgcttgcccgctag

SEQ ID NO: 84015 - DNA, 639 bp, Glycine max
  Peptide Sequence Number=SeqID_175700
atggaaaatttcctgaacgactacatggtttttgttaacaacaaccctacatacacaacccttgttttcgtataccctccacccactactgaaataaaggccttctaccttccatattggccatctcacaacaccttggcagcactttgtgcacagttccaacaaggaggaagcaatgaaatggcgccagcacttcgtgcacacatcccacaaagtcaaaggtcctgtgcatgtcatccattccaggaagagttgcatcaacaacatagggccaagacatgcaaatttgaaaagtttcttatggaccaaagtatgcctgatctattgtcacacatatgcattgtgcacaactatcctctaccttcatacacctttcatgatacacttgagcacgatggcatgaaagtatttaggtatgtaggcatgttacaaatgccaaactttggacctcttgtttcgttaagcaactatgcttgtaacatatttgacgtcaaagaagaaattcctgccgatttgatatggaagagccttaaggctgaagttgacaagtcaaacaatgctggatctggacttgaaatgaaggttgccctattgagaggtagactaaaacaacttggttcaaacagggagaatatttag

SEQ ID NO: 84016 - DNA, 439 bp, Glycine max
  Peptide Sequence Number=SeqID_175701
aaaatctaagccgaggcgcttccgaatcgtttccgtaacgttttccgtgaggaatctcgcaaaggtttcaaccgttcttcgacgttcttcattcgttcttcatcgttcttcgatcttcaacgggctgccgtcccttggggcggacgtgtggggtgctaataccttccccgtgcgtaaatacaactcccgaacctttcacttaaaagttcgtagatcgcgtcttttccggttttttcgacgttttcctcaaataaacgttggtggcgactccgcgcgtattcctttcgtggaacacgcatcccgcgagtctcgcgtcgccctcccgccgaagggcatttctcctccgctagccacgcgttccaatgcgaggcaaagaacaagggggtgtgtggtggaagcacatgaagaagaaggtagcagtggtgatgaacgaggttag

SEQ ID NO: 84017 - DNA, 315 bp, Glycine max
  Peptide Sequence Number=SeqID_175702
atggaagtcgttgtatcactcacccaatactatgaccagcctttgagatgcttcacgtttggagacttccaattagtaccgactgttgaagaatttaaggagattctaggatgtcctcttgggggaagaaaaccgtatcttttcttcgggtttcttccctccttgagcaagattgctattgtggtcagggattcagcaagagagttggatcgtgaaaagcaaactcaaaacagtgtagtgggcctacctcggaagtacttagaaggcaaggcaagggatatggcgaatcaagaggagtgggtcccgtttatggac

SEQ ID NO: 84018 - DNA, 510 bp, Glycine max
  Peptide Sequence Number=SeqID_175703
atggaaggaaggaaaagagggggttctcttctcaggtggggactacccaaacgtgtcgttgatagggacgaggagttggtaccccatgaggggagcaccgacggaagagagcctctcgcctttccttgtgagagatttcggcgcgcaaagtctcaagattgtacaaagagtccacaaggcgtggaaaagcccgataaggaagaacttaggggcattcgtaatggcatcatcggtggttatcatgaatggctaagagttcatacacgagggttagattggctctccaagttgaaaattatcaacgaggagaacttcgaagctccggaagaggatgaagaagtccaagctctaaaatctgagctaggaaaggcaagactcgccaaagaaaacttcaagtcagccgctacaaacatccggaaagagtgtgccgagttacgagaggaaaatgcgactaccgcaaaagcccttgaacaagaaaccaagagggcccgcaaggaagagcatggctga

SEQ ID NO: 84019 - DNA, 432 bp, Glycine max
  Peptide Sequence Number=SeqID_175704
atgcataaggcattgcgattaaatgctctattgccatatccacacctagtcactatattccttcaacactttaacatccctcttgattctgaaccttatgttccaatcaagagatccttcttaatcggtgccgctgtgattgcatcttttggttaccgtaaagagcatgatggctcttgggtaaaaaagggtgctcaaccctttgatgaagaaggaaacttaccagttggagaggattactctcttcttcaaagaattttggacaggttcgatggtcttcaaacctttgttggtgaaaggtttgatgctttggagttacaagtggacatgcgattcgatgagatggattcaaggatcaccaaggttgaaggagatgtctcttacatctgcacatgctttgatctaccaccgccgccgccaccatcatcttag

SEQ ID NO: 84020 - DNA, 426 bp, Glycine max
  Peptide Sequence Number=SeqID_175705
atgacccaagagctggtagcccgcggagacaccttaccgttatccgcacctcgtcattcagtgatcccaagtgtgattgatgagcagaggccaatgtggtcatctgcgccctttccggagatgtcagcatcttccggtggagactttttcaagtctcacaagttatctagaactacagacaaaatttggtcattctgcaccttttgtcatccaaaggcggcgggcccgatgacatgcaaagacaaaatttggtcattctgcacctttatgtcatccagaggcggcgggcccgatgacatgcagagacaaaatttggtcattccgcacccctttgccattcagacacagtcgtgtccgatggcacgcagagacaaaatttggtcattctgcaccctttttgtcatccagaggcggcgggcccgatga

SEQ ID NO: 84021 - DNA, 927 bp, Glycine max
  Peptide Sequence Number=SeqID_175706
atggcgcgacgtgtcacgcagatattcctttcatgtgatgccgctgataaccgcacgagtggtagcggcgcaatttattgcgcgatgcctttcaattgcgcgtctcaggtcaccatgaatggtgaccctgcagtctctgcgcgtttttgtagggtgcgcaattttgcgcaccgacataggcccattctggcattgcggggagatccaatgttgagcttaaagaatatgaaggtcggcgtccgcctgggcatcgcctttggtttagtggtggcactactggtggtgattggtattacctcaatcatgaagatcaacaacatcaagagcggcattacctcgattgtggaagatcgctatgtaaaagtgcggctcggctttgacgtgcgcgatggcgtcaacgatcagatcaaatacctgcgcggcatcgtcatcgataccacccgaccgcagttcaacgtgcagcgctttcagcagctggcagacgccaccgcccgcaccaacgcggcgatgaagaagatcgaagcgattcagattaccgccgtaggcaagaagaaaattgccagcctgctggctgccagtcagcagtttgaacagcagaaaaatgaggtgctggatctggtgcgggccggtaaagccgatgacgccagctactacgtgctgaaaaaaattaccgccgtgcagaatgcctacctcgacctggcggtggcgtttgctgattcccagtcctcgcagctccagcaggaaggcgccggcattatcgacgatggcaccacggcgattgaagtcacgctggtgttctccgcgctcgccattctcgctgccgtggtgatgggctggctgctgacccgttcaattgtgcatccgctgaatgaagcggatgaccatcgccagcaaagtggctgccggcgatctcagcaaacgcattga

SEQ ID NO: 84022 - DNA, 315 bp, Glycine max
  Peptide Sequence Number=SeqID_175707
atgcgggggtaccgtatggttatccacacctttcttcaaccaggggcgaacaaacccattgacgcacagagactaacgtcgtcttctgcacctttcgtcaaccaggaggcaagcgagcccgttgacatgcagagactaacgtcgtcttctgcacctttgtcatccagagacagtgagtccgatgaaatgcagagatacccaagtggttatccgtacaaaacaatttctgttaatcctgacccgagaagtctgggagcaggcggaaataccccaagtggttatccgtacacacagttttgctaccccgacttgtga

SEQ ID NO: 84023 - DNA, 216 bp, Glycine max
  Peptide Sequence Number=SeqID_175708
atggtacatctcttgtggatcagttcaagtggagggtacatccacttggttgttcaaagagaacaaggaaaggccttggatcttcttcataaatggagtcttttgcttcttgaagatcaatggaagtggaatggagaaggaggaaaggtgattggagacaccacttcaaggagaagagtcaagaacatgctcaccactataggaagctatggataa

SEQ ID NO: 84024 - DNA, 159 bp, Glycine max
  Peptide Sequence Number=SeqID_175709
gtcgactctagaggatccccttctcccttcactcctccccctatttatagcaaaatagaggaggagcttgccacccagctcgcccaggcgagcaaggttgcttcctccagaagcaacaaccttctggaggaagaatctggaaggcccaagtgggcctga

SEQ ID NO: 84025 - DNA, 172 bp, Glycine max
  Peptide Sequence Number=SeqID_175710
gggttgctcgcccaggcgagctaacctgccacatttttttaggggaaacataaccatggccctctacaggacgctaggctgccttgcagcgacgttttccgcttgtccagcgccgggaagggacgatgatctgtcggtcgtgaccctatcctctatttgcatccgtccctaa

SEQ ID NO: 84026 - DNA, 183 bp, Glycine max
  Peptide Sequence Number=SeqID_175711
atgatgaaggaagtgatccacgatcacaactctgcagtgcctcgactccactttccctcttctccttcttcttctgcatttttctctctggggaaactcgcccaggcgagctgcttgcttagggctgaaggtatcagctcacccaggcaagttggagctcgcccaggcgagtggcttgcttag

SEQ ID NO: 84027 - DNA, 165 bp, Glycine max
  Peptide Sequence Number=SeqID_175712
atgatgatgagctcactcctcctgagccttttgattatgatgcagattccagagccatctccagcccctacgcatgcacctaatgatgccacaccagtggtggagcctgagcagactattcaggattttttagcagctccagcactagatcttaatgaagattag

SEQ ID NO: 84028 - DNA, 569 bp, Glycine max
  Peptide Sequence Number=SeqID_175713
atgggggataagcttcatcgtcgagagggaaacagcccggatcaccagctaaggcccctaaatgaccgctcagtgataaaggagatgaacggggctaagcgatctgccgaagctgtgggatgtaaaaaagaatcggtaggggagcgttccgccttagagggaaggacccgcgcgagcagtgctggacgaagcggaagcgagaatgtcggcttgagtaacgcaaacgttggtgagaatccaatgcctcgaaaacccaagggttcctccgcaaggttcgtccacggaggggtaataaggggtagagaaaatgcctcgagccaaagttcgagtaccaggcgctacagcgctgaagtaatccatgccatactcccaggaaaagctcgaacgaccttcaacaaatgggtacctgtacccgaaaccgacacagaccatgtatggcccccgacgcctgcccagtgccggaaggtcaaggaagttggtgacctgatgacaggggagccgacgaccgaagccccggtgaacggcggccgtaactataacggtcctaaggtagcgaaattccttgtcgg

SEQ ID NO: 84029 - DNA, 348 bp, Glycine max
  Peptide Sequence Number=SeqID_175714
atgatcgtcattgtcaatgcggaagcttgtggttacgtgagcatgaactactaccaatatatagatgttgtttatacaaacgagcacatcttaaaagcttactccgcacaatggtggcctattgggaatgaagcggctattcctccttctgatgatgcatggacacttatccctgacccaactacaattcgtgcgaaaggttggccaaaatcaacaaggataagaaatgagatggattgggtcgaaccatctgagcaccgaacaaaatgcagtagatgtggagccgaagggcataacaggcgtcgctgtccaatgcaatttgagcgtgggagtttttcaaatcgttga

SEQ ID NO: 84030 - DNA, 120 bp, Glycine max
  Peptide Sequence Number=SeqID_175715
atgaagcacttgaagacttatcaaggtaatccttgtggtgtctaccctgacttatcttccttcaccggaagtggcgtcatccaaatatccgtagcctgtatcaagcgatccgcctcgtaa

SEQ ID NO: 84031 - DNA, 364 bp, Glycine max
  Peptide Sequence Number=SeqID_175716
ggaagagaactttgtagaggttgaagcttatgaggaaagtcttgtagaagagcatgattcaagagaaaaagataaagaaaaaagtgagaagagaacacaacaacaatgggagaagtgctcacaagtagaaattcaacaagaaagtattctccgagtcaatacccctcctcatcaactgattggcaaggaagaaaggcatgaagaaccttataaatctttaagtgccattctctcctggatcactagcacttctcttactatgatatggaaggctttttttggatacatgagtttcatggagtctctagccaagaggcgaaagtgcaaggaagatgtgttctatgtgacctttatgccaccttga

SEQ ID NO: 84032 - DNA, 723 bp, Glycine max
  Peptide Sequence Number=SeqID_175717
atggggtctgcattggacgctgtgatcgaatgtttcctgatatgggggttattggagctgcggcgaggacttgaggagactttccagaacgcgtgggacagcctctgtgccagagcacttgttttcttttccactaaggataacagtatttgggatttgtacctgcagatgaaaactgcagtgatgatattgagaaacctggaggcacttgagcatattattaaagcaggatggaggatttctaagttcttctgttttgtacacgttacccaaacctatctgatcgcccctgctgtgatctatggtcctagcatgcttcctacaatcgatttgaaaacagctgtgttcttaatggaaaagatctcaccctggtttggtaaagttgcttgtggagatattgtagtcttgcgcaatcctcaagaccctaggcgcttcatgaccaaacgtgtggttggattggagggtgatagcattacatacatttccaatcctgagacctatgaattggagggtgatagttttacacacatttcctctcttgataacagtgataagtctaagactattttggttccaaagggggccgtttgggtagagggagataataagtataacagcaattattcaagaaaatttggtcctgttccttatgaccttattgatggcaagatgttctggaggataacaccacttaaaaaatttggacctttctggaataaatga

SEQ ID NO: 84033 - DNA, 115 bp, Glycine max
  Peptide Sequence Number=SeqID_175718
atggtgatggagaagaaggggagaagaagaagaaaggggctgaacggcgctagggcctgtgtgcggaaggctgagatcaagcttatcgataccgtcgacctcgagggggggcccg

SEQ ID NO: 84034 - DNA, 648 bp, Glycine max
  Peptide Sequence Number=SeqID_175719
atgcaagccaatacctcgaatcttcttgacatttatgtgaaatcaacaaaaggagaagatgaagatcatcaacttataggccagggccctcctcctcaaccgcgacctctcttttgccaagatcactactccgcgctgggcgttgggcccagcaagacaatctcggacgatcagtcgtggttgagatccaagttcatgcttagaagggcagcaggaggagggattagctgtcagaactgcgggaaccaagccaagaaagattgccctcacatgtggtgcaggacgtgctgcaagagccgcggcttcgattgccaaacccacgtcaagagcacttgggtccccgcatcacgcctccgcgaacgactacaacaactctttgctttgcaacaaaccctcgaaccacctttttctggaggaggcaaaaccctaaccctaagaggaaggagagaaaagggattactaacatatctgagggccagggctgccgtcgccggtgagagagtcgaagtcagtgccaaagaggcgagtgttgcggttggcgtcagtgtcctagtggaacccgcggcccttggtcttcttcagtcaccgcagtttcatccttgtttttgctcattgttcgaggtcgaggggtgtcgtgcgtgtggataa

SEQ ID NO: 84035 - DNA, 282 bp, Glycine max
  Peptide Sequence Number=SeqID_175720
atggaaggaaaccaagggttcttgcgagcaagagttagacctagggcatattttgtgaatgttaagggaactgaattgtccaaaaagagttgtattatggaaattgttcatctttatgtcgagcatcctggggcagaggctgaagttatcttccatcttctaagctgtcttgatgatgatgatatgttgatgatccacttggtgatcacattgcaagtgatcacaatgaagataatcagggggagttattttgtagaatgtggaagtgaaccagcaatttga

SEQ ID NO: 84036 - DNA, 141 bp, Glycine max
  Peptide Sequence Number=SeqID_175721
atggagttatatttcagttgtggaggggcactgcaaaggtttggcaaggcaccccggttctggacgaacgtggacccacacaatgtgctagttgatggtgtgggggtgatgcgagggagaaatctaggtaacagcatctag

SEQ ID NO: 84037 - DNA, 882 bp, Glycine max
  Peptide Sequence Number=SeqID_175722
atggagttatcttttacgcaaggtcgatggaactatgatagatggggtggatttgattcaatatcaagctgcaatgcaaagcttccaggtgttgaattgtgggcagttcttgatttccctagaccatctatttacagaagcttttaccactctcagcggttgcacttgacaatgtccacagatcattcagatgggtcaagatcaggaattaatctagaacaaacagttacagttgtactccagcctaatgaacagaaagcaggtactgaggattttagaaggaatgctggctttgaattatctgttactcccaaaagggtgcatgcagaaatggaaacgagctcctcaattctgtatgaatatccaatcaaagaatacatggagactgaacaatttgatttaggcctaacgtggaagcatccaattgcttggtctagcccacatgcacctttatatgccagtagattttcgatgggaagtgggaatgaaaggggtgctattgcaatatccttgaaatcgatccagggacttgttgcaatcaataacgttatagaaaggtgtaagttgcaagctaatgttctccaaattgtgccttggtatgttaaggtatattatcatactttgcaattagtagttgatgaaaggcctcaagcactcacagattttgttgagagaatgcgtgtttcgccttccgaagacaaagtatcacccggggtgatggagatggttctccaatttccttgtgaaatgaagtcagctgtattgagtatagtgtttgataagggcttcttacacattgatgaataccctccagatgttaatcaaggatttgacattccatcagcaataataagctttcctgacttccatgctagtttgtaa

SEQ ID NO: 84038 - DNA, 327 bp, Glycine max
  Peptide Sequence Number=SeqID_175723
atgaagagatccttcttaatcggtgccactgtgattgcatcttttggttactgtaaagagcatgatggctcttgggtaaaaaagggtgctcaacccattgatgaagaaggacacttaccagttggagaagattcctctcttcttcaaaggattttggacaggttcgatggtcttcaaacctatgttggtgaaaggtttgatcctttggaattacaagtggacatgcgattcgatgagatggactccaggatcaccacggttgaaggagatgtcacttacatccgcacatgctttgatctaccaccaccaccaccaccatcgtcttag

SEQ ID NO: 84039 - DNA, 441 bp, Glycine max
  Peptide Sequence Number=SeqID_175724
gatgtgcgcaaaaaggcacaggccatccagaagcagaacactgccccccacgttttgtctcgtgggggttatgactatttggagcagaagctcctggctaagaagaccaagaagaagctggaggaagcagcacagtcaggaagtgttgatggcgtcatcgaccctccatccccgatcagatgccgcgtgaagtggaagatggcccgcacaaagaaaacaggggagatgacgactgaggccgcaaaggaaatcactgcgaagatcgattcccttgaggaggaggcgacacagggatccttcgtccctcatggacatcaggatgttctcatcgctgttattggacgtccagagcaccctggacgtgtccgtgctgctggagccggtgtcaccatcaagcaatactttggatcggctccacagctcttcctcgctgcctcctga

SEQ ID NO: 84040 - DNA, 300 bp, Glycine max
  Peptide Sequence Number=SeqID_175725
atggggaagaacaagggtcgtcaatctcacttagctgcaaagcaaattatggtgaagggtactacctcaggttcaggcaaggtgctcgtaaaaaagacagggacaagttctgcaaaaactgatgatgtcgcacaccaagtgtttgataatttgtcgcaatgcagtgttgaatctgaatcttccccagaggtttcttgtaccttaggggacaatgattcaaccactgatgatgattcatctcactcctgtggctctaagtcatcaccgcagttagatgacaataaggctcccactccttgg

SEQ ID NO: 84041 - DNA, 405 bp, Glycine max
  Peptide Sequence Number=SeqID_175726
atggaaccttatggattacgtaatcatcccttttttggctttcggaatattacggaacctcacggattgtgtaacaatgcttcctttcgattttcggcatgttacggaacttcacggatcgtgcaacaatgctctattttgacttctggcacgttatggaacttcacgtatcgtgcaacaatgggtgccaagtacctcgaatcggccaagcaaaggttgcatgccatcaaacaatggtccccggacgaaattaggtggcatctccaatcgtctttcttccttctccattccgctgccattgaccttcaagaagcaaaggactctattgatgaagaagattcaaggcctacaagctccacatggagctacatcactaactatggtatcaaaagccgtaaattataa

SEQ ID NO: 84042 - DNA, 252 bp, Glycine max
  Peptide Sequence Number=SeqID_175727
atgaagaagatcctaggcctacaagctccaatggagcttacatcaggggatgtctcctccacctctagaacctcacaatcactcacagactcatctcatgattcttcctcacgctcagccgcaagagtggtgcgctcagcggatggctcgttaagtcggcagattagcttagcgtggcttaacgagcagatcaaaattagcacttcacaaacttgcctaactaacctgaaattgaaaggaaatgattattaa

SEQ ID NO: 84043 - DNA, 964 bp, Glycine max
  Peptide Sequence Number=SeqID_175728
gggcagcgaagttggtgtgcgttcagaatggattcccggcctgcaaagctcattggcagtgtggcagctggatattgattccgagctcctgtttgtgggcgatgccggagaaaccgaacccagccgcgccagccgccgctatggcgtagagtggaacaaccactacgtcgtcaacgactggctgttgctggatatggatctcgcgctttcaaaagcccgctttacgcacaaagaccctgcgggccaatatatccccggcgccattaataaagtggcctcaatgggtgccacggtgaccaactggggtaactggtttggcagcgtgcaactacgctatttcgggccaaggccactcattgaagataactccgtgcgctccaactccacctttctcacctacgctcgccttggctatcgctacaatccacacaccacactgacgctggatgtatttaacctgtttgaccgcaaagccagcgatatcgactattactacgaatcacaactggcaggcgaagccacgccggtgaacgacaagcactttcatccggtggagccccggtcagcaaggttaacgaatgactcacgcccgagcgatatgggcgattattcactgactatccagagacactttatgcgacgcattacaatttcggtcgaagatgacctggccgatgcctttgaccaattggtcgccgttcgggcctacgttaaccgttcagaagcttttcgtgacctcgtgcgaaaggcgcttgatgaagcagtgatggaaaatgcagatcatgcacaggccgagtgcgttgcctcgctcagttatgtctatgatcatcacgaacgccagctcgccagtcgggtgaatcaactacaacacgaccatcatgacgtcattatcactgcccagcatgtgcatttggatcatgacaactgtatggaaacagtaattctaaaaggcaaaattgccgag

SEQ ID NO: 84044 - DNA, 304 bp, Glycine max
  Peptide Sequence Number=SeqID_175729
aggatcccccgttggccgcgtgatttcggcagaggtctttgcagaagcgcgcaaaccagcctacaaattgcaaatcgactttggccccgagatcggcatgcgcaaatccagcgcccagattacagcgcactacacaccagaaaatctgatcggcaaactggtggtcgccgtggtgaactttccgcccaagcaaatcgggccattgatgtcagaatgcctggtgacgggttttcatgatgcagaaggaagagtgactttatgtgtgcctgagcatgaggttccgctggggacaaaactgctgtaa

SEQ ID NO: 84045 - DNA, 311 bp, Glycine max
  Peptide Sequence Number=SeqID_175730
gactctgccagtcgttcggagtccccgtcgcacctagcaaggcggccaaccaccgggcgcatgtacagacccatgattgtctttaccagttgagcctcagcctgcagagccagggttttacttcttttccgtgccctactccggaccagttcagggcagaggtcgcatggcctggagattggcctgaggcccgggcaggagaggcgccagcagaggcacaagcagaggctcccgacgaggcagatgaggcccgcgaggacgaggagatgaccgatttacttgatttcttaggagggagcgaggccagatga

SEQ ID NO: 84046 - DNA, 492 bp, Glycine max
  Peptide Sequence Number=SeqID_175731
acaattaaggagcgcatcatgcgtatcggtcacggttttgacgtacataaattcggcggcgaaggcccgttggtgatcggtggcgttcgcatcccttacgacaaaggtttgctggcccactcggacggcgacgtcgcgctgcacgccgcgaccgacgccctgctgggcgcggcggcgctgggcgatatcggcaaactgttccccgataccgatccggcgttcaaaggcgccgacagccgcgagctgctgcgcgaagcctggaaacgcatccgcgccaaaggatatcgcctcggtaacctcgatatcaccattatcgcccaggcgccgaaaatggcgccgcacatcccgcagatgcgcgttttcctggcggaagatctgcagtgccatatggatgacgtcaacgtgaaggccaccaccaccgagcagctcggcttcaccgggcgcggtgagggcatcgcctgcgaagcggttgccttgctgatcaaggaataa

SEQ ID NO: 84047 - DNA, 342 bp, Glycine max
  Peptide Sequence Number=SeqID_175732
atggtctcaagtgggggaattgtggcagtgctaagggaagtctcccttgagagaaggtgtttgaggatgcaacacaaatttagtgccaagatgggtgagatcacaagattggcctccaaggagctttctaaccatttggaggtcaccttcttcatgggggtagacttcctcgctagactcttcaccccttacttcatcttcacttccagtagaggaaggggaacaagcaatgtgacctctctcaagacatttgaagcatttaatgttgctagtccttgttggggaactagtcttaggggtggatttctctatggtcttacccttatcttccttgggttttga

SEQ ID NO: 84048 - DNA, 447 bp, Glycine max
  Peptide Sequence Number=SeqID_175733
atggaacttcaacgtctcaaccaaaatgaagagaccgacaaaagtaaaagaagcatagcactcaatgcctcctcctcaatgcaagaagaagaagaagaagaagaagaatctaatgatgaagaggacttctcactcattgtgaagaagtttcataaattcgttaaaaatagaagaattgagagatgccataacttcaacaatgggaagagatctcaagaaggttccccaacacttaaatgctataagtgttatcgacccggtcacataaaggcacattgccccacaaatgaatcatggccagagaagaatgagaaaaaaagccatgaagaaagaagatccaagaaggcatatattgcatgggatgacaatgactcatctgatggtttggagaaggagatcaaccttctatccaaggaccatgagagcaataagaacatctctcaataa

SEQ ID NO: 84049 - DNA, 576 bp, Glycine max
  Peptide Sequence Number=SeqID_175734
atgagcatttatgtggctcagctaatcgctgatgccatctatatatttgcaggtataacgcctaccaggcaccctctggacccggataagtccaacagggccctgggatttcctgccttgatcacaggactctgccaatcgtttgacgtccccgtcgcacctagcaaggtgattcggccgcccatcacccgagcttttattgagaagtactgcacgcagagacaggtccagggtgatgcaccacaggccgcggacgcgccgccaccacatcaggctggtccagctggatcatttgacacggagcagtatttgcggcatttggttcgccagcaggcggccaaccaccgggcacatgtacaaactcatgattgtctttaccagatgagcctcagcctgcagagccagggttttacttcttttccgtgccctactccggaccagttcaggcccgaggcccgggcaggagaggcatcagcggaggcaccagcagaggctcccgacgaggcagatgaggcccgcgaggacgaggagatgaccgatttactagattccttaggagggagcggagctacatga

SEQ ID NO: 84050 - DNA, 324 bp, Glycine max
  Peptide Sequence Number=SeqID_175735
atggcaggagttggtgacaatggtggtgtatatcatcaacaggacggatttcagcgcttgttactggacgcgatgactacacaaatgcaacgtggcaacagaagggtcaatgatggatcaaaccgaatagaggggcaagacagaattgagggagagatgaagattcagcatgcattctcatacaatgattatcctgaagagcagaaggtgaagttagcagcagctacattctcagactatgcccttgtttggtggaagaaaaatcaaagagagatgaagagagaagaagggcgggagatagatacatggactgagatgagaatg

SEQ ID NO: 84051 - DNA, 375 bp, Glycine max
  Peptide Sequence Number=SeqID_175736
atgagggttcattgttatcaagcaagtcagagacctagcatgaccacagattcacctccactccttatgttcccatggacccggtcgccaactatcgcaacctaccattcaacgggagggcataaaagagttctatacaagaatgtaagactgaaaaaagaggaagtcatcatattgcacgagattagaaggcctaactctctaaaaactgtccccagtggagtcgccaactgtcgcaacctacccttcggcaggagggcgaagcgaaggctcacgggtgcgtcttccaagaaaggaaaatgcacggagtcgccaccaacatttatttcaggaaaatgtcagaaaaaccggaaagacgtggtctatgaaatttaa

SEQ ID NO: 84052 - DNA, 157 bp, Glycine max
  Peptide Sequence Number=SeqID_175737
atggagggatttggcagctcaagtggcaccccctatggtggaaagggaaatgatcaccatgatagagacactctgccagtgttctactatgagaaattggtaggctacacgccctctacctttgcggatctagtattcacgggcgaaaagataagag

SEQ ID NO: 84053 - DNA, 154 bp, Glycine max
  Peptide Sequence Number=SeqID_175738
ctggctacgacgtggaaatcagcatattggcaatgatgatcttagacttttccgtcgaaaattggatctgatgaaacgacatgagtttgtctgggagccatacacaccaactatgatggcagcgttagggggtagggttgggttttatggttag

SEQ ID NO: 84054 - DNA, 267 bp, Glycine max
  Peptide Sequence Number=SeqID_175739
atggtgaatcctgagaaagacgcagatctggcattggtgcagatgactcaggctgagaagaagacatgtccagcactgcagtggaagactctggtgtcacctatggggcttagcgcaaataaggatttgcacttagcgcagcaaggcgcgcttagcacaactactctactgaacagcactggcttagcgagtaggctcactaagcccaattcccacaatttgaaaaacatagagataattgcacttagcgtgacagggcatgcttag

SEQ ID NO: 84055 - DNA, 222 bp, Glycine max
  Peptide Sequence Number=SeqID_175740
atgaggaacgccttgcgcttagatagcatgaaaaagcccttcgataatatgtatgaaatgccaccgaggaagctcttcgcaaagagatccaggagggacgccgcggccgaaggaaccagcgccgctcctgagtttgatagccatcgtttcaggagcgcagagcaccagcagcatttcgaggccatcaaaggatggtcgttccaccaagagagacgcatctag

SEQ ID NO: 84056 - DNA, 300 bp, Glycine max
  Peptide Sequence Number=SeqID_175741
atgttgtggaagcttggagggattgatggggacccggtgttgagaggaacgaggataagggctacgtgggagtacgtgagctcagttgaaggtgggcaactggggatggtggatttatgtgtgatttgtggatgtggagagtcgacttgcaccatcgcccgatcgccacctagtaccacatatgaaggagtggtacctgaagatatgtcgcgggggtcaggagaccttggggacgtcaggtggggtgctatttcccaaaaccaagctttaccaatcccgacccaacccgggcatagttag

SEQ ID NO: 84057 - DNA, 591 bp, Glycine max
  Peptide Sequence Number=SeqID_175742
atggacatgaacattggcggcttgatctctagacaaataaccattatggctcagtccaactcttctctcctaggcttcccatctttaatcacagccttgtgcaggtcaaggggagttggatctgatgctcttacttcttacaagagcctgaggctgggacaaatgctcattatgcagagcttgcaagaattggcccaccaaaggctaatcatgagtgtcgagcagttcattgagcagccagagccagaaaatgaccaatcttatgaagccaccgttcttggagcttttgatgtttcagaaggtagatcagagatgagatccgataaggttatttatcctgatctagtaccagtaccagctgatccaccatctccaatggtggatccatcttgtctcgcgccagaagcagctctcccatctacaccaattattatatttgatgaccctacagtgcgaacaccagaatggattcctactcctccaaccacacctgagcttcagttttcagatgaggaagggggacagattactactcctccggggacaccagtgttacatttggatgatgaggagcaggatcgagatgaatga

SEQ ID NO: 84058 - DNA, 579 bp, Glycine max
  Peptide Sequence Number=SeqID_175743
atggccccgaagaaactcgctgctaagagagctagaaaggccactacaggggaaggatccagtgcagccccacaagcggaaattgagtttgatgggcaccgctttcgaagtgaggagcatcagcatcgttttgaggtaattaaggattggtcttttctcaaagaaagacgggtccaaataacggagggagagtatgcagaattccaagttgaagttgccaggaggcgttggacacaactaacagagcctatggcaaagtatgatcccgaagtagtcatggagttttacgcaaacgcctggcccattgaagaaggagtcgtggacaagcgctcttgggtgcggggccaatggatcccatatgacacagatgttatcaaccatttcttggggcatccattggtcttagaagagggacaacgatgcgagtatgctgatagaagaagtcaatttttaggttttgatgaagaggccatagcttatctcagatgccatccaccagttcataggtattgcacctttgagacacctagtggacccagagaagtccaacagggcactgggatttctgccattgattag

SEQ ID NO: 84059 - DNA, 1531 bp, Glycine max
  Peptide Sequence Number=SeqID_175744
atggggtataaacccaaacagaaacctctgtctggctttgtatcggccttgggtaagaatcttatcaagttagtcaggttccagcatactacagattttgccaagggggtggctgctcgcactatttgtagagcggagtgccctaaggtagctagtgccaccatttctctagttgaggctatgagttcgaaccaccaattgtcttctaaagttggtagtgtattggccaagttgctactctccagggtggaggatgttgtggcgaagagggacgagcttgccatgaaggtggcagatctcgaggccctactaaaagagtcaaagtcaatgctgaaggagttcgagctgcgggttgctagggagagggaggccaacaaggagcttgaggagggactgcttattttcaagaagggccttgacttgggtctctttgaccctttcaaggacgtgaaggacagtgttttacttaacgaagatgatattgctactaaagaggaggccgacgaggaagagcagggtactgaggagaaagatgatgttgccattgtcatcatgatgataagtgtggaatctttgatggcacaggaagcaagaccttgtcgaagtagaggtaggaccatggtgggcttccttctgctttgtggagcttgtcccctaatgtttgtgagcaatatgtttgacttgcccctagatagaggtcttgccaaccagtctggggcttctcctctgagggttatcatgagtaagtatgacttccaaccgattgaagtgcgcaaaacaaggggataccttgggttttgtaagagtgtgtatcaaggggtgaaccttaggtttaacgagccttggatcgaggatgtatttgtctcgggttttgacaagcctgtagagctacatcggggcttaccaaggacggaccttgggttttatgagccttgtatgtgcagcatagtggtggcacatactggaggcgtaatgttgtgctcttgcaaacgtgtcacttatcataagtggcacgtactggagacatggtgtcgtgctcgtagatttagtggtgtgctcttgcatacatgtcactcgttgtgggtgacacacactggagacttagtggcacgctcttgcatacatgtcactcgttgtgggtctagagacttagtgctagaaggagggctcaccaagtgtgctccttgggttgcttgttgtgaccctaaatgggccttcccaattgggaccaatctttctcgctcggggatcctttctggctttacctcagacttgccatatgaggtcatcaccagtctcattgttgatggttccccgacttcaacgaggatcatggcatttgtgcgtgccatatgtgagtcgacccttagacttgtcaagtctagtatgcatggccctaaggatgactctattagttacctctatctaatagttggtttgaggatgttcgacagaggtgaattccttcacctcactggtcgtaatttcccgcagtggtcttgcttttatccatttggtgaagtagttaatg

SEQ ID NO: 84060 - DNA, 417 bp, Glycine max
  Peptide Sequence Number=SeqID_175745
atggatatatcattcaacccctttagtcttttctctcaagatatacaagttgagacatgtcagggtggacatggccaaagtgggctcctggactttcgcacgtcggctttgagagtggcctttgttaagaggacaagaggggggacctgcaaaacaaaggacttcgatgctcaaaggggtgacaagtttgtcgagcccttgagtatggacaagcattgtccggtgtcgagagtggtaacctcaacaggtgtgagaattgtaggtctgtcaagcttgtcaagcccttgtgcttggcaagtgttgtctaggctacatctatcaagttgtccagggtggacatgcattcagttttccatgctaggtctaacatatcaggtgaggggaatctctatatttgacaaccctgcccttttctga

SEQ ID NO: 84061 - DNA, 165 bp, Glycine max
  Peptide Sequence Number=SeqID_175746
atggaggtggttgtggagagtggtaatagtatggttttttctttggtgggggtggtggtgagtggtagacatagggagggagtgggtgtgggtgtggatgaggatggcggtgagggtgagtgtacactggaggtgggggagatgggtacttgtagggattcttag

SEQ ID NO: 84062 - DNA, 564 bp, Glycine max
  Peptide Sequence Number=SeqID_175747
atggctaagtttgacccagacatagtcctggagttttatgccaattcttggcccacagaagagggagtgcgggacatgcggtcatgggtgagggtgctggaggaaggccagaagtgcgagtttagtcagaggaggaatagggccgatgggttcgacgaggaggccattgcccagctattgtgcacaccggggcaggatttcgcccggaccgctgccgggaggcgggtgcggatcatgcgcaccagcatgaccaccttgacacagatgtggatgacattgctgcttagcaatgtcttgcctagtgatcataactccgaccttcctctgccgaagtgtcagctggtgtatgccatcctaacacggatgagcgtccatgtggttcagttgattgctgacaccatctatttatttgtaggtatgccacccaccaggcaccttctagacccggataagtctaacagtgccctggggtttccagcactgatcacgggcctctgccaggcccgcatggatgaggagatgatgaacttgctccgtttcttgggaggaagcagagccacgtga

SEQ ID NO: 84063 - DNA, 339 bp, Glycine max
  Peptide Sequence Number=SeqID_175748
atgtggaccaccacggcaaattcgaaagagagagaagtgcctaaggggctgacccttttcctcttcacttctccccctatttatagcaaaataggggagaagcttgccgcccagcttgcccaggcgagctcagcttgcccaggcgagcaagaagttacggaaacccacggattgcgcaaaagcacctcttttcgacttccgccacattacggaatttcatggatcgcgcaagcctgcttccttttgatttccgagatgtctcgggacttcatttattgtgcaacaaaggacgccaagtatctcaaagcggctaaccaaaagttgcatgtcatcaagtaa

SEQ ID NO: 84064 - DNA, 705 bp, Glycine max
  Peptide Sequence Number=SeqID_175749
atggaacttgttgaatggttaaaatggtacagattaactataagtaatattttggcagaaaagaatatggtagttggaactggctattttgatgtacttgagaaagatttttatttagctattcatgcaacatactatgcaaaggcattgtggacagggttgaaaatttacaaatcacaggctactaggttcaaggagatggaaattgttgaatggttaaaatggtatagattaactataagtaatattttggcagaaaagaagatggtagttggaactggctattttgatgtactcgagagagatttttattcagctattcatgcaacatactatggtcctgaaattcattccatggagcttcttcctaaatgctttgaggctgaggagaggtcctcttatgaaactcctgaggttttgcacttagtttcaggacatgatcttttcggaatggtttgcctagccaacaaggttccagagatatcaattacaaacaatgagaagtcaacatcttttaaattcttcctttcaagcccgtgtcaatctataatagatttgaacatccacaggaatgtagaaagatcaaatgattttgaaactcacaaaggtcactgctctaaaacttcaagtattgtatcaaatgcatatagacatctaaaacttaaagtttatatattactccaaattctaaattctaacatttaa

SEQ ID NO: 84065 - DNA, 786 bp, Glycine max
  Peptide Sequence Number=SeqID_175750
atggttagaacaacaggtcttggccaggctgtggaagcaatatcttccaaggttattttgatgatgccaaagaatcaagagtcaagcaaaatccaaaagattcaagaatcaagtttcaagaatcaagatcaagattcaagactcaagattcaagaaacaagggaagactcaatcaaggctttaggccgagcaataggaaaagccttggggaggagagacgcaagtgatgatgatgatgtcccccagcggtgtaggcctactgcatcagcccgtagacagcgacagcaagagcatgattttctaggcggaccacatgatgcatcagttctcaaagattttgaaaatcacattgctttgagagtgtggaatggagaggaacgtcctgagctaaagctatcttcccatggaaggaagatggctaagttcgggaggcctgctccagagattgaaggccttgtggtggccactggactaagtcctttgatctgttccctagatacggacaatcggggactaatgtttgcttttgtggaacgctggcataaggaaactagcagtttccatttgcccgtcggagagttgactatcaccttggatgacgttgcgttcttcgagctacttcatgtcaaccacgctatcgatatgttggtggaattactcaaggtcagcactgcagaggtgagagctgagatgatttggtgtcatggctcttatgctcgactatcgtggctgcgcgacttgtatcaaatgaagatcgaggcatatgaatggattgtagcaatgtga

SEQ ID NO: 84066 - DNA, 183 bp, Glycine max
  Peptide Sequence Number=SeqID_175751
atggattggttttacatgatctcgcacccattcatgagtccagcacagccaggggatcctcctagagttccgttggatcagcaatatgacacatttgttgaactagatgtgtatcaacaactgataacgacagtggcacctaatgaggcagacgttgatgtgcatcatgttcgacatgcagtg

SEQ ID NO: 84067 - DNA, 165 bp, Glycine max
  Peptide Sequence Number=SeqID_175752
tgctggtcagcttggagagcaggtctgctctggtgttgcactctgatgcaatcctatcccgcaagggcattgggtagaagactccaagtagattgggctagagatccaagggaaggccctaggattctcatgagccttagggtagatttcgagctcatgggctaa

SEQ ID NO: 84068 - DNA, 489 bp, Glycine max
  Peptide Sequence Number=SeqID_175753
atgggacatcctatgtggtactccgacgcacgtgccaatcctccatttattatctacaagccgataattatttgcaaatgctataacaacctctacaaaaaaggactcgcagctccattccactcctataaataccaagttccattgaaccctcaacacatcccgaacacacaagcatacgagcaaacacgcatatgcaagacccttttcgaaggctccaaccctccactagcagctatgagagacacaaatactcttcagcaactccaaaaccgcatagcaaagatggagcaacgccacgtggaagagttgagaaagctaaaggttgaccatgatcaactagaggctcatgttaaacgttccaagggcgacgagcactccgctcacacattgcctgagcgcacccaaggggaaacacaccctcgacgcacagtcaacactctagatgacttaagtctctcccacttaggcaaatctatacaacaatga

SEQ ID NO: 84069 - DNA, 189 bp, Glycine max
  Peptide Sequence Number=SeqID_175754
atgacagacatgcagagtgggcagcaatccaaaccgtttgatgtagaaatgggagatcacttggaggatatgattcgtgaccttggacaagagtcttttcagcaagcacatgcccctatggtgcaagaattcgttgacgctgttgttggtggtttaagtttggttaatatcaaagccagatatgggtag

SEQ ID NO: 84070 - DNA, 498 bp, Glycine max
  Peptide Sequence Number=SeqID_175755
atggatgccaagcatctcacaaggaccaaagaatggtcgcatgtcatcaagcaaaggaacaaaaggtgcagaagactatgtcagcctctgcatgctatcaaggcgttctgcttacagatgcaaaagaatgtttatacggataaccactcgggtatttccgcgtatcatcgggcccgccgcctctggatgatacaagggtgcagaatgaccaaacttggtctctgcttgtcatcgggcccgccgcctctggatgacaaaagggtgcgaataaccgtaagaatgaccaaacttggtctctgcttgtcatcgggcccgccgcctctggatgacaaaagggtgcgaataaccgtaaggtatctccgcgtatcatcgggcccgccgcctctggatgatacaaggggtcagtatgacaaagattatggggcggccgacaaaagcaaagctcttgctcctacgtatcctccaatgaggaactcagacctacgtagttctggataa

SEQ ID NO: 84071 - DNA, 246 bp, Glycine max
  Peptide Sequence Number=SeqID_175756
atggttcgccagcaaacggccaaccaccgcgggcaggggcagggctccccaccttttgtatgccctaccccagagcaattcagggctgaggtcgcgtggcctggagattggcccactgaggagggaaccgagcccgcaggatccctgggcaaagaggaggaagcccacatggatgaggatatgaccgacctgctcggttacctgggagagggcgaagctacacaaccaaggtcgtcacacttgtga

SEQ ID NO: 84072 - DNA, 75 bp, Glycine max
  Peptide Sequence Number=SeqID_175757
atgcctataggtggagttgatattgaggaggaggaactaacagatttgaggtcaaatcttctagacttggagtga

SEQ ID NO: 84073 - DNA, 297 bp, Glycine max
  Peptide Sequence Number=SeqID_175758
atgatggaacatacgaatttggggatcccacgatcatgtggctccgcatgccaccagactcttgggtcacgaggaagcactgggttcaacaaaaatagaagaaaatcactcaaagtgtatcaatctcacacaaggcaaggattgacattctcaccctgggtcaaggtttatgataagttgggattttggctcaaggcttgtagaacgggtagtcatgatatatgtcagggtttggccagcggttcggggataaaggggatgtcctacattatttccatgatacacatgcaacaatga

SEQ ID NO: 84074 - DNA, 1132 bp, Glycine max
  Peptide Sequence Number=SeqID_175759
gtctcaccttcagaagactacacgtcctcgccttcagaggactacacgtcctccccttcagaggactacacgtgctcaccatcagagggctacacgccctcgccttcagaggactacacgttctcctcttcagagagctacacgccctcgccttcagaggactacacaccttcaccttcagaggactacacgttctcgtctgcagaggactataggtcctcgccttaagaggactgtacatcctcgccttcagaggactacaagttctccccttcggagagctacacgccctcaccttcagaggactacatgtgctcacaatcagagggctacacgcccttgccttttgaggactacacgtcgtccccttcagagagctacatgccctcgccttcagaggactagacgtcctcaccttcagagaactacacgtcctccccttcagaggactacacaggactacacgtgctcaccatcagagggctacacgcccttgccttttgaggactacacgtcctccccttcagagagctgcacgccctcgccttcaaaggactacacttcctcaccatcattggactacacaggactacgcatcctcgccttcagaggactccagatcctcgacttcaggggatacatgtcctcaacttcagagatctgcacgcccttgccttcggagggatacacaccctcgctttcagagggatgcacatcgcccccttttgaggtctacacagaactacacgtcctccccttcagaggactacacgtcctcgcctttagtagactacacatcctcgccttaagaggactacacgtcctcgccttcagaggactacaagtactccccttcagagagctacatgtcgtcgcctttagaagactacacgttctcaccatcagaggactacacgcactcgccttcagaggactacacgttctccccttcagagagatacacgccctcgccttcagaggactacacgtcctccccttcagaggactacacgtcctcctcttaagtggactacacgtcttcaccttcaaagggctacatgtcctccccttcagagtgctacacgcccttgcctttagaggactaaacgtcctcaccttcggaggactacac

SEQ ID NO: 84075 - DNA, 66 bp, Glycine max
  Peptide Sequence Number=SeqID_175760
atggtgaccaaaggttggagctttaatggaggcttcaatggagaggaagaagaagagaatgacaac

SEQ ID NO: 84076 - DNA, 653 bp, Glycine max
  Peptide Sequence Number=SeqID_175761
aggtgaggcatgcttgcccgctagaaagccactgttcatgcacagataaaggaggggcaaattgggaccaactcttagcaagcaaagaaggagcatctgtcaactggttccctcgatggaaggaaggaagaatcggagttcttatttcatgcggaggatttccaaatgttcccttgatggggacgaggggttgcatcagctacaatcccattcttgctataagacaacttggctaccctatgagaggggcgccgctaaaggatgagctcgcgcctgtcatttcacaaggcttcaataagaccaacgtggagacacttcagaaggttcgcaaggcatgggaggtgttgcaaaagaaggacaaggaactcaagggcagtaacaatgggcccatcggtggctatcataagtggttaaaagcccacgtgcaaggtttggattggcttccaagtttgagaactgctaaaagagaggaagttgaggcaccggaggaagacgaagaagtgcaggcccttagggcggaactcgagcaagcccaaacagttaaagaagggcttgtagggaagaacacggtcggaacaaattccaaggggctctgtggggcagtaacaacgagcttaagctccggagagaggaaagggaccaatcacgagtag

SEQ ID NO: 84077 - DNA, 803 bp, Glycine max
  Peptide Sequence Number=SeqID_175762
agaaggacaaggaacacaggggcagtaacaataggcccatcggtggctatcgtaagtggttaaaagcccacgtgcaaggtttagattggcatccaagtttgggaaccgctaaaagagaggaagttgaggcactagaggaagacgaagaggtgcaggcccttagggcggaactcgagcaagcccaaacagttaaagaaaggttcaaatcagcagctctgaaaatccgaaaggagaataccgaactgagagatgtaaatgtggctaccaccaaagtcttggaacgagaaaccaagagggcttgtagggaagaacacggccggaacaaattccgaggggctttgtggggcaacaacagcgagcttaagctccggagagaggaaagggaccaatcacgagtagatagtctgatcttgaaagatgagttgaaggtttgctcaaagtccaaaagaaacctgtctcagcggttatgcgagacagaggccaacatgttagctatcgccagcgagtaccaagaagaattaaatctagccacggcccacgagcaaaaagtggtagacgagtatgcccgagtgtatgcggaaaaggaggctggaggaagggtgatcgactcgttacatcaagaagcaacaatgtggatggaccgatttgctcttaccttgaatgggagtcaagaacttccccgattgctagccaaggccaaagcaatggcgaacacctactccgctctcgaggagatccacagacttctcagctattgtcagcatatgatagacttgatggcccatatgattagaaaccgctag

SEQ ID NO: 84078 - DNA, 840 bp, Glycine max
  Peptide Sequence Number=SeqID_175763
atgggatcaagtcaaaagccttcgcttaaaaagaggttctatcaagtcaaaatcaagagcttagaggtcactagtttacgagagttggggcaattaatgggtcaacttcaacggcaagccttctgcaaagcctatggtaagatttgggacctagctagggtagaagtctccatggaaccgattgcatccctttcccagtattatgaccagcccctaaggtgcttcacattcgaggacttccagctagtgccgactgtgaaagagtttgaagaaatcctgggatgcccactgggaggaaggaagccatatcttttctctggcacaagagttggaccgtgtaaagcaaaacaggaatggggtagtcggagtaccaaggaagtgtttgggaggaaagggcaaaggccttggcaaatcaaggcgaatgggctctcttttattgacatcttggcgcttttgatctttggagttgtcctctttccgaatatggaagggttagtggacctagcagcgattgacgctttcctcgcctttcatcatggcaaggaaagcccggtcgtcgccattttggccatgtatgacacgttcgaccggggatgtgaaaagagcagcgcaagaattgtttgttgtgcactggctctctatgtgtggctggtttcacacctttttctccaagaaggtaggcccgtctatccgctacaaggtctctgctcgtgcgtcgaaaaaggaaaggcgaattgggaccaactcttggctagcatggagggacgtctgttaattggttccctcactagaaggaaggaagaatcaggattctatcttcatgcgaaggatgtcccatga

SEQ ID NO: 84079 - DNA, 645 bp, Glycine max
  Peptide Sequence Number=SeqID_175764
atgatcattgatcaatctttgtttttttctttgactaaattacccagtcaaggtgcaccttttgagggcaccattgttgatgactggaaatttgattattctagtcatgatgctcaccgtatggtttgtaatgaccaggctgaaatgaccgatagattactggtcggatcattgacctttgataatggcatcatgcactacattattgttagaattttgctccctgggtcttcaaatttggctcaagcctctaaggaggacttgattttgatgtgggtttccttaccggtcgcattacgggccaatgcacctctcccttaccctcaattggtcactctgtttctccgtcattttcaaattccacttgatgatgaacctttcgttcaagtcaagcgttcctttgctattggtgctggtgtagtcacttcttttggataccgcaaggatcggaatggtcaatggttgaagaaagatgcacttcctccacaagatgagcgtactccttctcctcctcctcagcgagatgattcagcccttatgactgaagttctttccgagttacggggtcttcgtacttatgttggtgaacgttttgacactttggataatcgctttgcaggaatgaatatccgtctcacagcttga

SEQ ID NO: 84080 - DNA, 483 bp, Glycine max
  Peptide Sequence Number=SeqID_175765
atgtcttgcctagcaatcataactccgatctccctctgccgaagtgtcagttggtgtatgccacccaccaggcaccctctaaacccggataagtctaacagggccctggggtttccggcattgatcacaggcctctgccagtcattcggggttcccgtcacccctagtaaggtgatccgaccgtcgatcacccgggccttcatcgagaagtattgcacgcctagacaggcacatggtgatacacctcaggccgcaaacgcaccgccaccacctcatcaggccgatcccgctggatcgctaggcatggaacgttatctacggaacttggttcgccagcaggcggccaaccaccgggggcagagactggcccgaggcctaggcaggggggagctcgcaagatcacccggtgcggcagaggagacccgtatggatgaagaaatgacggacttgcttggtttcttgggaggaagtggagccacgtga

SEQ ID NO: 84081 - DNA, 564 bp, Glycine max
  Peptide Sequence Number=SeqID_175766
aacaggccattcgacagggagactcggaagttgcggagtcttggtttaatcaagccgctgaatattggaaacaagctatagccctaacccctggtctctttgtatgtgttgtctggaaagaggaggactcaatgattattcgttcaccggaaccagaagtgaaaattttggtagatagagatcccataaaaacttctttcgaggaatgggcaaaaccaggtcatttctcaagaacaatagctaagggacctgatactactacttggatctggaacctacatgctgacgctcatgattttgatagccatactaatgatttagaggagatttcccgaaaagtttttagtgcccatttcggccaactctctatcatctttctttggctgagtggcatgtattttcatggtgctcgtttttccaattatgaggcatggttaagtgatcctactcacattaggcctagtgctcaggtgatttggagagcatctggaataactagtgaattacaactctattgtaccgcaattggtgcattggtctttgcagccttaatgctttttgctg

SEQ ID NO: 84082 - DNA, 377 bp, Glycine max
  Peptide Sequence Number=SeqID_175767
atgtctgacgctgcgatgatggtagcccgtgtgatgttaggacatgggtataagcccagaatggttttaggacagaacaacgatggaatggctagcttggtagaattcgaggaaaaccgtgggaaatttggacttggctataggcccacgcgtgctgatatgagaagaagcgccctagagagaagaaacaggggcatgggccaacagcaaaggccacaagtgaaagaggcccatctatgttacatcaacaagagttttgtaagtgcgggctggagattcgatgacaagtcctgtgaaggtactaattccgaggaccctgatgttgattttgaacgagtagcaaaccgagctgaggatgaagaagatgaagatatggg

SEQ ID NO: 84083 - DNA, 291 bp, Glycine max
  Peptide Sequence Number=SeqID_175768
atggaaaaatttgacaagagaaatttcaaagaaaagaaagcatacatcatttgggaagataatgacatgaattcttcaagtgattcagaaaatgaagtcattaatctgggtctcatggccaaagactatgaaagcgaagaaaagaaagatcatagcgcatcaacatgttatattagaaagaatggtagtagcattggaaaaatggtatggttccaaaaggatccttacccaaaactaacattcaaggacccaagaaaatttgggtaccaaaatcaaaataagattatatga

SEQ ID NO: 84084 - DNA, 645 bp, Glycine max
  Peptide Sequence Number=SeqID_175769
atggtccatgacatcttggtccatgagcaatacccgttgggaggaaggaagccatatcttttcttggggttctatccctccgtggctagagttgccaaggtagtgaaaatctcgacacaagagttggtccgggtaaagcaaaatcggaatggggtagtcggagtaccaaggaggtgtttggaggagaaggcaaaggccttggaaaatcaaggtgaatgggcttcttttattgacatcttaacgcttttgatcttcagagttgtcctttttccaaatctggaaggattagtggacctagcagcgattgacgctttcctcgcctttcatcatggcaaggaaagcccggttatcgccattttggccgacatgtatgacacgttcgaccgaagatgtgaaaatagcggcacatcaattgtttgttgtacaccgactctctatgtgtggctggtttcgcaccttttttgccaagaaggtaggcttgtgtgtccgctacaaggtcactgctcgtgcgccgagaaaggaaaggcgaattgggaccaactcttggctagcatggagggggcgtccgttaattggttccctcactggaaggaaggaagaaccgggattttgtcctcgtgtgaaggatttccaatgttcccttga

SEQ ID NO: 84085 - DNA, 321 bp, Glycine max
  Peptide Sequence Number=SeqID_175770
atgaaggttcagttagtgaggcagacacttaacaccttccttgcttggtcagcacatcttgtaaagccatacccagaacaagataaacaagtaactgagggaccgacgaaacctgtagctatgctgaatcctgacatcgatcccctctacttgatgacattgaccattccacagattttcctcaagccattaccggtgtcgtgggatgctagcgtgttttgggtgtataatgataatttctcattgtacataaagcatgaagatctttctgaaatagttcatggtggtcaatttcaaagcatctttgttatacaattgtag

SEQ ID NO: 84086 - DNA, 378 bp, Glycine max
  Peptide Sequence Number=SeqID_175771
atgactcctgcggattttaccctatctacacccggagccaatctcctatcggtcctgccaccacgccgcagaacgggagctcgtgtggaaccttttatttctggcgtaacagcggtggaacgtaaaaaaagattacggtcgcgtaacataagggccggaggtacggatcacaagtggaacgctaagcaggggggaggggaaaggcttgggctgggcctacctatcccgataggacctcataaaggaacgggagctgttgagaggttccatattgccgagctgaagggcagcacttctgtacgtgatcgtagtatgtcacgtcgtctcgtccccgcagcattgaaaagtacctatgcactatttccggttcacttctaa

SEQ ID NO: 84087 - DNA, 204 bp, Glycine max
  Peptide Sequence Number=SeqID_175772
atgtcgttttgcttggatgttgtggaagcttgggaggatggatggggacccggtgttgagagaaacgaggatatgggctacgtggaatggtacctggagatatgtcgcgggggtcaggagaccttggggacgtcaggtggggtgctattgcccaaaaccaagcttgaccaatcccgacccaacccaggcatagtcggtcagtga

SEQ ID NO: 84088 - DNA, 1152 bp, Glycine max
  Peptide Sequence Number=SeqID_175773
atgcaagtgggtaccattggcaatattgttagcatttctggtccctttttaaccaaactttctgccccctaccctttactcctcccactcttttggacaatggaaagtggagtacccttccttgactgtctcttgcaaaacactcttagaagcatttgctcatttcccacttcttcaacttcttccaagtgggtgtatgcagtcttctggaggatagtacctcgaaactttcctccgcctaggtgggaatttggaggaacagctcttgatcgctcaaagggaaacaaaagaaactggcaagtttggatccttgtatgggaagatggtttctgcgattttaatgaatgtgaacaagggaggaatggatgcttgaactacaagtttggagctgatgtattcttcaaaatgtctcatgaagtttatagttatggagaaggactaatggggaaagtggccgcagataataatcataaatgggtttacagtgacactcaaaatgggtgtgaatctagctacattggtgcatggaatgcttcaatggatcatcaaccaaagacatgggagtttcagttaaattcaggtattcagaccattgctgtcattgctgtcagagaaggcttagtacaacttggttcatttaacaagattgctgaagatctcaattttgtggttagcattcaaaggaagttcagctacctccacagcataccaggtgtattttccattcaaagaccacacctacccattcaacatccatgcattgccaaaccaaacctacaaatgatggaaagcaatgaaatgaccctatctgcctataatgcaacaaatcaagtcacaagagtcaatggagtgcatgaggaaaaatccagcttcttttccatgatatccatcaacttgggtaggaatccaccaccccaaaatggaacaacaacaacacaagggtcacctctttggtcagctccaccttccttgcccaacatgtcttgtagttttggtgctatgctatcaaagcttccatatgttactccttccaataatccccctcaagttcttgaaaccaataagaccaaccacaaagtgaagattgaggagtgcagatttcatggtgctgctaatggagatcagaacaaaaatgcagggtggaatccttga

SEQ ID NO: 84089 - DNA, 102 bp, Glycine max
  Peptide Sequence Number=SeqID_175774
atgcttgtggcgaaagcagggcctaacagtgggagggcaggacactatggtttaaaaccaaaggaacttaagcagcaaccagaaaggatgctaactaagtaa

SEQ ID NO: 84090 - DNA, 936 bp, Glycine max
  Peptide Sequence Number=SeqID_175775
atggaagaccacgcgcatgctgcactacctcccggttaccggttctacccttccgaagaggttctcgtcggttactacttaaccaagaagaacgagaaccgggaggagggtttctacggttctgatttgatcagagaacttgacctctacgatcacgatcccttcgaattaccggacgctgctgcttgcttttcgtacggttacaaagggaggaagaagcattggttctgttacgctaaagagaccaaacgcagaaacagaagaaaggtgaaaagcgggttctggctccggaagggaaaggttcgggatatttccgaccacaacggcgacgacgtcgttttgggcacgaggacgcgtttcgttttctacgtcggcaattccctgaaaaacgctgccagaaccgattggattttgtacgaatacgcattggttgatcgctttctggcttcgtttgtgctttgtcgtgtggtgaataagcctcctcataagaatagtccgtcggagatcggtctgagttgttgtgctgaggagagtgttgtggcggtggtgcgtcacgttggtgttcagtgtgatggatgtgccgaaagtgatgttgttgaagctaaggtgtgtgatgaaggctttgttaatagagagaatgagattgctgagaatccaattagtggtgaacatggtgatccagctgcacctgtttcagttgctcagggaagtcagccgttgtcaattgcaaacttctgcatcagcaattgcctgaaaaatttattcagaattagggtcatcaatacagggaatcagtcaaaatgtttgttgcaagttcaggaaaggctttctaaacttcccagtggcagtgcattgttcgtaggagctatgacatctcagcaacttatgctttccattctagaggaggatttcatagaattggatgatattgcatga

SEQ ID NO: 84091 - DNA, 549 bp, Glycine max
  Peptide Sequence Number=SeqID_175776
atggcttcctcctccgaagaactatttggtttgaattacctgctgctgaagccacaagaggcaagtgctgttgatcttggacgcctcttgttctcttccaacttgaaaaacagaagattcatcgaatgcccagaagagattgaggccagagaatttcgacaaagatggctcctcttcatttccattgtcgcgcagaaggtcctcgttgcatcaagaaactcattgaagaacgttggggacacgttggagttgtggctcaatcgtctatcaagcaatggaggcttaataagactcttgttcaacattctaacaggaaagatgataacaccggagagatcatcggcgacattcttatccgtggtgggctacagtgacacacgagttgacttagacaaaagcattaaggagaaggatactaaatacaaagggttcctctcaatgatggcttcaaaattagcgtatgagaatgaagaattcgttagtaacgcagtgcgaaatcattgggatatggatttcttggggtcacacagcttctggaacggtacgtaa

SEQ ID NO: 84092 - DNA, 1326 bp, Glycine max
  Peptide Sequence Number=SeqID_175777
atggagttgttcgcattgttggttgtggccaaggaaatgaaggggaatcatgcagtgactctattcttcttcttctcttacaaaatggtcatcgccgattccgattacaatggtcctctcttcaaggtctcccaagtcttcctctgggatgatgaccttaagttttcatcctcagctgaacgctggaaattggatgaagctgatgccaatttgattgaccttgttacacctgaggatttggagcttaccaaacagctgaatgatttggggctccctctttccttccagacaaacaaagagaaaaatagaccagtaaaatgcaaaaagaagggtaaactttcaaagcatccagatacttgtcacaaccctgtagatgaaactctatatgaagtgactggggaggagattgtatctcctgctaaatttcatgataaaactagtagtcctttatcttgtatatcaatgctgggccaaagtgaatcttcttaccgtgaagttgcaatggatattgatatgacccaatgtgcctatggtgaaggagataagtccgcttgctgtactgggtttgctagtggtgtttacagggagataaataatgataatttaaatcaggtagcaactaatgatgcccaagatgatgatttcttaatcagtaatgatcgtgttgatttgaaaactgcacccgcttcagatactggagtctctgctggaagccatttgaaaggtgctggtgtcaattattgtgggacagaatatgatgaaagcttgattgacagtgaatgtttagaagtttcaccaattgttggcaaaaatacagattgtgatactatttacagtgatgatggtgctgccacttgtcatccacatgctattgaatcagagttgcttcccgtgagttcagaaggaattgaatgtgacagaaatgatgtttcaaataattatgctgaacatggagattggatggcaccctcagggatggagcatctggcaactggcgggtgtactgaatcagctgatagtaaaactctaaaggcatcagaagaatgtggaacacaaaatagcactaaaccacctgaggaaaccttgattgaagagaacttggaagtacagcaacatgaagagtatttgacaaagagtggagttgctgttggcaatttcatctctgatatcactacacatggtgaagaccaatctctcaatcattcagatgagtgtcttgctagggatggcaagaataaaatagtcttcacttggttaaagaggctacaatatgatgtcatgaatcaattctccctaaagcttaagcttctacgtggaggcttctga

SEQ ID NO: 84093 - DNA, 321 bp, Glycine max
  Peptide Sequence Number=SeqID_175778
ctagaagaactagggccagttgcattgcgtagagccgtagaggagcgagaagggaaggagagtggccactatgttgatggtggtgagaggggaggaggggaagacttgactaaaggaggcattggaaacaatgaattggattcatcatcctcttgggtggaggagtactacaatctgagcaaagaagcagagcaagcgaacacaagggttgaagctgctaattgtgaaattgagatagctaaggagtgtgaattgaaaaccttggagaagctgaatgatgtgaatagagagaagggaatctctgaagatggcaatggatag

SEQ ID NO: 84094 - DNA, 219 bp, Glycine max
  Peptide Sequence Number=SeqID_175779
atggaagcatgtttgcttcttggtcgggtagatatctttaccagtattaggtttaggtcatgtcagatggaattggtgtacagtgcacttgtcaatccatcaataagagcatgtcgtcttctaaggagagcagacgccaaccacgatggagtactcaccatcgaagaacttgacaccattgttgattttgctcttgctaggtacaagttcaggaagtaa

SEQ ID NO: 84095 - DNA, 1752 bp, Glycine max
  Peptide Sequence Number=SeqID_175780
atgcaagcggtggggaggcttggcagcttcatcagccgcggtgtcaacaccgtttcagggacgttcctccctttcggtggcgcggtggatattgttgtggttcagcagaaggatgggagcttcaaatcctctccatggtatgtaagatttgggaaataccacaaggtttttaaggaagaggagaaggaaaagatagaggttcatgtcagtgtcaacggtgtagaacctgatttcaacatgtatttgaaccgtaatggggaagctattttcctccatcatgcagatacacaagaagaagaagaagaagaagaggaggaggaggaatctacgctttttggtggtgaaagtgaaactgatgatatcacatcaccgagtggtaggaggcatttcaagtccaaaagttggaactttgattcaccagacaagtcaaattcagatgctaaggttgttgtgggaaggactaagtctcgccgtgcccgaattcttgggcttgtgtcaaggtctttgagaggggaaggtggagatggtgatgtgaatggggtggatttgagggagcgtgccgagattgcagccaagttgttggagctgaagtggtccaccaatctcaattttgatcataaactaccttgtagggataggaagaagactaggggtgatgccttggacaacggtttgcctttaccaccgcgtaaaatgaaggaggaagctcgttcttgcagtgatcaagatggcatcagttccaagcctgtgtttaatgagatgttgtgccctgcaagtgcaggatgtggagatgttcgtgtccatgctcaggaggtcttgcatgctgcaactctaatgctacctgaggttgcacaaagtgaggaactcactaagaattctgacattgggaggccagcaataaaggcctctgagttacattctcagcaaagagattgttcccattctggtaggagtgatgccggggatgttgtaaaaacaccaaagtttcgaaaatctcaaactatcaatcttggtcgaagagatttagttaagaaggttagtgctaatactccaacgtctgaacagctagcatccttgaatctgaaggaagggaggaacacaataaccttcagtttccctacggttaaggggaagcagcaggttgatgctcacatgtatttgtggaaatggaacactcgtatagtgatatcagatgtagatgggacaattacaaggtcagatgttctaggtcaattcatgcctttagtaggaatcgattggtcacagacaggagttgctcatttattctcagatatcaagggaaatggctaccagctactttttctcagtgctcgtgcaatatctcaggcctatcataccagacaatttctatgcaaccttaagcaggatgggaaacttttaccagatggccctgttgttatatcccctgatggactctttccttctctatatcgagaagttatccggagggctcctcatgagttcaagattgcatgtttagaggacattaaggcactttttcctccagattggaatccgttctatgctggttttggaaatagggataccgatgaagtcagttaccttaaggttggaatcccaaaaggaaaaatattcatcattaatcccaggggagagattgctgtaaaccgtcgttgttttgacacaaaatcatatacttctctgcattctctggtgaatggaatgttcccccctacaaactcatctgaacagattttcgaagttgactag

SEQ ID NO: 84096 - DNA, 765 bp, Glycine max
  Peptide Sequence Number=SeqID_175781
atgtatcctgaatggttttttgcgctaagaaatggttttgggcttctgatgtatggctttggatccaagaaggttctgattgaagattttgcttcaacggcactgaccgagtattctgtagttgtcattaatggatatcttcaaaccattaacttgaagcaggttgttatagctttagctgaaattctgtgggaacaagtgaaaacaaagcaaagggtttcctatcgggacttacccaagagccaacagtcattcaattcaaaatccatggaagatcttcttacatttttggatcaagcggaaatagaggcgggtgctttttttgtttgtgttgttattcacaatattgatggatccggattaagggactctgaaacccaacaatatcttgctcgactagctgcatgtgcccagattcgtgttgttgcctctattgaccatgttaatgctcctctgttttgggacaagaatatggctcatacacagttcaattggtgctggtatcacgttcctacttttgctccttacaaggtggaaggcatgttttatcctatgattcttgcacatggaatgccaatcagtgatctctactcagtctgtcgagaacgtttccttgttagcagtcagattacgctgaattcccatttgactgaatttaaagaccatgaactggtcaagattaagaagcattctgatggtcaagattgcttgcacatccctctgacagccgaagcacttcagaaagttgtgctcgagatcatttag

SEQ ID NO: 84097 - DNA, 1089 bp, Glycine max
  Peptide Sequence Number=SeqID_175782
atgcagaagcttgatggtgatcatgtaagattggcagattactttgatgtgattgcgggaacaagtactggaggattagtgactgcaatgctcactgctccagatgaaaataaccgacccttgtatgcagccaaggatattaaggatttctaccttgatcatacccctaaaatcttcccacaaaataacaatttattctcacctatcctgaagttgggcagaaccctgtttggaccacagtacaacggcaagtacttacacaagcttatcagggagaaactgggagacacaaaattgcaccaaacattgaccaatgtcgtcatcccagcatttgacatcaagcaccttcaacccgccatcttttccagcttccagctgaaaaagagacccgatttgaatgcatctttgtcggatatatgcatttcaacttcagctgctccaacatatcttccagctcattcctttgaaaccaagactcaccacggtgtcagcaaattcgaccttatagacggtggcgtcgctgcaaataatccggctttggtagccatggcggaagtgacgaatcgaattagccatgaagggcaatgtaatagcttaaatgtgaaaccaatgcaatacgatcgatttttggtgatatcgttgggaacaggttctcagcaaaaggaaatgaaatacagtgcagatgaggcagctcaatggggcatctttagttgggtaactacaaccaatggtggcacccctttaattgatgcctttagccatgcaagttcagacatggttgactttcacatcacctcccttttccaagcactcaattctgaacataactatctccgtatccaggacgattcattaaatggggacatgtcttcggtagacttggccacggagaagaatttgaatgatctcgtgaaagttggggagtcattgttaaagaaaccagtttcaaagattaacttgcagactggcgttcacgaacctgttaactctcatgaaacaaatggagaagccttgaagaggtttgcggaacgactatccaaacagaggagatttcgtaaatctcaaatgtctgccaatgggaatctttag

SEQ ID NO: 84098 - DNA, 1029 bp, Glycine max
  Peptide Sequence Number=SeqID_175783
atggaaatgttttccgtttctaggcctggctgctcttcctttgggtatggagccatgcaagaactcggaccttttagagtcaacagtgatggaagaacactttacacaaatcaatatgcatggaacaatgtggcaaacgtgattttcctagagtctccagcaggagttggtttttcatattcaaacacttcttctgactacactaaaactggtgacaagagcacagctatggactcttacacttttcttctaaactggctcgagagatttccacagtacaaaactcgagacttgttcatcactggagaaagctatgctggacattatgtccctcagcttgctgacactattctcacttataataagcttacaaatcacacagtgatcaacctgaaagggattgcggttgggaatggctggatagatgataatatgtgtggaaagggaatgtatgaatatttctggacacatgctctgaactctgatgaaacccatgagggaattcaaaggcattgtgactttgagaacggtaacttaacaagtgagtgcagcaaatatcaaattagaggggatattgagattggaaccattgacatatatggcatatatgctcccccttgtgattcagctgcaacaaaagctggtgccagtcctgccactaactctgatagcaattacgacccttgttctgacgattataccaattcctacttaaatctcgcggaagtacaagaggctctacatgctaaagcttcagtatggtatccttgcagtggcgatacagatgggcgtgttcccataacatcatctaggtattcaataaattccatgaaacttccagtggagacaacatggcgtccatggtattctagcaatgaggttggaggatacttggttgggtacaaagggctcacactaatcactgtaagaggagctgggcacatggttccaagttaccaaccgcagagagccctaaccatgatctcatttttcctacgaggagaacttcctcctgagttcacctcttag

SEQ ID NO: 84099 - DNA, 255 bp, Glycine max
  Peptide Sequence Number=SeqID_175784
atgggaatactagacgaagaacaagagagggaaggagaacaatctacggtgatgcgttcgcgtttggtggctttggtgggtgtggctcacagcggcgatgaagatgaggttccagtgatgattgaagttgcccggtggttcgtcgttatctggcgttttcctttggcgaaggatttaacaggggctcacggtgatttcagaggtgtcatcggtgttattttgcatttttcgatgacagagaagaaacagggttaa

SEQ ID NO: 84100 - DNA, 885 bp, Glycine max
  Peptide Sequence Number=SeqID_175785
atggaagtggtggtacaaagtcctagtagtccaaccatggataatttcgattttggtggcaacatgggttcgatctatcaaagtgttccttcttcaccaaaaggttttggtaattactacctaagcgcacccgcgagtccatctaggatgtctgaattattcagcgaatttgaatattattcttcagcttcaccctcttcattcgaagccgccaacataattgatgatgatgacgacgacgaaaacaaggactacagtttcgcgttttatgttaatcgcgatcaatccgacaagtcctctcgctcggccgaagagctcttccacggtggcaaaatcaagcccttgaacgagccacgttcttcttctaaggactcttctgttgctgaacaaaaaagaggcagagaaagagagagaacttcttcttcaacaacaacgttgtcatcttcgaactcgggtggtcgtagggtgacacgatcacactctccttatagaaaatcatgggaagttgaacaacaacaacaacaacaacctcaacctcggagcagcaaagaggaatcaagtgcaagtgttttgtcctcgagtacttcttccaagggttcgaagaggtggtggctgaaggactttttgttgttccgtagtgcctccgaagggagaggttcaagcaaagatgcattgaagaagtactacaagaagaatagtaacgaagaggttaaagggtcgtcgagttttagatcctcggattcgtcgagatcaagaaaggaaccgctttcggcgcatgagttgcactacgccatgaagagacaagagtccgaggatatgaagaagagaaccttcttgccttacagacaagggattctgggaaggttggctggtttcggaatctag

SEQ ID NO: 84101 - DNA, 601 bp, Glycine max
  Peptide Sequence Number=SeqID_175786
ctatgtgggaaccggtgatgcggaagttgaagtccttaagttgtcggtgtggaggcaaaaaaacattatccgatccattgggggaaggatttgcctcatcaactcggttctatcatccttaccactttcccacctttcgttctttaagatgccaaaaaaaggtgatatgcttgcaaaggaacttcttatggggttgatctcgggtggtgaggacttgtggtgcaaagttttgaaatcaaactatggaaaagaatcatgtggaaagttttgcaggagatcatatagggattcaatgtggtggcgagattcaggccttacttgtggtgaaaatgtgggtttgataacctctgtgggtggaaagttgggtatggagatgccgtggaattctggaaccatatttggggagatgcaggatgctggaatgtggaaaggggatccaacaaggctttatactgtgaaatcagcatatagaaccttgttgttgaagatcaattcccatcatattgaggtgaattctgagtttgtggatttaatctggaaacaacaggtgtcgtctaaagctaggttcttgtgctggaacatcatgtatggtgtcctctaa

SEQ ID NO: 84102 - DNA, 231 bp, Glycine max
  Peptide Sequence Number=SeqID_175787
atgtcgtgggaaagtaaagacaaaccttcgcgagaattggcattagtggtaattagcaatgttgtgaaaaccgagccgggagtgcgatacggtgagattgagaaagggacgccattggacgctgttccaaacagctccagtagcctccgtgagacagtgacggcgagtccgcgagagaaatttaacagggatgtcaccgtcaaacactcaaacgacggcgcggtggtgtag

SEQ ID NO: 84103 - DNA, 1167 bp, Glycine max
  Peptide Sequence Number=SeqID_175788
atgagtggtgcgaatgagaaaaacatgaagaattctctgtttctcctccacaatgcaaacacaatccacttcaatcttcattcccagattacccttccttccattcccctcacaacaattacaactaccaaacccttccctcacaaccgtcacttcccacgcatccaatgctgcagcaacaacaacaacaacaacagcatcgaaatcgacatggtgaagaacagccaaggaatctacgcccccaaagcctccaaggtggtcgtcctctgggacctcgacaacaaacccccccgcggcccaccctacgacgtcgccatctccctcaaaaccctcgccgcccgcttcggcgaccttgtcgacttctccgcctacgccaaccgccacgccttcgtccacctcccccagtgggtcctccagcaacgccgcgaccgcaaaaacctcgacatcctcgaacgaaagggaatcatcaccccaccggagccctacacgtgcggcgtgtgcgggcgcaagtgcaagacccacctcgacctaaaaaaacacttcaagcagctccaccagcgtgagcgccagaagaagctcaaccgtctcaagtccttgaaaggaaaaaaacggcaccgtttcaaagaacgttttttgcgcgggaaccataagtatgacgatgcggcgaggacgcttgtagtgcccaaggtcgggtacgggctggcggcggagctgaggcgagcgggggtgtttgtgaagactgtgcaggataagcctcaggcggcggattgggccttgaagaggcaaatggtgcactcgatgagtagagggattgattggctgtttttggtttcagatgattcggatttttcggagatgttgaggagggccagggaggcggatttggggaccgtggtggtcggggattgggatagggcgctcgggcgccacgctgatttgtgggtgccgtggagtggggtggagaatggggaggttggtgatttggtgcccaagagaagaagggagaatagtaggagaagagaacagggagaagaacatggttttggtttggaagatgatgatgatgatgatggtgaggatgaggaattggggcaagagtatatgttgttgtatgatgatgatgatgatgatgaaggagaagaggaagatggcttatatattttttga

SEQ ID NO: 84104 - DNA, 1485 bp, Glycine max
  Peptide Sequence Number=SeqID_175789
atggattctcccttactagaaaacattgacaactcttgttctaatgttgaggaggagaagacaccgaacactgttgttaagagatttgggtttgagtcgaagaagctatggaaaatagctggccctgctatcgttacctctatatgtcagtactcacttggtgcactcactcaaacatttgctggccttgttggtgaccttgatcttgcagcagtttctgttgaaaattctgttattgctggcctcgcctttggagtcatgttgggaatgggaagtgccttggagactctgtgtgggcaagcatacggtgcgggacagatcaggatgttgggtgtgtacatgcagagatcatgggtcatcttgttcatcactgcccttattttgttacctctttatatttggtcacctcccatcttgaggctcgctggacagacggctgagatctcagatgctgctgtggtcagtactcagttccctccatccatccattggctcttgtctatccagaaaaaagagtctggattggaaaatgggtcaattactggtgaccagaaagtttgctgtgtggatgatacctcagttgtttgcatacgctataaactttccaatagtaaagttcctacaggcacagaggaaagtgctgcagcagttactctcaatacatcatggtgggtgattgtgattgcacaattgttgtacattttcatcactaagtcagatggagcatggagtggatttacatggctagcattttcggacttgtttggttttgtaaagctttctttggcttcagctgttatgttatgcttggagttttggtatttgatgatactggtggtgataacagggcgtttggaaaatcctctgatacctgttgatgccatatctatctgtatgaacataaatggttgggatgccatgattgcgattgggttcaatgctgctataagtgtgagagtatcaaatgaacttggagctggtgatttcaaggctgcaaagttttcagtgtgggtggtttccatcacatcagtgtccataggtgttgttgtcatgatcggagtgctattaacaaaggattactttccctacttgtttaccaccagtgttccagttgccaatgaaacaactaggctttctgctttgctagctgtcacagtgcttctaaacagccttcaaccagtcctatcaggtgttgctgttggggctggctggcaatctctagtagcatacatcaacattgtgtgctactatctagttggattaccggcagggataatattgggatttaaacttggtcttggagcagagctctttaatctttatgcctgtgtaattcagggtatttggtcagggatgattgcaggcatagttttgcagactacaatccttataatcgtcacttcaatacgaaactggaaaaaagaggctgaagaagcagaaagccgcgtgagaaagtggggaggagcaatttcatatgatcaatga

SEQ ID NO: 84105 - DNA, 228 bp, Glycine max
  Peptide Sequence Number=SeqID_175790
atgcaagacataaatgcttgtggttggtggtgttgggtgtttgacgcagtgcttgtggttggtggtgttgggtgtttgacgcagtgcttgtggttggtggtgttgggtggcggatctgatgtaggcttggccgatggtggtggtcggtgggaggagggtggcgctgagtggtggctagtggtggcttggctgttccggcactctgactgtccgtattcactcctctga

SEQ ID NO: 84106 - DNA, 2019 bp, Glycine max
  Peptide Sequence Number=SeqID_175791
atgcaatcagtaaataacaaatctctcattgaagagcttgataagcttcttgagcgattgcgtgtcccttctgagtatgccacaagtttgacaggaggttcatttgatgaagcccgaatgcttcaaaatgtagaagcatgtgaatggttgaccagtgccttgcgtggtcttgaaatgcctaatctagaccctagttatgcaaacatgagagctgttaaagagaagcgtgcagaacttgaaaaattaaaatctacttttgtcaggagagcctctgaattcttgagaaattattttgctagtttggtggacttcatgataagtgataaaagttacttttctcagcggggacagttaaagaggcctgatcatgctgacctgcggtacaagtgcaggacatatgcacgtcttctgcaacatttgaagagtcttgacaagaattgtttgggtccattgaggaaagcttattgcagttctctaaacttgcttcttcgcagagaggcccgtgagtttgcaaatgaacttcgtgctagtactaaagcatctagaaatccaactgtttggcttgaaggttccacaggttctggtcagaatgtaaatgctactgacacttccacagtctctgatgcttatgcaaagatgcttacgattttcatcccgcttctagtggatgagagttctttttttgcacacttcatgtgctttgaagttcctacacttgttcctcctggaggtgttgttaatggcaacaaagctggatatgatgatgatgatgatttgggaattatggacattgatgagaatgacagcaaatctggtaaaaattctgtggagcttgaagctttgaataaatcacttaaggatttacttgatggaatacaagaagacttctatgctgttgtggattgggcttacaagattgaccctttacgctgtatatcaatgcacggaataacagaacgctatctctctggtcagaaagctgatgcagcaggatttgtacgtgatttgcttcgtgacctggagtctcggatatctatgcagttcaaccgatttgttgacgaagcttgccatcaaattgaaagaaatgaacgcaatgttcgccaaatgggtgtcctatcctacattcccagctcatcaggcactatctatagtgaatgggcttggcgcatgaatagtatggtaggtggttcagtaatggatttaaggacaagctttgatattatgtgggattttgggtctaattcaatcctacaaaatcggcatatttgcaacccttgcaactcggatggagcagtacatccaggtttttaccgtaatattactggcgggaatgtcgctttacaggttagcataatgtttgcaactttagaaaaaattgcacaaacagatccaaagtatgcagatattttcctttttgagaactatgctgcttttcagaatagtttgtatgacctcgccaacattgtgcctactttggccaagttttatcatcaggccagtgaagcctatgaacaagcttgtacacgccatattagcatgattatctactatcaatttgaacgccttttccagtttgctcgaaggattgaagacttgatgttcactgttgcacctgaagagatgtattacgaggttcatgaacggacttggacaggggtcagtaatgtggatttgggtgacgtaacctcaaatgaggctattggaacgggagaatgtccccacaagggggtaaagatggcaaaaatagattccttttcagcttggactgtcaaaaatggatcttcggaagatgttaaaatccagtttatctggggtatggttgacaagtccattgctgcgatgtataagaaactgcaaaagaatttgacttcggaggaattgttaccctccttatgggacaaatgcaagaaggaatttcttgataagtacgaaagttttgcccaactcgtgtctaagatttaccctactgagacgatcccgtctgtagcagagatgagagaccttttagcttccatgtag

SEQ ID NO: 84107 - DNA, 1374 bp, Glycine max
  Peptide Sequence Number=SeqID_175792
atgaatgactacatcctcactccaacagcctttattcataaactgactcatcagtcatcgcagaacccttcccttgccagcagtgtgtttgggattcctcgaccactcaactcccagaaccctgctggatgtctggtaggaggccctcaacgtgtcgtcgccgccgtagaccctccgcgagacggcgaagtcccacgtgttcttggccacgtcataggcgggaaactgtgtccgaattatgagaaggtgaatgggttggagacggtgctggaggttcctattccggaggacatgtggaccagcattggcagcaccgcctccaaccgctggctgaatcttcgtgctctcttgagagctcaaattaattccaataaaacctcctcgtcgtcgtcgtcatcgtcatcgtcatcgtcgtatctcgttgcttcctccaacaacgaattcatcgacttgcttaagctcgttggttgtcccctcatccctcttcaggttcaatccgatcacaccctaactcgtcccctcaaagatgcttcttccatcgaagcttcaagtgccaaatatatagtgcagcagtacataggtgcgattggaggaatggttgcaatggattcgctgaaaagcatgtatgcagtgggacaagtgagaatgtttggttcggagatgcgtcaaggaggtgaaaacatcaaaccaaaaggcaaggctgaagtagggggttttgtgctgtggcaaaagaacccagatttgtggcactttgaattgattgtctctggattcaaggtaagtgcagggagtgatggcaaggtagcatggaaccaatcttcttctcaactttcacaagccaaccaaggtccccctagaccccttcgccgcttctttcaggggctggatccaaggtgtacagctaacttgttcatagacgcagtatgtgtaggagagaaaacaataaacaatgaggattgttttacactcaagttagagacagcacataacatcctccaagcactgaacacgtcccatacagaaattctaagacacacagtgaggggatactttagccagcgcacggggctactagtcaaattcgaggatacaaagttggtaagaatgaaacatgctaagggaaatgactcggttttctgggaaacaagcatggagtctgtgattgaggactataggtgtgtggatggcattaacataggtcatggtggcaagacagtggccatcttatataagtacggtatggcgcataatcaccagcgaaagattgaggagacatggaggattgaagaggttgattttaacatttgtggcttgtccatggattgctttttggccccctctgatctcaagaaggaacaacatggtgtagtgtag

SEQ ID NO: 84108 - DNA, 1005 bp, Glycine max
  Peptide Sequence Number=SeqID_175793
atggccgacgacggagcaacctcggcggcgacgagccggagaaagccgtcgtggagagaaagagagaacaacagaagaagagaaagacgaagaagagcaatagcagcgaaaatatactcaggacttcgagctcaggggaacttcaacttgccaaagcactgcgacaacaacgaagttctgaaagctctctgcgcagaagctggttggtgcgtagaagaagacggaaccacttatcgcaagcttgtgataagtagcaataaatctctgcttgttgatatgccgaagacggaatcaaactttggtgctcaaggttgcaagccgcctctagccaatggtgctgggagctccatgagaaacattcccttttcttcttctcaaaatccaagtcctctttcttcatcatttcccagcccaattccttcataccaagttagcccttcctcctcctctttgccaagcccgtttcgtttagatggggataaggacaatgtatcaaacctcattccatacattcgcaatgcgtccttgtctcttcctcctctcaggatatcaaacagtgcccctgtgacaccacctctttcatcaccaacatcaagaaattcaaaaccaattcctacatgggagtctattgccaaagaatccatggcctccttcaattaccctttctttgcagcgtctgcccctgctagccccacgcaccgtcacctttacacccctctcactattccagaatgcgatgagtccgatacttccattggtgagtctggccagtgggtgaaattccaagcatttgctccttctgcatctgtgttcccaacttctccaaccttcaatcttgttaaacctgtgattccgcacaggatgcctgataactcaatccaagtgatgaggacgagttcagaagagtttggggtacaggtaaagccttgggttggggaaaaaattcatgaagtggcattggatgatttagagctcacacttggaagtgggaaggtgcggagttag

SEQ ID NO: 84109 - DNA, 1737 bp, Glycine max
  Peptide Sequence Number=SeqID_175794
atggaagtttgtgagccagtcaaatctgaaaatagattaaagcaccgccccttgacccctattaggttcttaaggggtctgataggtttagtggtgtttctttctacagctcttatgtgtttagtctattttgtgccagtagcagttgtaggattgcggcttttcagcatacgttgtagtaggaagacagtgtcattcatctttggactttggctgtctctgtggccctctctatttgaaaagattaacaaaactaaagttgtgttttctggggatggtgttcctatgaaggaacgtgttttacttattgctaatcacagaactgaggttgattggatgtacttgtgggatctcgcacttcgaaaggggagactgggatgcataaaatacatccttaagagcagcttgatgaaactacctatctttggttggggattccacattctggagttcattgcagttgaaaggaagtgggagatagatgagcaaatattgcaacaaaagctttcaaccttaaaggaccctcaagatcccttatggctagctctttttcccgaaggaaccgattatactgatcagaagagtaaaaatagtcaaaaatttgctgctgaagctgggctccctgtgctgacaaatgtattactaccaaaaacaaaggggtttcatgcttgcttggaagctctgcgagcctcattagatgcaggcaatgtagcatatgccacagtgtttaccctggagaatcattgcagttacacagtttggcccggcacactttccggcaacggcgctgcccttctcggcgaaggcggtttcgccctggcacccggttcggcggtccagctcaccgcgccggctggctggtccggccgcttctgggcccggaccgggtgcagcttcgacgcctccggaagcggaaaatgtgtcaccggagactgcggcagcggactgaagtgcagcggcggaggcgttccgccggcgactctggcggaattcaccctcggaagcgccagcaacggcaacaaggacttctacgacgtgagcctggtggacggttacaatgtgggcatgggtgtgcgggctaccggcggaaccggtgactgccagtacgcggggtgcgtggcggacgtgaacggtgtttgcccggcggagctgcaggtgagagacggcagcggcgcggtggtggcgtgcaagagtgcgtgcttggcgttgaatacggcggagtattgctgcaccggcgaccacaacacgccgcagacatgtccgccgacgcattattcggagatattcaagaatgcgtgtcccacagcgtacagttacgcatacgatgatgcgtcgagcacttgcacgtgttctggatcagattaccgtaacgtagcatctgcaacagtgtttaccctcgaaaaccattgcagctacgcagcttggcccgggacactttccggcaacggtggttttcccttggcgccggattcatcggttcagctcaccgcaccggccggctctgggcccggagcgggtgcaccggagccggtgttcacggtcggatccgccggtaacggcggcagcaatgacttctacgacgtgagcctggtggacggttgcaacgtgggcgtgggagtgcggggggtgctcggaggacttgaacgcggcgtatatagttacgcttacgatgatgcttcaagcatttgcacttgttctggatctgattacgttatcactttttgccctgctcattaa

SEQ ID NO: 84110 - DNA, 168 bp, Glycine max
  Peptide Sequence Number=SeqID_175795
atgatttcacctcttttggtgctaatagtcaaagtaaaggctgtattggattatttatatggtctaactttaagctttgtcttccagatcgtagcatctgttaacttggccgaggagttgaaagctcccaaacttgttgctgagaccacatggaattttgagatgtag

SEQ ID NO: 84111 - DNA, 1209 bp, Glycine max
  Peptide Sequence Number=SeqID_175796
atggtgcttcagaaactgttatcgaagcatttctttgacggtgtcaaaatgaggccgtttgaacgcagtgtcgtgtcgtctccaactatgcaacaacaagtcatcgcgcctccgagcatgctgggagtgagttcggcagacggaggatttctccggcggtttttcctcctccggcaagcggtgtaccactccagtccggcacgtttcccggatttcctgtctctccccgtcggagagaagctccgggagaaactcaaaagcatcaacaacatagccggcataggagactgttgtgttgctctcgctccggcacctatggccagcgatgcggtgtttggaagtggaatgtctgtcagccacgcgaggaagattttgagggtgccgcaaatggagaaggtgaaggcaaagctgagaaacgtttcggagagttcggttccgtactcggagtttttgcggatctgcgttgagacgtgtgagaatcatgagcaaggggctgagtttgcaaagatcttggatgaatccggaaacgtcatcgttttggggaaagcagtttttctccggccagaggaggtattccgctctgctgtttctggcagctccactaaactgcagaggatgatgatgacgtggatccttatcctagtgtggcgtaacggtgctttggctggttcccttgaaacggtttctttcgggtgggacatgtggaatgtggcaaaatcaatagagagcttaatctatcaatcaatagccaatccaaatgaccctagaaggaaggagctagagctgatggagaagcaaaagtggatgattgatgaaaaggccaaggcccaggtccgagctgagctttattttgggctgggcttcttgacagtccagaccctcgggttcatgaggctcactttctgggaactaagctgggatgtgatggagcccatatgcttctttgttacctcattcggcttcgctcttgcttatcttttcttcctcaagacctccacagaacccacctttcagggcttcttccatcaccggtttaaggccaagcaagagcgtctcatgaagacacacaactttgacatgagtaggtacaacgagttatttaaggcatgctatacaaattatcatggtggtgccaaatttgaatcttcttatcccttccactaccctggggagacacatctaactgatctaagagccttgcatcgttga

SEQ ID NO: 84112 - DNA, 1128 bp, Glycine max
  Peptide Sequence Number=SeqID_175797
atggcgcttcgaaaactgttatcgaagcgtttcttcgaccgtatcaaaacgaggtcgtttgaacgcagcgtggtgtcatctccaactatgcaacaacaagtcatcacgcctccgagcatgccgggagcgagttcggcagatggaggatttctcttgcggtttttcctcctccggcgagcggtgtaccactccggtccggcacggttcccagatttcctgtctctccccgtcggagagaagctccgggagaaactcaaaggcatcaacaacatagccggcataggagactgttgcgttgctctcgctccggcacctatggccagcgatgcggtgtttggaagtggaattgtctgtcagccatgcgaggaagattttgagggtgccacaaatggagaagaagtattttgcgaatctgcgttgagacgtgtgagaatcatgaaacaaggggctgagttcgcgaagatcttggatgaatccggaaacgtcatcgttttagggaaggcagttttctccggccagaggagactgcagaggatgatgatgacgtggatccttatcctagtgtggcgtaacggtgctttggctggttcccttgaaacggtttctttcgggtgggacatgtggaatgtggcaaaatcaatagagagcttaatctatcaatcaatagccaatccaaatgaccctagaaggaaggagctagagctgatggagaagcaaaagtggatgattgatgaaaaggccaaggcccaggtccgagctgagctttattttgggctgggcttcttgacggtccagaccctcgggttcatgaggctcactttctgggaactaagttgggatgtgatggagcccatatgcttctttgttacctcattcggcttcgctcttgcttatcttttcttcctcaagacctccacagaacccacctttcagggcttcttccatcaccggtttaaggccaagcaagagcgtctcatgaagacacacaactttgacatgagtaggtacaacgagctatttaaggcatgctatacaaattatcatggtggtgccaaatttgaatcttcttatcccttccactaccttggggagacacatctaactgatctaagagccttgcatcgttga

SEQ ID NO: 84113 - DNA, 534 bp, Glycine max
  Peptide Sequence Number=SeqID_175798
atgagaaaatgcgacggtgttggaagacgagtgggctggctcaatgagaagtttaaggaaagtgaagagatgatgggaaggggtggcattggaagtttgaggaaggagttggaggagaaggttctagagaaaagagagaaaggtttatgcagttcaccgtctaggagtcctccgtcaccggctcgtcgtcgcaagctttctccatcactaggtcatcgtgccttgttccccgaagatccatggaaaagtgtaatagaccaagcaaaagacgaagcaagcaaagcaggtctctctgaagatacaatatttggggctgagaaggctataacagatggttctgccgaaaaggttgctgaggatgccttgggtggaggatctttggatgattgggttcaagaagcctgtaatattgccaatggtggaagttcaccatttggggcactgaaagatttacctgattacaacgaagaggataatcttccggaggcactagaattggcaccaaaaagttcaccgtcagtaacacccgtatag

SEQ ID NO: 84114 - DNA, 1125 bp, Glycine max
  Peptide Sequence Number=SeqID_175799
atggaaacgttggaagtacttcacatgaacaaaggcgcaggccaaactagctatgccatgaactcttccgttcagaatacgataatctcttgcgcggagccagcaagaaagaaagctcttgtgcaaattctttgctcaagtaattggcctgagaagatgggaattgcggacttgggttgttcctcaggaccaaatgccttaagggtcatttcggagatattggatggtgtgtatgccaccacatgcctcttgaatcgccctgcgccagagttggtggtgtatttgaatgaccttttcaccaatgacttcaacaacatctttggctcattgccatctttctacagaaaacagaagcaagaaaagggtagtgggtttggatcatattttgtttcagcagtccctggctctttctatggtaggcttttccctagcaaaagcctccactttgcgcactcttcttctagcctccattggctttctcgggttcctagtgggttagagaatggtagtgggagagcattgaacaagcgaaagatctacttatcaaagagcagtccaaagtgcgtgctagatgcttattctcagcaattcaaaaacgatttttcagtgtttcttgcttcacgttcccaagaaatggtagcggggggacgcatggtcttgtctcttatgggcagagaatccatggacccaaccactgaccatagttgctatcagtgggaactcttagcacgatccctcatgagcatggtttctgagggtcttttagaagaggaaaaggtggattcttttgacgctccatactatgcaccatgcttggaggaaatgaaaatggagattcaaaaggaagggtcatttattgtgactgagcatgaagcttatgaaatcgattgggatgctggaatggaattgcaaagtgattccccaacaacaggtacgccattaacgagtggagaacgagttgcaaggagcattagggctgtggttgaatccatgttggaatctcatttcgggtgccacataatggatgagctgtttcgaaggtacgcacaaatggtagaggaccacttatcaaagactaggaccaaatacattaatttggtcatttctctcgtcaagcaaggttga

SEQ ID NO: 84115 - DNA, 2067 bp, Glycine max
  Peptide Sequence Number=SeqID_175800
gttggaaatgaggcagaatatgtgagctttgatcttcgaccttcagatgctatcaacattgcagtaagatgcaaggttcctatacaagtcaacaagtacttggcatacagtgatggtatgagagtaattgagtcaggcaaattgtcaacacagttccctggtatggatggccgactatttactgaaatggaccggccaagtggtcaaccttgttccgagaccacggagtttaatcttttgcacaacatgttgaaagctgttgttgaagagcgctataaagatgctgggttctctggtcatgatgaaaggagggagaggaaatcagattttgagaactcagaagacgataggcgaacgaggattggtagcttgaaaaagaaagcaatcaatgcttcaagcaagttcaggcattctcttaagaagaagagcagcaggagaaagagtgcaaaccgaagtaattcggtttccattgaggatgttcgagatgttaaggagctccaagcagtggatgcatttcgacaggcacttatgttggataacttgctgccaccaagacatgatgactatcacacgttactgagattcttgaaagcaaggaaatttgatattgagaaagcgaagcacatgtgggccaacatgatccaatggaggaaagaatatggtactgatacaattatggaggattttgaattcggtgagttgaatgaagtcctgcagtgctatccacatggctatcatggtgtggataaggaaggaagacctatttatattgagaggttaggcaaagttgatcccaataagcttatgcaagtgactaccatggaaaggtatttgagataccatgtgcagggttttgagaaaacgtttgctgttaagtttcccgcatgttctattgctgcaaagagacatatagattcaagtacaaccattttggatgttcatggtgtgggtttcaaaaatctaaccaaatctgcgcgggaactcatcatacggctgcagaaaattgatggtgactactatccagaaacattatgtcgaatgtttataatcaatgctggtcccggttttaagctgctttggaacacagtgaaatcatttcttgatcccaaaactacttcaaagataaatgttcttggaaacaagttccagaacagattactagaaattattgatgcaagcaagctgcctgaatttctaggtggtagttgcacttgtatagatcaaggtggttgtatgaggtctgataaagggccatggcaggatccaaacattttaaagatggttcttagcggcgaagtgcaatgttctagacaaatagtaacagttactaatgatgaggggaccctgattgaatgtgataaggcttgttttccaatgccaataagaagtagtgatacatcaacagcagaatcaggatctgaagttgaagatatcacttctcccaaagcaagtgggaattatacaaacccaaggttgactcctgtccatgaagaagcaagattgattggtagggctagtggtttctctgagtatgatgattatgttcccatggttgataaggctgttgacctcgggtggaaggagaaacaagtagcaactcaaaactcatatggctcaacagaaaatttcctactgagtactggaaagtctggtggaaactgtgcatatatcttggctgttattgtcggcttctttgttgccatctttacttttgttcgttcattagcacttcgtgtgactaagggaatacaagacaccaaatctgattctgccaaaaatatgctgcctaacacgactgttgattcaataaccaaggaagaatctcgtcccccatcgccagttcccagattaacaaagacagaactcatctcatctgctttgaaacgccttggtgagcttgaagagaaggttgacatactgcagtcaaaaccaaatgtcatgccatatgaaaaagaggagctgctgaatgctgctgtttatcgcgtggatgcattggaagcagaactgatcgctacaaagagggtagatctgcttagcatagagctgctgcttcaattcaatacatga

SEQ ID NO: 84116 - DNA, 414 bp, Glycine max
  Peptide Sequence Number=SeqID_175801
atggcgcagtgtgtgaccaaaaacacattcgtgcaaggaaaacccttccttccagttccagcagctcccactaaaaatgcgctgcaggttcggagagtggttcagtgcggtgtgtggtgcaggaagaaggagatacacccgcaattccacgaggaagcgaaggtgtactgcaacggggagctggtgctgacgacaggtgggacccagaaggagtacgtggtcgacgtgtggtcggggaaccaccctttctacctcggaagccggtcggcgtctatggtcagcgacgaccaggtcgagaagttccgcaagaagttcggagagctaaaagagatcatggagattcctgttctcaagggagagattgttatcccctcaagacgcaagggcgtttccaaaggaggcaagaaaaaataa

SEQ ID NO: 84117 - DNA, 489 bp, Glycine max
  Peptide Sequence Number=SeqID_175802
atggacctctgcgacaaggttgacgatgacaaaatacgcaggcggcatgagggggaggcactctgcgacgaggttggagcaaagggcagtggcgaggagctggcaatgacctcacgaatgccacgcctactccctccccctccctggccagcactgcgggaccaaagggagggcgatggccatgaaggaggtggaagtgctacgccacgtcagaggttggagcaaagggcaatggcggtggcgaggctgcaacacgacagaggtggtgtaacggagttggtgaggaggaggtggggaagggccgtgggagggaagacggttgaggaagttaaaaggcactatgagatgctcgttgatgatttgaagcaaattgaagaaggtcacgtgcccttgcctaattacagaaatgttgctgcaacaggaggaagcagcatcagaggctacagttacatggaggaagaacaaaggttgaaatcaaatccttattga

SEQ ID NO: 84118 - DNA, 1101 bp, Glycine max
  Peptide Sequence Number=SeqID_175803
atggtcccagatattgttattgacattcagttccgatgctctcttttatgcactttggttccttgggttgctgtttcattgtttggcattgatttttgtttcttcttcctctatgtgcttattgcagatctgtccgtgtcaagcaatttttctacagtggtgaagaacccggcggaatcttcaataccaaatctttctttttcaataccttcagtcttctcaacgcctacagcagatcctttgcctaatcacaattatcaccatcttcccaactctactccaacaagatgggcacatcgatctccagcacaccctctgttgagacagatttctgatagtcgaatcatgggtctgaaatcgccagacaactcaatttctgaaggtaggccatcatttgtactctcaacttgcagcaatgaaatggcagctggatccatatgcggatcatctgatggctggtcaatgcgcaccttttctgagctggttgcatcatcacaaagggaaaggtggtcctttgatagtgagtgttttggatctggccgtcacaagataagtggatccagtagcaggttctcgtattctccctccatggaactacaatcttgtggggcttgctcaaagctattgaccgagagatcaacatggagcaaccagaagtttattgccaacagtgacctctcagttgttgctgtactagtctgtggtcattcatatcatgcagaatgtttagaggctatgacatcagaggcagataggtatgatccagcatgtccaatttgtatggttggagataagaacttgtcaaagttgttgtccagaaaaggtcttcgggctgaatcagagatgaaggccaagaaccacaagatatccagaaaccgtgtagttgatagctaccttgatggtggttttgatgtttttgatcgtcaaaaagatatagatttgagaggaaaagtgtcaaaaatggaacctagctgcagtgcaaggagctcatttggaaagcctttcttgaggagacacttttcacttggatcaaagtggagccgatccctgtccgagaatgattctgccaggaagaaaggcttttgggcaagatatcgttaa

SEQ ID NO: 84119 - DNA, 1089 bp, Glycine max
  Peptide Sequence Number=SeqID_175804
atggaaatagccttatcgcttcctcttgagcgttgccatgttcatgttgggacaagttttgggtcgataaccccaacgttgtctgaaaagcgcagcatgttcattctcggtatgggattttttgggcaatcacttgcacgcaaactccacaaccaaggatgggtcgtgtctgggacttgcacaacccatgtgaagaagaaggaacttcaggaaatggggtttaatgtccaccttttcgatgcaaaccaccccgatgtggacgtcctacaagtaatgaaaaattactctcacattcttgtttctgtcccacctcttgtgggcattggtgacccgatgcttcggcatgaagagcttttgagaagctcgttaactgatggggatcttcggctttctaaaactaggtttgccccactacaagccatgtctactgctgctttgacatacttttctaatgctttcagattcaaatatgatgacagagacactttctgccttgcaggtgtctatggagactgtgatggtgaattggtggatgaggattatccaacaaacccggaaagtgggttggctaaattaaggttagcttctgaagaaggctggtcaaatttggctcacaatcttgggatctcaccgcttttatttcgactaggaggtatctatggccccggtagaagtgctgttgatacaataatcaagcagaagccaatgtcagaaggtcagaaaaggagaaaaaaccgaaaatatacatccagaatacatgttgatgacatctgccaggcactgatggctactgttcttgcacctccccccagggaagtttacaatatcgttgatgatgaccctgctccgagggaagaagtatttgaatatgcaatgaaattggtggagaagaaatggccagggttgaagttacaaagtgtagagcagaagcagaaagagtggccaaatgcgaagaatccaaggggtgagaagagagtgtgtaatgctcgaatgaagagggaactgggggtgcaactactttaccctgattacaaatcaggattgaagagtataattcaccaaattcagactccattccagtctcattga

SEQ ID NO: 84120 - DNA, 213 bp, Glycine max
  Peptide Sequence Number=SeqID_175805
atggggatgagtgggtcaccgaagaagggaggccacaactacaagcagaagacgatcataaatttgcccaaaggaggaagccattgttcatggtggcttgaaaggaggatggtgcattgcacaagagaaaggacacgactcaaaattcaaagtactcgtgatggggttctgaaggttgtcttactcacatcttcctccttcatcaaaatctaa

SEQ ID NO: 84121 - DNA, 396 bp, Glycine max
  Peptide Sequence Number=SeqID_175806
atgggagaggtgagcactggcagaggaaaggcttttgatatgagaaatgatagagagagaacaagagggcgtggaggtgggagtggctcaggaaaggacaaaattgattctcttggtagactcctgacacgaattttacggcatatggcatctgaattgaatttgaatatgcggagtgatggttatgtaaaagttaatgatttgctaaagctgaatctgaagacatttgctaatattccactgaaattgcacactattgatgatattagggaggctgttcgaaaagataataagcagcggtttagcctcttagaagagaatggggaactactaatacgtgcaaaccaaggccacacagtaaagatgtcattaatgaaaaactctactagtgattaa

SEQ ID NO: 84122 - DNA, 1107 bp, Glycine max
  Peptide Sequence Number=SeqID_175807
atggagtcagtgagcactggtccaagggatttgagccactggacaccaaagacgatgtccgcgccggcaataggcagcacatataggtccacagcacaagtaatgttgcgataccaagtccccttggatgaagttttgcgtactgctgccatccatgaggatgacaacttggtggccgacgatcgtgcccaacaggagccgggtcaaggccctctatattatccccaacagcatcctcttcgccgcaagcaagagaaaaaccctagaggcacaacggtggcctctatggcaatttcttccgacgacaggcgctttagagtgggcggtggtcgtggcggcagtgagtgtggtgacagtgaaggaagcagagcgggagaagggataggacgtggcggcagtgagtgtggtgacagtgaaggaagcagagcgggagaagggataggacgtggcggcgacatcgtcagcactgcttctcctcctagagacaagcgagactggttgcctgaaccagcgttagtgggtgcaatgcctgcacctcgcgacggatttcgggctgacggtgcccttctaagtcagcttgaagagagtgcttgtagggttgtcgtaatggtacggagcgaagcgagtttggaggacctagatgaacacaggataagaagtgaattgaccattactggtcatccactggaactaggcaagtgctctgccatccatgtagaaagaaataatggtaagtcgatcttgttctggggttgcatggtactagaaatattgattgatcttgaacacccactcgaaagggtcagtgccatcaaagcggtagaaaggcaagggaggaaaacgaagaagcagctcatcaaatttctgagtcatagactagactgtttctccgagggacacctggtgattggtgagcttgagaattgcggctttgaggttattagagggcccagaggtacaggaggggtcggtcatggtgacgagagcaccaaaatgatagggaaggctagtactagtttcgaggaccagttcctcctagaagaaggaaatttagaagataagaaaatatcacaagctaaaacggaattggttattgctgtcccctga

SEQ ID NO: 84123 - DNA, 5628 bp, Glycine max
  Peptide Sequence Number=SeqID_175808
atggagggggagaatattaggtctgggacaaagaagaagcgatccaagaaggaaattggtttcgactccgacgacgacgagcccattgggtcaatgtttaagttgaagaggtccaagaagaagggtagtggtggcggcagtagtgatgctgctgttgttagggagaaagaggatttggggggtatggatgataatgataccttggctagctttaggaagaggctgaagggtcctaagagagatcagggatctggggtcacaagaggaggagcaattcctgctttgcatgtgtctgatgaagatttggttgctttgggacctaaaggtaaggatgagaaaggcgtggcgcccgtgcccttggtgtggggtgatgaggacatgcagatgcaagattgcactgatcaacaacacatggaggatttgttgcccgtgattttcaataaggcacagtctagttcttctaggaaatctcgtagccagggttcgaggcagaaaaaggggattcagaatgtagatagtgaaggttttgtggaagctgtggattctggggttgaaagtagatctggatctgcttctggctcgaaattggttggggggaatgttgagtctgtggaactcttgcctcaagcgtctgaacgggttgttgcatctgtggtggatgatcagaagtgtggtgatgactgttttcaagaggaagctgtgaagggccattgcgatttggacattccagatggaccgtctcagtcgaacaatgtctgccatggagatatgcagcaattgtcttgtgtacaagttgaagatatttcttgtcattctgaccaaaaggttggattgcaggaaagtgctctcagtgatgctttaaaaaatttatctaccacgtcgcatgatgaaatagttgatactatctctctctcaaaagtgggggagggcgaaagaggatttactgaggcaggagagtccgaaaacagattgacggttgaaccagcaaaagtgtgcaacagtgcttcagaacctgatgtttctacttttgctgggaaagaaaatgtcttaacttcttgccacactgaacccttgattaaatcagctgaaactatattgaatgagaataataatatggttgctagaaaagttttccaggaatcctcatggaatggagctctggatttatctggatgtcatatggaagtagacggaggtggaaaatcagaaaccgagttcgtttctgatagaaatttctgtgattatagtagtttagatacaaaggccgaagtgcaagattttgtttcaggtttttcacctaaaagaaataatgtaactgtcagtggtagtttatcttctatggtgtctaacgaagccaatgaagctgaattgactgcccactcaaatcacccagagaaacctctagaaggttgcaatattccaaaagactcaactgcttcaattctaaaatgtagctcagtgttagatccaattcaatctgatggatcctctcttcagtcttctattccagatgaaaatgggaactctgctgaataccgggcccctgtatctgattttgctgataatgagggtaagatatcaagcatcccacgggcggtgcgaaagaccaaaatgcgtaagcatggtgacatgacatatgagggggatgctgattgggaaattttaattgatgatcaagctctaaatgaaagtcaagttatgacagatggtgaccgcactcttagatcaagattgaagcatgattcctctttgaatactggtgaagactctgaaaatgttgcagtagtagcagtatcagctgggctgaaagcccgtaaagctggtccaattgagaaaataaagtttaaggaagtcttgaagcgtaaaggtggtctcaaggaatatttggattgcagaaatcagattttaagtctttggaacagagatgtcacacgtattttgcctcttgctgaatgtggagttagtgatactcattctgaggatggaagtcctcgttcttctcttattagggagggttatataaatgttggaattgcctctcagaaggagaatgttggaagtaatgcaaggcattgttataaactggtaaaagaaaaaggttttgaggaaagtctcgcagcttcaatggctgactctgaagatggagtttcctttcttgttggtcagaccaaaatgtcagatacttccaatgagattaacaatggtctaacaaaggatggtgatgacctaacacttgaagccgcagaaggcatgaggcatgctaatgaaatgaagacggatttatcaaacatgacacaacaggtagaaagaaaaaaaaatgattaccagggaaatgacagttctgttccttcttccaactttcctgattgcagattgatttctctggtagctaaagagaaaagcaatgactctacctgcataaaatctgccttagatgctcgggtaggttatcatctgcagtctgatttagatcctaggaagagagtaattgtcattggagctggtcctgctgggctaactgctgctcgccacttagaacgtcaaggattttctgtttttgtgcttgaggctaggagtaggataggaggtcgtgtatttactgatcatttgtcactttctgtccctgttgatcttggtgctagcattataactggtgttgaggctgatgtggccactgagagaagaccagatccttcctcattgatttgtgctcagttgggtcttgagttgacagtgttgaacagtgattgccctctttacgacatagtgacaggacaaaaagttcctgcagatatggatgaagcattggaagctgagtataatagtcttattgatgacatggtattggttgttgctcagaaaggggaacaagcaatgagaatgtctcttgaagatggtttagaatacgctcttaagattcgccgtatggcacgctctgaaagtagtgaagaaactgaacaaaataattctgcagatagtccatttgattccaaaaaggatagtactctggaaaaaaaacttggtgaggagattttgagccctcaggaaaggagggttatggattggcactttgctcatttggagtatggttgtgctgctttgcttaaggatgtttctcttccctactggaatcaagatgatgtgtatggaggttttgggggagctcattgtatgattaaagggggttacagctctgttgttgagtctctgggagaaggactgacagttcacttgaaccatgttgtaacaaatgtgtcatatggtatcaaggaacctggccagagtaataaagtcaaagtttctacggaaaatggcaatgagttctttggcgatgctgtccttgtgactgttccacttggctgtttgaaggctgaaactatacagttctccccacctttgccacagtggaaatgttcttctgttcagcgtcttggttatggagttctaaataaagtggttttggaatttcctagtgtattttgggatgatgctgtggactactttggagcaacggctgaggagagaagcagtagaggtcactgctttatgttctggaatgtcaggagaacagttggggctcctgttcttatagcattagtggttggtaaggcagccatagatggtcaaagtttgagctcttctgatcatgttaaccatgcattgaaggttctccgtaaactttttggggaggactcagttcctgatcctgttgcctacgttgtgactgattggggtagggatccttttagttatggttcttattcttacgttgctgttggagcatctggagaagactatgatataatagggagaccagttgataactgcttgttttttgctggtgaagcaacatgcaaagagcacccagatactgtcggtggtgcaatgatgagtggactacgagaggctgttcgcatgattgacatattgagcagtgggaatgattatattgcagaggtggaggcattggaagctgctcggggacagttagacactgaaagggatgaagttagggatataataaagagacttgatgcattagagctttctaacataatgtacaagaactctttagatggtgctcacattttaacccgggaagctttgttaagggaaatgttctttaatacgaaaaccactgctgggcgcttacatgtggccaaacaattgctaactcttcctgttggaaacttgaagtcttttgctggaagtaaagaggggctagccattctcaattcatggatactggactcaatggggaaggatggtacccaactcttgaggcactgtttgcgtcttcttgtccgtgtttcgactgatcttcttgctgtacgattatcaggaatggggaaaaccgtgaaggaaaaagtttgtgtacatactagccgtgatattcgtgctatagcaagtcagttggtcaatgtatggcttgaagttttccgtaagggaaaagcttctaatggtggattgaagatatcaagacaaacatctgctgtagatttatcaaagagaaaatctgtaaaagattcagccttgggaaagccacctctgggcacatatcatggtaccattgagaataaaggaggcttgctgaatcccacctctgctggaagcaattcaccttccactgcacatgtgaagaaattgcacagcaaacaaggaagacaaccagcagcatatgactcaaggcacgaggtcagttcttccaggtctaaaggttcaatagacacagtagttgctgagaaggaggataacctctgcactatatctgaagaagaacaggctgctatagctgctgcagaagctgcccgagctaaagctcttgctgctgctgaggcatatgcctctgcagaagccagatgtaataccctgttacagcttccaaagataccctcattccacaaatttgctagacgtgaacagccttcacaaaatgacgagtgtgatagtagaaaaagatggcctggtggtgtttatggaaggcaagattgtatttcagagattgattctaggaattgcagggtcagggactggtctgttgatttctctgctgcttgtgtcaaccttgataattccagaatgccagttgataacctttcacagaggagtcattcaaatgagattgccagccatttgaatttcagagagcactcaggagaaagtgttgctggggacagcagtatatatacaaaagcttggattgacacagctggtggtattgcaattaaagaccatcatgccatagagagatggcaatctcaagcagctgcagctgattcttatttttccaacccatctattgatttgaaggatgaagaggattcaaatgcctgttcgaagttacccagctggaagcgtgatggtattgcaaatgagagctctatttcacaggttactgtaaataaggaggctcaaaaaggtcattcacgaggagcagatcatattaaacaggctgttgtggactatgttgcatcactacttatgcccttgtataaggcaaggaaactagacaaggatggatacaaggctataatgaagaaaagtgaaacaaaggtcatggagcaagccacagatgcagaaaaagccatgactgttcgtgagtttctagattttaagcgaaagaataag

SEQ ID NO: 84124 - DNA, 360 bp, Glycine max
  Peptide Sequence Number=SeqID_175809
atgaagcccttaccaagcttcaatcaacatgtgaaaccctcaggcccttacatatcatttccaacaacgtcgttgataacaccttcttctagcaatgcctctatctcctcctttgccctaaccctcaccttcacgaaattagcgcacactatagggaatctcaacgatgtcgtcaactttaagaagcgaggtgaagattattgtaacaatgaggcatcggtggaaaagagggttaaggacgccatggttgagaaagggaagcccttgatcttggagttgatgtgggttcttggtatgatcaatttctctttggttgaaatcggaagtagcatcaaaagagtgaagaggtttaaagaataa

SEQ ID NO: 84125 - DNA, 2799 bp, Glycine max
  Peptide Sequence Number=SeqID_175810
atggcttccgttgaagaaaagattaaaactggaggagttggaggaggaatggttgttgggggtcaaactcttgttgctgagatgaaactgttgaaagaaatgcaagaacattctggggtcagaaagactttgaattcagagttatggcatgcttgtgcaggccctcttgtgtcactaccccaggttggaagccttgtgttttacttccctcaggggcatagtgagcaggtggcagcttctactagaagaacagcaacatcacagattccaaactaccccaatcttccatctcagttgctgtgtcaagttcagaatgccacacttcatgcagacaaggagacagatgaaatctatgctcaaatgactctgcaaccactgaattctgaaagagaagtttttcccatatctgattttgggctaaagcacagtaaacatcccagtgagttcttctgcaaaactttgactgctagtgacacgagcacgcatggcggcttttcggttccacgcagggcagcagagaagctctttcctccattggattacacaattcaacccccaactcaagagcttgttgttcgagatttgcatgataatacctggacatttagacatatataccggggtcaaccaaagagacacctgctcacaacaggatggagtttgtttgtaggctcaaaaaggcttagagctggtgattctgttcttttcatcagggatgagaaatcacaattgcgagttggcgtgaggcgtgttaatcgtcagcagacaacactgccatcatcagtactttctgctgatagcatgcacattggtgtgcttgctgctgcagctcatgctgctgccaatcgaagtccattcactattttctacaatccaagggcatgcccttcagaatttgttattcctctggccaaatacagaaaatctgtatttggaactcaggtctcagttggaatgagatttggcatgatgtttgagactgaagaatcgggtaagcgcagatatatgggtacaatagttggtatcagtgatgtggatcctttaaggtggcctggctctaaatggcgcaatattcaggtggagtgggatgagccagggtgtggcgataaacagaatagagttagtgtgtgggagattgagactcctgaaagcctttttatctttccttctttgacttcaggtctaaaacggccattaccatctggacttttggaaaatgagtggggaactttgttaacaagacccttcataagagttccagaaaatggaactatggagctctcaaactcaattccaaatctctactcagaacacatgatgaaaatgctttttaaaccccagctgattaacaataatggagcatttttatccgccatgcaacaagaatctgctgctacaagaggtcccttgcaagaaatgaagaccactctggcagcagaaaaccaaatgctgcttaaaaatctacatcctcaatctatccctgaccaacctaatgccttaaacatgcaatcactgttgaaaaatgatcagcctgaaaaatttcatcctcttgccaaaattgataatcatcttccttctgggatagttattgacaagccaaaattagaatgtgaggtattacctgaccgcgtgattgactatccttccatggaagggtgcaacaatgaaaaggtggcagtaaatcctgttaaccagcaaggcctagcaacccaattgccattccataatcaaaaccagagtccactactccctcaatccagtccatggcctatgcaacctctgatagaatcctccatgccccatcctcaaatgattggtatggctcaagctgattctgccatggtaaatggcctgtttcctcagcttgacattgatgaatggttggcgtatgcttcttcccaaccttttgctgggcagaacagaccaactggacctttttctgacttgcaagaacataactcacttcagcctcaagtagtgaatccccctttaccttcaatgaacaatgaagtatgggatcattatgtcaagaacttcaagttcttatctcaagcagaccagcttacatccatctgtcagccagggatgtatggcctcaatggcgtaccaagctcaaataatttgagggatctttccgctgagagcaataaccaaagtgagatttgtgtcaatgttgatgctagcaacagtgtaggcaccaccatggttgatccttctacttcaagcaccattttggatgagttttgcacgatgaaggacggagaatttcagaatcctcaagattgcatggttggcaacttgagttcaagccaggatgtccagtctcagataacctctgctagtctagccgagtcacatgcctatcctcttagagacatccctgacaactccggtggcacttcatcaagccatgttgattttgatgaaagcagcttcctgcagaataactcatggcagcaagtacctgcacccatccgaacctacacaaaggtgcaaaaggcaggttccgttggaagatcaatcgatgtgactactttcaagaactatgaggagttgatccgtgcaatcgaatgcatgtttggactcgatggcctgctgaatgacactaaaggctcaggatggaaattggtgtatgtagattatgagagtgatgttctacttgttggtgatgatccttgggaggaatttgtaggctgtgtccgctgcataagaattttatcaccttcagaagttcagcagatgagtgaagaggggatgaagcttctaaacagtggagctttgcaagggatgaatgtttga

SEQ ID NO: 84126 - DNA, 219 bp, Glycine max
  Peptide Sequence Number=SeqID_175811
atgtcgctccaatccaatggaacattcgataggattgagagaatagatatgagaagtcaacgtgattgcttgatcgacaacacagacaacattgtcgcaacaaccacgacgatgttgattagatttgagaagtcaccaccatcaaatagatctatcgcgttaatggaggagaggtcgagggtgaggctatatgagagcaagcgagctatgcaacattga

SEQ ID NO: 84127 - DNA, 1947 bp, Glycine max
  Peptide Sequence Number=SeqID_175812
atgctcataataaagattcggagttggctactagagccaaaggtatggagttttgtgtgctttgtttcatctgttgttgggttgctctgttacgctctcagcacctctttcaaccatttatttggaaagtggacttggtggaagacattactttatattgtctttagtttcatcgtgtgtcttgcggtcttattcgcaaaggcatgggagcgctccacctctacctggctggaagctcatatggcctttttgattttgttcttcacttctgtatactcctttttctttgataaagaagtgaaaggaaaacctgatgcttatagcctattttcctgtgctgcatttgctatcatgtctctgagtatgtcaagactgagtcactttggatttgaggttgatctcctatattttttcagcggagttcttacgatacaactcatgaaaataaaaatatggttagtcgtcgttggtgggagtttcagttattctctcatccttcttcgttctactttgggtgcttcaccgacgagaatcgagtatcgtggactacaactcagagatgatctagtcattgaaattgattcacaaggaaccagtcacagtacatctcagttgcatcctgatgttatgattatcacgcaacaagacgctcatgtccctcttgaattcccagtcaattcactttcacaacaaggcaacagtttcagtgataacaacatcatggaacggttcatgggttgtatagaggcgcttaagaaggagaacgagaaccttatggacacaatttcaaaacatgtcagcaaataccttaaggctaatgttgtcaacgaggaccaaattcatgtgtgtgaaattgatgccgatgataacttggtggtggatgcgttgttgtcgtcgggaataatcatcaacgacctccgtgaaaccgttaggctgatggtggcagcagggttgaaggtggaatgctgcagagcgtaccgtagctgtcgcaggaaattcctgagaaagagtgtttcgaatttttggttgcgaatgcaagatctcaacgtggaggaggacattgacaagctgatgatagagattcagtgttggataaaagttctgaatgtagctgtcatgatactcttccccaatgaaaggacactatgcgatcgcgtctttgaagggtccatttcctctgtggagaagtaccatgtgtcactcggaaatgatgctctctggggtgacaagagtttgaacattttaatgaacttggtatatttttcttatgctgataaggagcaagccactgttactcctgtaggtggaggggttcatcagattacccattgtgtgttggactatatgaacaggatagattggcaaaagcctttatctctgtttgtggaagtagacaggataataataatgaagctattagagacttgtttggaagccaactccaaaatttacaataaccctactttgggttatattttcatcatgaacaattggaggcaaatagaactagcagcaacacaaccccaattgaatcctatttttggcgactatgggttcaaaaaaagcacaacaaaagttcaacaaaaccttgaactctatcagagaagctcgtggaataagattgtggacattttgaaggtggacattgatgaagtagaacctaatgttgcggccgaggtaatgaaagacaagctccattccttcaatgaacacttagatgagatatgcaacgttcagtctgcttggtttgtttttgatgaacaattaagggaacaactaataaaatccatagaaaacatggtgttgccagcatatggaaacttcctcgggaggcttcaggattttcttggtaagcacgcttatgagtacattaagtatggaatgtttgatgttcaatatcgactcaacaataatttgtttcttgtatgggagaaagaactagagtga

SEQ ID NO: 84128 - DNA, 222 bp, Glycine max
  Peptide Sequence Number=SeqID_175813
atgatctgggggttccgcaaagcaagcatggccaagagtgcacacaaggtgttcgataaaaggtgctacgaatccaacatggttactttcaacacgttgatccacgagttttgtaaaagaggtgacatggagggtgctcggagggtttttgacagattggtggagagtcaaagttgcaagccggatgtggtgagttttaccttggcaaacagggaggtgtaa

SEQ ID NO: 84129 - DNA, 1881 bp, Glycine max
  Peptide Sequence Number=SeqID_175814
atgtctgttactgttgctgccgacactacctccgccgccgtaggatcctgtctttcacgatcgcggcggcggtgcttaacggtggctctccgatctaaagtgtcagtcaccccaaccagaatattgacgaaactcaaacacgagtgtgccactcctctgccccttcttcagcaagtggccaataacatgtcttctgacatgcgagctgggcttgctgcagaggctgggcctgggcccgggcttcccatgatacccagctatgttgaaaatcttcccactgggaatgagaaagggttgttttatgccttggatctcggaggaaccaacttccgtgtgctgagggtgcagttgggtggcaaagatgagcgtgtcattgccaccgagtttgatcaagtttccatacctcatcaactcatgtttgctacatctcaggagctgtttgatttcattgcttcggggctagcaaaatttgcgtccaaggaggatggtagatttcatatctcaccgggaaaaaagggagagattggcttcacgttttcatttcctgtgaagcaggcatctattgattctggcatactaatcaagtggaccaagggttttgcagtgtctggaacagcagggagagatgtggtggcttgtctgaacgaggcaatggaaaggcaaggaatagacatgcgagtttctgctctggtgaatgataccgtggcaacgttagctggagcagaatactgggataatgatgtcgtggttgctgtcattttgggtactggaaccaatgcttgctatgttgaacagatcagtgccattcctaagttacagggccatgtctcttcttctgggaaaatgatcattagcactgagtggggtgctttctcaaatggtctccctttaaccaagatcgatagggaaatggatgctgctagcatcaatccgggtgagcagatatttgaaaagacaatctcgggaatgtatctaggcgaaattgttagacgagtgttgctggaaatggctgaagagggtggtttgtttggaaaatctgtcccgcagaaactatctacacctttcatactcgggaccccagatctatgtgccatgcagcaggacagttctggcgatttacatgcagttgggtccctcctctatgataaagcaggggttgaatccaatttaagtgaaagaaaaacagttttagaggtttgtgagacaattgtaaagcgaggtgggagcttagctggtgcaggaatagtggggattctacaaaaaatggaagaggatcagagaggtctcgtctttgggaatgggaagagaagtgttgttgccattgatgggggcttatatgaaaattatcctcaatacagggcttatttgcaagattcagtcacagagctgctaggaacagaaaagtcaaacaatgtggtgatagagcatactaaagatggatctggaataggagctgctctattggctgcttcaaactccatgcagggcaagacccgtcttgccaaatactacgttcctctcgaggactccgagaagcacaaggtcgaatacgaggttcatcggctcgtcgtaaacagagaccctaaatacacaaatttcgtcgagtttcgtacgcacaagataatatacaggcgatatgctgggttatttttctcactctgtgttgatatcactgataatgagttggcgtatttagagtgcatccatttgtttgtggaaatattggatcacttcttcagcaatgtctgtgagctcgatttggtttttaacttccacaaggtctatcttatacttgatgaattcattctagcgggtgaactgcaagaaacaagcaagaaggctatcattgagagaatgggggaacttgaaaaactagaatga

SEQ ID NO: 84130 - DNA, 168 bp, Glycine max
  Peptide Sequence Number=SeqID_175815
atgttgccacttgccactaccggaacaaaaacagagtttaccccatttcatcactccgcgacatattgcatgctgaatatgccggaattgcttgacattattgaacaagaagaagaagttaacacacttttgaaactattggatgaatatccatggctcacattttga

SEQ ID NO: 84131 - DNA, 1782 bp, Glycine max
  Peptide Sequence Number=SeqID_175816
atggggtctgtttgctcagctggtaaggctgagaaaaataaaaacaaagaggttgaagggaaagccttggggaagaagcttaagaagttaaagagcattgcaaaggggaaagaagattcttattcaatttcaaggactggtagaaagcaaaagaagctaaactccggactttcaggcgaattcaaattatccactcctagtcgaaaagaaggcaaagagagctcccagagaggctccttttggggaagagctggtgagagggcagtagaagttcttgacacacttggaagtggcgtgccgaagttaagcaatagtaatgggtttggctctggaatggctcctagagggaataaaatatctatattggcatttgaagtagctaatacaataaacaaaggagcaatcttgtttcaatcagtttccgaagaaaacattcagttccttaagaaggagattttacaatcagaaggggtgcaacaattagtttcaactgatacaaaggagttaataggtcttgttgaagctgacaaaagggaagaattcaatgtcttctcccgggaagttgttagatttggaaatatatgtaaggaccctcagtggcataacctagaacgatatttctcaagattacatttggatatcttggacaacaggcaaccaagggtagaggcagaaatgacaatgcaggaattgaccactctagctcagaatactgctgaattatatcacgaactaacttcgttagaacgttttgaacaagattatcagcacaagcttaaggaaatggaatccttaaatcttcctctcaacggggacagtctcactgcttttcagattgaaataaagcatcaaagaaagcttgttaggagcttgaaaaagaaatctctttggtccagaaatttggttgagatagttgaaaagcttgttgagatcgttacccatatagatcaagcaattttggagttccttggagatcatggtgcaaccgctgtcaagcattgtaatggttctgaaagacttggtgaagctggcctctcactgcactatgctaacattatcaatcagataaacatgattgcatctcgtccaaccgttcttcctccaaatataagagacacattgtatcatggattgccaaataatattaagagtgcacttccttcccggatgcaaagcattgatgctatgaaagagctctccatcactcaggtcaaagctgaaatggacaagactctgcagtggctcaatccatttgccacaaatacgaccaaagcacatcaaggttttggatgggttggcgaatgggcaaatacatgcaatgagtttggagaaaatatggccagagaaagtaacctgattcgcctccaaacactttactacgctgagaagcaaaagatggatttttacataatcgaattgttgactcaccttcactatttggttacatttgtaagatacagacacaataccatgaggccaatgccaacaagaacttctcctaggcgacttgattttcaatcaaacatgttgcaatttatatctttagacagtattaacaagcctttgggatctaaactttctcaagaggataaaagattattagaagaggtaactatgaggaaaagaagccctggagttagcaaaagcgagaatcttgaagtaaccaagaaaagaagtgccaaagtttggcatcatagcaatagtgtaggaagttcacctgttactagagaaggcttggagcaccaaagatctaatgttttggatattatagatgggctataa

SEQ ID NO: 84132 - DNA, 456 bp, Glycine max
  Peptide Sequence Number=SeqID_175817
atggagcataagtttcatcaatctaagattgtggcaaaggctgtcgctttttccattaagcaacaatttggtcaggcttggcctacatggggagcgattccaaaattagaggagctcggtcgatctgtatacgtagatgaggtctttcaccaaactcatttacgaaaggatactggtcaatttgtcgatgatagatctaggcagacacatgaagaatttgaggctaggctatctcaagctagttctgatgctgcatcaagtgttagtgaatcacaacttactcttttagaccttattgaagaacaaagacttaagagtcagtgttgggttgcagttgtgggaccaaagcataagggacacctttgtggtactggagaccttgcttatacttataaatgtggtggaaatgacagcttcatgcagcatacgcaaggatcaacaaaggcactctcctga

SEQ ID NO: 84133 - DNA, 132 bp, Glycine max
  Peptide Sequence Number=SeqID_175818
atgaagatccaaggccacatggagctacattatgacgaatgtgttgaaagtgatcaaggggtttccacgaaccctaagagaagaaaggtatcgaaaaaagaagctcagagtttcaagaacctctggatttga

SEQ ID NO: 84134 - DNA, 369 bp, Glycine max
  Peptide Sequence Number=SeqID_175819
atgatgatggaagcaataatgagcatgaggaagatgatgaaggtcaacattgttacaactattgctgctagtactgctactaagagggactcgattcacccgtctgggttcaatcaagagagttgtctagtctcagatgtaagtaagtcttcttttctgtcatacggtttccatcctaattatacatcgcctactgttgtacatgctcctgatgagaatatcgataattctacacccttattcattgagaatcaacaaccccaacctgatcatactcatgcccatgtctctcaacctatgggggaaacacatgaagctccccaggaccacactctgactagtttcagggtctatatgggatatacctag

SEQ ID NO: 84135 - DNA, 525 bp, Glycine max
  Peptide Sequence Number=SeqID_175820
atggaccaattaaagcgcctaagcatcccctcagaaatgcttagattctctaaccatgctagttacccacgtctgggccatccgacaagaaaaatcagcatgcaacagggacaagcagatatcctcataggtaggttccctgaccctaactatggtgttaaaatgggtttcattctctaccgaaaccgcgagccaagttggaagattctgcttcggtcgaagggttcctctcggtgtggggttgcaacggagaacaacgacagtttgtggtggctaatggtggttgtgggtgatggagaaagtgcttgggacattagaaatggctttggaagaaagaaagaagaagaaatggtgtttttcctaagctacacgaaagcaaaggctgaaaacgctcaagtgagaaatggtctcggacacggaaactttccgtacactccagacatctctcaaagatcccaacggtcagatcgtggacaaatgtcttgtgaagctgcagacacaatttcgagaagagacaatggttaa

SEQ ID NO: 84136 - DNA, 351 bp, Glycine max
  Peptide Sequence Number=SeqID_175821
atgtggaccattggtctctctgccccaggtggtctagtggccaaggatcatagccgtgtggctttgcgtgtccgcttcaaggtagatggagacgctgatgcgtctgcaggaggaggaggaggaggaggcgaggcaggtggagtagccatgatgcatgctttgttagggtcattcaacagtggaaactggtctgactctaaagtccttgctgagaagaactcccactcatgggttttccgagccaatccaattgaatatgtttatagatgggctgagaccacaaaccaagcaactgttagacgcttctgcagggggaaagataaaactgaagaccccggaagaagcaactga

SEQ ID NO: 84137 - DNA, 189 bp, Glycine max
  Peptide Sequence Number=SeqID_175822
atgatgacaaaggcgatgacaaaaagctcaaagttcaatcaaagaacaactcaaaacaattcaagagttcaagataagaatcaagaagaattcaagactcaagaagaaagtttagagtcaacaatcaagattcaaggttcaagatctcaagaatcaagatcaagattcaagaatcaagagaaggcttaa

SEQ ID NO: 84138 - DNA, 318 bp, Glycine max
  Peptide Sequence Number=SeqID_175823
atgtatacgactacaataacccatattcgtctccaatgcagcagacactggcaaatggtcgtcattctgcctaaggaaaacgttgttgtctggtttttttcgttgcataacagaccaaacaactaccttaagggaataattaacagtgctttgaaaggacttgatgatactccacaacctaaatccaaggctggtgctaggtggattgttattaagttaacgtttaacttaatatccaaatttcattatgtatttagtgtaatagacaaaaaggaagcactgagtgtggctattacgtcatgtactggatgtccatga

SEQ ID NO: 84139 - DNA, 389 bp, Glycine max
  Peptide Sequence Number=SeqID_175824
atgtggtgttatgagtggaaaaagagtgaggctttgagagttgaaaggctaaatctggattctgtgcttgggaggattgatggggacccggtgttgagagaaacgaggatatgggctacgtgggagtacgtgagctcagttggaggtgggcaacaggggatgggtgaaacttcctgcttttattcgttgaccacggagtggtacctggagatatgtcgcgggggtcaggagaccttggggacgcgagctcctggcagtcaacagataaaaggaacaaagaccacaaagcaaggaggcttgtgtggtggctggccagttgggtgtaatcgattaccaggcttgaaacgaggtcaggaagctaggacagcttctggtgatcgataccaagg

SEQ ID NO: 84140 - DNA, 366 bp, Glycine max
  Peptide Sequence Number=SeqID_175825
atgaactgggtattgctaattgaagacattatgttgaagagtcatcgcctggtaggttatgaatttcctcatgttgtgcttgtcttaagattcatttactacttcaatgttgatgtctctaatgagattgtggactttaccaaaacctttagtgagattaccgaaaggcatctcaagaagcttggaatgaggtttgttgatcatgaatggataatggttggagagcctgtagctggaaacattgacaggatggaagaagatgctgaagctgaagctccacaagagcctgcacatcaatggagtccttttgagtcacttatgattaagaagatggacgatatgcttcacctctatgaagagcactaa

SEQ ID NO: 84141 - DNA, 498 bp, Glycine max
  Peptide Sequence Number=SeqID_175826
atgcaagacaatgcatccacatcctctgattcttctagtgaagaagaagtttcaaatgtgtccttgatggcagattcaatggatgactcctcaaccattgaagaaattgagatgattaccaatctttgcaaattgtttgaaaatttaaaaaaggatcactgtgaagaacgtatgaagttgcaaactatgctttcctatcttaaagatatttttagaaaaatgaacaaaggcaagagtgatcttagtcacttgctcaatgtgcaaaagcatactatcgataagattgatttagggtataacaagcaaactaccttttctaagaaaaccaagtttgcatcctccaaaaagttggataatggctattctatgcacatgatgggtgacaagtctagacttactgactttgtgtcaaaggaaggaggatatgtcacttttggagacaataataagggaagaattatgggagaaggaaacattggaaatcaacacaagacataa

SEQ ID NO: 84142 - DNA, 369 bp, Glycine max
  Peptide Sequence Number=SeqID_175827
atggccagcaatataatcaacaatagggacaatggaggaaccaccctggaaatcagttcaatggagattaagctggaagagcctctagctcagtttatgcaggtttctacttccaataagaagagcacagagtccaccataaagaatcttgaggtccaagtgggacaacttgcaaagcaattggcggatagatcatcaagtagttttacagctaatacagagaaaaatcccaagaaggaatgtaaagctgtgatgactagaagtagaatgacaatccaaggagatgatagtgaagctagaaagaagatggaggaacataaacaacagctggcacttaagccagcccttgaacctgtttctgatttgtag

SEQ ID NO: 84143 - DNA, 202 bp, Glycine max
  Peptide Sequence Number=SeqID_175828
gagactcttgttaatgttgcaatgtcggcttcccaatttggaggggagtgtgcttattgcaactctttggctgttgaagagagtgaatatgcttttatggatgttgttgaatctgattctcttgaaattggttctactaatgttgattcagattcctttgaaatggaacttgacatggatgatgagatgactacactttcaa

SEQ ID NO: 84144 - DNA, 81 bp, Glycine max
  Peptide Sequence Number=SeqID_175829
atggataagagcttgaaggtaggagaagatgagtggagggagaaggagagaaagagcaagaaattttgtgccttaaatgag

SEQ ID NO: 84145 - DNA, 420 bp, Glycine max
  Peptide Sequence Number=SeqID_175830
atggtacatgatgacaatgaaatagttctgcatgcaaacactccaaatgatgaaatcaaggaatatttggattgcagatacatttctccatgtgaatctgcttggaggatctttggttttccaatacatggtagaaaaccttctgtagagaggctacagttccatcttctaggccaacatagcgttctctaccaagaccatgatgatattgatgatatgctctctaacccaagcatttctgaatcaaaatttatagcttggatgaatacaaaccaagtttttgttgaaggtaccatgaacaaacctgaagaagtatgggaaaaaacttggcattggttaagtgaagatattgtatatagtcatcgcagatcatcaaacactccaggattacatattgatgactccaatctgatgaatctg

SEQ ID NO: 84146 - DNA, 360 bp, Glycine max
  Peptide Sequence Number=SeqID_175831
gaaaaccacgaaggtcagaccgggcttcgttctcaaccaaaaccgcgaggcaagtttggaagattccacttcggttgaagggttcctctcggtgtggggtttcaacggggaacaaacggaggagaaagaaatggttgtttttccaaggctatacgaaaagcaaaggctgaaacactcaagtgcttctgctcgcgggaaaggaagagttcctcacacgccagacgtcatattgaagatcgcaacggaaaagtttcaagaatatccaacggttaacaaaggcaagggggcacttttactgagacagtttcagatagcttccttgagaagcttcattaagaggctccctcgagaagcttcctc

SEQ ID NO: 84147 - DNA, 123 bp, Glycine max
  Peptide Sequence Number=SeqID_175832
atggaagttggaagtggaagttactggaagttggaagttggaaatgaaagttattggaagatgaaagttgaaaatggaggttggaagttggaaggggaaaaattattgtgcatagttagttga

SEQ ID NO: 84148 - DNA, 390 bp, Glycine max
  Peptide Sequence Number=SeqID_175833
atgagtcatcattcatctagtgttaatggtgagggtcctagtcataaggaccctctatctagaatcttagatgagttgagttccctcaagttatggaaagaaaaactagaaagaaaagaaaaaggaaaagagagggcagaaataaatcaagatgagagggagcaaataaaggaagaagaaagaaggaaaatactaaaagagttaagaaaagaaaaacatgccacctatagtagtcatgactcttgtaagagcctaagtgaagaactttgtgactattatgaagaaaggcataggtcacatcttagacatcactcccataggagagaaaaggaaagaaagcctcaagaggcaacattaacctcccatacttccatgggaaggacaatgtag

SEQ ID NO: 84149 - DNA, 90 bp, Glycine max
  Peptide Sequence Number=SeqID_175834
atggttcaggggctaaaccagggactacaccatccgggactggagaaatttgaacagcttgcaatacatgttatggggatggtcgggtaa

SEQ ID NO: 84150 - DNA, 1027 bp, Glycine max
  Peptide Sequence Number=SeqID_175835
gaggcagaacggcattggtgccgccattcgccagctggtcaccaattatcagcagcagctgatgctgaatatttctatcggcgatgagttacgcgccaccaacctcagcaccttccatgaagtgctgtggaccaccattaccggcgtgatagccacagtgattatttttggcctgttcgccctgttcaccgtgctgcgcattcgtcgcagtctgtccgatgtcggcaaagtcatgatgcgcgccagcgaaaatctcgacctgacgctgagcgccgacgaaagccgtcgcgatgaggtgggcaccatggcgcactctttcaatcagctgatgcgcagcgtcgccagttcgttaagcgccgtgcgcagcgcctcacattcggtgggcagcgcgtcagtggagatcgccgccggtaacgaagacctctctgcgcgtaccgagcagcaggctgcttcgctggagcagaccgcggccagcatgactgaactgagtgaaaccgtacgtcagaccgccgataacacgcgtcaggccagccagctggcggctaacgccagttcgctgtcggaaaaaagtggtatcgctttccagaccaatattctggcgctcaacgccgcagtcgaagccgcacgcgccggtgagcacggcaagggctttgcggtggtggccggcgaagccagcgacgtcagcagcaacatgcaggtgatgaatgacgctatccatcaggtcagcgaactgatgagcgaaatccccgcagccgcggttgagcagagtcagggcattagccaggtacagcaggcggtgaatcagatggatgatgtgacgcagcagaacgccgcgctggtggagcaggcctcagccgcgtcgcaatcgctgcaggagcaggcccagacgctcaaccagctggtgacccgcttcgtgctggcggaatccggcgcaacgccggtcatcaagcccacgccggcgagccataaagcgccacagccgggacgcctggcactggccagcgatgccgactggcagagtttctaa

SEQ ID NO: 84151 - DNA, 525 bp, Glycine max
  Peptide Sequence Number=SeqID_175836
atgtcgcgcaggcgtattgacgttcttcatgcgcatttccgccgctttcgggctgggggaggtttcaaacagccagctttcgtagtcgatgccgcgaatcaggtcgcgcaccgcattcaccggttcacgctcggtgagctgaacgatttcattcagccagtgggtaaagcgctgcagatgctccagcccgcgcccggaaagcgtctgttccagccccatatcaaagctggcgttaaacaggcttttgttgcgcagattggcccactcacccagcttctgcagcgtcgcggggccgatctcgcgacgcggcgtgtttacgatgcgcagaaacgcgctgtcatcttccggattggtcagcacgcgcagataggccagcaaatctttgatttccggccgcgagaagaacgacgtgccgccggagatgcgataaggaatacggttctgcatcagcagcttttcaaacacgcgcgactgatggttaccgcgataaacacaccccgtaatctttgtactgggttttattaa

SEQ ID NO: 84152 - DNA, 495 bp, Glycine max
  Peptide Sequence Number=SeqID_175837
atgccacccaccaggcaccctctagacccggataagtctaacagggccctgaggtttccagcattgatcacgggcccctgccagtcattcggggttcccgtcacacctagtaaggtgatccgaccgctgatcacccaggccttcattgagaagtattgcacgcctaggcaggcgcagggtgatgcaccacaggccgcagacgcactgccaccacctcatcaggctgatcctgctgggtcattaggcatggagcggtatctacagcacttggttcgccaacaggcagccaaccaccgtgggcaggtgcagatacatgagtgtctctaccagctcagcctcaatcagtttaggcttgaggtcgcatggcccagagattggcccgaggcccaggcaggggaagcgcctgtaggagctcccggcgatgcagaggaggcccgcatggatgaggagatgacggacttgctcggtttcttgggaggaagcggagccacatga

SEQ ID NO: 84153 - DNA, 144 bp, Glycine max
  Peptide Sequence Number=SeqID_175838
acttatcaaggtaatccttgtggcgtctacccagacttatcttccttcatcggaagtggcgtctaccctgacttatcttccttcactggaagtggcgtcaaccaaaaactctacagcctgtatcaagcgattcgtgccccgtaa

SEQ ID NO: 84154 - DNA, 219 bp, Glycine max
  Peptide Sequence Number=SeqID_175839
atgtataaccctgtcgcaacctacccttcggcgggagggcgacgcggggatcgcaggtgtgtcttccatgggaggaaaatgcgcgatgtcgccaccaacgtttattcgaggaaaacgtcggaaaaaccggaaaagggtgtttcccttgctcctacgtattcctcaattgtgataaggaaatcagacctacgtagttctttgaaaatgaacgttggttaa

SEQ ID NO: 84155 - DNA, 219 bp, Glycine max
  Peptide Sequence Number=SeqID_175840
atggcgtatgggaggccatacctgcatatgaggtatttaactactcttggcacctttggcagtggtcctagtatgttcattccccatatggcaaaaggaaaaagggagctcagactgcggagattgttaggaggggtgtgtggagtgtctgcaaacttttggcatcgtcttcatgtctttgtgaagtcaagggcatgtgccctgagtgttggccaatag

SEQ ID NO: 84156 - DNA, 552 bp, Glycine max
  Peptide Sequence Number=SeqID_175841
atggccccgaggaagcttgcctcaaagaggtccaggaaggacaaggcagccgaaggaactagttccgctccggagtatgacagtcaccgctttaggagcgctgtacaccagcagcgctttgaggccatcaagggatggtcatttctccgggagcgacgcgtccagctcagggatgacgagtatactgatttccaggaggaaatagggcgccgacggtgggtaccactggttactcctatggccaagtttgatccagaaatagtccttgaattttatgccaatgcttggccgacagaggagggcgtgcatgacatgagatcctgggtaaggggtcagtggatcccgtttgatgccgacgctatcggccaactcctaggatatccgttggtgttggaagagggccaggaatgtgagtatggccagaggaggaaccggattttgcccgggactgctgcagggaggcagtgcgaatcatgcgcacccaacatgaccaccctgacctcagatatggatgactttgctgctcagcaacatcctgcccaccgatcataa

SEQ ID NO: 84157 - DNA, 630 bp, Glycine max
  Peptide Sequence Number=SeqID_175842
atgtcagcattctcacttccgatacctccaggatgtctcacgactgtcccttcacaggcttacggaacgctccgctaccacgcacatacgtgcatccacagcttcggtgtatggcttgagccccgatatgggttcggtcctccagtacgtgttaccgtaccttcaacctgctcatggctagatcacttggtttcgggtctaatgcatcgaactgaacgccctgttcagactcgctttcgctgcgcctacacctaccggcttaagcttgctcgatacactaagtcgctgacccattatacaaaaggtactgtttcactcccctcgtcggggtgcttttcacctttccctcacggtactggttcgctatcggtcatgcacgagtacttaggcttggatcgtggtcgacccatgttcagacaggatttcacgtgtcccgccctactcaaggacttctgctattctacgtgtacgggactatcacccacttcggtcgagttttccaactcgttccacttcattcacaaaagccactggcctggtccgcgttcgctcgccactactagcggagtctcgtttgatgtcctttcctctgggtacttagatgtttcagttccccaggttcgcttctaa

SEQ ID NO: 84158 - DNA, 294 bp, Glycine max
  Peptide Sequence Number=SeqID_175843
atgacaattgaggaatcaatacatgttacttttgatgaaactaatattacctccctgagaaaggagtttcttgatgatattgcaaattctttggaagatacacaaaatgaagaaaaaaatctaaaaaggaagagagatgaagaaaatgaggatgttcaagatgatatagtacaagaaaatgatgatcttcccaaagaatggaaaacttcaagaaatcatcctcttgacaacatcatcggtgatatctcaaaagcggtaacaactagacactctcttaaagatttatgcaaataa

SEQ ID NO: 84159 - DNA, 471 bp, Glycine max
  Peptide Sequence Number=SeqID_175844
atgaaaagtattgcttatcgcgcaaagggttttatgttgcctgtggcaatatttttactggtgaccttggctgcactggttggctacgccatgcgtttgtctatgctggcacaaatgggaacgattcaggatgtgcaaggtgcgaatgcatatctggcctccagggccggtgtggagtgggcagcctttcaggtgttagcgccgggctctaacgcgatgcagtcgtgtccagcatctccgacgacgttaacgattaacagtttcagtgtcgtcgttacctgtagtcaaaatgtatccaaggataaaggcaacacgcaggatattggtatttacaccattacctcaacggcatcagtgggaacagctgctactcaggattacatagagcgtcagattaaagtgacgctgagtaggtgcttgtatttggatcctagcgcacctgtgggtacagcggctgaggaatgtaattaa

SEQ ID NO: 84160 - DNA, 153 bp, Glycine max
  Peptide Sequence Number=SeqID_175845
atgactgtgagagcattagcatcaaggccgcgcgctaagtgcgagattagtgcgctaagcacaacaggtgtcttcagccaggctcaacgcacgattggcgctaagctcgaaagtggcgctaagcgcaacattgcgaatttagagcctatttaa

SEQ ID NO: 84161 - DNA, 384 bp, Glycine max
  Peptide Sequence Number=SeqID_175846
atgaatgaaagtcttatgagacacacttcaaagttccacttctctccctcttttattccttcaatttcgtgctccccccttctctctttcttttcctccattgaagcatcatctcctagcttcttatccaaggatcatcttggtggtgaagctccttcttccatggcttattccttaatggatggcacctcctctcacctctattcctttgtcttccgctgcatctccatggattgcattagtcaccaactgtcgcaacctatgggagggcaacacgaggctcacaggtgcgtcttccaagggaggaaggcacacggagtcgccaccaacgtttattcgaggaaaacgtcggaaaaaccagaacatgtggtctacgaactttaa

SEQ ID NO: 84162 - DNA, 509 bp, Glycine max
  Peptide Sequence Number=SeqID_175847
ggatacacgccctcaccttcagaggactacacgtcctcacctttagagggctacacgctcttgccatcagaggactgcacgtccacacctttagagggctacacgccctcgcctttagaggattgcacatcctcacctttagagggctacacgccctcaccttcagaggattacacatcctcaccttcagagggctacacgccctcgccttcagagggctacacgccctcgccttcaaagggcgatacgtcctgaacttcagagggctgcacaccctcgcctttagagggctatgcgtcctcactttcagggccagcaatttccttttatcagttcctgggccaccccctgatcttggaggagggccaactatgcaagtacaaccagaggaggaggctcatgcgcaccaacatgaccactcttacacagatatggatgacggatcgcacccacaaagacacccagtggacccggagaagtccaacagggccctggggtttctagctttg

SEQ ID NO: 84163 - DNA, 342 bp, Glycine max
  Peptide Sequence Number=SeqID_175848
atgaccacagtcaaaggtcgatgttccataagacgaactatcaccagattggttgacaagaccttcaaccaggggcaaattacactaactcctcacaaacatcagaagagaaactctgtgtcataccctaatttcgttcggggaccatccgttgttgggatgcgaccctcgtttgaccacttcgagggggtgcaaatagcaaccgggcccacttgggccttccaggaagttctccagaaggcgggaagcaacctagctcgcctgggcgagctgggtggcaagattttcaaccgttcttcgtcattcttcattcgttctttgtcattcttcggtattaaaccg

SEQ ID NO: 84164 - DNA, 384 bp, Glycine max
  Peptide Sequence Number=SeqID_175849
atgagagacaaggacatcgaatttatccatattattagcattgtgactgttgtttacagtaatagcataaacttgaaaatcctaatgagtcattggagacatctaacaacaaccttcaaattgctccaagcatcatacattgtatcacttaacgacatcaaaattcacgagcgattctcctcctcgaatctcagccagcctgcatcaatcaggtttgcaccttatgtttcagggtcatacaatgctcaatggaatgccccgaaactcctctatgataagcacatgttgcattcgagttatatccttgagaaaatggaggtcgaggactctttgttgggattatggctaccattgcattattgggtagatatgggagaaagttag

SEQ ID NO: 84165 - DNA, 291 bp, Glycine max
  Peptide Sequence Number=SeqID_175850
atgactaacaagagaaatgacgaaggaagtgatccacgggagcctgccaaacctcaccccacagcggatggcatcactcaggtcatgagcatggacgaagggtctctagtccaagccctagctgtctaccaagcaagcctggacgacaaattcgatgtagatccaagcgacgacgcttctgacagaggcgcaaaacctattgaagagctcatcaagctacaacttgaacacaaaccggacaatgtacgtagctcagtagggacctcaccagccatgagcacaaatgcataa

SEQ ID NO: 84166 - DNA, 201 bp, Glycine max
  Peptide Sequence Number=SeqID_175851
atgaagattggagcgcctctgttattgggttactgtactaagagttatggaattggacagctatacgatgatgaatgctcaagttcccaaatggctaatgatttcaggatccaacaaattcattaccaaggcaaggatcaaacacaggtctttcactccagctaccaaacaatgcacctgcctggcaaggtcctaacatag

SEQ ID NO: 84167 - DNA, 1335 bp, Glycine max
  Peptide Sequence Number=SeqID_175852
atggcacccaatagaatcaaaactgctacgattcttggaatcaacaataaggaggaggccaagaacacttttctagcagattccttcatccttggacgatgggaattgcgcaacataatgaaacaagcatcagaggcaccgtcaattgaaaaaaaagtgataatctctcttgcaaccatcgttgttgcgtctagatgtgtagaggagggtctggcttttgacaaggacttagagaaaaggataacctacaaagccttggacattatgctctatggtggcccatgcccagtcacaaacaataagaaggtgaatcttcctaaagtcatcttctattactggatgcaagccttcaaagacaagttcaacccaaagcatattgagaaaaaggtcaagaaggagcctaatgaggaaccacagtctgtggttgaagagcacatgctgaagcttgacgaggatgctaagcttgtttccttggcgggtaatgtgtctgctgaaattccagatgatgacattttggaatctcttaagactttgtctgttgaggagcagaggaagagtcctgaaaaggccaccatgatggagatagatggtaagccaatgcctaaagtagttgtgcttgaatttttactacctcactctacaattgagcaattgtctactgatgatgaaaagctagttgaatctacacagtctgaagaaacagatgcagacagactcagacgattggaagaagtatgtggtgctatggagtatgtatccatggaagatatggtggatagtttggaacccttgcctccacctccacaaattacacctattgatcctagtgttaatgttagatttatcttggctataaaggttatagaatcttggtgtggaaaacttgcaatagaatttggaaagagaaatatgatattgggtctcacattattcatccaaagatgcaacaagtggagcttgacaagcttaatcttacaaagctctttgaaagaaggttttctaggtattgattccttcaagtatccatcttgggatacttttcttgaagaggaggaatatgcaattggagtgtatggagaaagggaactagtgctcaagcaatttcccatcagactcattattgctcctaacccaaacagcctgatatttaagtataggccaactgcaatgaaggtttatccccttggtcccaccatttttgtctttgtgggataccctaacggaactaagggatactatttctacaacacatatgaggaaaaagtatctatcactaggattggagtgttccttgagaagcaatacatctcccatggagccaatggaggaatgtag

SEQ ID NO: 84168 - DNA, 379 bp, Glycine max
  Peptide Sequence Number=SeqID_175853
gggtataccaccaactgtttgcccttccgtggcatatccgaggcaaggctcaaaatcggctagattgtggtggggcatttcatgtgtcattgccagacgagctcagctcgcccaggcgagcaaggttgcttcctccagaagcaacagccttctggaggaatcttctagagggcccaagtgggcctgctttcgaagaagttacagaaactcacggtttgcgcaaaaatacttcttttcgatttccgccacattacggaatttcacggaacgcaagatgatgacaaaggtgatgacaaaaagctcaaaggtcaatcaaagaatgagttcaagattcaagaggaaagttgaagaacacttcaagattcaagaggaaagttaa

SEQ ID NO: 84169 - DNA, 231 bp, Glycine max
  Peptide Sequence Number=SeqID_175854
atggggtcgaaccaagcacatgcttttaagaaaagaggaggtgcaagagcagatgaaggccgacatggaggccatgaaagggtagatgaccacaatgtggaggccttgatgagtataggaaggatgatggaggtcaatacgactacagttgttgccgcaagtactgccacagaggtggacccgactcacccacctggctttaatcaagtaaatcatctagcctcgcatatg

SEQ ID NO: 84170 - DNA, 156 bp, Glycine max
  Peptide Sequence Number=SeqID_175855
atggctaccattgcattattgagtagatatgggaggtggtgtttggcctcggatgtgcagcaggcgggttttatggtcaatttagaggcgacctttgtggatgatttggtgttcttggctggtagggtggtgggtaatgagatggaccgatattga

SEQ ID NO: 84171 - DNA, 300 bp, Glycine max
  Peptide Sequence Number=SeqID_175856
atggagtgggatgagtcccattctggtacttgttggtgtagtggtaatgcttatattcttatgcatgttgtgattaatggagcaaccaaggaaatgggaaaggcagcagtagtggcagtgactaaggcatgtagaatggaggtagcaggagcgatatgtggcatggaagagatccttcaaatacccatcataaatggccttactatgattttgggctccatatctcaattccaggcagtaggaattgtagttgatttcaccaacccttcctttgtatatgacaacgtgaaacaggtttga

SEQ ID NO: 84172 - DNA, 405 bp, Glycine max
  Peptide Sequence Number=SeqID_175857
atgctttgtgccataggtccttgttccattgtaggtggatcaatgctccgtgtgacttggatttctccaagatctagattcctcttatcaaaccctaattccgtccggcacaaggcccagaggtcccttagggttttgatggttgtggaagcaaagcttcatgatgaatcaacaatgattcaaagaacatctcaagagaatcaagatcaagatcaagattcaagaatcaagaattcaagactcaagaagaaagcctacaaacaagtatcaagattcaagattcaagatctcaagaatcaaagatcaagattcaagaatcaagaatcaagactcaagatctcaagaatcaagatcaagattaaagactcaagattcgagaatgaagaaaagactcaatcaagataa

SEQ ID NO: 84173 - DNA, 411 bp, Glycine max
  Peptide Sequence Number=SeqID_175858
atgattatgaggggccaagacatttatagtagccaagataaggctactactttaccttcctctagtgaatgtgaagaagcaaaaggggcagaatctagtgaagaaatctacccccaagaagaaggactaccattagtggttaaagagaagtgtaaggaggtaagtgtctcctccaagagagtttttggctgtggagagactgagaaagagctgagcttgacgaggaagccatcttgtggagcttttgatgagattttgagaggttgtgaggaagcttccctgctatggagagctaaatcctcagttggttcttcctacggggtacttgattactcaattctagtgtgcctttaccttgatcacgcacttgcatgcttagttagggtcactcaatattgggaaatggtttga

SEQ ID NO: 84174 - DNA, 172 bp, Glycine max
  Peptide Sequence Number=SeqID_175859
gagaatgatagatctcctccagcacaagttgttgcagcccagatacgcacactgctatataaacatgaaggctgcacggggttgagtaccaaccaccttgatgttatcctaacttcaagtgttggacctgagtgtgtagagttgatctcttttgttcagagagcaatctctg

SEQ ID NO: 84175 - DNA, 291 bp, Glycine max
  Peptide Sequence Number=SeqID_175860
atgatcagagcaacatatgcttcttggatgaaaaacaatgtgtctaccggggaaggagacctttcgcttctaaatgaccatttagaggaaacactgggttcaacaaaaatagaagaaaatcactcaaagtgtatcaatctcacacggggtaaggtttacggtaagttgggattttggctcaaggcttgtagaatggctagacatgatatatgtcagggtttgggtttggccagcggttcagggataaaagggatgtcccacattatttccatgacacacacgcaacaatga

SEQ ID NO: 84176 - DNA, 237 bp, Glycine max
  Peptide Sequence Number=SeqID_175861
atggcagtgaaacacttttatctctctgagaaaaatggatatgattttgatgatgtcaaaagaagaatcaaacaaggctcatttgcttcaagattaatacaagattgcttcaacaagcaaagccttgcttcaagattaactcaagatcaagccttgccattgaaacaaagtgctttcaagacattcaaggctctggtaatcgattacccaaagacagggttgagaaatagctgttga

SEQ ID NO: 84177 - DNA, 176 bp, Glycine max
  Peptide Sequence Number=SeqID_175862
tagtccccttacttcagaaaaaaatattcactttcaagcctgatgcaatcctcccaaggaggggacccatcaccagagccatgactaggagactccaggaagattgggtcgggaatgcaggagaaggccctatggttctcatgagccttagggtagattttgggcctatgggctaa

SEQ ID NO: 84178 - DNA, 435 bp, Glycine max
  Peptide Sequence Number=SeqID_175863
atggctctagatgcttcaaaattcaatttcgagcgtctcgatatattacgggactcaatcggacatccgagttcaacattcaatttcgagcgtctcgatatattacgggactcaatcagacatccgagtaaaaagttattgtcgttgaattggctcataggttcaacattcaacttcgagcgtctcgatatattacaggactcaatcagacatccgagtaaaaagttattgttgtttgaattggctcagaggttcaacattcaatttcgagcgtctcgatatattacgggactcaatcagaacatccgagtaaaaagttattgtcgttttgaattggctcagaggttcaacattcaatttcgagcgtctcgatatatatgggactcaatcagacatccgagtaaaaagttattgtcgtttgaatatggctcatag

SEQ ID NO: 84179 - DNA, 1058 bp, Glycine max
  Peptide Sequence Number=SeqID_175864
gggataaccgtgaaccttacctgccggagccggagcctgaaccgcaacccgagccagaaccgcagccggaaccggaaccggaaaatccgcaggtgccgcagccagagccaaaaccggagccaggtaaggtgcgcgcggcggtgattccgcaggtgccgacctacatctcgctgcccgccgccttccacagcgtgacacacaatctgcaagcgctgttcagcagcagcgcgcagcaggcgggcgcagagggccgtccggatctgtttgtgtccggctacaccggcgacgaccgctatcacagcgcgggcggctttatggattacggctacgatttccacagccgctatcagggctggatgattggcagccgcttcccgctgcagtcggcgctggcgctgagtgtcggcgtcaataaaggcaacctgagcatcacgccggaagcgcgcgacggcaacagtcacgcccgcgtcgatacgctgggcgccagtgcgctactgagctggcagcccgatcagggcctgcagctggccgtgccggctggcgtgatgcagtatcgcggcagcgtcagcactgacctgcgcggtaacgtaacgcagctgaaagcgcgcggcgcgaacctcgggctcgacagcggctggcgctggcagtccggcgcgcatgcgctaacgccggtagccggcgtgaatgcacagtggctcgatatcaatgatttcaccgacagcgacggcgcacaggtcagctaccgtaatccgctgcagtggcagctctccggcggcgtaaaatacgacttccgcctcaacgaaaagctgaagctgggcgcggaaacgcactacgtgcagcgcatcagccagcgcgatcgggtggcgattggtgacggccagcaggcagcgcacttcgccaccggacgcggcggcaacagcttgcagtacagcggttacgccggctggcaggtgctggacaatctggagcttaacacccagcttcagggccagcagcgcctgacgcaggaaggcatcagcgactggaatctgcaggccggtgtgaaaatcagtttttaa

SEQ ID NO: 84180 - DNA, 450 bp, Glycine max
  Peptide Sequence Number=SeqID_175865
atggtccaacgccttaacgtttctctcctttctaaaaccaagagatcgttaatggaaatttgtgaaattccaggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 84181 - DNA, 186 bp, Glycine max
  Peptide Sequence Number=SeqID_175866
atgaaaatcagaggaggagatgggggaactgcttcaagttcaggcaaaaaaggtggattcaccactggagattgtgggttagctggctctgaattgacctgcacagttactgacaaaggagttggagtggatgacgaagggatgtcttctattctagctctttttcttgattccatctgtaactaa

SEQ ID NO: 84182 - DNA, 294 bp, Glycine max
  Peptide Sequence Number=SeqID_175867
atgaccggacacggttcgccattggattttttgtttcctacttacaggtacatagggatggatgcaagtggggctagggtcacgaccgaccgatcgttgccccttcccggcgctaaacaagcagagaacgtcgctgcaaggcagcccagttcaagtgggaaaatgctaacccataaggaaggaggagacatggttaatgttcccctaaaaaaaaatggcaggttagctcgcctgggcgagcaacccctgcacccaaattataaaaacgagggaggggaacgtttttgtatctaa

SEQ ID NO: 84183 - DNA, 891 bp, Glycine max
  Peptide Sequence Number=SeqID_175868
atggatgatgcgatacagatgctggtggacttattgatgatctctacagaggctgccagggctgagacagggcagtgtcgtggatcgtacgtacgcctgcaatgggcccttcgtgatctcagtcagatcgagaggtacacctggggagtagctgcgctggtccatatgtacgaccacctcaacgatgcttctatcagcatcagtcgacaacttgacagttacatcacgctgctgcagtgctggatatacgagcactttccctcgatcgtggagtccactgctaatccggactacaacgaggattcaccgcgtgcctgtaggtggattgctacaaagaagaccgtgaagagcatatgtacactagcatatagggagcgcctagatcgactatggattccggacatctgttggatcccatatggggagcaccgactgaccattcctactccgcctgtcgattcatgggtgtcgtatgatgatatacatgataagtggatgcactattcggatcatatggctacagcaggtgaggtgtgcgctatgccaggtcagtgtgccagcgactacatagactggttcttccgtatttcacatcatttcatgacaccaggccaagcatcagatcctctgccagatggtcatgctccacagccccgagtcatccctcaggtcccagagttagatatccctcacgtgtcgaagcctggatcaccatcgacatctgcaaggcccgctgcggacgagcctagacatgcagtggaagtttgctatgggattgctgagaggttggagtgccatctgagcctaggggtggtcacgccaggctcatcaacacatgaggtgatcgaagaatgcctcagatggccaggagtgtcacacaggaccagctag

SEQ ID NO: 84184 - DNA, 324 bp, Glycine max
  Peptide Sequence Number=SeqID_175869
atgtcgctaaacagtagtgtgtattttgtgaagatggcctctaggaaacgtaagagcattggggcgaggccgactgctcaatatgatactagacagttccattcgcttgatgcttggaactgttatacagataatgtcttagggaggaatattttgccagagaggaaggttgagatataccacatggagttcgacgacttcaagacagagttggagaggcgtaatcttcacaaacgcctcacctacttggctgatgggactattgatcttgctttggtgaaggaattttatgttaatctctacagctctgaggggatcctctag

SEQ ID NO: 84185 - DNA, 300 bp, Glycine max
  Peptide Sequence Number=SeqID_175870
atgactaggggcaatctaggtgatttacaaccctttgatccggaaatagatagaacctttcatagattagttaggcatagtgtgcatcctgatcattctgtgcattttgagcattctgagtattttgttgctagtgattctgaatattttgattttgagcattcaactactaattttcatactgagaacatggctcaacctccacctcatgagaggaatcttagggagatggttgcacctgatttcacttatgaaagtttgtgcattcaatatcctgatgagggtcttcccttcatctag

SEQ ID NO: 84186 - DNA, 763 bp, Glycine max
  Peptide Sequence Number=SeqID_175871
aaagggacacgctttacgacgcccttaccgaactcgtgctagagctagagtaatgggtgaagtagaggagatacaagagaagatgaaggccgacatggaggccattaaagagaaaatggccacaatgatggaggccatgatgagcgtgaagaagataatggaagccaatgcggttgcaattgccgctaccagcgttgttgctaaggtgaacccgatgtccccatccggcctcaagcaaatgaatcatccaacctcaaatatggtaggcaaagatttaggaagtacgggcggcccccatgatgtgcaaattcaaaacgagcacgccttcccgtcatatggcttgcctctcaactatacgccacccaatgtggcgtacactcccaataagaatgtcaataactccactcctataccattgaaagccagcaaccccaaactgatcatgcacatgtctcttaaacttatcacccacaactgcacctcttgcattccacagcggttaaaaaccctcatgactatggcaggaatgggaaagttggatcatctagaggaaaggctcagggccattgaaggaggtgaagattatgcctttgctaacctagaagagttgttcctaatacccaaacatggtcattcccaagttcaaggtgctggactttggcaagtacaagggactactcgctccaagaaccatctaaagatgtactgtcggaagatgggggcatacgcaaaagatgagaaactgctgatacatttttcctga

SEQ ID NO: 84187 - DNA, 294 bp, Glycine max
  Peptide Sequence Number=SeqID_175872
atggaagctctcaagatattcaaatggtcattatttttcactccgatgtccgattcaggcgcatcacatatcgagatgctcaaaattgaacaattgaagctctcgaaatattcaaatggtcttgacttttcacacggaggtgtatcacatatcgagacgctcgaaatttatcaacggaagctctcgagaaatggaagctctcgagatattcaaatggtcataacttttcacacggaggtccgtcaggcacaaggaggtcgtatgcaggcgcataatataacgagacgttcgtaa

SEQ ID NO: 84188 - DNA, 210 bp, Glycine max
  Peptide Sequence Number=SeqID_175873
atgaaggcccaagtggagaaggatgaaggcccagaggcagagacactatcaagactattaattgttgctgaaggcccaagtaatccttgtggcgtctaccctgacttatcttccttcaccggaagtggcgtctaccatgacttatcttccttcactggaagtggcgtcatccaaaccttcgtagcctgtatcaaacgatccgccccgtaa

SEQ ID NO: 84189 - DNA, 858 bp, Glycine max
  Peptide Sequence Number=SeqID_175874
atgctacacgtcatcaccttgagaggactacacaccctcatcttcagaggactacacgtcctcgccttcagagggatacacgtcctcgactgtagaggactacacgccctcaccttcataggacaacacatcctcgcctttagagggctacacgtcctcaccttcagaggactacacgtcttccccttcagaggcctacacgccctcgcctttagaggactacacagaactacacatcctcgcctttacaaagctacacgtcctccccatcagagggctatgcgccctcgccttcgaagggctacacgctctcaccttgagaggactacacgtcctcggcttcagagggctacacaccctcgccttcagaggactacatgccctcgccttcatagggctacacgccaccaccttctgaggactacacgtcctctccttgagagggctacactccctcgccttcagaggactacacctcttccccttcagaggtcaaagggctacacgtcctcaccttcagggactacacgccctcaccttcagaggactacttgtccttgccttcagaggactacacgtcctcgccttcagaggactacacgtcctcgccatcagagggctacactacacgtccttgccttcagaggactacacgtcctcatcttcagagagacacacgtcctcgcctttaaagggctacgcatcctactcttcagaggactacacgtcgttgccttcagaggactacacgtcctcatcttcagaggactacacgtcctcaccttcagaaaactacacgccctcacctttataggaccacaaagcctcgccttcagagggctacacgtcctcacctaa

SEQ ID NO: 84190 - DNA, 549 bp, Glycine max
  Peptide Sequence Number=SeqID_175875
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttgccccttcctctgttttggctaagaggaagcgagatgacaacgctggggcattgggccataaaaagtcgagggccctcttaagccttcgagccctgaggcaagctgtagggtttacacctggtttgggtcaccctctgagtttgcaagatgtacgtccgactccagtggtcgtcgaggctcctgcttccactgttgttgctactgttactcctgctcctccacctcctcttgttgtacctgttcaggaggttactcttgttgctggagttgatgtgttggggtaccgagctcgaattcgtaatcatggtcatagctgtttcctgtgtgaaattgttatccgctcacaattccacacaacatacgagccggaagcataa

SEQ ID NO: 84191 - DNA, 786 bp, Glycine max
  Peptide Sequence Number=SeqID_175876
tgggtccagttttgccagactcgcagacatccttcttgggaggatgtgcgcaaaaaggcacaggccatccagaagcagaatactaccccccacgttttgtctcatgggggttatgattatttggagcagaagctcctggctaagaagacgaagaagaagctggaggaagctgcacagtcaggaagtgttgatggcgtcatcgaccctccatccccggtcagacgctatgtgaagtggaagatggcccgcacgaagaaaacgggggagatgacgactgaggccgcaaaggaaatcgctgataagattgtaagccacacagaatcgttcgtcccccatggacatcaggatgttctcgtcgctgctattggacgtccagagcaccctggacgtgtctgtgctgctaaagtcggtgtcaccatcaagcaatactttggatcggctccacggacctctcacagcgcttcctctctgcctcttgacgaattgcagcagctgacccagcaaatcagggaccagctaaaggagtccatcatagagaaagtgacgagccagatgcaatctcagggacttgcagtgcctcctaagcctctaattggtcccttcgatcctcgagtgagcataaaggggagttgtgttgatccctcaggaaatgatcctgagactggtgactctgaccggtgtggcttgtacatagaagcaaatcctgcccgcctggttgccatggggagagtttatgagggatccactgttgttcataacactcctttgttgcctggccaagtaaag

SEQ ID NO: 84192 - DNA, 552 bp, Glycine max
  Peptide Sequence Number=SeqID_175877
atgggtgaagcagaggaggtgcaagagaagatgaaggccgacatggaggccatgaaagagaaaatggccacaatgatggaggccatgatgagcatgaagacgataatggaagccaatgcggttatagttgccgctactagcgttgtcgctaaggtgaacccgatgctcccatctggcctcaagcaaataaatcatccaacctcaaatatggcacatatctctcaaaccatgggggagacacatgaaattccccaccacgatctagttgacttcgagccttggctcggatatgccactgaagggcaagcagttggtggtatatcctttgaaaacactttggaggaccctcagtgtcacccacaaccacaaccctcacatgccacagcggttaaaaaccctcatgctacggcagaaatgggaaagaggaaaggctcagggccattgaaggaggtgctggactttgacaagtacaaggggactacttgccccaagaaccatccaaagatgtattgtcggaagataagggcatacgcaaagatgaggaactgctaa

SEQ ID NO: 84193 - DNA, 270 bp, Glycine max
  Peptide Sequence Number=SeqID_175878
atggagctacttgaggtctctggtgaggaggctagagctgagaccgtacgggcgcatggggcatacttacgactttcgtggcttcgagaagtctatcagagtagatgtcatgctcgacggtggattgtagtagcccgtgcttacctcctccacttggcgggttgcactcttttttctaacaagagtgcaacaaatgttcatgtggttcatctagagggttttcgagacctgggtcagactggggtctatgcttggggagctgcggcgctg

SEQ ID NO: 84194 - DNA, 204 bp, Glycine max
  Peptide Sequence Number=SeqID_175879
atggttttgctccaatgtgtggacgccagggaggatgagcagatactagtggaatttcatgaggggtcctttggaacacatgccaatgaacatgccatggcccggaagatactaagggtagggggacagatgtcgtacaggatgtcacgacatcacgcttcagaacatgcagattgtatgtgtccgtatgaacagattaaacaa

SEQ ID NO: 84195 - DNA, 1442 bp, Glycine max
  Peptide Sequence Number=SeqID_175880
gatccccaagtcaatgttaaaggtctagatgtcactagcctcaaggaattaggacgattgatggcacctctccaaaggcaagccttccgcaaagtgtacgggaagattctagatttgaccgtagcggaggtatttacggaagctgtcgtatccctcgcccaatactatgaccagccgttgagcaaaagagttggatcgcatgaagcaaattcggaatggaatagtgggcctgccacggaaatacttggaaggcaaggcaagggatatggcgagccaagagaagtggggccgtttgcggatattttagctttgctgatttttggggttgtcctctttccgaacgtggacggtttgatagacttagtcgccattgatgctttcctcgcatatcaccatagcaaggaaagtccagtggtagctatcttggaaaatttgttcgacacctttgaccggagacacccgtgtccgcttcaaagctatcgctcatgcgccgaaaaaggaagagtcgattgggaccaacatttggctgggatagggggcagcgcgatcaattggtttcctcgttggaaggaaggcatggaaggagttcttttatcgtgtggggactaccctaatgttccattgatagggactaggggttgtattaattataatcccgcactcgccataagacagctagggtatcccatgaggggagcgccaaccgaagaaagtctctcgcctttccttgtgacgggtctaggcgcgcaaagtctcaaggcaatacaaagagtccacaaggcgtggataagtccgttgaagaaagacaaggagcttagaggcatccgaaatggcgtcatcggaggttatcatggatggctaagaattcacacgcgagggttagattggctctccaaattgaaagttatcgaggaggagaacttcgaagctccggaggaagatgaagaagtccaagctctcaaattggagctagggaaggcaagactcgccaaggagaagttcaaatcagctactacacacatccggaaagagtgcaccgagatacaagaggaaaacgcggccactgcaagagcccttgaacaagaaaccaaaagggcccgcaaggaggagtatggccgagagaaattccgaggagcattgtggggtagcaacaatgagctcaaactccgaagagaggagagagattggtcacgggtgcatggcatgatcttaaaagaagagttagttgcttgtgcgaggtccaaaaggagtttggctcaacacttggaagccacggagcaaagcatgctagctatcatagggcaatacaaggaagagttgaaccagtctgtggcccatgaacaaaagctagtggaggattttgcacaagtatacgccgaaaaagaagcaagagggagggtgattgatgcattgcatcaagaagcgactatgtggatggatag

SEQ ID NO: 84196 - DNA, 816 bp, Glycine max
  Peptide Sequence Number=SeqID_175881
atggggattgagaggaccttggctgataggaaaaggaagagacttttcaactcaaggaggaaccggcggcggcagaggaagaagccgccggttcagaagcttttcgagacttgcaaggttgtctttgcctctgcagggacaggctttgtccctccccatgaggacattgacgagttgcagtctgttctagatggaataaagccagaagatgttggtttaagaccagatatgccgtatttcaggacaagtgccactcagagagtgccaagaatcacgtacctgcacatatatgagtgtgaaaagttctcgatggggatattttgtttgccaccttctggggtcattcctcttcacaatcaccctggaatgacggttttcagtaagctactttttggcactatgcacatcaagtcatatgattgggtcgttgacttgcctcctgaatctcctacaactatcaaaccatcagaaaatcaaggtcctgagatgaggttggccaaagttaaggttgatgctgatttcactgctccctgcaacccctccatcctttatccagaagatgggggcaacttgcactgtttcacagcagtgacagcatgtgcagttctagatgtgcttggtcctccatattctgatgctgaaggcagacactgcacatactaccacaatttccccttttccaacttttcagcggatggattatccataccagaagaggaaaaaaatgcttatgaatggctacaagagagggaggaacttgaagacttagaagttaatggaaaaatgtacaacggtcccaagattgttgagagctaa

SEQ ID NO: 84197 - DNA, 1448 bp, Glycine max
  Peptide Sequence Number=SeqID_175882
ctaaccaagtccatctctacctcctcaacctccctcccgattcctccaattctaattctaatcccaattccaaaccctatgcttacacctactcccccggcgactcttctgctgctgtaacaaagtgctccgggacgttcttcacctcctcccaccgcttcttctggatcgacctccgcgccggccccgtcgactacggtccctcgatctccggcgacggcgtcatcccccgcggcgagttccaccccctcgccgcgctccacggccgtccgaaatccaacaaggccttcgccgccgacctcgcctctctcgtctggagcgcctaccacgtcttcctcgccccctccctccggatccccgtgcccttcgagaattcactcgtgattcagttcgtccacgtgcacagcgagaacgagaaggatttggccggtttggattggaaatcgatcgagaagagcttcaggtttgagggtaagagcaatggattgcttttaggggatcagagtttgagctttaggaagtatgagattaggtattcagagtgctcgatttgctcgttcgcgatctcgcggtcgattaattcgtatacgtctaggtttctgtttgataattataccttgattgtgagtgagtatttggattcgaagcgattacaccagattttgtctgattccggcgatgagttgagaaagctggctggtgttccggaggaggactttggcagggttgttcctgtgtatgtttttgacttggattacacttcgttgttgttgcttgatcggtatcatcagtcagtggcgtttaaggatatggtgattgcggttaggacgaggaacacgcagactacgaggcaacttgagcggccgattgttgggtcgattcttcagagtatgtggggggtgtctccaacacatttgaattggagccctcaacacaatgagactttggtggattatacgtggagtatggggcagacgccattcgggccgttttctgagatgctgagtttgtcctttgtgcagaaggatgctgccaggaggaatgttctgttgacgtcgttgaattacagcataacgagtgctatagatgttcttcagagtgttgagacgcatggcggggccaagagtctgctcaagcagaagcagcatgtggagtttgtgcagagatggaaccttttcaagtacaagctgaacaaggccgtgtctgcattgtcacatttggattttgacatggcgttgttttacttgaggtcctctgatcacgatctgtatgccattcactccattgtttatcacgcctcgcaggaaattgaggcgtcccttgtgtgctttagggaccctccatttccctggggttcggtctctatttctgtatcagctttccttgctgtctcttatatttatgcaagacgagacaagctttttagaaacaaaaggaagcaattttga

SEQ ID NO: 84198 - DNA, 1197 bp, Glycine max
  Peptide Sequence Number=SeqID_175883
atgctggctttcatggttggttcaaagcaagcttttgaagtgtctctagctgatgtctctcaaacacagcttcaagggaagaatgatgtcatcttggagtttcatgtggatgacacaactggagctaatgagaaagattcactgatggagataagttttcatataccaaattccaacacccagtttgttggtgatgaaaatcgtccccctgctcaggttttccgcgacaaaattatgtctatggctgatgttggcgctggaggtgaagatgctgttgttacatttgaggagaacttacattggtttttcttgtcattcttgcttcaaggacaggctaatgatttcaaaatccagtatagcagtgtggttcgcctatttttacttcctaagtctaatcaaccacatacctttgtcattattagtcttgatccccctattcggaagggacaaactttgtaccctcatattgttatgcagttcgaaaccgattatgttgttcaaagtgaattggcgatgaatgaagatctttataacacaaagtacaaggacaagttggagctgtcttataaggggcttattcatgaagtattcaccacaatattacatggcttgtctggtgccaaagtgactaagcctggaaaatttagaagttgtcaagatggttatgcagtgaaatcatctttgaaagctgaagatggaattctgtatccccttgagaagagcttcttctttcttcctaaacctcccactcttagtcttcatgaagagattgactatgtggaatttgagcggcatgctggtggtggttccaatatgcattattttgaccttctcatcagactaaaatctgaacaagaacatctcttccgtaatattcagagaaatgagtaccacaatttgtatgaatttatcagttcaaagggcttgaaaattatgaacttaggagatgcccaacctactgttggtataaagaaggttcttgagaatgatgatgatgatgctgttgatccacatcttgagcgcataaagaatgaagctggtggagatgaaagtgatgaggaggattccgactttgttgctgacaaggatgatgaaggttctcctaccgatgactctggggcagatgattctgatggcagtgatagtggtgatgagaaagaggcaagcgattttggtttgcctttgttatctttgtga

SEQ ID NO: 84199 - DNA, 342 bp, Glycine max
  Peptide Sequence Number=SeqID_175884
atgtccgcgtactgttccttcttcgaaacaaagttctcgtcccccatccacgcgccgtgtagcaacgcgctgccaccgagcaccacccagaagaagcacagcgactccggcggcgttaaagaggtcgagaacgaacacgcgaatcccaacatcgtggaactcagcaacgcccacgacgcgagtttcacggcgtggagcccacgcgccttgggttgttgtggtggcgaggtaggttatgatgccgctgctgattgtggtgctgagaaaactaaagatgtcataaagtggcagcacgcgcgggtttggcgcgtgggcgtcggaggaggtggcaacagggagtag

SEQ ID NO: 84200 - DNA, 587 bp, Glycine max
  Peptide Sequence Number=SeqID_175885
cattctatgctttcttacaagatgacgcaggggacaaattagcagatgtacttggtgatgatgatgaagccggtgatagtcctgggagtgaaggatctttgcataataaagtggaagaggtacgggcttcttttacttttgtggaagatttacgtaaggttcttgcaccggtagatgaattcccaatgttggaatactggagacctaagatccttttctctattgctataggcattgggatacctttgttgttggatgatgcaagggctggctatgcattctttgtggatgttgtttatgagaggctcccttcattttgttcttcttgcaaaatcgttggtcactcctttgaatcttgtaaaaaaagagcaaaagaagtttcgcggaaactagtggatcctaaaggagaacctagaaagaaacaaatatatgtgccaaagaacaagaataaagatcataaggtaattcaagatgatgttgttattaggcctggtcctagttacacgaataatcctgagggccatgtgtcccctcctgatcttgttgatgttgttcctcaaacgcagccagaaatatccgattgttaa

SEQ ID NO: 84201 - DNA, 237 bp, Glycine max
  Peptide Sequence Number=SeqID_175886
atggcagctcaagtagtgcccccaataatggggagggagttgataatgttaatagtagacacgttaccggtgtcctactatgagaagatgcctggggcaaatggagagaatgagaaggaggaaggaacccatgttctggctaccattcctacatggccaaatttcccacctactcaacaatgtcattactcagccgatattagccctcctcgttacccaccatccaatcatccataa

SEQ ID NO: 84202 - DNA, 237 bp, Glycine max
  Peptide Sequence Number=SeqID_175887
atgaattaccagggtgtttgtcagtttctactcttggttaacatgtgctggatttgggatgaagactctcgagacagggcaaactattataggagtatgggtccaatgaagaacaaaaagaatggacctcaacatcagggaaaaccatactcgacctctcctaagcaatatgacaaaaggggcatatttagagagattgtccatatcccaagaaggagcaaaatggtgggggcctga

SEQ ID NO: 84203 - DNA, 255 bp, Glycine max
  Peptide Sequence Number=SeqID_175888
atgggggaacacatgaatgcatcatatggtaatcgattacatgttgaaaattcaaattcaaaacctttttcaacagttatttctcaaccctgtcttctggttatgtgggatgctacggcgttcggggtgtttaaccaagacatccccttgtacataaagcatgaagatctatctgaaatagcacaaggtggtcaatgtctcaacatctctgttatacagttgtggattatgcatctgactaagacaagtatgtga

SEQ ID NO: 84204 - DNA, 1022 bp, Glycine max
  Peptide Sequence Number=SeqID_175889
atggaaggggtgacgccggccggcaaccgttcggtcggcagcctgttcgccaacctgacctacgactacgacggctggctgacgctggagggcgggctgcgttacgaccgctatcgcctgcgcggccagaccggcctgagctatccggatttggccaaggatgggcaacgctacacgattgacaatccttgcaaagcgttgcgtctgaccggctgttcaaccactacccgcgaagattgggacgtggatcgcgatcagggcaagctgtcgccgacgctggcggtggcggtgcgccccggcgtggagtggcttgagctgtataccacctacggcaaatcctggcggccgccggcgatcaccgaaacgctgactaacggcagcgcacacagttcttccacgcaataccccaacccgttcctgcagcccgagcgctcgcgcgcctgggaagtcgggttcaacgtgcagcagccggatctgtggtttgagggcgatcggttggtggccaaggtggcctacttcgacaccaaagtggataactacatcaacttggcgatagaccgcaataaaccggggctggtgcagccgagcatcggcaatgccgcttacgtcaacaacctgtctaaaacccgcttccgcgggctggagtaccagctcaactatgacgccggggtgttctacgccgacctgacctacacccacatgatcggcaaaaacgagttctgctcgaacaaggcctggttgggagggcgtctgcgctacggcgaccgatcgcgccgcggcaacttctatgttgagccggatgccgcttccaatgacttcgtcacgtgtgacggggggacgcagttcggctccgccgcctacctgccgggcgatcgcggctcggtgacgctgggcggccgcgccttccatcgccagctggacgccggggtgacagtgcgctttgcgccgggatatcatgacagctctgagccatccaactatccgtacctggtcgactggccgaagtacaccctgttcgatct

SEQ ID NO: 84205 - DNA, 702 bp, Glycine max
  Peptide Sequence Number=SeqID_175890
aaactgtccgcttctggttcacccgctgtaccatcatctccgcaccaggaacaaccggaattcaacattcaacccatacaaataattcctggtcaagcttctgtccctgagaaactgattcccagaagaccacagggagtgaagattgctgaaaaccctaaccctgcaataagtcctagggaagtagacacggagatggacagaaaatccgcaaaagatgttccaacatcgtccacttcaaatgctgaagtccttccttcacccagtgaagaggagtcaacagatgaagaggatcaatccacagaggagacccctgcaccaagggcaccagaacctgctccaggtgacctcattgacttagaagaagtcgaatctgatgaggaacccattgccaacaagttagcacctggcattgcagaaagacttcaaagcagaaagggaaaaaccccccttaagaggtctggacgaatcaagactatggcccagaagaaaagcactccaatcactcctaccacatccagaaggagcaaagttgcaatcccttccaagaagaggaaagaaatttcctcatctgattctgatgatgatgaagcagctgaggaagaagaagcagctgaggaagaagaagaagttgctgaggaagaggaagatgcagcagaggatacagaatcagatgatgatgattctgaagccaccccatga

SEQ ID NO: 84206 - DNA, 375 bp, Glycine max
  Peptide Sequence Number=SeqID_175891
atggcggctaagtctaccaaaccatcaacgttcggaaagaggacaaccccaaaaatcaacaaagctaatatatctacaaacggcccccacttctcttggctcgccatatcccttgccttgccttccaagtatttccgaggcaggcccactacgccgttccgagtttgcttcatgcgatccaactcttttgctgaatctccaaccatagctgcaatcttgctcaaggaaggaagcaagccggagaaaagatacggttttctccccctaagagggcatcctaatatttcctcaaactcttcaatagatggtaccatttggaagtccccaaacgtgaacacctcaacggctggtcatagtattgggcgagggatatga

SEQ ID NO: 84207 - DNA, 946 bp, Glycine max
  Peptide Sequence Number=SeqID_175892
gtcgactctagaggatcccctcaccttcttagggctgcacaccctcgccttcagaggattgcatgttctcatcttttaagggctgcacgccctcgccttcagaggactacacgtcctcgccatcagagggctgcacgtcctcaccttctgaggactacacatccttgccatcagaggactacatgtcctcaccttcagaggactacacgtcctagccttcagaggggctgcatgccttcaccatcaaaggactacaagtccttgccaacagagggctgcacgccctcaccttcaaaggactacacaggattacacgtcctcaccttcagagggctacacaccctaacctttaaaggactatatgtcctccccttgagagggctacacgccctcgccttcagaggactacacgtccccctttgcagagggctacactccctcgcctttagagggcgaaacgtcctcgacttcggagggttgcatgctctctcgcctttagagcgctacgcgtcctcacttttagtgggctccattaatttccttttatcagctcttgggccaccccctgatcctggaggagggccaactatgcttgcacaaccagaggaggaggctatcacacagctactgtgcataccagggcaagatttcacccgtgccgctgcaaagagacgagtgtggatcatgcgcaccaacatgaccactcttacacagatatggatgacgttgctacttagcaactttctgcccagcgaccgtaatgccgatctccccctgcagaaggatcgcacccgcaagtcccctagtggacccggagaagtcaaacagggtcctggggtttccagctctgattacgggcctttgtcagtcctacagagtgcccgtcgcccccagcaaggcgcaccgccaccacctctagagttcacctcagcttatccacaaaaag

SEQ ID NO: 84208 - DNA, 97 bp, Glycine max
  Peptide Sequence Number=SeqID_175893
gatagatgaccgatcgaggtctaaaaaagaagcttcatcggatgatgccaatcgaacatttcctaatcgacatcatccaattgttattaagggatga

SEQ ID NO: 84209 - DNA, 756 bp, Glycine max
  Peptide Sequence Number=SeqID_175894
atgggatcaaatcaaatgccttcacttaaaaagaggttctatcaagtcaaggtcaagagcctagggaccaccagtctaaaagagttagggcagttaatgggtcaactccagcggcaagcttttcgtaaagcttacggtaaaatctgggacctagccatggtagaagtctccacagaggccattgcctccctcgcccagtattatgatcagccgttgaggtgcttcacctttggggacttccagctatcacctatggaaaccatacctcttctgagggttctatccctcattagcaagaattttcaagatagttcaaatctcagcgcaggaattagaccacagaaagcaagtcgaaaatggggtggttggaataccaagaaaatatttggaggcaaaagcaagatcttggtagtgatcgacacttttctcacctatcataaccacaaggaaagcccggttgtcgctatgctagccgacctatatgacaccttcgaccaaagatgtgagaagagcaagaaaggaggggcgaattgggaccaactcttagaaagcaaagaaggagcatctgtcaactggttccctcgatggaaagaaggaagaatcggagttcttatttcgtgcggaggatttccaaatgttcccttgatggggatgaggggttgcatcagttacaatcccgttcttgctattagacaacttggctaccctatgagaggggcgccactagaggatgagcttgtgcctgtcatttcatga

SEQ ID NO: 84210 - DNA, 771 bp, Glycine max
  Peptide Sequence Number=SeqID_175895
tggcgatggcgaatccgttcgcgatggctgctgatcgtgcttttatcttcttttacgccgcaactgaatgaaaccgcggagtatacagagcgtaaggaacatccgactttaggacaatcgctgactattctgctggcaaactggcgggtggtgattgcggggatgttaatggtggcgatgaccactaccgcgttctatttgatcacggtctacgcgccaacctttggcaaaaacgtgctgttattaagcgcctcggatagcctgctggtcacgctattggtggctatctccaatttcatctggctgcctatcggcggcatgctttccgataagtttggtcgtaaacccgtactggtcagcatgacgctgctggctattttcaccagttggcctgcgttatcgctgctggcccgcatgccggacttcgccatgatgttgtccgtgctgctgtggctctcctttatttacggcatctacaacggcgcgatgatccccgcgctgacggaaattatgcccaggtcggtcagggtcgctggtttttccctggcttacagcctggctaccgctctgtttggcggttttacgccggcgatgtccaccgcgttaattaaagtcaccggggataaggcggcgcccggctactggatgagttttgcggcaatctgcgcgctactggcgacgcttggtattcacctgcggctatgcgcatgttgccgtcgcgcaggagatcacggtgatgatttccggcggcttctctgcggcgttggataa

SEQ ID NO: 84211 - DNA, 111 bp, Glycine max
  Peptide Sequence Number=SeqID_175896
atggatatctttcttcacacggggccaataaaacttgtctctgagtatgacaagggtcttgtctatcccaaagtggcctatgagcccaccctcatggctcttctttcacaa

SEQ ID NO: 84212 - DNA, 237 bp, Glycine max
  Peptide Sequence Number=SeqID_175897
atgggctggagaggattggatcaggggcctcacaaacagcatttctccacctggtgggctgacctaaaggcactcaatcaagatcacaatatgactgctgtctctaaacaattctgctggaagatgggtaggggtgatcaaattttattctgggaagatgcctgggctgaggatggaattccactcaaagatcaatttccagatttgtactcaaagatgcctcagcaatgtctttag

SEQ ID NO: 84213 - DNA, 168 bp, Glycine max
  Peptide Sequence Number=SeqID_175898
atggcagtagaatggagaaggaagagagagaggagatgccacttcaaggagaagatgagtcaagaagaagctcaccaccataggaagccatggataagagcttggaggtacgagaagaagaatggagggagaaggagagggagcacgaaattttgttcctcaaaagag

SEQ ID NO: 84214 - DNA, 174 bp, Glycine max
  Peptide Sequence Number=SeqID_175899
atggtttttcacttaaggcttgtaatgggcttcaaaacaaagaaagggaaacataggctcaaagggattaattcaaggaagcatcaacaagaatcaagccaaggctattgtgcaagcaatcaatgggtcaaaacacaccaaatgattatgatgatggctcaaattctcacaaag

SEQ ID NO: 84215 - DNA, 66 bp, Glycine max
  Peptide Sequence Number=SeqID_175900
atggggtatgaaggcacctgtttagagcatttggcagaacagaagttttggtttacgttgggttga

SEQ ID NO: 84216 - DNA, 536 bp, Glycine max
  Peptide Sequence Number=SeqID_175901
atggcactagctgatgtagaggacactagggcagacattcctgcagacacaggcacgcaggctgctgaggatgagcatgagggatttctgggttgtccaagcgacccatccgtgctgacccagtatgcggatcatgttacttgcagcatatggatgggagaggagcgtcttgagttgaagttatcctctcacgggaggaaggtccatagtttaggcaggcttgtccctgccattgagggactagttgctgggacaggactaagtcctctgatcgcatgttcagtagacactagcgatcggggacttttgtccttgtttgtcgagcggtggcaccgggagacgtctagtttccatctccctgtgggagagctggccattacgctggacgacgtctccttgcttttgcatgtgcccgtggttggtgacttgcacgcctttcagcccttgcacgtggatgatgcggttcagatgctggtggacttattgatggtctctgcagaggctgccagggctgagacagggcagtgtcgtggacc

SEQ ID NO: 84217 - DNA, 198 bp, Glycine max
  Peptide Sequence Number=SeqID_175902
atgtcagtgaaaaaccttgtcgggcgcctaggaggaggccagtcagggtcacagtgttttgcaagaatgctccaactatgtgggattgacacaggcttaaaggagcactcaaaccaggtgacccccaaggcctacactccgaagagtccgtcagggcctctccctcctaattcaggtccaatccagaaaacattttag

SEQ ID NO: 84218 - DNA, 420 bp, Glycine max
  Peptide Sequence Number=SeqID_175903
ttgtttgagccactggatcccgaggacaatgtcagcgccactaatagggagaatgtggaggggggtggtagaggaggtgggaagctggagatatttagcaaccctggactgaataaaattgtgggtgctcccttcgttgatgagcactgtgacacgggagtgatggatgaagccaaagaggcaaagtgcatccggggtggggttggttgggaaataatgggggtgggtggcggtgaggtggtgtcggggtcgggatcatcctcgtcgacaatgagtaaaaagaagcgtgctttgcatttgtggttggtagtgggtggcttgggtaaaggtgagggtaagggtgatggtgaaggtgaaggtgagggggagggtagcagaggtgggggtggtgtgggaacggcgggagagggtgggttctga

SEQ ID NO: 84219 - DNA, 204 bp, Glycine max
  Peptide Sequence Number=SeqID_175904
atggatgttccgcaacagcttcatcacattgtggacatcactcctgcaagccttggagacatgcttcacgccaatactcccatcatcctttttactaagttgcttcatctccggcctggtgccgaaattgcaccatgtggttcaggcattacaacccatttcactgcctcaggctatctccctcgccaagttgcagaaggataa

SEQ ID NO: 84220 - DNA, 273 bp, Glycine max
  Peptide Sequence Number=SeqID_175905
atgaaggattgtccttgtgtgtttagaacttgtaaaaggaatttacaagatagtggaactctcaagcgggttgcttggggactggacgtaggcacaaggatatctgaggccacttgtctaacactacccccatccgtcgaaccagttgtgccaccaccaatatttgttatgaaatctcatcctgaggttcttgcatcagaggctccaataactattgatcctatgcctgcgcctccacctttgccacccaagtcaccacctcccattccttaa

SEQ ID NO: 84221 - DNA, 273 bp, Glycine max
  Peptide Sequence Number=SeqID_175906
atggatgaccatcatcgtccctgcatactgtcgcaacgtgcccttttgcaggcgagcgaaggcgaggctcacgggtgcgctttccaaaggaggaaagatgcgcggagtcgccaccaacgtttatttgtggaaaacgtcggaaaaaaccgaaggaaaccggtcaaaacgaaaattctaagttcgggagttgtatttacgtttgaggaaggtcgacaaaagctgggctcttgctcctacgtaccctccatcgaagaggaaatcagacctacatag

SEQ ID NO: 84222 - DNA, 480 bp, Glycine max
  Peptide Sequence Number=SeqID_175907
atggaggagttgattaacaaaacacaactctctcctaaaataattccaacgtcatcacgtcggctcggcggctcctcaacagaatcttacttcatgtaccctactactgtcattctgctcccacgaacaagtgttcctcttggtgtgggggtccaacggcaagcaacggtggcttacgatggccatcggtggtcttgggtggtggaaaatgaggttttagggattgggtggcattttggagaagagaagagtgaaaaaattgtgtttttcacgttgaaaacccccctctacactagggcaggcttaacgcacccttgggcacttagcgcaacttcctctctggttggaattgggcttagcacacctctaggcgctcagcacaacttcctctcggttggaattgcgcttaacgcgccatttgcaaaatttgaggatgatccaacggttgacgaatttgggatcgcgattttactgaactag

SEQ ID NO: 84223 - DNA, 468 bp, Glycine max
  Peptide Sequence Number=SeqID_175908
atgcccaaagaaaagaaggataaagacaaaagctccataattttctatcaggagaatattcaagataagaagaaattcttcaagactagacaaaagaagggtcttatgagtacctgggaggacctagacggcacctctcttgatgaagatgatgaaaaagccaatataagcctaatggcagatacaacttttgaggagtctgaatcagaccacgaagatgagataatcttaacaaaccattacaacactatagaagttcctcagacaaatctggaaatgaatacgatgggaaggtatatgttcatgattaggacactgtcataccctaatttcatccgggaactattgcttggtggcatgcaacctttaattgaccgcttcaaagtagttggcacccttcgttgcacaatatgtgaagtcccgagacgtgccggaaatcaaaaggaagcgttgttacgcaatccgtga

SEQ ID NO: 84224 - DNA, 336 bp, Glycine max
  Peptide Sequence Number=SeqID_175909
atgagtcatcattcatctagtgttaatggcgagggaaggcataggtcacatcttagacctcactcccatagaagagaaaaggaaagaaagcctcaaaaggctaacattaacctcccatacttccatgggaaggacaatgtagaggctaacttagtttgggaaataaggatagagcaacaacttaaaaagaagtctacatcaaaatcttatggctctcactctaattcaaagaaagaccagggtcaaggcatcttaggggtgacaccttctaagcccaaagatgataaggggaagacaatagaaaagcaagcccctaaggctagtatgcatgagtag

SEQ ID NO: 84225 - DNA, 186 bp, Glycine max
  Peptide Sequence Number=SeqID_175910
atgcaaatcctgatgatgggagcttcaataggaacaccaaaggcgagtgctcctttatctgaggaggagaaacaaaaggctaaaaaagaggtaatgttgtgttctcattgcagtgctgtctttgacaagtcagctgctaaagctttcaaggcttcagagattcgaaagaattttctaaaaatttag

SEQ ID NO: 84226 - DNA, 528 bp, Glycine max
  Peptide Sequence Number=SeqID_175911
atgacgttgctgcttagcaacatcctacccagcgatcataattatgacctccccctgccgaagtgtatgccgcctactaggcaccctctggacccggataagtccaacatggccctgggatttccagctttaatcacaggactctgccagtcgttcggagtccccgtcgcacctagtaaggccccaaatgcaccgcctccacctcctcaggctgacccagctgggtcatttgacacggagcggtatttacggcatttggttcgccagcaggcggccaaccacagggcacacgtgcaaacccatgactctctatatcagcttagcctcagcctgcagagccagggttttgcttcttttccatgccctactctggatcaattcagggcagaggtcgcatggcccgaagattggcctgaggcccaggctgcagaggcatccgcagaggctcccggcgagccagataaggcccgcgaggatgaggagatgtcagatttgctcggcttcttgggagggagtggagccacatga

SEQ ID NO: 84227 - DNA, 516 bp, Glycine max
  Peptide Sequence Number=SeqID_175912
atgaccaccatcacgcagatcaggatgacattgctgcttagcaacattctcccaagtgaccataactcggacctccccctgccgaagtgtcagttggtttacaccatcctgactcaggtgagtgtccatgtcacccagctgatctctgatgctatttaccagtttacaaggattaagcctccgagacactcagtggactcggagaagtccaatagggccctagggtttcctgctctaattacaggcctctatcagttctatggagtggcggtcacctccaccaagctcatccggcctcccatcagtagggccttcatcgagaagtactgcatgcccaggcaggtgcaaggtcaggcgccacaacaaccagctgcagatgcgccaccgccgcctctagaggagcccagagacgagatcgattttgagatacgggcgggacccgtaggggcccctagggataatggaggaactcaggaggatggtgacatggctgacgtgttggatttgttcacttga

SEQ ID NO: 84228 - DNA, 630 bp, Glycine max
  Peptide Sequence Number=SeqID_175913
atgagcattctgattctgagcattctgattttgcacattctgagaacatggcacaacctccactccgtgagatggtccagccctcagcaacaacaacagcagcctgctccttccttccaaaatgctgctggcccaagaagaccatacattcctccaccaatccaacaacagcaacaaccccagaaacaaccaacagttgaggcccctccacaaccttccctcgaagaacttgtgaggcaaatgactatgcagaacatgcagtttcagcaagagaccagagcctccattcagagcttaaccaatcagatgggacaattggctacccaattgaatcaacaacagtcccagaattctgacaagttgccttctcaagctgtccaaaatcccaaaaatgtcagtgccatttcattgaggtcgggaaagcagtgtcaaggacctcaacccgtagcaccttcctcgtctgcaaatgaacctgccaaacttcactctactccagcaaaaggtgatgacaaaaatttacctaacaatttctgtgcagaagcagcacattccccctcttccattccctccaagagcagtttccaacaaaaaaatggaagaggcagagaaagagatcttggacacgtttag

SEQ ID NO: 84229 - DNA, 1212 bp, Glycine max
  Peptide Sequence Number=SeqID_175914
gaggaactcaagaaacaccattgggatgagaagctgactaattttgctgacagcagtatggacatcgccattgtgaaggagttttatgccaacctctatgacctcgaagataaatcacctaagcatgtgagggtgagaggtcatttagtgaagtttgatgaggatatcttgaacacattcttgaagacccctgtagtgttggaagagggggagaacttgtgcacttattctcgatttgcactcttaaggcctgatcctcaggaattggcagctcgattatgcatccctggaaggggattcgagttaaatgctgatggactgccactaaagatcttacggaagaatctgaccacgctcgcccagtcatggagtgttctttctttctctaacatggtccctacctctcacatctctgatatcacattagatagggccaggttgatttatggaatcattcagaagatggatatgaacttgggctatattatttcagctcaaatttctatgattgcccagcatgactcttctaggcttgggtttctagccttaatcactgctctctgcaaagccaggggagtcatttctgattctttaacattggagagcctcagttcaactattaatgtggattatgtgaagaaaaactactggaacctagatgacctctcagttaccttcagagggccgcgcaaggccaaggggaagaggtctgaggctcccgtatcttctgagatttcctcttcctcagctccagcacctattccatctgtcccatttggggtagtccatcatcatgcagagcctgcagggcttaggcttgccatccatcatgagcatggaggagagcctgcttttgaggagccagcagtagcagcagcagagggggaggatgagctcacccctcctgagcccttttattttgatgcaggtatacacatggctcaagaggaggatgcttctatagacaagatcccagagccatccccaacacccataccagatgatgccacaccatcggcaccaacacctgagttagagcagcctatctctcaggattctccagctgctcagccattagaagagaatgagcatgtgattggaagcatgactgaaaatgttagtcagtttgtcagattgattgttaaggaatgcattaaccgtatcttggccgtgtttgatggtgatagccacttagccaaaaaagatgaccat

SEQ ID NO: 84230 - DNA, 467 bp, Glycine max
  Peptide Sequence Number=SeqID_175915
agagaccagtgaggcatgttgatcttgctaccgggaaggccgacggcccccacaggaagaaattaagaacatatttggggattgtggcgtgtgataaggtggacatcacctacgagaactggaaggaggtccctactgctcagaaggacctgatttgggaggatattcaggcggaatttgatatcccagaggcttctgacagtaggacgaaaaggaagttactacagatgctgggggagagatggaggcagtttaaattagacctcaagagcaaatgggcccttgcagccgatcaggatggtgtcgaggacactgtctgtgagaaatatggcatcatcaaggaaaagtgggcccagttttgccagactcacagagacccttcttgggaggatgtgcacaagaaggcacaggccattcagaagcaaaatactgccccccccccatgttttgtctcgtgggggttatga

SEQ ID NO: 84231 - DNA, 757 bp, Glycine max
  Peptide Sequence Number=SeqID_175916
aaaattctctaaaccttcaaagaagatagaaagtaaaaacaacaccttcacatgcttcgcatgtgggaagcaaggtcacatcaaatatgaatgtcctatctaccttagaaaacaacttgctgaaaagaaaagaaataaagatagaaaacagaaaaggacctacatagcctgggaagacaatgcatccacatcctccagctcttctagtgaagaagaagttgcaaatgtgagcttgatgaaagattcaatagatgagtcctcaaccattgaagaaactaaggtaacttctaaatttaaagaagttttggaagcatttaatgaaatgcttgaagaagcgcaaaggcttgctattatgaacaataagttgagaagcaatttaaaactgcatatcactaaattggcttcaacacaaagtgagctggataaattgagacaagaaaatcaaaaacttgtttcgagttataaagccactagatgtgtttatgcatccacttctcttaatatggatgattacaaatctttacaaattgagtttgaaaagttcaaaaagaatcgctatgtagaacgtatgaagttgcaaactaagctttcctatcttaaagatatgtttagaaaaatgaacaaaggaaatagtagtcttagtcacatgctcagtgtgcataagcatactactgataaaactgttttggggtataacaagcaaactaccttttcgaagaaaaccaagtttgcatcgtccaacaaggggatcctctag

SEQ ID NO: 84232 - DNA, 198 bp, Glycine max
  Peptide Sequence Number=SeqID_175917
atggataaacctcctacaaattatcttacttcaagctgtatgagatcctctttgagtgagtttcaggtcatcaaagcttttaacatcaatattcatgcacccaaggctgctcattccaaaggttgggacaagctttggctggaggtgaattctcttttagtcctcaaggcttttaatgttatcactgtggctccttag

SEQ ID NO: 84233 - DNA, 204 bp, Glycine max
  Peptide Sequence Number=SeqID_175918
atgcagctcctgagacggtcacagctgtctatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 84234 - DNA, 291 bp, Glycine max
  Peptide Sequence Number=SeqID_175919
atggggtcgcaagccatcaatgaagatattgagttgaactggctcgctgaacacgtgggtgggagtcttccgaacaagatgggaatatggatcttcattagggagcctatgaaagagattgccttgaatcaactagaagagaaaatgtggataagggatattggcagcttgaacttcgggccgggctatgcttgtgaaatactagggtgtagaggtactagagtagtcatccaaggtgatcctccgtggccggtcttcttccatgatgtgttcttcaaagttgggatgtga

SEQ ID NO: 84235 - DNA, 569 bp, Glycine max
  Peptide Sequence Number=SeqID_175920
gcaagcgagcccgttgacacgcagagactaacgtcgtcatctgcacctttgtcatccagagacggcaagtccgatgacatagacggcaagtccgatgacatgcggagataccttttggttatccacaccttttgtcagctagaggcaagcgagcccgttgacacgcacagactaacgtcatcatctgcacctttattatccaaagatgacaagtccgatgacatgcagagataccttatggttatccgcactttttgtcagctagaggcaagcgagcccgttgacatgcagagactaacgtcatcatctgcacctttgtcatctagagatgacaacgagcctgttgacatgcagagactaacatcgtcatctgcacctttcccggagatgtcaacgtcttccggccgagactgcgaaaaattctcatttctgccgtcagactcaagagaccaatgtggtcatctgcacccttcccagagatgtcagcgtcttccggctgagaccgcaaaaaagtctcatttctgccatcagactcaagtgtctggtagcatgcagagacgtcctatacg

SEQ ID NO: 84236 - DNA, 300 bp, Glycine max
  Peptide Sequence Number=SeqID_175921
atggggggtgctttgaccttgttggatgtccctagtgggggaaatagagcagttaaagagtctaagcatctcttggggggatggcttaggatctttagtttatccatggtcattgcacttgatggttggtcaagcccggcaagtgcactagatcgcgcaagtatttacatcaagtacctacaaggaagaaccaacagaggatttagcatctgtggtgtaaaaataaaatctgatggatctacagataaagaagctggaagtggtatctgtgtgggtgcaggaggaataactggaatctga

SEQ ID NO: 84237 - DNA, 366 bp, Glycine max
  Peptide Sequence Number=SeqID_175922
atgccaatctccgcctgcagatgtatcggttgggatcacgcccacaagacgcccagtggacccgaagaagtccaacagggccctgggggatcgcgcctgcaagacacccagtggacccgaagaagtccagcagggtcttggagttgtcaagctctaattacgggtctctgtcagttctacggagtgcctgtcacctccagcaagggcatcaggccccctactaatcgagctttcatcaagaagtactgcgtccccaggcaggcacagggcaaaataccaaagcagcctggggatggccggcagcgggcaacagacgcaccgccaacacctctagagttcacctcagctcatccacaaaaaggttag

SEQ ID NO: 84238 - DNA, 693 bp, Glycine max
  Peptide Sequence Number=SeqID_175923
atggcatctaggaagagaaagagcacgacttctagacccacagctcagtatgattccaggcgtttccaatctctggaagcttggaacagatatacggacaacattctcagtcggaacatcattccggagagaaatgttaaaatttatcatactgagttcgacgagtttaaagtggagttggagaggcgtaatctccataaacgcctttccaacctccaagatggaagcatagacgtggctctggtgaaggaattttatgctaatctatacagaccagaggaaccaacccctaaacaagttagagtaagaggacatctgattaagatcgatgcagacaacctgaatgaatttcttcagactctagtggtgttagaggaggggaaatctttacccacctactctaggttttgcaggttgaggataaatcaccaggagattgaaaccagtctttgtattccccgcaaggggtttattttgaatgctgagggccaaccgtggaaacttctcaaaaaagatctgacgacgctggcccagacatggagtgtcttctcttactccaacctagctcccacatcccacacctcaaatttgaacatggacagagctaggttggtctatggcttggtgtctaacatgaacatgaacaccgtagcccttatctcagagctagaggagttacctctaacagtttga

SEQ ID NO: 84239 - DNA, 219 bp, Glycine max
  Peptide Sequence Number=SeqID_175924
atggaacaagaagagaaaagatttgtgtaccgtatccgctgttcttcggatgagaacaataaggaagaggaaatagaggaaggaatcagtgttcctgagtctcggaatgtcgttgactccgactcgaagaacccttttcgcttctttaatggggcagggacacgttgtaatcaattacagtatttggtaatcgattacacccttcttaactgcctgtaa

SEQ ID NO: 84240 - DNA, 240 bp, Glycine max
  Peptide Sequence Number=SeqID_175925
atgagtgaacggattgtcatcatcaaaaaagggaagattatggaagcaatgacttccaagattattttgatgatgccaaagaatcaagagttaagcaagttccaaagaatcaggcttcaagaatcaagtctcaaagaatcaagattcaagaacaattcagttttaagattcaagattcaagaacaatcaagatcaagattcaagattcaagattcaagagaagaaatcgagaagcaatag

SEQ ID NO: 84241 - DNA, 201 bp, Glycine max
  Peptide Sequence Number=SeqID_175926
atgggcacacaacaccgtacatttgatcaccaattgagtcctttcgctaagcgcaaacctcgaactaagtgcatctgttgtcatgcgctaagcggagagtctctagcgctcaagctgatttggtccgctaagttggccaaggctgagctaagcccatttcaatgctatctgaatttggctaagcgatggcctgctcgctaa

SEQ ID NO: 84242 - DNA, 307 bp, Glycine max
  Peptide Sequence Number=SeqID_175927
gtttgcccgtgcatggatattgagattcatgggaggtgtcttgttcgttgacaaaagcattaacaaagtttcgctaaggcagatgtgcagtgccaccgattataaaactaaatcaatcggaggtatgtgcatcttactacaaatgtgggcatgtgaacgatgtccaaccttggctccaaagaggactccttcccaagtagtaaataaaccactggggcacaggtggttgcgacgtggaaaccaacatatcggcaatgatgatgtgagagtttttcgtcgcaagttggatattatgaaacgtcatgag

SEQ ID NO: 84243 - DNA, 466 bp, Glycine max
  Peptide Sequence Number=SeqID_175928
gtcgactctagaggatccccctccggaggaggtgcgcggcgcctcagcctcagccgcgctcaccgccgtgcaggaagtgcagcgtcagaccgccgacctctccgtggtccgcgccgccctggcggacgagttgaacgctcaccccccatccgcggcggacagtgaccgcgacaccggcgccgcgtccgcacacacggtcgaaccggctcggacggtcgagccgccggagtcgacgtcgacgccggccggtgtttccgacgtcgtcgagccgcccgccgtcgtcgagccgccagatgcggtcgagccgccagacgtggtcgaaccgccggatcccgccgagccggccgtcgtgagacctcgcacacacccgatcgtcctgccgacggtcgacgtcgccgagctcggagtggccgatcgtctcggtctctctgacggggacgacgaggaagtggggccgacctcgtga

SEQ ID NO: 84244 - DNA, 219 bp, Glycine max
  Peptide Sequence Number=SeqID_175929
atggaggcaacaatggtggagaagaagaagagaaaaagcaacgtggaagggaggaaagagagccacaaaggagaaaaaaaattggacctttttggatgccgaaatccttcctcggtttgcatgctgcctctctggttccagttcctcgcgtttctctgcacccgtcggggcccgttttcgaaagtaggcaatatatatatatcaaaatgctcagaatga

SEQ ID NO: 84245 - DNA, 312 bp, Glycine max
  Peptide Sequence Number=SeqID_175930
atggctcacaaattttgttttgaagcacttgatcaaagtctaagagatattattaaggacaaatccagttctgataaaatctttggagaaagcaacatacatgcaacagatagaggagaaactacagcttttgcacaatggatccttgattttggtgactggattgttgggccgcaaaatgatggatatgctacagttgaaatcccacaagatctgttgatcacagaatatgatgatccaatccatagtatagttaattctacattcccagatttacgtcagcattacaccagccctgaatacttccaataa

SEQ ID NO: 84246 - DNA, 330 bp, Glycine max
  Peptide Sequence Number=SeqID_175931
atggtcatactttttcagtcggatgttcgattcaggcgcaaaatatatcgacacgctcgaattgaacaccggaagctctcgaaaaattcaaatggtcataacttttcactcgaatgttcgattcaggcacttaatatatcgagacgctcaaaattgaaaaacggaagctctcaggaaattcaaatggtcataacttttcacacggaggtgcatcacatatcggcacgcttgaaattgaacaacaggagctctcgagaaattcaaatggtcaaaaattttcacacggaggtccaattcaggcgcatcacatatcgagacgctcgaaattga

SEQ ID NO: 84247 - DNA, 219 bp, Glycine max
  Peptide Sequence Number=SeqID_175932
atggatgaattcattgaactgatgaaagaacgtaactcggaaacgttgggatgcttgagtgcccacctggctgtagccatgactaattttgcacgttgttttcaaatcatcattgtcacgcgtgccttatggagtgatatgggagttcggcccgagaccgacaccttgacacccaaatttgtttcgccccagatatcaagattggggttgccgcgataa

SEQ ID NO: 84248 - DNA, 441 bp, Glycine max
  Peptide Sequence Number=SeqID_175933
atgcagctaccgcaagagcccttgaacaagaaaccaagagggctcgcaaggaagagcatggtcgtgacaaatttcgtggagctttgtggggcagcaacacgtttatacgagacagagaccaacatattagccatcgtcagcaagtaccaagaagaactaaatctagccacggcccacgagcacaaagtggcggacgagtatgcacaagtgtacgtagaaaatgaggctagaggaagggtgattgacgcattacatcaagaggcaacaatgtggatggaccgatttgctcttaccttgaacgggagtcaagagcttccccgattgctagccaaggccaaagcaatggcggacacctactccacccccgaggagatccacggacttctcagctattgtcagcatatgatagacttaatggcccatataattagaaaccgctag

SEQ ID NO: 84249 - DNA, 138 bp, Glycine max
  Peptide Sequence Number=SeqID_175934
atggaaatgctcaaagttagagagcaagaatctgattcctctcaacaaatcgaggaggactggagaagacatagaagtgacacgaaaaacattttctacaacagcgaaacgacaacggttgatcaagaactgccttag

SEQ ID NO: 84250 - DNA, 117 bp, Glycine max
  Peptide Sequence Number=SeqID_175935
ccatacccacgggattgacgagttcgcacccccagaagctcccggcgatggagaagaagcccacgaggatgaggagatggccgatttgcttgacttcttgggagggagtggagatac

SEQ ID NO: 84251 - DNA, 243 bp, Glycine max
  Peptide Sequence Number=SeqID_175936
atgccagacattcgcaaacaatgtcaacgctccgcccctacctctaaatgtcttggccgcgccgtggccatttatttctcaacacacacatcaaatattcacttaatgattgcatcagttgtcaccgttgtcaccaacgaagttgaggcggtggtgtcttctcattggcataagcagtacattcaccggcatagattggtagaactcgagggaggaggaggaggaggagggagtccgctctga

SEQ ID NO: 84252 - DNA, 252 bp, Glycine max
  Peptide Sequence Number=SeqID_175937
aataagttggggattggatcgacttttggtcgtcctcctgttcttggttatctggttagtcctactggaattgaacgagttctaactgaaaaagaccttctggttgactcatattcagacctagaggcttctattcttgaagaaaaagaatttatcctattgaagaacaaacggtgtggccttatgatgcaatcctatcccgcaagggcattgggtagaagactccaagtagattgggctagagatccaagg

SEQ ID NO: 84253 - DNA, 315 bp, Glycine max
  Peptide Sequence Number=SeqID_175938
atgcgtaaggagaaaataccgcatcaggcgtcattcgccattcaggctgcgcaactgttgggaagggcgatcggtgcgggcctcttcgctattacgccagctggcgaaagggggatgtgctgcaaggcgattaagttgggtaacgccaggattttaaatatggattcttttgaagttaatgttgatgagaatgacaatgggagtattgatgtggatgtgcatgaaaatgttattcatgaagatgaacctattgagtctaaaatgtcaaaaaagagggctagaaattattcatcacatgtgtggaattttttttga

SEQ ID NO: 84254 - DNA, 294 bp, Glycine max
  Peptide Sequence Number=SeqID_175939
atggtatatgggtggagtgacaaaaacttcactttattgcttaaggtagtgcagcgtatacttccagaagaaaacatgtttctaacaagtttatataagagtattagaaaatttatgcatgccctaatgattgcatactatacagagatgagtttgaagaaatacataaatgccctaggagaggggtatcacagttcaaattcaaggatgatgaaaattgtagcagtgatgaaagcacaaagaaaggccctcaacgaaggtgttatggtgtctttctttcattccaaggtttaa

SEQ ID NO: 84255 - DNA, 888 bp, Glycine max
  Peptide Sequence Number=SeqID_175940
atggagattcagaaaatgaataatggtcacagtgttgttactgctactgttactgctactgctactcctactcctactactactttcgttgctgctgctactgctattactactactccttcttcattgagttctttatcttcttctaggtggccaaagacagaagttcatgctttgataagactgaggacaagtcttgaaaccaagtaccaagaaaatggaccaaaggctccattgtgggaggatatatcagcaggaatgctgaggctcgggtacaacaggagtgccaagagatgcaaagagaaatgggagaacatcaacaagtacttcaagaaggtcaaggagagcaacaagcaaaggcgcgaggatagtaagacatgtccctattttaatgaacttgaagctttatacaaagaaaagagcaagactcagaacccctttggcgcttcgttccacaacatgaagccacatgagatgatggagccattgatggtgcaacccgagcagcaatggagacctccctctcagtacgaacaaggtgcagcgaaggagaacaataataatgaaagaaaagaaagagaggaggaggaagaagatgaagaagaagaagaagaagaagaagaggatgaaaatgaagagggagatctagagagtgtggaagatgaaggagggcatgatgatggcacaaacaccggcactataaaattcaattctttaataatgaatgacccatctaaaagcatggtggtgcagaagcagaagcagaagcagaagcacaagatcattggagctgtgggtcacattccggccgccatgaactgggatcagagatcgttaattaacactaagaaacaacagttcacatgggccagcaaagcagaagcatag

SEQ ID NO: 84256 - DNA, 207 bp, Glycine max
  Peptide Sequence Number=SeqID_175941
atggagaagtcattggcaatcactcgtatacattcagcaagtggtggacatagacaaaggtccttaattggggcaatgaattatccatctcatgactcatcgacggatggagattgggttgggacaagacaactttcacatttcgatctaataatcgccacgcttctaccaaagatgtctttccccatttattcggaatgcttgtga

SEQ ID NO: 84257 - DNA, 1185 bp, Glycine max
  Peptide Sequence Number=SeqID_175942
atggcgtcttccaattcacgaaaatcagaaacttccccttctcccgccccgcaattcaccaccaccaacttcatccccatccccgccgccgcagcccctaaaaccgtcgatgacgtgtggcaggagatcgtgaccggcgaccgccgcgagtgcaaggaggaggccctcgacgacgacgacgacgacgacaacgagatgatgactctcgaggacttcctcgccaaggccgacgccgtggacgacgctgaccatgaccatgaccatgcccatgaccacgaccccgactaccacaacgacgacgtcaagatgccaatgcccctcaccgagaggctcggcagcggcaccctcttctccttcgaccaccttcccacgacgccgtttcacgacccctccgaaggctccgtcatagggttcggaaacggcgtcgaggtcatcgaatgcggaaggggtaaaagatcgcgtcccgttttggagcagttggataaggccgcgcaacagaggcagaggaggatgatcaaaaacagagaatctgctgctaggtctagggaacgcaaacaggcttaccaagtggaattggagtctttggcggtgaaactagaggaggaaaatgacaagctcttgaaggaaaagtctctaaatctgtcatttccgatttctattgtctcaacacatgctactgtgcttgttttcattgctagcatgcttgcatttggaatgtttcttcgaccattttgggttgcaaaaaacccacattttttactgaatgttcccaaaacaggggatgctgagaggaaaaagaagaggtacaagcagggtactggttacttgctagttgctactgacagaattgttatcggggttgtgggacgtgccgctgacgctggcattttaggaagtggtgctgttgcaggcacgaccagacacgttggtttgccaggcgcgaccagacgcgccggtcaggcatttccttccatgcgcttccctggccatgatgcgaaccaagacgcctcgggcaagggcgtgggtcaacgcgcctgcacgcagggcgcgacccgtagcgcctgcaggcccagtgcgacacgtggcgccttgcctttggcacgtccaattcctgtcagcgccgctttgactccccgtcccaccatgcaacgtgtcagctttatgtggaacacgcccctcggatag

SEQ ID NO: 84258 - DNA, 675 bp, Glycine max
  Peptide Sequence Number=SeqID_175943
atgcacttccccattctctttctcttccttctaccttcactcttcaagttttcatattcagccacaattctagtagacggatcttcagagtggaagaaccccactgtttccatcggtgactccatcattttcaagcacaagcaacactacaacctctacattttcaagaacgagaaagccttcaagctctgcaacatcactcaagccactcttctcaccaacccctacacgtggcatccatctcggcctggtttcttctacttcaccttccataatgggtcactgaaagcgtgccaagattctcaaaagctagccatagaggtaacttcttcagcaatggctccagaagtttctccggctccttcttctggtggagaggtaccatcttctccttcgtttccatggccttttcatccaggacaagaagcttcttcacctggtcctgcaccacaagcacaagcacaagcaagttcgccggtgacaattccgttagtgccggataaaggtggtggcatgcccttcattaacagcaaccctgcagttcctctacctactggtgaagttgactctgctaccatacgccccttacccatcacctctggccatcaaggacaggaaattgcggacaaaaatgctaatgtagacacgcttacggttataatgtggttgcaatga

SEQ ID NO: 84259 - DNA, 315 bp, Glycine max
  Peptide Sequence Number=SeqID_175944
atggtgttgtggagaggaaaaaatagatcccttggagaaggagctaaaactcttctaaatgaaacaaagctaccagagtacttttgggctaatgctgtttttaggataaagattatgctcttgaaaatgaaaccagagttgaagtgcttgaacaaagcaaagaaatcactgccatgcctcctaaagacctccctagagaatggagaactcaaaaagacctctccttggacaacattattggagaaatatccaagggagtttctactcactctagactcaggattttatgccaataacatgggtttagtttcttag

SEQ ID NO: 84260 - DNA, 1029 bp, Glycine max
  Peptide Sequence Number=SeqID_175945
aggagaatagattgggaccagctcttggccgggataggaggtagaacaatcagttggttcccccgatggaaggaaggaaaagaaggagtccttttctcatgtggaagatacccaaacattccgctggtaggaacgaggggttgtattaactacaatcccgcgctcgctataagacaactagggtaccccatgaggggagcatcgacggaagaaagcatgtctcctttccttgtgagggatttcggcgcacaaaattccaagactatacaaagaatccataaggcgtgggaaaccccgttaaagaaagatcaagagcttagaggcattcgtaatggcatcattggtgggtaccacgaatggctgaaagttcatatacgaggtttagattggctcgccaagttaaaagtcgtcagcgaagagagttttgaagcaccggaagaggatgaagaagtccaagctctcaaaagcgagttaggaaaggcgaaacttgccaaggagaagttcaagttgccgctacacacgttcggaaggagtgtgccgggttacgggaagagaatgcgattaccgcaagagcccttgaacaagagaccaagagggctcgcaaggaagagtatggccggaatgaatttcgcggagctctatggggagttaattgcttgttcaaagtccaaaagaagcttgtctcagtgtttatgcgagacggagaccaacatgctagctatcatcgccaagtaccaagaagagttaggtctagccacggcccacgagcatagaatcgcggacgagtatgctcaagtatacgcggaaaaagaggctagaggaagggtgatcgactctttacaccaagaggcaaccatgtggatggatcagtttgctcttaccttgaacgggagtcaagaacttccccgcttgttagccaaggccaaggcgatggcagacacctactccgccctcgaagagattcatgggcttctcggctattgtcagcatatgatagacttaatggcccacataattagaaatcgttag

SEQ ID NO: 84261 - DNA, 255 bp, Glycine max
  Peptide Sequence Number=SeqID_175946
atgaccatttcatcatggcagaacaagctaaatagggtattttatgtgcaagacccttctgatgaaaagtggtgcgttgttctacacggaaaaacaattggtgttaatgtagaagatgatcattcatacatggacaattatgttagtcctttgtccacacaaatgactcctaacatcatcggagaaaaagaagttgacgacgttcatgctaatcgtaatgatcatgatgaaggagaattaattaccattgtctaa

SEQ ID NO: 84262 - DNA, 543 bp, Glycine max
  Peptide Sequence Number=SeqID_175947
gtgatccgaccgccgatcacccggccttcatcgagaagtattgcacacctaggcaggcgcagggtgatgcacctcaggccgcagatgtggcgtccctaaataatgactgggttgactctctcagtaagtctgaccctgagatagtcctggagttttatgctaatgcttggcccacagaagagggagtgcgagacatgcgccagttcctgggtgacccgttaatgttggaggaaggccaggagtgtgagtttagtcagaggaggaacagggccgatgggttcgacgaggaggccatttcccagctattatgcacaccggggcaggatttcgcccggactgctgcagggaggcgggtgcggatcatgcgcaccagcaggaccaccttgacccagatgttgatgacattgcttctcaataatgtcttgcctagtgatcataactccgaccttcctctgccgaagtgtcagctggtgtatgccatcctgacacggatgagcgtccatgtggctcagttgattgctgacgccatctatttgtttgcag

SEQ ID NO: 84263 - DNA, 393 bp, Glycine max
  Peptide Sequence Number=SeqID_175948
atgactattttgtcccatggattgagtctgttccaggaaggcaagagtagtgggaatctgaagactaatgaatctaacaaggaaaatgctggagaagatattactggtgcaaagaatgaagtgaagtgtgacaaccaagcacctgaaaacaagagtgagacagagaaatccataccagtaacgaagaaagatggcgaaaatcctacacctgcaaaagctagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 84264 - DNA, 183 bp, Glycine max
  Peptide Sequence Number=SeqID_175949
atgagtcatggcccgagaagaatgagaagaaaagatataaagaaagaagatccaagaaggcgtatattgcttgggatgacaatgactcatctgatggttcgaagaaggagattaaccttctatccatggactatgaaagtgatgaaaacatctctcaagaagtttaattactttctttcttga

SEQ ID NO: 84265 - DNA, 189 bp, Glycine max
  Peptide Sequence Number=SeqID_175950
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccaggagttgtagggaatggccgtaggcctaag

SEQ ID NO: 84266 - DNA, 1254 bp, Glycine max
  Peptide Sequence Number=SeqID_175951
atggccgtattcgtcgttaatcttcttgaagtggtcgatatccagaataatcagcgccgccggaccgctctccagcgtctggctgatgcgctgaataatcgcgccgcgattccacaccgccctcctgcgccagctggtttaactgctcattcacgcggttcagctcgcgttcggcgcggtcgctgcgcgagatcagccgccaggtttcgcgcatcaggcgctgatagtggcgattcaggtgcagcagcgcctcgcggtaatcctgtgcgctcagcgtgctttgtgctgccacgtcctattaacctgcagatcggtaaaatccagcgccagttcctgaccaaactcttccgcgatgtcatcttccgcatcaaacagccagttcagcgtgacgcgctgaccgcgctgcgccagctggttgaacagatcgaacaggctgaacagcattttggtgctggagctattgaagtagcgcagcgcgatagtgacgaccaccgcgtcattgtcggtgggttgccactgctcaagggcatccagcagcgggcgataaaacgccgccgcgttctccggccacgactcgccgcgcagcgcaaactggcgggtggcaaaatcaaaactcacttcgggcgtgctctcagtggcagcgataatcaggttttgcatacaacctcaatcctggtgaatggtggctttaagccaaaacgtggcgtagccgctggcgggcagcggacgcagttcatactccagcggttcactgacatcacgggcaagcgtcagcaaaccgatattggcccctttgctggtggcggggctctcggtgcgcagaccgacacggtaggcctgcttaatttcgtcgttactcatggtacgcagcagatcgagccagtcgcgcagctgctcgcaggcggcctgttcgacctgattactgctctccagcacatagctatcgccatccacgtgcagtgttacggtgccaaagcgatagtgctgttcggcatggctcagggtacggctgtcctgcgaatagcgcagaatgttctgcacaatctcgacaaagctggagaacagccggcggcgcactttcagcggggcctgctggttttccagaaacactttgatcacttcacccatcgcggtgatgttttgcggcgaaaagaagccggtatagtgcagcgcaacgctgtcgggcggcaggtgcgtgccggtggaagctggatgcataagaggctcgttaataacgcaggccaaaccaggtga

SEQ ID NO: 84267 - DNA, 273 bp, Glycine max
  Peptide Sequence Number=SeqID_175952
atgtttttttatggcccctcacaaatatttgtcaccactttcaacactccaccatctgcatataatctaccaccatcgacctcttattatcgtccatcattacctactcaaatgcatgacataggtcatgaaaatgaggaggatgatgatgatggtgatgatgatgatgacaacggtggtgatcatgttcttcaacaacaacacacaattatacgtgagcatcctagaacaagaggaggtagagatcgtagaccaataggacaacaaacatag

SEQ ID NO: 84268 - DNA, 306 bp, Glycine max
  Peptide Sequence Number=SeqID_175953
atgaaggccatttttgattgtgatagccacttagccaaaaagctgaccattgaaaaagggggtgcaaatagaaaccaggcccactcaggccttcttgagggttccaaaagaaggcggtgccttctagtggaagcaaccctgctcgcctgggcgagctgggcggcaaccacctccctcttttctcctataaataggggaaagagggcagagcaaaaaggttcagcccttctggtattgagaaatctctcgaaattagtgagaaaaattgttttcgtggaaaaaatccaagccgaggtgtttccgtaa

SEQ ID NO: 84269 - DNA, 702 bp, Glycine max
  Peptide Sequence Number=SeqID_175954
atggcagagctatcgaagaagagaaagggatcatcctccaccgctgctgctgctgcccatcgccgccacggcccatccggagaacccacaacacctattcatccttctttgtcatctccaagatcatcaacattgttttcatctgatgatcaacatctacgaattttgcttcctcggtcttcaaatttagcacaagcctctgaggaggatttgattcttatgtgggcttttctaaccggtcgtcagatcgactgggcccatttggttcggtaccgaatgcataaggcattacgggccaatgcacctcttccttatccacacttgattactctgtttttgcgtcattttcaaattccgcttgatgatgaaccctttgttcaagtcaagcgttcctttgcaattggtgctggtgcagtgacctcctttgggtatcgtaaagatcggaatggacaatggctgaagaaggatgcactccctcttcaagatgaacgtactccttcacctcctcctcaacgtgaggattccgctctcatgaatgaagtcctctccgaattacggggtcttcgtttgtatgttggtgaccgctttgactcgttagattcacgctttgccggtatggacattcgtcttacacagcttgaagaggatgtcggatacattcgtcagagtttcgatcttccaccacctcctccgtcttcttag

SEQ ID NO: 84270 - DNA, 102 bp, Glycine max
  Peptide Sequence Number=SeqID_175955
atgggcccaattttgccagagccacagagacccttcgtgggagaaaagaagctgatggatgagaagacaaagaaaaaactggaggaagctgctcaatcctga

SEQ ID NO: 84271 - DNA, 646 bp, Glycine max
  Peptide Sequence Number=SeqID_175956
ggcgtggaattgtgatgctggattttgaaatccgcgcacatttcctgcatcatcttgttattcagattggtaccatttttggtaatgatcttcctagggagtccgtaccgacaaatcagcttcctcttgatgaatctaaccactacactccttgtgacattggtgtaggaagccgctttgacccatttggtgaaataatctattgccacgagaatgaagcgatgaccgttcgaagccttgggttcgatggcccctatgacgtctatcccccacatggaaaaaggccaaggggaggacatgacattcagaggatgtggcggagcattgacattgttcgcgaacgcctgacatttatggcatttccttacatggatgcagaaatcactttccatggtgagccagtaataacctgctctcaggattttcctagccatagcatgcccgttggctatgctcccgctcatgaagaaatcggccgccaatctcctcaatgtccttttatcgttgtcggaagccccctgtgggtatcctttgctttcaacgagacgtgccagaaatcaaaaggaagcattgttatgcaatccatgaaattccgcaacgtgccggaaatcaaaaggaagtattgttacgcaatccgtgagtttcc

SEQ ID NO: 84272 - DNA, 1008 bp, Glycine max
  Peptide Sequence Number=SeqID_175957
atgggatcaagtcaaatgccttcacttgaaaggacgttctatcaagtcaaggtcaagagcctagggaccaccagtctaaaggagttagggcagttaatgggtcagctccagcggcaagcttttcgcaaagcttacggtaaaatctgggacttagccatggtagaagtctccacagaggccattgcctccctcgcccagtattatgatcagccgatgaggtgcttcacctttagggacttccagctatcacctatggtagaagaatttgaagagatcctaggatggcctctagggaagaaggtcgaaaatagggtggttggaataccgagaaaatctttggaggcaaaagcaagaatcttggcaagtaaaggcgaatgggccctgttcatagacattcttgcactgttgatctttggaggagtcctctttccaaatgtggatggagcagtaccaggattatctgctgtgctcccagtctttatgtatggttggtttcacacctttttcgccaagagagaaggagcatctgtcaactggttccctcgatggaaagaaggaagaaccggagttcttatctcgtgcggaggatttccgaatgttcccttgatagggacaaggggcttcaataagaccaacgtggagacacttcagaaggtccgcaaggcatgggaggtgttgcaaaagaaggacaaggaactcaggggcagtaacaatgggcccatcggtggctatcttaagtggttaaaagcccacgtgcaaggtttggattggcttccaagtttgagaaccgctaaaagagaggaagttgaggcaccgaaggaagacgaagaagtgcaagcccttagggcggaactcaagcaagcccaaacagagaccaagagggctcgtagggaagagcatggccggaacaagttccgtttgtggggtagcaacagcaagcttaaactccaaagagaggaaagggaccaatcacgagtagacagtttgatcttgaaagatgagttgaag

SEQ ID NO: 84273 - DNA, 363 bp, Glycine max
  Peptide Sequence Number=SeqID_175958
atgtcattgcctagcgctgttcatgtgtcctccaccttcgagtctggagccccgcgaatgtcattgcctagcactgttcgccaattctccattctccactttttctcgaatccccatgaatgtcattgcctggcgttgttcatgcatcctccaccgaaagagtttggagctatgctttatgattgcctaagggtggaccctctagtgcaatcctccattctccactttttttcggagccccgtgaatgtcattgcctagcgctgttcatgtgtcctccaccttcgagtctggagccccgcgaatgtcattgcctagcactgttcgccaattctccattctccactttaattcggagcccatga

SEQ ID NO: 84274 - DNA, 156 bp, Glycine max
  Peptide Sequence Number=SeqID_175959
atgtcactatgctcccttgctttccaagattacttgcctgattcagggatggagcaggaagtctttatcttatgcagatattggcaaaaacaagcccttggttgcttggtcaatagtttgttctccgaaaaaagaagggggtttaggcctttttaa

SEQ ID NO: 84275 - DNA, 222 bp, Glycine max
  Peptide Sequence Number=SeqID_175960
atggattcattcagtggagtggtcttaaagtggaagttcctcagtggagtggattcagggatctttagtttctcaaagacagccattgacttggtacaaagaatacgaataggcaatgttaaagtgcgtaaaggaagcccacttgtcacttgtctcttggaaggttcccgtggcagtggtaaaactgcactttcagatactgtgggtattgacagcaactga

SEQ ID NO: 84276 - DNA, 357 bp, Glycine max
  Peptide Sequence Number=SeqID_175961
atggagaatgtcaaaacaattaaggctgtcctaaggtcctttgaacttgcatctggccttaaaattaattttgccaagagcacttttggagcttttggtcaaactgacctttggaagcagcaggcagccacctacttgaattgccagttgcttgaattattaagagataggctgccgacaagaaaaaacttgcagagaagacagattcaactcacagattcactttgtcctctctgcagaacccaacaagaggatgcatcccatcttttctttcattgcagcaaagttcaacccatatggtgggaaaccatgtcatgcctgcaagttaagggtgcttttccattaagcccacagtag

SEQ ID NO: 84277 - DNA, 297 bp, Glycine max
  Peptide Sequence Number=SeqID_175962
atgtcccacgctgttaaggatagtcgagacaagtgggccccgaattatgaaggacctttcgtggtgaaaagagctttttctggggcaaggagcagaatcgtctcaggccacagtcagaagtcaagacaagtcaatggcagaaatcaaccaaggtacatagggacggatgcaagtggggctagggtcacgaccgaccgatcgttgccccttcccggcgctaaacaagcagagaacgtcgctgcagggcagctcagtatcctttgcgttcgcagtttcttttactattgtttgttttaa

SEQ ID NO: 84278 - DNA, 186 bp, Glycine max
  Peptide Sequence Number=SeqID_175963
atggaagcttgcttgtggggctcctatggaggctggatctttgagcttcaattaggtcctttaatggtgattttccaccatggagatgtagcggaagacaaaggagaagaggcagcttccttgagaagctttcttaagaaaacatccttgagaagcttctttgagaaaacttccttgagaagctag

SEQ ID NO: 84279 - DNA, 276 bp, Glycine max
  Peptide Sequence Number=SeqID_175964
atgtgggagttagagtgtcaaatggaagctgcctatccatccttgtttgagtcagttttcctggatatccctaagatatgtttctacagtctgaccgttgggatcttgaaaacaataacttttgatctcccgctatgtgagaaaggcgcgctaagcgcaattccaaccgaggggaattgcattgagcgacccaaagctgcactaagcccatttccaaccgagaggaagtgtgttaagtgcccagaaggcccgctaagcgaaagttgcaagttataa

SEQ ID NO: 84280 - DNA, 429 bp, Glycine max
  Peptide Sequence Number=SeqID_175965
atggcaagagtagcaaaactggtcaagatctcagcacaagagttggaccgagtgaagcaaaataggaatggggtggtagggataccaaggcagcgcttggaggaaagggccgaagctttggtagataaaggagagtggactttattcattgatatattagcattgttggtgtttgggattgtactctttccaaatgtagacgagctagtggatttagtagcgattgacgcttttcttgcttttcaccacagcaaggaaagcccggtcattgctattgtcgcgacctaccatacagcggaggcccgaaatggccaaaatcaagggccaaggagtttgtctccgagggagaaaatgagcggagtcaccaccaacatttatttgagaaaaaagttagaaaaaccaaaaaagacgaaggtctacgtattttga

SEQ ID NO: 84281 - DNA, 327 bp, Glycine max
  Peptide Sequence Number=SeqID_175966
atgttgcgaaactttacggattacgcaacgatgcttgtctttgactttcagaatgctgtgaaactttacggattacgcaacaatgcctgtgttgagggtcccgaagggagcaaacaaagttcgagaaccaatcgcaagtactcctggacaaaattagggtatgacagttttgagggaagaagcctagagcttcaagaacctctggatttaaggtcaaatccttttcaaggggaagggaatgatgcaatcctacccccagggcattggatagaagactttaagatgattgggtcagagatgcaagagaaggccctaaggttctcatga

SEQ ID NO: 84282 - DNA, 303 bp, Glycine max
  Peptide Sequence Number=SeqID_175967
atggacaaagatcaatggacgtataactatgtgatgtcacaagaagttcatatggattatgattatgataatgaagaagaatgtggtgtgaatgaaccacatgtcgattgttcaaatgcttttaatacgtctcagtgggttcgaacagttgtccatgaaaacagatttgttgtagtgattatgaggtctgacatagataccggaataaagaattcgttagaagagacactgggagtaggaaatgtgattgtcccttcaagcttcgtgagaaaccagtgcatggagggaaaggttggatggtga

SEQ ID NO: 84283 - DNA, 726 bp, Glycine max
  Peptide Sequence Number=SeqID_175968
atggttagaacacgaggtctacgtcgtgtgctaggcacaggtagagccagagaccttagtcaggatgtggctgaggatgttcctcgccgtcgtaggcccactgcctcagcacgtaggcaacgggttacccagatggctgaggatgtggctgaggatgttcctcagttggctgaggatgtccctgatgcctctgatggtagcccagagaggacaggagttgtcgatgctgctgagtcggatggagtggctagtgatgggatagctgctgatgatgaggggttccccggtgggccacgcgatccatctgttttgataggatttgttgatcatgtggcacacagcatatggcgtggacagttggtctcccatggtaggaaagtagataaattttggagaccggctgctgagatcaaaggtatgattgcggccaccggattggattcattgatcaggtgttctgtgatcaccactgatcctagactcatatccgcctttgttgagaggtggcttagggagacgagcagcttccacctcccagtaggggagatgacgatcactctagacgacgtttcgtcgctcctgcacatcccgattactggagcgctgcattcatttgggccgctggctaagaatgccattgtttatcaaaaattaatgccaacctcgagttcacgatcgtctgggacaaagtctctcctaagaatgccattgtttatcgaaaattaa

SEQ ID NO: 84284 - DNA, 276 bp, Glycine max
  Peptide Sequence Number=SeqID_175969
atggaggacgacgcgcgcggagaagaagacttagacgcggggagacactgctgcacgcgtggagctctagtcgcggaagaagaagaactcgaaggtgaagaagctttgggtcgcggaagaagaagaagaaatcgaaggaggaagaagaaggcttttggtcgcggaagaaagggcaattgtgtaacttcacataattgctgggtgcaccagccattttgttgggtgcacctagcaatagccttacaacttataaggagcattcatgtcaaagcctag

SEQ ID NO: 84285 - DNA, 1047 bp, Glycine max
  Peptide Sequence Number=SeqID_175970
gactttgacggccatgagcaaatattccaggcaacatttggtaacaaatggtatacatggtccttcaacaattggagaagttcttcctctgaacattccacatctgggtttgaatggagggaacattcaaataggacaaacaagtggaaaaatgaaagtgatactgagcatgaagatgatgactcatgttgtgaaggatcaagttctgataggactgttctgggtctgcctccaacaggtccattaaagattgaagatgttaaaaatgctatccggttatcggctttaaaatggcatcctgataagcatcagggcccttcccaggctacaaaagaaagatcacaagatgctcttgagaaagtgtttggggacaacgattggggcgtgggggggttcctggtagtgaatctcgaactcgtcgtcggcaacaacggaatcgtagtcggcattggcggcggcgagtctgatcttgatgtccctgaatttctcggtggccaagccgagggtgagcttgtggcagcggcgctgggtgatggggatccagcagtggcggcattggaggcggggggactgggccagggccaggaagacgaggcccaggaagatgaagaatatctggaagagcttgtggagctccttcttctggaggtcgatggcacgcttcttctccaagggcctggaaggctgtttctttcgactggtgctggtgctggatgctgctttcgtactctgccatggatggaatctaaggtcttcccttgtccttgtcccgacaacaacgttgccacatttcttcgcccagtggcatttctcactggtagtgatcttgttcctgggcctgctgctggagtgtttccttcaaggggtggtcatggcattggtggaagcatgcttgtagttcaacacttggaagcagggcctaatgacccccgttggtttggtggtattggtggagatcctgcttttcctggaggattgccgttccaagttcttgctctgaagcaatgtaacttcaatgaggtgtacatcacatcacttgtaccttga

SEQ ID NO: 84286 - DNA, 261 bp, Glycine max
  Peptide Sequence Number=SeqID_175971
atggccactgttcagcacctagtgatggacaacaagaagaagaggcccattatctgcaaaaccaagccagacctcaacaaaaatttcaaggaagctaccaaggctatagaggctagcaaccagctcgcttgggctaaagatcttacttcagccctaagcaagaaactcgccgagaatccatcagcattcaatagtgaagaaagcatgcagaggctgaggaagaagaaggagaaaaagaaaagtggagttgaggcgttgtag

SEQ ID NO: 84287 - DNA, 357 bp, Glycine max
  Peptide Sequence Number=SeqID_175972
atggcgctaagtgcgacgtcgagcgattatgaggttcctagaggtggaggagacatccccactcctttgcttaacgcgagattggcgctgagccaaagttcacttactcgtgctaagtgcgaaaatggcgctaagtgtgacgtcgaggttagaaagccctttttaaagcctggaataacagaattgaaggagagcttgaagagtgcaaacacaaaagagcagatcagagtaaaggagtcaagttttgagattttagggagatttgtgagttttttagcgattatgaggttcctagaggtggaggagacatccccactcctttgtaagaaaacaatttctcttaattcctcttcctaa

SEQ ID NO: 84288 - DNA, 570 bp, Glycine max
  Peptide Sequence Number=SeqID_175973
atggtcatctacaccgtttacatcaaagactcaatgtctattgacctagactactttagtctccaatttttcaaccagaggcaagcgagcccgttgacacgtagagacaaatatggtcatctacaccctttcgtcaaagactcgatgtctgtcgaccgagactactttagtctccatttcgtcaaccagaggcaagcgaactactactttagtctccatttcatcaaccagaggcaagcgagcccgtatacacgcaaagacatatatggtcatctgcacccattcgtcaaagactcgatgtccatcgaccgagactactttagtctcgatttcgtcaacaagaggcaaaggcaagcgagcccgtatacacggaaagacaaatactgtcatctgcagcccttcgtcaatgactcgatgtccatcgaccgagactactttagtctccattttgtcaacaagaggcaagcgagaccgttgacacgtagagacaaatatggtcatctgcaccctttcgtcgaagacttaatgtctgtcgacggagactactttagtctccatttcttcaactag

SEQ ID NO: 84289 - DNA, 618 bp, Glycine max
  Peptide Sequence Number=SeqID_175974
atggtcatcgaagactcaatgtctgtcgaccgagactactttggtctccattttgccaacgagaggcaagtgagcccgttgacacgcagagacaaatatggtaatctgcaccctttcgtcaaagactcgatgtctgtcgaccaagacaactttagtctccatttcgtcaaccagaggcaagtgatctcgttgacacgcagagacaaatatggtcatttgaaccctttcatcgaagactcaatgtctatcgatcgagattactttagtctcccttttgtcaaccaggggcaagcgagcccgttgacacgtaaagagcaatatggtcatcagcacccttttgtcaaagactcgatgtctatcgaccgaaactactttagtctcgatttcgtcaaccagaggcaggcgagcccgttgaaacatagagacaaatatggtcatctacaccctttcgtcgaagactcaatgtctatccaccgagactactttagtctcccctttgtcaaccagaggttggcgagcccgttgacacgcagagagcaatatgctcatctgcaccctttcgtcgaatactcaatgactatcgatcgagattactttagtcttcattttgaaaactag

SEQ ID NO: 84290 - DNA, 279 bp, Glycine max
  Peptide Sequence Number=SeqID_175975
atgaaaccaaaagggcacaaaggaagcttgggggttgtcgcaacctacccttcggcgggagggcgacgtgtgactcgcgggatgcgtgttccacgaaaggaatacgcgcggagtcgccaccaacgtttatttgaggaaaacgtcggaaaaactgggaaagacgtgatctacgaacttttaagtgaaaggttcgggagttgtatttacgcacggggaagggtgtttccctttgctcctacgtattcctcaatttgcgatgaggaaatcagacctacgtag

SEQ ID NO: 84291 - DNA, 663 bp, Glycine max
  Peptide Sequence Number=SeqID_175976
atggcatatcatgctagctctacggctaatcataatgcaatacaaaagcaggagattcaatgtgccaaagttggtaagctggtagaagaagtgatccaagctatgagcagaagagaagaaaatattgtagaggttgactctcaagaggagagccttgtgaatgagcatgatttagaagaagatgaggagaaagtgcaacagtggaaacagtgcttacaaacgcgtgctcaacaagaagataatttccaagttaacacatgttctcatcaactgactattaaagaagaaaggcatgaagaccatgagggttcactcattctgggacaaccctgtctttcatttgccagttgtgttttagacatgggtaaaggtaaattggaactgaatgtagaggatcaaaagatctcctttgacttaattgaagaaataaaacacccagttaacggtgaggattggtttgaagcagaaatatcggagcaggagatggaattaacagcctcagccatggtattacagacgcctggggagaaagaatttgaatatgtgacagaatgcctagtcaatgaagatggaggaagaatgttagcttgtattgaagagctgggggatctagacgatgaatctattggtcatgtgatgtttgaagaattggaaaacaattga

SEQ ID NO: 84292 - DNA, 57 bp, Glycine max
  Peptide Sequence Number=SeqID_175977
atgggtgtcaagtacctcgaagtgatcaagcgaaggtcgtatcccaacaaacagatg

SEQ ID NO: 84293 - DNA, 212 bp, Glycine max
  Peptide Sequence Number=SeqID_175978
gcgaagggaggctgttccaaatatccctaacccctgggctatgcatttcagctgttttgggtgaaaaaaattgtttccgtgaagaaaatccaagccaaggtgctttcgtaatgcttccgagacgtttctgtgagcaaatccgtgaaggttttccgtcgttcttcaccgttcttcattcgttcttcgttcattcttcgttcttcaatgggtaa

SEQ ID NO: 84294 - DNA, 393 bp, Glycine max
  Peptide Sequence Number=SeqID_175979
atgggaatatatgaaggtgtgatgatcacatttgctgcgccggacaagaattggaagtttgatatccacttctcaccgccacttcatgcacagacatgtggcaggcctgtccattctgccagagaatatgtgtttactgtggatgtcgacaatcggatgattgttagactttatccattggtactgccactcgatgttgtgggttatgttaatgcaggagatgactatgttactgtccttggtgttcgtgggcgtcgtcagttttggaagttgagtatgcataatgggcttaaatgttttgctgacccatggttccaattcttaacaaaaaacgatttgatggccggtgatgaagttgtcttttatttcaggccaaatcaacttctttgggag

SEQ ID NO: 84295 - DNA, 243 bp, Glycine max
  Peptide Sequence Number=SeqID_175980
atggaggaagacgtgcaggaggtccttggagccgatccaaagtattgcttgatggttataccagctcctgcagcacgcacacgaccagggtgttctagtcgcccaatgacaacattcacaatttcctttgctgcctcagacgcaatgtggccagttttctttggtgcaggccagcttccacttcacgtgttgtctgatgagagatggaggatcaatgacgatgtcagtgcattccgaaattga

SEQ ID NO: 84296 - DNA, 504 bp, Glycine max
  Peptide Sequence Number=SeqID_175981
atggccgaagatcttttgaagaaatcaagcaaaggtaggactttagaagaggttggtcatgagtattttgatgatttggtttcgagatcatttttccaacgttcaaacacaagtagaagtagttggccttatggcaaatgttttgtgatgcatgacctcatgcatgatctagccacatcactcggtggagatttttactttagatcagaagaacttgggaaagaaacaaagatcaagaccaagactcgtcatttgtcatttacgaaattcaattcttcagtcttggacaactttgatgttgttggtagagcaaaatttctgagaactttcttgtcgattatcaattttgaagctgctccattcaataacgaggaggcacaatgtatcatagtgtcgaagcttatgtacttgagagttttatcatttcatgacttccaaagtcaggattctttgcctgattcaatagatgtaacaacaacagtaccaacttccaacttgaaatag

SEQ ID NO: 84297 - DNA, 457 bp, Glycine max
  Peptide Sequence Number=SeqID_175982
acgagtagttatagttgttgctaaggatgttgaacatgtggatcatgctgctgacgaggttcatgaggagcctcatgagccagttatggatcatgaacatactgagttgaaattgacctcttatgagaggaaggttgagaaatttgaaagacttgcacatgagattaaaggcataatggttgctacagtactaagttatttgatttcatgttcgttggagacaggtgacagaggacttttatttacttttgcggagaggtggcacaaggaaactagtagttttcatctaccgatagtagaactgactattaccctggatgatgtggcatccttattacatctacccattacaggtgtcttccatacctttgatgctattgatatagaggaagttgtcgacttgttagttgagttacttgaggtcagtagacaagaagcaaaagatgagactgagtaa

SEQ ID NO: 84298 - DNA, 912 bp, Glycine max
  Peptide Sequence Number=SeqID_175983
atgtcgcgcatgctggtctggtggaagcccttggcgaggaagcactgcagggccgcctgcaggatcagggtccgccagcagggcagcgttcagccccgccccaagccggcctgcgcggcttcagaagaactcgtcgagcagacggtagaacgccagccgtcgttcgtcggccacaacgccatagcggcggaacagcggtgcgacccaccgggtgtcgccgaagttgtggaccaggctgcgcgcggccaacgccagatcctggtagcgatcggccacgcccagccggccacagtcaatgaaaccgctgaaacggccttcggctgccagcaggttcggcaggcaggcgtcgccatggctgaccaccagatcctcgtgatcgggccgggtggcgcgcagttcggcgaacacctgctgcgcgctctgccccaggcgttcgtcatcgaagtcatcggcgtcgaccaggcccgcctcgacccgtgcctgtgcggcctgcaggcgcgaggccagccgctggtcgaacggacagctcgccaccggcagggcatgcaggccccgcagcgcatcggccagcagctccaccaggtgctggggcgcgagcgccggcgacgaggccagatcgtggccaggcagcgcactcatcagcagccagcgccgacccgattcttcggcagtggccatcaccgtcggtgcgggcatgcccctgcacctgcagccagcgcaggcgcgtatctcgtcgcccagctcactgaaggcgtcgatcacttccgacttcaggaaggcatcggcctgccctggacgatgcacgcgggcaacgtccgcacgcgaaacacgcgatcgactgccgttcaatgcgcgcgtcggccagcgcttcctgccacgcccacggcagcggcagcggcaggccatcagtga

SEQ ID NO: 84299 - DNA, 237 bp, Glycine max
  Peptide Sequence Number=SeqID_175984
atggagagggagttgataacaatgatagtagacacattaccggtgtcctactatgagaagatggtgggttacacgtcttcaagctttgtcgatttagtgttggtcggcgaaagggtcgaagtgggtctgagaagaggcaaatttgattgtctcggtttgacaagtaaaaagcctggggaaaatggagagaatgagaaggaggaaggaacccatgttctggctgccattcctacatag

SEQ ID NO: 84300 - DNA, 246 bp, Glycine max
  Peptide Sequence Number=SeqID_175985
atgcaaatatgccctagatgtggggtatcacggtacaaagtcaaggatgacgacgagcgtagtagtgacggaaactcaaagaagggcccccagcgaaggtgttgtggtatcttccgatcattccacggtttaagcatttgtttgctaatggagatgacacaaaagatcttacatggcatgcaaatgggagaaactacgatggaatgcttcgtcatctggatgattcctcccaatggaagaacatag

SEQ ID NO: 84301 - DNA, 81 bp, Glycine max
  Peptide Sequence Number=SeqID_175986
atggcgggatggggcagtaccgccactggcggttgcaggacagggggagagaggatcccgccagctcgaaaggcgggatag

SEQ ID NO: 84302 - DNA, 93 bp, Glycine max
  Peptide Sequence Number=SeqID_175987
atgaagagatgcgtgatgcaatcaaggaacatgccagagtgtcatgtgtgcgtagaaaaagtatttctaaccatgaatgtaatcgatagataa

SEQ ID NO: 84303 - DNA, 237 bp, Glycine max
  Peptide Sequence Number=SeqID_175988
atggataagagcttgaaggtagaaggagatgagtggagggagagggagagaggggggcacggaatttatacctcaaatgagctatggttcaaccaactaatccaagatcaagtccaagattttccactatatgtgcttaggtgtcttgaggcatgtaaaacatggaggacatgcacaaagtgtgactatatgatgtggcaatggggtatagcaagcaaatgctcacctatcccttag

SEQ ID NO: 84304 - DNA, 129 bp, Glycine max
  Peptide Sequence Number=SeqID_175989
atgtggcaagaatatgaaggagatcagtggggtcctgatccaaggagaaagaggactgcaaagggttgtcccgttttaactcacattcctactgagatggacaaagacgaaaatgaacgggaaatataa

SEQ ID NO: 84305 - DNA, 231 bp, Glycine max
  Peptide Sequence Number=SeqID_175990
atggcctcctatggtgtggcgtctcctctctctcttccttctccattccgcggccattcatcttccaagaagcaaaggaatccattgatgaagaagatcctaggcctacaagctccaatggagcttacatcaggaggcctattaatagagttcccttatggaaatagaaagtttgatgaggccataactattcttgaagtttctaaaccttgtacaagaattaagctatga

SEQ ID NO: 84306 - DNA, 279 bp, Glycine max
  Peptide Sequence Number=SeqID_175991
atgaaatggaggggaaggggttttatacggaagagggacgtggctgggccaccactagtggacgtgcttgacaggctaccactagtggtcgcgcctggggccccaccactactggtagcgcctggcaggccaccactagtggtcgtgcctgacaggccaccacttccacccctgtcctatcgtcctgtgaagtcacgccacgtgtcgcgttctggtggaacgcacccctcagagggcacacattacgatgaacacacttcactcctcggaaaatattaa

SEQ ID NO: 84307 - DNA, 165 bp, Glycine max
  Peptide Sequence Number=SeqID_175992
atggctagacatgatacatgtcagggtttggtttggctcaaggataaaagggatgccccacattatttccatgacacaaaatgcaaaaatgatgatttggaaattttatgcaaaactggtcatgcatgcacctatgtggacactcaagacgatgttcctaaatga

SEQ ID NO: 84308 - DNA, 519 bp, Glycine max
  Peptide Sequence Number=SeqID_175993
ctggttcgccaccctgtacgtcaacctgttccgttcggtgccgctggtgatggtgctgctgtggttctatctggtggttccaagcttattacaacaggttctagggctttcgccgaaaaccgatattcgcctgatctcggctatggtagccttttccctcatctcgcgcggccaatcttccgccgcgctggcgctgggcatgacccactggcaatccatgcggctggtgatcctgccgcaggcgttccgcgccatggtgccgctgctgctgacccagggcatcgtgctgttccaggatacctcgctggtttacgtactgagcctggccgacttcttccgcaccgccctcgccgcctcggcgctggtaagctatttgaagaaaaggactgtttgatgatatccctgaaaaatgtttccaagtggtacggtcactttcaagtgttgaccgattgcaccaccgaagtgaaaaaaggcgaagtggtcgtcgtctgcgtcttcagttcggcaagtccaccctga

SEQ ID NO: 84309 - DNA, 375 bp, Glycine max
  Peptide Sequence Number=SeqID_175994
atggtagcaagtctgcgtacgacattaggatgggagcgaattctgcaagtttctttaccggaaaattccttctcggattggcgcttgtgctcgaattggagctgtcggcggggcgagggctttggccaagtaggagctgaagtcacgatgtgggcttctccttccttcttctttcccccacttgcccagaatctcctattgcttgtgccggcaggggggtgccacttgtgctgccaagtccctccaccgttaggcgtactccttaaaggactcatgctcccgcttgctcatattttgcagctaggttctattgggagccatgtcagtattgtattggtaccgcctaatgaaggtagtaatcaagtccttccatga

SEQ ID NO: 84310 - DNA, 597 bp, Glycine max
  Peptide Sequence Number=SeqID_175995
atggatgctcatccgtgtcaggatggcgtacaccagctggcacttaggcatggggaggtcggaattatgatcggtgggcaggatgttgctgagagcaatcatccatatctgggtcagtccgggcaaaatcctgccccggtatacatagcagctgggcgatggcctctcatcgaacccatcagaccggttcctcctctggccatactcgcattcctggccctcttccaacaccatcggatatcccaggagctggctgatagcgtcggcatcgaacgggatccactgacccctaacccaggatctcatgtcacgcacgccctcctctgttggccaagcattggcataaaattcaaggaccatttctggatcaaacttggccataggagtaaccagtggtgcccaccgccggcgccctatttcctcctgaaaatcagtatactcgtcgtccctgagctggacgcgccgctcccggagaaacgaccatcccttgatggcttcgaagcgctgctggtgtacaacgctcctaaagcggtgactgtcgtactccggggcggaactagttccttcggccgccttgtccttcctggacctctttga

SEQ ID NO: 84311 - DNA, 396 bp, Glycine max
  Peptide Sequence Number=SeqID_175996
atggttgagttttgtctaacaagaggaatctgcggacgatgcttgatcacgattaggctagactatcatgagaaatcagggtttagcatttcaggagacaccatagaacacataatattttatatgcatagatctcccacaggcgattcagttcctctagatttagaaattgaagctatattgagaaggaacagggccgagaagagaagaaaacttttgcaagacagaacagttgcatccattattgaggaagaaactcatttttctaattcattatcacctgattcaccatcatcaagggaatccgctactcaattgcctaaagccactaccatggcagacgagcagcaccagaggatcacccttgaggattattcaagcagctcactaccataa

SEQ ID NO: 84312 - DNA, 90 bp, Glycine max
  Peptide Sequence Number=SeqID_175997
atggtgacaacaacaaaggtagaattcttggagtgggccttaagcacagcctgcttagcgttagtcaactatgtgacaaaggctatctag

SEQ ID NO: 84313 - DNA, 414 bp, Glycine max
  Peptide Sequence Number=SeqID_175998
atgaggataatgatagtagacacgttgccagtattctactatgaaaagatggtgggctacacaccatcaagctttgcggatttggtcttcgccggcgaaatgatcgaaacgaatgagaaaactggggcaagtgaagagggtgagaatgagggagaagcccgcgctgtgactgccattcctatacagccaagcttcccaccaacccaacaatgtcattactcagccaataaaccttctccttacccaccgcccagttatccacaaaggcaatccctaaatcaaccacaaagtctgtctaccgcacttccaatgacgaacaccacctttagcacaaaccaaaaacaccaaccaagaaatgaattttgcagcaagaaagccttagaattcaccccaaattccggtgtcatatgctaa

SEQ ID NO: 84314 - DNA, 195 bp, Glycine max
  Peptide Sequence Number=SeqID_175999
atggaagttattggctctggctatcagggtatccagactggagaagtctcaatggtcataggaacccacagtttgatagcagacagtgtggaattctcagccttacgtattgctgtggtagatgagcagcatcgctttggtgtgattcaaagaggaaggcttaacagtaaggtggttcacatcttcaggatttaa

SEQ ID NO: 84315 - DNA, 1049 bp, Glycine max
  Peptide Sequence Number=SeqID_176000
agaagctaagcttagctattagccatgggcagagactagaggatgagcatgtgaaggtatcaactctgcaagtggaaagggaagcaagggagagggtgatagaatcatttcacgaggaagctgtgaaatggatagatagaatcgctctcactctaaatgggagtcaagagattccaaggttgttagctagagccaatgcaatggcggacgaagtgcaagagcagatgaaggccaacatggatgccatgaaggaccaaatgacctccaagatggaggccatgctgagtgtgagaaggatgatggaggacaatacggttactgttgccaccactagtgtcgctgccgaggcagatccgacccacccatctgacataaaccaaacaagttgtccagccccagacatggtaggtcagggaggagaagtgttgggcagtacgggcggtccccatatggtgcaaaataagaattcttacccgccgtatggcttgccacctaactatacaccacccaatgcggtgcatgtgcctagcgagaatgccaactactttgttcccgttgaaggccagcaaccccagttggggcatgcacccgttactcaacctatgggagaagcccgtgaagagcctcgggatcatgctctgggcgagtttgaaccataccctacatatgccactgagggaccagaatttagtggcatgcctcagcccaatgccacgaaagcccttcaacaccgcccattgcaacccctgtatttctcggtagggagactaccttcgaccatggaagaaagagagaagtttgatctcatagaggaaagactgagggccattgaggggatcggtgattatccatttgtcgacatggcaaggctatgcttagtgcttgacattgtcatccctcccaaggacttcgacaaatacaaagggaccacttgccccaagaaccatttaaagatgcaatatcaatacaacactgacatggctcttgatagaactcaattgcaaaacatgtgcaagaaggagcatgagtctttcaaggagtacgcctag

SEQ ID NO: 84316 - DNA, 228 bp, Glycine max
  Peptide Sequence Number=SeqID_176001
atgttgagcccacctaagccaaactcttcctccttggatagtcctctatcagggagactactattccgacaacaaaaaaatgaagaaaacatgagggtggaacttgaaaccaccaaagaaatccgtgaaatggcgaggattaaggaagaagctgtgaaactacgagcactaaggagatgcaatacaaaggttcaaccacgagcttttcaacccgccaacctcatatga

SEQ ID NO: 84317 - DNA, 384 bp, Glycine max
  Peptide Sequence Number=SeqID_176002
atggagatgggacttagtaaaagaaagggctcaccaaaggggcgtgtttgccttgggttttatcaagcctatggagttgcgtcaaggcttaccaaggacgagccttgggttttgtggacatgtaaggatcagcaagcacagagcttgagtttgacgagtcttgtgtgcaatcatgctcttgcatacgtgcctcttacaaagaggcatgaatcaattggactcaccaagggtggaccttggattttgcaagccctttggatgattgaccagggagttgccaacctgggttttgggcaccgtgctcttgcatacatgccactcgatgtaggtggcacgtgctggagacgtggtgatatgcttctacatatatgtcactcgttgtga

SEQ ID NO: 84318 - DNA, 549 bp, Glycine max
  Peptide Sequence Number=SeqID_176003
atgacacagtctgagaattcttttgattcttcccattccctaatacaaaagcattcaaaggatttttacaaggttgaaagaaatctcaaggaccgcaggtcgcttggggactggaggccactcgatccaacagttaacatccccaagtacaatcgagagagacgaacagaagaagacacagggagacaaccaaagaataaaggagacgagatacagacacaagttcacagagccacacagcaacgtcagacaaaaccgctatcttacgcggatgctgtgagaaagaaaaacatcactcatcaacgaagaaaggaccaaaagcaacattcccatggatacgaaaactacacttcctcagtatacttaaacataaagacaaaagaaatcaaatggctagaggacgcgtgggttggccgactcaacaacctagccatgttcaaaaggttggtggaggagttgcgatgggagctgggaatggacatagcccctaaatatttaggggatgatctagtcctcttacctggattgactgaagctgaagcggaatga

SEQ ID NO: 84319 - DNA, 1408 bp, Glycine max
  Peptide Sequence Number=SeqID_176004
atgacaactgttggtgcaaaaaagcgtacccggacctcaccatgtgatgcacacctttttgtagacagtgccttaccgcatacacaatttacaccattatcagaaagcactttgtctgcgaatcagacagaacaacattttacagagcaatttgaaactcgaccgaaaaatttcgtcaattcacgtaccatcaatgcttcttcgatacagaggaatctgttgtccaagtttggaaaagagaatttaactttgtcaaaccttaattcatcaccatctattgcaacacatacaactacaggttgtcgacctatgcaaattgggacgacttctcaacatataaattcaggaagatacacaatactcaattccaaactaatagagcacatctcagatgacactaatgacaaactcgatataacacagggagacattgttacagattattcatttgacgacccagcaactgaggatgttgttgataccgatgatgataggaatctagacgcaccatatcacaatgaaaataccagtttttacattcaatgtgcaggttacaaggatattggagatccaattttgcaatgcaagcaatgtaaagctaagatgtggtatgatgagaggattaacaaagataaacagacaagaaacctaatgtttacattatgttgtggtgatggaaaaatacaactgccaatactacatgatgctccgcagccattgcggcaactactctttgacaccagagactcacaagctaagaaatttcagcaaaacatacgtttatacaacctaatgtttgcattcacatctccaggtgtcaaagtagacacatcctataatactggaagaggtcctcctacattgcgcatacatggtcaatcgcatcacctcattggaagcctcctacctatgcctgataactcgccaaagtttgcacaactatatatttatgacattgaaaacgaagtcaacaataggctttcacaataccctataaaaaataatgttgatgaagacattataattggcatcaagaatatgctagatacccacaatcgatatgcacaaaaattcagaatgtcaagggacaaactacactcttctgcagtgtgcgacctgaaactaaagctcattagtggcagacaatcagatggcagattatataatttgccaaatgctactgaagtggctactttgattattggtgacgagcatatagtaaataacagagatatcatcatcgagaagcaaacaagcatgctccaaagaataaatgaacttcatcctgcatatttacctttgcaatatcctcttttgtacccacacggtgaagatggctacagaccaaacattcttcataaggataatccgcatagccaagttgcaaagaggaacaaagttaccatgt

SEQ ID NO: 84320 - DNA, 1866 bp, Glycine max
  Peptide Sequence Number=SeqID_176005
atgtctcacaaagaaaacctcatatgtgaactgcatacaaagaaaggtacttggaagatagcggtgcgaatcactgatatgtggcgtcttaacaagcagaatggtcgacaatccattgagatgggtacaaagattggcgcaactctatggcaagaattgttccttgaatttgagcccaagctgcgttgtggtggtgcatatgttattcagaacatcaaggttgttgatactcattctgactacaaagtgagtacaattaaatatttggtttatttcgtgaagacaacgtctgtcaaagaggtagacagacctgagattcctcccaatgttcatgccattactgcatttgctgatataattttaggcgttgcaaaacctgatactttggttgatgttgtgggtcttattgctgaagtgattgaacgcaaaacagttaatcctgcatacagagtgactgtcaagttgagaggcaacattcatgctgagatcatcatgaccgtgtgggaggaatatgctcttcagctggatgatgctattgagaaaaaccattttctgcaaaagccattggttgttatgtttacttttgctaggatcaaagaacccaaggataagtttttgcataatgctcaaatagtaagctttggtgaaataaagagtctgcgacaggactgttactatttgactgttggcaccgtcgatgaagtgatgattgatacaccagggagttatgacagttgtccatactgtactaccacttttggtcaattaaaaataggtgcagcctgccattcgtgccagaaccatgttactcacactattccaaggtataagttagttgtcaagatggaacagaatggggagaaggctaacttccatttttgggatgcagtatgtatcaaaatatttggtaaaactgcggatgaatgtcgtcaagagttgattgcgagtggtgatgagatcaagatgttccttgcgtgtgttgatcaattgttgagtaaaacctgggttgtcagattcaaataccgtatacagatgcaccaatcatttgtgttggattttagtgaacaggaacatcatatacaatcattgatatccacgctaggtctacaggatgaacaatgtataagcaacaggtcactggccattggtgctgcatcttcatcacaacaagattaccatcctacaccttcattgtcacagtcagctgaatatgatcctggaaatactgcctttgtaactcctgcaaaaagaatgtccgatcagcaaggaagtagtaagtttgacagtgaagaatacgcaacatatgaactatccaccaacaagcatataaaagttgaggaattagttgacccacctatgttattcgcatccagtatgacataccaatttaaggccatatttcatgttgacaggttcaagagggatataggaatatatgaatgtgtgatgattacatttgctgcgccgaacaagaattggaagtttgatatccacttctcaccgccactcgatgcacagacatgtggcaggcctccccattctgtcagaaattatgtttttactgtggatgtcgacaatctcatgattgctcgactttatccattggtactgccacccgatgttgtgagttatgttaatgcagcacacgagtatattactgtccttggtgttcgtgggcgtcgtcacttttggaagttgagtatccataatgggctccaatgtcttggtcagccatggttccaattcttaacacaaaatgatttgatggctggtgacgaagttgtcttctattacaagcccaatcaacgtgtttgggaggtcatttccagaaagcaaacaacgagggacgaggacgactccccttga

SEQ ID NO: 84321 - DNA, 189 bp, Glycine max
  Peptide Sequence Number=SeqID_176006
atggtggtggaggttttagagatgatacaagtcaacctcagtgaggtcaacagggaggtcgattgccacaagtcactcaagctagtcaggcgcatatcaggccttgcaagcaaggatcaacaagttgctattgatgtgggcaagttggacattttgctaggagttgtcctatgtcatcttttcaactag

SEQ ID NO: 84322 - DNA, 579 bp, Glycine max
  Peptide Sequence Number=SeqID_176007
atggagggacttccccaaggttaccgtcccaacgttggtgtctgtctcatcaactccgatgatcaggtcttcgacaaagatctgtcgctagttttggcggaacaatttcgtactaataagatgatttttgtggcttctaggttgaatgtcccaggagcatggcaaatgcctcaggggggaattgaagatggtgaagagcccaaatctgctgccgttagggaacttcgagaagaaactggaatagtgtctgctgagataattgctgaggttcagaaatggttgacatatgatttccctcctgctgtgaaggctaaagtcaatcgtctatggggaggtgaatggcatggacaggctcaaaagtggtttcttatgagattaacaaaagatgacagtgaggtcaacttagctaatggggaagcagaacgtgaatttgcagaatggaaatgggcagaccctgaagaagttattgagcaggcagtggactacaagagaccaacctatgaagaagttataagaaccttcaagccttactttcaagggagtggaatatctgccaaatgtaaatcaacaaagtggtga

SEQ ID NO: 84323 - DNA, 859 bp, Glycine max
  Peptide Sequence Number=SeqID_176008
gcggttaacaggcagctggcatccctcgtcaggtctgcgcagcgttaaccccgttgcggcctttcgccgtgttttttctcttatcaatgagtacgccacgatgctattcaactcagtagttttctcgtcgatacagacgccccctcagcaacggttgtttgcgtttaccgcctttttactgggtgtctccctcccgacctccaatcccctgatgaatatctcactggggttggttgtcatctgtattctctggcagcgcgatatccggccgttggttgccctggccggccatcctctggtctggttgccggccctcatgtttgccctgctggcgttgtcattgctgacgcatgctcacgcctacggccccaaaatggtcggcaaataccaaaaattgctgtatgtcctgccgctggcgctgttcttcctggcggacccgcggctgatgacgcattttgtccgcggctttctgtgggccaatgccgtgatattggccatcagcctcacgagcgggcttggtcatgtcacattgggcgggctgaatcccgacaaccctacggtgtttaagctgcagatcacccagaacgtgtttatggctctggcggcgctggtctggttgtcgcgtgcttttgtctgtagaggaaaacggcgctgggggtatgcggggctggtgttgctggcgacgcttaacgttctgctgatggtgcaggggcgtaccgggtatgtggcgttggccattggcatgggcgtctggttattgcttaccctccggcgcaagcagcaaatggccgtgctcgcctgcggcatactggctctcgcgatgctggtcatgacccccaaccgcgccatggagcgctga

SEQ ID NO: 84324 - DNA, 135 bp, Glycine max
  Peptide Sequence Number=SeqID_176009
atgccacttcaaggagaagacgagtcaagaacaagctcaccaccaaaggaagccatggataagagcttgaaggtaagagaagatgagtggagggagagggagagaaggagcacgaaattttatgcctcaaatgag

SEQ ID NO: 84325 - DNA, 462 bp, Glycine max
  Peptide Sequence Number=SeqID_176010
atggcggcgggcccgatacaagcagagaccaagtttggtcattttgcacccctgtgtcatctagaggcggcgggcccgatgatacgcggagataccttacggttattcgcacccttttgtcatccagaggcggcgggcccgatgacaagcagagaccaagtttggtcattctgcacccttgtatcatccagaggcggcgggcccgatgatacgcggagataccttacggttattcgcacccttttgtcatccagaggcggcgggcccgatgacaagcagagaccaaaggctgacatagtcttctgcaccttttgttcctccgggaacaacaagtcatttacatgcggaaatttcatggtcgcccgcgactctcgtcaaccgagaggagcgaaattagtgtcatacactgattttcggggacctttgcttgatgacatgcgaccattctttggtccttgtgag

SEQ ID NO: 84326 - DNA, 330 bp, Glycine max
  Peptide Sequence Number=SeqID_176011
atgtcacgaaaccttacggattacacaatcatcccttctttggcttccggaatgttacggaactttacggattgcgccttaacacgtcctttcaactcccgacatgtcgcggaacttcgcggattgcctaacgatgggtgtcaagtacctcgaagtggtcaagcaagggtctcaccccaacaaacagatgatccccggacgaaattagggcgcataatgaccataatttgtctctgcgtggcatcggacatgatcgtatctggatggcaaaaggtgcggaatgaccataatttgtctccgcatgtcattgggctcgctgcctttggatga

SEQ ID NO: 84327 - DNA, 153 bp, Glycine max
  Peptide Sequence Number=SeqID_176012
atggaggagatacatggagaaaatgatgaaaaacaaggaattaaagccttggatcttcttcatcaatggagtattttgcttcttgaagatcaatggcagtggaatagggaaggaggaaaggtgattggagacgccacttcaaggagaggatga

SEQ ID NO: 84328 - DNA, 105 bp, Glycine max
  Peptide Sequence Number=SeqID_176013
atgagtgagataggaaggtttggaggtttgggaatggaggaacgtcgcaaggaggaaggggctgcgcagggatttctggaaaatgaggaggcagcctactggtaa

SEQ ID NO: 84329 - DNA, 291 bp, Glycine max
  Peptide Sequence Number=SeqID_176014
atgctaaaggtacaaaacgaaaatttcaaggaaataagaacaaaggtccaaacaaacagacaaattgtcatgttggaagtgtgggaaacctggtcatttaaagagggattgccgggtgttcaaaggaaagaacaaggctggtccaagatgatgacgttgcttggtggtttgattcgggagcaaacaagccatgtgtgcaaagatcgtcgttggttcaaggaatttagaccaatcgatgatggctctatgttcgaagatgacaagcaagtttgcaaagttgacaatccttga

SEQ ID NO: 84330 - DNA, 222 bp, Glycine max
  Peptide Sequence Number=SeqID_176015
atgagatttcagatgttagcattcgttcctaaacgaccatttagaggaaacactgggcctaacagaatagaagaaaatcactcgaagtgtatcaatctcacacagttttcttctgagggcagggattatggtaagttgggattttggctcaaggttgtgcggatgagggcacacaaggcctacctatgtcaaatcaaaaagcaaacggagaagaatgcaatg

SEQ ID NO: 84331 - DNA, 569 bp, Glycine max
  Peptide Sequence Number=SeqID_176016
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgatccccatcctcaacgtcggccacgtggcagaagagatcgacgtcggcttcctgcaaggcctgccgcaccacgagccgatgccttatgtgaacgcttaccaacttaatgagaagacggtgtatttgctggccaacggctcgatgtttaacctgaccgccggctatggcgacagccttaacgccttcgatgtgacgctggcggtgatggcggccggcatcggccatatcgtcggcgccggtgcgcggcaaacgccggggctgtacctgttgccgcagtcggcctggcagccggcgct

SEQ ID NO: 84332 - DNA, 390 bp, Glycine max
  Peptide Sequence Number=SeqID_176017
atgggcgccaagtccctcgaagtggtcaaacgagggtcgtatcccaacaacggatggtccctgaaagaaattagggcgcaaaatgaccataatttgtctctgcgtgtcttcggacacgatcgagcctggatggcaaggcgcagaatgaccataatttgtctctgcgtgccacctgacacgatggcctctggatggcaaaaaggtgtggggaatggccataatttgtctccgcgtgtcttcggacacgatcaagcctgggtggcaaggcgcagaatgaccataatttgtctctgtgtgccaccggacacgatcgcctctggatggcgaaaaggtgtggggaatgaccataatttgtctccgcccagctctcgacttattgtccctgaatga

SEQ ID NO: 84333 - DNA, 192 bp, Glycine max
  Peptide Sequence Number=SeqID_176018
atggccggtgtcggtcgttatatggccccgactgatatctttcagccgacattgcgcaatttcctttacaaacgctggccgataatcctaaaaaatttacaacgtaggacggctaggtttttccgtgcgagctcaaccgagggtacgttccgaccgacactggcatgttgttcttctcatttaggaggataa

SEQ ID NO: 84334 - DNA, 435 bp, Glycine max
  Peptide Sequence Number=SeqID_176019
atggtttgtaatgaccaggctgaaaagaccggtagattgctggccggatcattaacctttgattgttgcatcatgtactatattatcgttagaattttgcttccccattcttctaatttggctcaagcctctgaggaggacttgattttgatgtgggctttccttatcagtcgtcagattgactgggctcacttgcgatcctttgctataggtgctggtgcagtcacttcatttggttaccgtaaggatcgtgatggtcaatggctgaagaaggatgcgctacctccacacgacgagcgtactccttctcctcctcctcaacaagatgattcctcagcccttatgaatgaagttctttcagagttacagggcctccgcacctatgtcgctttgaaggcatggatacctgcatcacccagcttgaagaggatgtga

SEQ ID NO: 84335 - DNA, 318 bp, Glycine max
  Peptide Sequence Number=SeqID_176020
ttgtaatgtcaactgcggaagacagcttcttccgtggagactcatgaaagacgtcttccgcgagactccacggaagaagctgtcttccgcagttgacattacaactgcggaagaatgcttcttctgtggaatctcacggaagatcaagcttatcgataccgtcgacccggaatatgaagaagattgtggtgtgaatgaagtacatgttgattgttcagatgcttttaatacttctcaggtctttgcaacccgagaagatgttttgaagtgggctcgaatggttgtccatgaaaatggttttgttgcagtaattataag

SEQ ID NO: 84336 - DNA, 159 bp, Glycine max
  Peptide Sequence Number=SeqID_176021
atggataagagcttgaagcaagaaaatgctcacctcctgatgcaatcctaccccccaaggacattggataaaagactccaagaagattgggctagagatgcaagagaaggccctaaggttctcatgagccttagggtttatttcgagcccatgggctaa

SEQ ID NO: 84337 - DNA, 465 bp, Glycine max
  Peptide Sequence Number=SeqID_176022
atgaccatgattacgaattcgagctcggtacccgttcagaaaacagtgaagtctttgggtgttggaaagattactgttggcataattactccttataagctgcagttgaaatgcctccagcgtgagtttgacgaagtcttaaattcagaagaaggcaaggatctatatatcaatacagtagatgccttccaaggtcaagaacgggatgtcattataatgtcttgtgtgcgtgcatccagtcatggtgttggctttgttgctgatatacgacgaatgaatgttgcccttacgcgtgcacgaagggccctttgggtcatgggaaatgcaaatgctctgctgcaatctgaagattgggctgcgttgattaacgatgcaaaatctcgaaattgctatatggacatggactctcttcctaaggactttcttgtatctaaggcaccttcttacacatcggggatcctctag

SEQ ID NO: 84338 - DNA, 222 bp, Glycine max
  Peptide Sequence Number=SeqID_176023
atgacgacgttagtctctgcatgctaccggactttgagtttgacggatagcgaaagagtgtgtgcgggttaccgtatagggcgtcttcgcatgccaacggactcttgggtcacagtaacaaaaggtggggtggtagacaaaagcgaggcttttgctcctacgtatcctcaatttgtgatgaggaactcagacctacgtagttcttgcttttgtgatgtatga

SEQ ID NO: 84339 - DNA, 649 bp, Glycine max
  Peptide Sequence Number=SeqID_176024
gttttctcataagggtggacccttgggtactagtaccctctccttcagaggactgcacgtcctcaccttcagaggactgcatgttctcaccttcatagggctacatgccctcacctttagaggactacatgccctcgccttcagagggtcatgtaccttcaccttcagaggactacacatcctcgccttcaaagggctgcacgccctcaccttcagaggactacctgtccttgccttcaaagggctacatgccctcatcttcaaaggactgcatgccctcaccttcagaggactgcatgttctcaccttcatagggctacatgccctcacctttagaggactacatgccctcgccttcagagggtcatgtaccttcaccttgagaggactacacgtcctcgccttcggagggttgcacgccctcgtcttcagaggactatatgtcctccccttgagaagactacacgtcctcaccttcggagggctacacgccctcgccttcagaggactacacgtccccctttttagaaggctacacgctctcgcctttagagggcgacacgtcctcgccttcggagggctgcgctctccctcgccttttgagggctatgcgtcctcactttcagtgggctccatatccacaccttaa

SEQ ID NO: 84340 - DNA, 243 bp, Glycine max
  Peptide Sequence Number=SeqID_176025
atgatgacaaaggtgatgacaaaaagctcaaagatcaatcaaagaacaactcaaaacaattctagagttcaagataagaatcaagaagaattcaagactcaagacgaaagtttagagtcaagaatcaagattcaaggttcaagatctcaagaatcaagatcaagattcaagactcaagattcaagaaacaagagaaggcttaatcacgataagtatgaaaagtttttctcaaaaattgagtag

SEQ ID NO: 84341 - DNA, 282 bp, Glycine max
  Peptide Sequence Number=SeqID_176026
atttgctcggggctgttcactttcacttggtcgcctggtggtatctttgaaacctctttgcttgcggaggcaggagtgcgtctgagagagcgcttcgtgaaagaatcgtgtggcgcggtgaaaggtttcccgttggggtgtcaaggcggtcgaagaaggccacaagtggaagcaaccgatgctttggtcattcagttgactccgccagtccgtgcttgctgtcatgctggcgcagggctttcggccttacctactattggatttgaaccaatgactctcgcc

SEQ ID NO: 84342 - DNA, 2196 bp, Glycine max
  Peptide Sequence Number=SeqID_176027
atggagatgtcattacagagaacatcctcggagaataattcgggaaggaaccgtgaggaacaggaaccttcgaacaaagaaaccaccatggaagctcctgcttccggtgacgacgaccaagatctcgaagaaggattcaaaaggaggcgccacacccgccacacacaccaccaaatttcggagatggaatctttcttcaagggttgccctcaccctgatgaaaagcaaaggaaagcgcttggtcgcgagctcggattggagcctttgcaaatcaagttttggttccaaaacaagcgcacccaagtgaagacgcaacaagaacgatatgaaaacaatcttctgagggttgaaaatgacaagcttcgagcagaaaaccgtaggtacaggaatgcactagctaatgctttatgccctagctgtggaggccctactgctcttggagagatgtcctttgacgagcagcagttgaggatcgagaatgcacgattaaaagaggagattgctagtatgtcaggacctgcggccaagcatgctggaaaatctggaagcaattcgtactgtaacatgccatctcaaaaccagatgccttcgcgctcgctagatctgggagttggtaacaacaacaagaacaacaactttgtagctgtagcacaagcacaacctgcagccatggttggggaaatatatggtggcaatgatcctcttagggaactcccccttttttcttgttttgataaaactttaattggggagattggtctggtggcaatagaggaaatcaaccggttgtctctgtctggagatcctttgtgggtccctggcaactacggcagtgaagttgtaaatgaagatgaatacctgagggttttccctaggggcataggtccaacactcttgggcgcaagaaccgaatcttctaggcaaacagccatagttatcatgcatcatatgaaactcgttgagatgcttatggatgtcaatcaatggtcaaacatgttttgcggcatcgtttcaagggcggtaacacacgaagtgctgtcaactggagaaactataagatacgatggtgcctgccaagtgatgtcagctgagtttcaggttccttcaccccttgttcctactcgtgacaactatttcatcaggttctgtaagaagcaccaaggacaatcgtgggcggtggttgatttttcaatggatcatctgcgacctggtgcaatcacaaaaattcgaagacgaccctctggttgcataattcaagaattgccaaatggttactcaaaggtcatatgggttgaacatgtagaggtggacgacagcgaggtgcataatctttacaaaaatttggttgattctacccttgcgtttggagctaaacgttgggttgcagcaattgataggacatgcgaacgtcttgctagtgcaatggccaccaacataccccaaggggcactttgtgtgataacaagtcacgagagtcggaaaagcatgatgaagctggctgaaagaatggtattgagcttttgtactggcgttggtgcttcaactgcaaatgcctggacaccactaccaagtggtcttgaagatgttagggtcatgaccagaaagagcgttgatgatccaggcagacctcctggtatagtgctcagtgctgcaacttctctctggctcccagttcctgcaaggagagtttttgagtttcttagatcagaaaacacaagaaatcagtgggacattctgtcaaccggggctcaagtgaacgaacttgcacatattgctaacgggagagaccatggaaattgtgtctctcttcttcgagtgaatactcagaatgtgggccagaacaatatgctgatacttcaagagagtttcattgatgctacaggctcatttgtgatttatgctcctattgatgtagctgccataaatgttgtgttgggaggtggtaatccagattatgtggccctgctcccttcgggctttgctgttcttcctgatgggcctggactgaacggagggcccgggcccatatgtgaggctggatccggaggaggctgtcttctcacagttgcgtttcagatactggtggattcagctccgacttcgaaaatctctgttggttccgtgacaactgttaacagtttgataaagagaacagttgaaaagatcagagatgcagtgtcgcttgatggcaactaa

SEQ ID NO: 84343 - DNA, 2814 bp, Glycine max
  Peptide Sequence Number=SeqID_176028
atgttctctcaaaacgtgattctccctcccgaaaaccctagacccacggcgttcgcttccaaacccatgagcaatgagatcgcgaagcctctgccgtcgattctcgttggccgcttcaaggctctactcaagcagcgcgacgacgaactccgagtcgccgccggcgaccccgtaccgccggcgtccaccgacgaaatcgtccagatttacgaactcctcttgtcggaactcacgtgcaatctgaaacctatcatcaccgatctcacaattattgccgaacagcagagggagcacgcaaaaggcatcgctgacgcaatttgcgctcggattctcgaggtgccagtagatcaaaagcttccttcactctatctgttggacagtattgtgaagaattttgggcaggaatacattagatacttctctttacgtcttcctgaagttttctgtgaggcgtacaggcagattcagcctactttgcattctgctatgcgccatctttttggtacttggtcaaaagtctttccaccttcagtcctgcgcaagattgaaactgagttgcaattttctcaagcagttaatactcaatcatcaaccctgaatcctgtcagggcttctgaatcatctcgaccaagccacgccatacatgttaatccaaaatacttgcggcagttggagcgctcaactgtggatagtgctagtaagacacatcaatttttatcaagcagtagcagccttggaatatcctcgtcgtccccttcaagaattggagttgataggcctttgtctgcatctatggatgaatatgcagtggacaattctgctgtcaggttaattgagagaaactcgcctcatcctgctgttgattatggagtagccaaagcattaggtagagatgtggatttgactgaatggcagcaaaagcagtatcctggtgatggtcgtaatcgatttccaacttctgttacatacagccttagtaatggacatcagcggcaaagtccaagagctttaattgatgcatacggcagtgacaaaagccaagaaacttcaagcagtaagcctttgttagttgaacgtctggatagaaatggtatagacaaagtgttgtcaacatcttggcagaatactgaagaggaggagtttgactgggaaaatatgagtccaaccttaacagaccatagtaggaataacagtttattgccttcaacttttggtttctctagggaaaggcctggtgttgcagctaatgcaactttgtcggagcaagatactaggaaggggtggtctagtggatctcagcttcctccagtagatgattcttctgccatagcagaagatgcatttgcctcttcgacttttcgtcgcacacccccgggtcaggtacctggatcccaaaatcaaatcaatcatagcctgggctcctctcaacctcatgatgcttggaagatttcacatcatccgtctaacatttttagtaatagggggcgagcaaggaatcttatgatccctcctatggacaacattcgcaatacagataataacccgtattgggttcgaccatcaatgtcgaggatggaagctcggccatcagttttgccagcaccttttgaaatgaggccttctgtaaatgtgaatgtaactagaccgcccatcataaatccaataaatccattgcaaaaacatgttaggagtcagttcaatgcaataaatactagtaatcctattgcaaaccatgtaaataaatcttcatttatgccaaaacagtcatttgacagtgttgagaacaaggatgcaagtatttcaaagatacatcagttgcctaatcagcttcctggagtaatttcttcaaaccagcaaaatcatgggcaggcaccacaactacagttttttccatctcaggatccatcaacctcacaattttgtcatgggagttcattgcagggacatggtgcttctataagtacagccatgtcaaatcccttaccagttataccattccctttaccatttcaaagtattgcaaataaccctttacatttacagggtggagcccatccatctttacctccaggtcgccctcctgctccatctcaaatgatacctcatccaaatgttggtgcatatatgtcaagccaacagccaactgttggatatactaatttaattagttctctaatgtcgcaaggtgtgatctcattggctaaccagctgcctgcacaggattctgttggaactgagtttaatccagatattctgaaggttcgtcatgagtctgcagtcaatgccttatatggtgatctccctagacaatgcacaacttgtgggctgagattcaaatgccaagaggaacacagtagtcatatggattggcatgtgactaagaatcggatgtctaaaacccgtaagcagaaaccctctcggaagtggtttgttagtgacaggatgtggctcagtggtgcagaggcattgggaacagaatcagctccaggttttttgccaacagaaaccatagaagaaaggaaagatgatgaagagttggcagtgcctgcagaagaagaccagaatacatgtgcattatgcggagagccttttgatgagttttacagtgatgaaatggaggaatggatgtatcgaggagcagtatacctcaatgcacctacgggaacaacagcaggcatggataggactcagttaggccccataattcatgctaaatgcagatcagaatctaatatggccacctctgaagatcttggaccagatgaaaagggtgccgatgaagagggttcccaaaggaaacgaatgcgaagttga

SEQ ID NO: 84344 - DNA, 420 bp, Glycine max
  Peptide Sequence Number=SeqID_176029
atgggtactgttccagttttgaaggagcgggagatggaaattgggtacccgacagatgttaagcatgtggctcacattggatgggatggcccctcaggaactggacccagttggatgaatgattttaaaacagcgcctgatttttcaacgtcactaggtaacttgggtgaactaaatgaccccaatggtatggctgtcaccgcatcatggtcctcccaagagtccacaggaagccaaccagcatcaaacatttacaaaggcatcccatctgctggggtttctcatgcttctaagaaatccaaaaagaaaaagaccaagtcaccttcctcttctgagtcgctatctgcttcatcaagacactcaagagcaacaaagtcaaaggctgcatatagtgacagagaagctactccaatctcttaa

SEQ ID NO: 84345 - DNA, 1383 bp, Glycine max
  Peptide Sequence Number=SeqID_176030
atggaagtaattcttgagattctgggagggaactcgttctttattgatgtcggtccctggttctttattgaagttggtcccttagacacagtcctcgatgtcaaagagaaggtgcaaaaccttcacaacatacccatttcctaccaaacctttctcttcaatggcgaaatcctccaagacgatctccaagtttcgacatctggaatcgatcgcggctcccgcattggcctcctagtcgccccacctgatgatgcaaaccttgcgccgccacaaccgacgctgacaccgccatggcacacacgtccgttcgggatgccggagtttccaccgtcgttgcatctcaatatactaccacacgtttacgatccgtttggatatggaatgccaaatataccggagttttcatcgttaacggagttgaggccgatgccacagatgccgcaacagcttccgtcatcatcaacggaggagatgccggtgccgtcaaatagcaatgagtttgaagaaccgctgcctgacttgacggaggcgtcaccgccgtcagagacggcggtgagagtgacgttgaacgtgaaagtgcctgagatccaagatcgcatccctatagaaatggagtttgaagacaccgttctgaaagtgaaagagaagatagttgcgcgcgaagaaatgcgaggtgtgccagtggagaggatcgcgttgcagtcgcattcagcgggtgtggaattgcttgaccatcaggttctgcaggattgttgttcggttttagagaataacgagatcgacgcattctctaaaacgtgttctgagaagcggatggtgaacgtgaaactgcctatgtcgcaaaatcgtatccgtatagaagtggaggtggacgacacctttcggaagctgaaagagaagattgttgcgcttgaagggatgcaaggtgtgccggtggaaaggatcctgttgtatccgtgttcaccgattcctcaaagcgtgttgaatcctattttctacgtgtacttgaaatcatctgttccggtggccggtggtggcagtagtagtgcgtcgtctgggaagatgacggtgtatctgaagccgaacggtctcccaaagtgttatccattacaggtgaatgccgtggataatgtgtcggcgttagggcaacagctggggctgttgctacagaatcacccgcttcgtcttcccccaaatgaggtttttttcatggtttacaagggtgagtggatgaatgaacaagagtcctttgagtggcacggtattagggactgtaccaagattgcaacttttgttggatgccccaagcaaagtaagccagtggagtatttgtctgttactaatcaaatcacttcatggcaaacaaccctacctatctgttag

SEQ ID NO: 84346 - DNA, 771 bp, Glycine max
  Peptide Sequence Number=SeqID_176031
atggatctgagtcttgtgatggagaatgataaaacactgtgtatggaagtggggttctttgactcttttcaagaaatcaaagaaaagatagagaagttcacgggcattcccacttacaggcaaacgctactcttcaacggccaagttcttcgaaacgaggccatcatcttcaacaccgacatcagtgaagcctctcgcgttcatttccttcttgatgcggatttcggcaaccaccatgacgagattacggacatgcacataccaagcggagaggagttagaagagttgatgcggtggaatccagacgggagcgtgacaccgatgacggtcacagagaacgcgttgccgccgcggaatccagagtttacaccgtctccgccaccaccgctgcatgaaacagaaattacaccgggaggatcttcaaatatgaagaatttggaagagtcgccggcaccgtcggacatgcagacgtcgcaggtgattccgaagccatacgattcgtcacggattgtgacgctgagcttgaaggcgcataaatactggaaagatcgtttccctatggaagcggacttggacgacaccgttctgaagctgaagaagttcattcttgcatcaatgaaagttcttgcaggctttgagatggaacatgtgacagtagataggatggtgctacactcgcattcaacgcgtgtggaactgcttgatcatcagcttattcgagattgtaatgtttcagagaatcatgagatcgacctctccgtcagggaatag

SEQ ID NO: 84347 - DNA, 1791 bp, Glycine max
  Peptide Sequence Number=SeqID_176032
atgggcgcgcacgaagttcatccgctgcatgtggaaaactggcccgatacctcgcactacgagtttctcgccgacactatgtggagcgattttgcctacggtcgcaatgccgtatacccggaagggcatcacggcaacgccgtactgtcgcgttatcccattgaacattatgagaatcgcgatgtttcggtcgatggtgcggaaaagcgcggcgtgctctactgccgcattgtgccgccgatgaccggaaaagcgattcatgtgatgtgcgtacatctgggcctgcgtgaggcgcaccgtcaggcgcagcttgcgatgctcgccgaatgggtgaatgagctaccggacggcgaaccggtattggtggcgggtgatttcaatgactggcggcaaaaagctaatcatccgttaaaagtgcaggccggactggatgagatttttacccgcgcccacggacgcccggcgcgcacgtttccggtgcaatttcctctactacgactggacaggatctacgtcaaaaatgccagcgccagcgcgccaaccgcgttgccgctgcggacatggcgacacctttctgatcatgcccctttaagcaataagatccagttgctggaaaacggcgagcaatattatcccgcggtgtttaaggcgattggcgaggcacaagaacgcatcattcttgaaacgtttatctggtttgaggatgacgtcggcaaacaactgcatgcggcactactggcagcagcgcaacgcggggttaaagcggaagtcttgctggatggctacggttcgccggatctcagcgatgagtttgtcaatgaactgacggcagctggcgtagtgttccgctactacgatccccgccctcgcctttttggtatgcgcaccaatgtgtttcgccggatgcatcgcaaaattgtggtgatcgacgcgcgtatagcctttattggcgggctgaattactccgccgagcatatgtccagctacggtccagaggctaaacaggattacgcggtacgccttgaagggccgattgtcgaagatattctccagtttgagctggaaaacctgcctggacagagcgcggcacgacgctggtggcgacgtcatcacaaagcggaagagaaccgccagccgggagaagcgcaggtattgctggtctggcgcgataacgaagaacatcgcgatgatattgaacgccattatttgaaaatgctcactcaggcgcggcgggaagtgattatcgccaacgcctacttcttccccggctatcgatttttacacgccttgcgtaaagcggcacggcgcggggtgcggatcaaactgatcattcagggcgaaccggatatgccgattgtcagagtcggtgcgcgcttgctgtataactatctggttaaaggcggcgttcaggtttttgagtaccgccgccgcccgctccacggcaaagtggcattgatggacgatcactgggcgacagtagggtccagtaatctcgatccgctcagtttgtcactgaatctcgaagcaaatgtcatcatccacgatcgtcattttaaccagacgctgcgcgataatctgaacggcattattgccgcagattgtcagcaggtggatgaaaccatgctgcccaaacgcacctggtggaacctgaccaaaagcgtgctggcgttccactttttacgccacttcccggcgctggttggctggcttccggcacacacgccacgtctggcgcaggttgatccgcccgcacaaccgacaatggaaaacgcaggatcgggtagaaactga

SEQ ID NO: 84348 - DNA, 774 bp, Glycine max
  Peptide Sequence Number=SeqID_176033
gccattcgacagggagactcggaagttgcggagtcttggtttaatcaagccgctgaatattggaaacaagctatagccctaacccctggtctctttgtatgtgttgtctggaaagaggaggactcaatgattattcgttcaccggaaccagaagtgaaaattttggtagatagagatcccataaaaacttctttcgaggaatgggcaaaaccaggtcatttctcaagaacaatagctaagggacctgatactactacttggatctggaacctacatgctgacgctcatgattttgatagccatactaatgatttagaggagatttcccgaaaagtttttagtgcccatttcggccaactctctatcatctttctttggctgagtggcatgtattttcatggtgctcgtttttccaattatgaggcatggttaagtgatcctactcacattaggcctagtgctcaggtggtttggccaatagtgggccaagaaatattgaatggtgatgtagggggagggttccgaggaatacaaataacctccggtttttttcagatttggagagcatctggaataactagtgaattacaactctattgtaccgcaattggtgcattggtctttgcagccttaatgctttttgctggttggtttcattatcacaaagctgctccaaaattggcttggttccaagatgtagaatctatgttgaatcaccatttgacagggctcctggggttgggatctctttcttgggcaggacatcaaatacat

SEQ ID NO: 84349 - DNA, 411 bp, Glycine max
  Peptide Sequence Number=SeqID_176034
atgaacgctatttgtagaaggtgtaatcaagagagaattagaaattttttgcaggatttagaagcagcagcaattccagaggaagaacctcaatcttttgaagcatcttctagttttcttattgcaggacattctcatttagatcatatcaaagaccacctcatggctgaagagccaagaagagtcaccctggaagattattcaagttctaatgtgccacaatttttcaccagcattgctcaaccagaagttcaagcacaaaccattacatatccaccatcattgattcagttaattcagaataatctgtttcatggtttaccaaatgaagacccatatgcacacttagccacctacatagaaatatgcaataccatcaagttggctggagtgcctgaagatgcaatctga

SEQ ID NO: 84350 - DNA, 192 bp, Glycine max
  Peptide Sequence Number=SeqID_176035
atggaaaaatccaacaagaagaatttcaaagaaaagaaagcatgcattacttggaaagataatgacttggattcttcaagtgattcagaaaatgaaatcataaatttgggtctcatagcgaaagactatgaaagcggagaagaaatgcattcaatgatttgcataaagaatctgtcaaacttgtcaaattag

SEQ ID NO: 84351 - DNA, 192 bp, Glycine max
  Peptide Sequence Number=SeqID_176036
atgactgcctctaccagctcagcctcagcctgcaaagccaggtttagggcagaggtcgcatggcccggagattggcctgaggcccaggcaggggaggcacccgcagaggctcccggcgaggcagatgaggcccgcatggacgaggagatgaccaatttgcttgatttcttaggagggagcggagccacatga

SEQ ID NO: 84352 - DNA, 207 bp, Glycine max
  Peptide Sequence Number=SeqID_176037
gctacatcctttgtggtacaagaagagggtacatctacttgggttgttgtaactgagaacaagagaaggtacatctcttgtggatcagttcaagtggagggtacatccacttggttgttcaaagagaacaagggagggtacatcccttgtggatctcaaggaccgcaggtcgcttggggactggatgtaggcacaggttgttgctga

SEQ ID NO: 84353 - DNA, 372 bp, Glycine max
  Peptide Sequence Number=SeqID_176038
atgactcagtttatgcagaatcccaaggaggaatgcaaagctatgatgacaaggagtaaaaggtttatggaggcaaaagatgaggatagtgtagtgtacaagaagaaagctgctgaaaagaaaggtactgatgaaaagaaagatgatgtgataggtgaaagcaatcatgaaaaagagaaacaaataatgaatgaagagaaaaatagaagtgaacaagttagagagaagaaaacagaaaaagctgtgaacgaaggtgtggaagtaccatatcctatggtaccttccaagaaggagaaggacctccatttggcgagatttttagatattttctggaaactggaaatgaccatgccctttggagaagctttatag

SEQ ID NO: 84354 - DNA, 384 bp, Glycine max
  Peptide Sequence Number=SeqID_176039
atgcaatcacaggaacttgcactacctccggagcctgaggttggtccctcagctgctcgtttcagcacaaaggagagttgtgttgatcctttatggaatgatccaaacacgggtgacttagacaaatgcaggttgcacatcgaagaaaatcctccccgcctagttgccctaggaagagtttatgagggatccacaaccgttcacaacatccctttgttgcatgatcaagtgaaggtaagtgttgaggaggttaaagatacagatgctcccattcctgtacccactgacgaggttaacttagtgggacaagcacttgacaccttccttacttggccgacacatctcgtgaagcgtttatcagaacaagtattttgctttcattaa

SEQ ID NO: 84355 - DNA, 438 bp, Glycine max
  Peptide Sequence Number=SeqID_176040
atggctgaatcaacgaaaaagagaaaaggctcttcctccaccaccgctgctgctggccatcgccgccacagaccatctgaagcacccacagcaccggttcctccttccgtgtcatccccacgatcatctactttattttcttcagatgatcaacgtctaagtcaaggtgttccttttgatagcactattgttgatgactggaagttcgattactcgagtcatgatgctcgttgtatggtctgtaatgaccaggctgatatgaccgacagattgcttgctgggtcattaacctttgactatcgcatcatgcactatatcattgttcgcattttgcaaccccgttcgtctaatcttgctcaagcctctgaggaggacttgattctcatgtgggtttttcttaccagtcatcagatcgaccgggcccacttggttaggtga

SEQ ID NO: 84356 - DNA, 597 bp, Glycine max
  Peptide Sequence Number=SeqID_176041
atggctccaaaaaagctttccgcgaaaagatctaggagggacgccgcggcggaagggaccagtgccacccccgagtttgatagccaccgtttcaggagcgccgagcaccagcagcgtttcgaggccatcaaaggatggtcgttccacagagagagacgcgcccagctcagggacaatgagtacacggattttcaggaagaaatagctcgccgacattggacatcgctggtcactcccatggctaagtttgatccagatatagtcctggagttttatgctaatgcttggcccacagaagagggagtgcgggacatgcgatcatgggtgaagggtcagtggattccctttgacgtagattccctcagccagttcctgggcgacccgctagtgttagaggaaggccaggagtgcgagtttagtcagaggaggaacagggcccaatgggttcgacgaagaggccattgctcagcttttatgcataccaggttaggatttcgctcggaccgctgcaggaaggcgggtgcggatcatgcgcaccagcatgagcaccttgacctagatgtggatgacattgctgctcggcaatatcttgcctag

SEQ ID NO: 84357 - DNA, 306 bp, Glycine max
  Peptide Sequence Number=SeqID_176042
atgctaaagttgctgtcaaagataaaggttaagaaaaaccatacttttccggtggtttacgaatgcgagttctatgacgtaaagggattggttctagttgaagcgctgaatcagcaaccagagaatgatcgggagagggccttggagggattgaaggctaaattagtggaacaatcggacgtctttgctgaagatgaacataacagacacaaccaaaggtgcggagagttaaataattgggtggcttaccaaataaccttaagaaaggggaattattgcttaagacttgagaaggcagccggttaa

SEQ ID NO: 84358 - DNA, 312 bp, Glycine max
  Peptide Sequence Number=SeqID_176043
cagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcgactctagaggatccccaaagaggaggaaggcagagacttctatggtgaaggatagccctactaggaatggttgcgtgacaaatctaccagaggaaaaaatgaatattgaccg

SEQ ID NO: 84359 - DNA, 411 bp, Glycine max
  Peptide Sequence Number=SeqID_176044
atggaggccatgaaagaacaaatggccacaatgatggaggccatgatgagcatgaagaagataatggagaacaatgtggctgcaatagccgctaccagcaccattgctgaggtggacctgacccccatatatggcctcaaccaaataaatcatccaaccccagatatggtctctcaacccatgggggagacacatgaaataccccaccacaatttagccaacgtcgagccttgcctcggatatgccactaaagggcaagtagttggtggtatacccctgcagaacactttggagggccctcagtatcacccacaaccacaccccttgccttccacagcgggtaaaaaccctcatgctatggcagaaatgggagaagttggatcatctagaggaaaggctcagggtcgttga

SEQ ID NO: 84360 - DNA, 1098 bp, Glycine max
  Peptide Sequence Number=SeqID_176045
atggggacaaatcaaaacagaaaaagattttatcaagtcaaggttaagagtctagatgtcaccagcctcaaggaattggcacaattgatgggacctctccaaagacaagccttccgcaaagtgtacggaaagattctagaattgaccgcagcggagatatttacggaaattgttgtatccctcgcccaatactatgaccaaccattgagatgcttcacctgtggtcggagattcggcaagagagttggatcgcatgaagcaaactcgaaacggcgtagtgggcctaccgcggaaatacttggaaggcaagggaagggatatggcaagtcaagagaaccgcaattgatgctttccttgtatatcaccatagcaaggaaagcccagtggtggctatcttggtggacttattcgatacatttgaccaaaggtgcgagaagaacagcgcacggatcgtctgctacttgcccgctctatgaaggaaaggagggagttctcttctcatgtggggactaccctaatgttccgttgatagggacgaggggttgtattaactataatcccgcacttgccataagacagctagggtaccccatgaggggagcgccaatggaagagaacctctcgcctttccttgtgagagatttcggcgcgcaaagtctcgaggttgtacaaagagtccacaaggcgtggagaagtccgttgaggaaagataaagaacttaggggcatccgtaatggcgtcatcggtggttctcatgaatggctaagagctcatacgcgagggttagattggctctccaagttgaaatttatcgatgagaagaacttcgaagctccaaaggaagatgaagaagtccaagctctaaaattagagctagggaaggcaagactcgccaaagaaaaattcaagacagccgctacaaacatccggaaagagtgcaccgagttacgagaggaaaatgcggccactgcaagagcccttgaacaagaaaccaaaagggcccgcaaggaggaacatggccaagataaattacgaggatctttgtggggcagcaacaatgagcttaagctccagagagaggaaagggacaagtcacgg

SEQ ID NO: 84361 - DNA, 1044 bp, Glycine max
  Peptide Sequence Number=SeqID_176046
atggagcgatcgggaggaaaatccatgagcgatcagccggtgcgggctcagccgcataatgaatttgaaaaagtgctctccggaagttcgacgcaggtcgccgctttcgatacgcacgacaagagcgcgctggaaaaattccagcactttctccattccagcccggcggcagtgccgcttatcgttctggtgctgtcgctgattattttcggcctgctcctcggcggcaagtttttctcggccttttcgctgaccctcatcctgcagcaggtcgcgatcgtcggcatcgtcggcgcggcacagtcgctggtcatcctgacggcgggcatcgacctttcggtcggcgcgatcatggttctgtcctcggtcgtcatggggcagttcactttccgttacggtctgccagcggagctctccattctctgtggtctcgccgttggcgcattttgcggcttcataaacggcgttctggtttcgcgcatgcgcctgccgccttttatcgtcacgcttggcatgtggcagatcgtgctcgcgaccaacttcctctattccgcaaatgagacgatccgggctcaggacattgcccagcaggcaccgatcctgcaatttttcggcgccaatcttcgtataggcaatgcggtcttcacctacggcgtcatcgccatggttctgcttgttgctctgctctggtatgtcctgaaccgcaccgcctggggccgccatctttatgccgtgggtgacgatccggatgccgcagagctcgccggtgtcaacgtcaaacgtatgctgaccactgtttacaccctgtcaggcctcatctgcgcctttgccggttgggctctcatcggccgcatcgggtcggtttcgccgactgctggccaattcgccaatatcgaatccatcacggcggtggttatcggcggtctgtcactgttcggtggacgcggctccatcatgggcatgatcttcggcgccctgatcgtcggcgtcttttcgctcggcctcagcttattgggacagacccgcaatggacctatttgttga

SEQ ID NO: 84362 - DNA, 363 bp, Glycine max
  Peptide Sequence Number=SeqID_176047
atgaacgtgagaaggcacagaagaaaagggtggtggatgatgaaactgccgacaaacatcagctggatgaagtcctatgaagatcctcctcattctcaaagaggggaacgagcaacaatttgtcgctgcaaaacccagggcgcgagcccgggcggaacggtcgtcggtgcagatcttggtggtaatctcaaatataggaatgagagctttgaaggccgaagaggggaaaggttccgtgtgaacggcacttgcttatggattagtcgatcctacgggacgggggaagcccgtctgatagcgctctgtgcgcgtactccgaaagggaatcgggttgaaattcctgaaccgggacgtggcgactga

SEQ ID NO: 84363 - DNA, 813 bp, Glycine max
  Peptide Sequence Number=SeqID_176048
atgtggtatgataaaagaatatcaaaagataaaaattgtgggagtccaaggttcagcttatgttgtggagatggcaaagttgaattgtcattattacaaaatccaccccaatatctccaacaacttttgtttgatgataatacaattgatagtaaaaattatcaacataacttacgagcatacaacatgatgtttgcctttacttgtgctggtattaagctagaaaaaacaattaatgattcgagaggacctactacaattagaatacaaggccaaccatgccacagaataggcagtctattaccaatgcttggaaaaaatccaaatttgcacaactatatatctttgacacagaaaatgaagtgcaaaggccatattgtctcaagtttaagtcacatgctagatgagcactattctcatgctaaaagttttagaatgaccagggatagattggcagatgatgaagttgataatatcaaattgcaactgatagctgctcgggggaaagatggtcgtgtatataatatgccaaatgttcctgaaattgctgcacttattgttggagattttcatccaggctcaaaaagagatattattgttgaaactcaaaatggagaattacaaagaatccatgaactgcaccctagttatctaccactacagtaccctatactttttccttatggagaagatggatatagagcttacatacttcaccgttctacttcatccagcaaaaaaagaaagcaaaaccgtctgacaatgagagagtggtttgcttatagacttcagtccaagtcaaataaagcatag

SEQ ID NO: 84364 - DNA, 216 bp, Glycine max
  Peptide Sequence Number=SeqID_176049
atggtcataactattcacttggaaattgaacaatggaagcgattgagcaattcaaatagtcataacttttcacttggaggtccgattcaggcgcatgatatatctggagacgcccaaaatttaacaacggaagctctcgagaaattcaaatggagtggatcgtttgatacaggctacggaggtttggatgacgccacttccggtgaaggaagataa

SEQ ID NO: 84365 - DNA, 183 bp, Glycine max
  Peptide Sequence Number=SeqID_176050
atggttgttgtgtgggatagtggagggttccgtacgacgaggagtagtgtgggtggtggtaagcagccatggaagctccgtacgttgagtgacggccatggaagacagccatggaagcttcgtacgctagctgaacttcgagggtcagcacctccaagaagaagaagagaagaagaaagctaa

SEQ ID NO: 84366 - DNA, 357 bp, Glycine max
  Peptide Sequence Number=SeqID_176051
atgaccatgattacgccaagctcgaaattaaccctcactaaagggaacaaaagctggtaccgggccccccctcgagggaagttgaaagataagcacagaagcaaacatagcaaagttgaaggccatatggatttccaagaattgtcaaatgatgactactttgcaaagaacaacgagtttgctacctggctaaaagaagagaagaatgtgtttttctcggatcttttggctgagtcagcacgcgagttgttttctgatttcatcaaagcctggaacaaaggaaagctcgattcacattactacgaaggcattgcaaccggacctcgcacatcccataactggaatatcaagaagtag

SEQ ID NO: 84367 - DNA, 675 bp, Glycine max
  Peptide Sequence Number=SeqID_176052
atggcttcttcctcagttggtagaagggctacatattcaacacaatctgtatcaacaaatgagccagttgtatctgtagattggctttatgataacctgaaggagccagatatcaaggtactagatgcttcgtggtacatgccggatgagcagaggaatccaattcaagaatatcagttaccacatatgctgccatcagaggaagcttttgctgctgctgtttctgctcttggcattgagaacaaagatgatttggttgtttatgatggaaaagggttatttagtgcagctcgtgtttggtggatgttccgagtatttgggcatgacagagtttgggtattagatggtggcctgccgagatggcgtgcatcaggttatgatgttgaatccagtgcttcaagtgatgctattcttaaggccagtgctgctagtgaggctatagagaaattgttagatagttcacagacattgttaccagcagatgagttgaagaagcgatttgaacaagaaggcatctctgtggaaagcccagctgtgacttcatgtggaacgggcgtaactgcttgcattcttgcattgggtcttcatcgtcttggaaagtctgatgttgcagtttatgatggatcttggactgaatggggagcacaatctgatacacttgttgacacttcatga

SEQ ID NO: 84368 - DNA, 959 bp, Glycine max
  Peptide Sequence Number=SeqID_176053
cccgtgccgcaggcctggctacgccaaacatcggtttactgacagatattatctgctgcccaggcggcgatttctgtagtttggctaatgccaaatcgatcccgattgctgaagcgatccagctgcaattcgacaacctggattacctgtacgaaattggtgacctggaattgaatatttccggttgcatgaacgcttgcggtcaccaccacgtcggccacattggcattttgggtgtggataaagatggttccgaatggtatcaggtcacggtcggcggtaaacaaggcaatgacgccagtataggcacagtgattggcccctcattctcggcagaagaaatgccgggcgtggtacagcgactgatcgaggtgtatgccaacatagtcgccgacgcctggacccgtgtaatacctccagccgctggcgaggagtctgtacgcaaacaagcgggtaaagtcgtgctattcaaactcactggcgagcaaacctatacggcagaccaaattgccaatacgcagatccctgccacaggtaaagttctggtgccactgaccatttggcaagcacgcaaagcagagctgcaacctcgcctggctgctggtgaactcggtattgtattggcgacgcatgaaacggcagaagccttgcaggctgagtttccagacctcaacgtattgccattgattgccgtatttgtagaacgctttgccgatggccgcatctttacattgggtaactggctgcgcacccgttttggttttaaaaacgaactgcgcgcgattggtgacgtgctgcgtgaccaactgtttttccataaacgtgcaggtttcaacagctttttgatccgtgctgaccgctccgcggaagatgcactggccagcctgaatgacttcagccagccttaccagggtggtgtggcagatgtgccagtctggcgcagggtgaaccgcgcatga

SEQ ID NO: 84369 - DNA, 303 bp, Glycine max
  Peptide Sequence Number=SeqID_176054
atggaaaaacgccagcaacgcggcctttttacggtcctggccttttgctggccttttgctcacatgttcttcctgcgttatcccctgattctgtggataaccgtattaccgcctttgagtgagctgataccgctcgccgcagccgaacgaccgagcgcagcgagaaacagctatgaccatgattacgaattcgagctcggtacccattttattgatcattgtgatatgctgatgtctgctagtataggtctgatgcatgagagccaaggagggaccacttatttaggggctcatgattcatag

SEQ ID NO: 84370 - DNA, 204 bp, Glycine max
  Peptide Sequence Number=SeqID_176055
atggccgaggagatagtgccaccacttgcggatggcagatgtgatcgcgtggagttcccggacgaaagtagaaaaccgttggagcctcgggcaaaggagttggctaaagaaagctatcgggtgagctcactgagaaagtacaatgcccattgcgaccccgaaagcattggtctccaagcaaaacatgatagtgaaattcgatga

SEQ ID NO: 84371 - DNA, 459 bp, Glycine max
  Peptide Sequence Number=SeqID_176056
atggaagacgcacccgtgagccctcgcgtcgccctcctcgcgttgccttcccgccgaagggtaggttaccgaacctgtggtagagctagagtaatgggtaaagtagaggaggccatgatgagcatgaagaagataatggaaaccaatgcggttgcagttgccgctaccagcgctgttgctaaggtgaacccgatgcccccatttgatctcaaccaaatgaatcatccaaccttagatatggtgggcaaagatttaggaagtacggatggccccatgatgtgcaaattcaaaatgagcgcgccttcccgccatatggcttgcctcccaactatacaccacccaatgtggcatacgctcccaattaggatgtcaataacttcactccgatactcattgaaagccaataacctcaatccaatcatgcacatgtgtctcaacccatgggggagacacatgtaa

SEQ ID NO: 84372 - DNA, 177 bp, Glycine max
  Peptide Sequence Number=SeqID_176057
atggccacattggctgccgtgttctggggcgctaatttcaacttggccagtcgtgtgctggctgaaatgacgcccctgcgtcatgttgttgctggtgtttgcccgccgctggatagtcccgctaaaacactggcgtgcctacctcacgctgggagtggtaggcgtatttggatttaa

SEQ ID NO: 84373 - DNA, 830 bp, Glycine max
  Peptide Sequence Number=SeqID_176058
atgtcgtcatcaggcattccgcttgccttgtatgccttgatggcaggtgcctttggcataggtaccacagagtttgtgattatgggattgttacctgaagtcagccgcgacctgcaggtcagtattcccatggccggattattgattagcggttatgcgctgggggttgccgtgggcgcacccatcatgtcactcgtgatggccagattttcccgtaaaagctccctgctctggctaatgggtatttttaccttaggtaacctgatctgcgcaatcgcccctgattacaccacattaatggtcgccagggtaatcacctcattcgcgcatggcactttctttgggataggcgccattgtagccactggcctcgtacctaaagacaaacgcgcgtttgcactggcattgatgtttaccggcctgacggtggctaatgtagtgggggttcctgccgggacctggctgggccagatgttgggctggcggtctaccttctgggcggtgaccatgattgggccgatagcgctggcagccttatattacctgctgcctaaagatcaccacaccgaaaaagtggatgtaacgtctgaaatcaacactttgctgcaaccgcaggtcattgccggattgttattgaccattattgtcgataccggtttattcgccatcctgacctatgtcgcccctatcctgacagatgtggcgcatttttctccagcggcagtctcgccggtgttcctgctatttggtgcaggcatggtgatcggcaatattctcggcgcaaaactcgcggatatccaccttgataaaacgctgatcggcgccttgac

SEQ ID NO: 84374 - DNA, 1308 bp, Glycine max
  Peptide Sequence Number=SeqID_176059
atgcatggcactgttggcgggtgcctggacggccgagatcgtgtggtcgctgagcgcggggccacgacgctttggagagttgcgcatcgatctggcgccggtgacggccaagacattgacggcgcgcctgcgcgacatgcagctgaaggggatgatcacccggcacgagcgcgatacctcgccgccttcgatcgaatacgcactcaccgccctgggggcgcaactgttgccggcgatccacgccatcgcacgcgttggcaatgcactgaagtttggagagccggaggtgggctgagttcctgtgcggaatggcaaggaaaaagccgctcgagagcggctttttccaaggtgcggcagcgttgctgttcagctcgacgcgctgcggatcgcctccggcagcggtgcgctcttgccggtctgcgtatccatccacaccaccaccacgttgccgtcggagtacagcttcgagtcgtcctgctggtcgacgatgcgatggccgatggtcacgctgctgttgcccaggcgctcgacgaacagctcgaccaggatgtcgttgggccacacgatcggcagccggtagttgacgttggtcgcggccaccaccggtgcgatgcggtcggtcatcgacacgccttcaacgcccagcatccagcgcacgcgcgcttcctccagataggaaatgtacttggcgttgttgacgtggcccatgctgtccatgtcacgccagcgcacgctgatcgggatgcgggccaggatcttgtgttcgctgctcatcaggcgtccttcttcttcttgctggcagtagcggtcttgctggacttgccggtgctcttggaagccaccgccttctttgccggcttctccggcttcaccttgcgcggcgggcgggcgtcgggcttgttggccacggcggcgggctgctccgggcgtgcgttggtggagggcagcatgcgcgccaggaactggccggtatacgactgcgggcaggccgccacgtcttccggcgtgccggtcaccaggatcgtgccaccgcggtggccgccttccgggccaagatcgacgatccagtcggcggtcttgatcacatcgaggttgtgctcgatcaccaccaccgtgttgccttcgtcgcgcagcttgtgcagcacgcccagcagcgcttcgatgtcgtggaagtgcaggccggtagtcggctcgtccaggatgtacagggtgcggccggtatcgcggcgcgacagttccttggacagcttcacgcgctgcgcttcaccgtcggacagcgtggtcgcgctctggcccagcttgatgtag

SEQ ID NO: 84375 - DNA, 357 bp, Glycine max
  Peptide Sequence Number=SeqID_176060
atgcatgctttgttagggttattcaacagtaaaaactggtctgattctaaagtccttgatagtacagggctaagttgtcgtactatcacgaggaatcgggtcctggttgagtttagtccaacaagaggaatctgtggacgatgcttgagcaagattaggctaaactattgtcgcaacctacccttcggcgggagggtgacgcggggctcacaggtgcgtcttccatgggaggaaaatgcacagagtcgccaccaacgtttattagaagaaaacatcggaaaaaccggaaaggtgtggtctacgaactttaagtgtgaaaggttcgagagttgtttttatgcacggggaaggtattag

SEQ ID NO: 84376 - DNA, 474 bp, Glycine max
  Peptide Sequence Number=SeqID_176061
atgtcattgcctagcgctgttcatgtgttctcccttatcaagtgcgaagcttctggtgactgggaagcacgttattctgttgttttccagatcggttccttcgccaaaagaaaaaaagaagaagtagagatgagagtcgtcatcgcgaaaagggcaggacggacgaaatcagtgtcctatctttgctttcctcttatctccgatgagaggcttgcgcgttccgtgaaattccgtaatgtggcggaagtcgaaaagagaagcttcctccagaaggctgttgcttctggaggaagcaacctggctcgcctgggcgagctgggcggcaagcatctcccctattttgctataaataggagaggaaccgaggcgcttccgaaacgtttccgtaacgtttccgtgaagaatttcgcaaaaggtttcaaccgttcttcgacgtacttcattcgttcttcattgtacttcgatcttcaacgg

SEQ ID NO: 84377 - DNA, 156 bp, Glycine max
  Peptide Sequence Number=SeqID_176062
atgaagaaagagtgttccgagtatgccgcatggcgtgtgaagaaagatacttggtgggtagattctggtgctactactcacataagtatgactatgcagggttgcatgtggagccgaccaccaagtgatgatgaaagattcatctttgtggggtga

SEQ ID NO: 84378 - DNA, 246 bp, Glycine max
  Peptide Sequence Number=SeqID_176063
atgcgtctccaggcaggcgcagggcaaaacaccacagcagcattgggatggctggtagcgggcgatagacacaccgccaccatctctagagttcacctcatctcatccataaaaaggttagagcgttgcctacgacacatggccgaccagcaggctaccaagtccaaagccaaaggtagcaagataccttggatatgcatgtatatagccaaaatacctcacaaaaatatacacatgtttaggtag

SEQ ID NO: 84379 - DNA, 657 bp, Glycine max
  Peptide Sequence Number=SeqID_176064
atggagagaagtatgatagatgctgccagtggtggagcccttggagacatgacccctgctgaagccagaaatttaattgagaagatggcttcaaactctcagcaatttagtgccagaagtgatgctattgtcattagaggagtgcatgaagtagtcacgaattcatcaggtgagactaagaagcttgaaggtaaactagatgtcttggttaacctgataacccaactggccatgaataaaaaatatgcacctgtcgccagactctatggtttatgctcctctgccgaccaccacacagacctttgcctttctgtgcaacaatctgaagcaattgaacagcctgaagcttatgatgcaaacatctacaacagacctcctcaacctcaacagcaaaatcagtcacaacagaacaactatgacctctccagcaacagaccatacgttcctccaccaatccagcagcaacaacagcaacagccccaaaaacagcaaacaattgaggcccctccgcaaccttcccttgaagaacttgtgaggcaaatgactatgcaaaacatgcagtttcaacaagagaccagagcctccattcagagcttgactaaatcagatgggacagttggctacacagttaaatcaacaacagtcctagaattctga

SEQ ID NO: 84380 - DNA, 335 bp, Glycine max
  Peptide Sequence Number=SeqID_176065
atggacaagacaacgtcaacaacaacctccgagagagaaacccacgacttcatgaacgtcgactcgttctcccaactccctttcatccgcccggctcctctcctcaaagagaagccagccattcgcctctttggcatcgaattcgccggcgaaaacaacaacaataacaacacctctgttgttgtcgcttcggccgatgactctgaatcggtcgaaacaacaaccaacaacaataacaacaacaacctcaactcattcgacctcgaccccaccaacaaggatgacaccgccaccgccaccaatagcacgaacggcgagagtagccgccgcttcga

SEQ ID NO: 84381 - DNA, 459 bp, Glycine max
  Peptide Sequence Number=SeqID_176066
atgacttttttattttctgatggcatccaattttttttttttgcaccgcaaaaatcaggtccagttcctgtacccactgatgaggtttccttagtggggcagacacttcacaccttcctttcttggctgacacatctggtcaagtctttatcacagcaggtagttgtgtctcctgcaaaaccacctccaaagcccgatgatccactttatctgatgacattgaccatcccagagcttttctcgaggccttatcaggttagatgggatgccaccgtgtttggggtctttaatctagatttccccctatacataaaacacgaagacctctccgaaatcgcacacggtggtcaatgtctcagcatatcagtgttacagttgtggattttgcatctcactgaaacatgtatgcgagcggggaattctgatatctatggattcctcgagccacagtccatttag

SEQ ID NO: 84382 - DNA, 192 bp, Glycine max
  Peptide Sequence Number=SeqID_176067
atggaagaaaaccctcccagcttcccttctgctctaagacacatgctcttaaaaggtcctccaacgactgaatggtccgttcagtttggccatcagtctgaggatgggtttctaggtagtcctaccacaaaatccatggaaatactgtcccacttccactggggtatctctaagggttgtaacttcccttaa

SEQ ID NO: 84383 - DNA, 519 bp, Glycine max
  Peptide Sequence Number=SeqID_176068
atgactcttcgagtcgaagccaatgacattccgagactcaggaaacacatattccttcctccatttcctcttcctcattgttctcaacagaagaacaacggatacattaaagccttctattctaacctagaaattcaagaaggcactttgatttctgaagtttatgggattaaaatggtcattgaccaatccctattctatgacttgacccaattatccagtgaaggtgtaccatttgaaggtacactgaatgatgattggaaattcgatttctctgtgcttgatgcctgcaggttagtttgcaccaaccaagtggatatgaccgaaaggcttcttgccggttcattggcttttgaaagccgcatccttcattatctcattgtgcctatcttgcttccaagatcttcaaaccttgcacaggtttctgaagaagatcttattgtcatgtgggcttttcatacaggccgacaaattgattgggcacacttagtcagatatcgcatgcataaggcattgtga

SEQ ID NO: 84384 - DNA, 222 bp, Glycine max
  Peptide Sequence Number=SeqID_176069
atgtattttcgtgaagaaaatccaagccgaggtgttgccataacgcttccgagacgtttctgtgagcaaatccgtgaagatttttcattgttcttcaccgttcttcgttcgttcttcagtcttcaaccggagaaaaagccttgtttttctcgaccacctcaagagatcgtaatggtccaacgccttaacgtttctctcctttcaaaaccaagagatcgttaa

SEQ ID NO: 84385 - DNA, 564 bp, Glycine max
  Peptide Sequence Number=SeqID_176070
gaacaggccataggcttcgctccagcctttggtcaccgtcacggttttggcggccagcttctgccacgcctggggcgctttgtccccgtaaactttttgcatccacagcagcaggcccagacccggcgtactggtgcgtgggtcttcataaattacacgccacttctggtcgctttccaccagctctttcaggctcttcggcgggtttttcagtttgtttttgtcatagacaaaagcaaagtagccgtagtcgaacggcacaaaggtgtcgtttttccagccgccaggcacgttaacggcttctgccgctacgccgcttttggcaaagaggttggtttgcgaggcggcctccagcaggttgttatcgagcccgagcaccacatccgctttgctgttttttccttccatgcgcagacggttgagcagggaaacgccgtcctccagcgccacgaacttcagttcgcagttgcagtccgcttcaaaggcttttttgacgaccgggcctgggccccagtcggcagagaaagagtcgtaggtgtagaccgtcagaacgggcttagctaa

SEQ ID NO: 84386 - DNA, 130 bp, Glycine max
  Peptide Sequence Number=SeqID_176071
aattgggaaggaggattggtgccatccattgaagaaatttgagtcaaagaaagcaagggggccaaccaccttaagagctattgggactaagaagcactccaaattgagtgaaacactaaagagagaatag

SEQ ID NO: 84387 - DNA, 1243 bp, Glycine max
  Peptide Sequence Number=SeqID_176072
tgtttgtgcgcaccaagctgaaagagtacgactaccaggaagtgaaaggtccgttcatgatggaccgcgtgctgtgggaaaaaaccgggcactgggataactacaaagaagcgatgttcaccacctcttcagagaaccgtgaatactgcatcaaaccgatgaactgtccgggtcacgtgcagatctttaaccagggtctgaaatcgtaccgcgacctgccgctgcgtatggcggagttcggtagctgtcaccgtaatgagccgtcaggtgcgctgcacggtctgatgcgcgtgcgcggctttacccaggatgacgcccacatcttctgtactgaagatcaggtgcgtgatgaagtgaacagctgcatccgcatggtctatgacatgtacagcaccttcggttttgaaaaaatcgtggtgaaactgtcgacgcgccctgagaagcgcattggcagcgatgagatgtgggatcgtgccgaagtggacctcgccgaagcactgaaagagaacaacattccgttcgaatatcagccgggtgaaggcgccttctacggcccgaaaattgagtttacgctgcacgattgtcttgaccgcgcctggcagtgcggcaccgttcagctagacttctccctgccgaaacgtctggacgccacctacgtgggcgaaaccaacgaccgtcagacgccagtgatgattcaccgtgcgattctgggttcgatggagcgcttcatcgggattctgaccgaagagttcgccggtttcttcccgagctggctggcgccggtacaggcagtggtgatgaatatcaccgacggccaggcagaatatgtcagtgaattgacgaagaaattgcagaatgctggcattcgtgtcaaagcagacttgagaaacgagaagataggctttaaaatccgcgagcacacattacgtcgcgtcccttacatgctggtctgcggtgagaaagaggtggaagcaggcaaagttgccgtgcgcacccgccgtggtaaagacctcgggagcatggacgttattaaaggcggaaaacgagtacaaccgacgcgtccgaaccgtatcaacggcgaaatccgtgccaccgaagtgcgcttaactggcgtagacggcgagcaacttggcattgtctcactgcgcgaagcgattgagaaagcagaagaagctggcgtagatttagttgaaattagcccgaacgccgaaccgccggtttgccgcattatggattacggcaa

SEQ ID NO: 84388 - DNA, 602 bp, Glycine max
  Peptide Sequence Number=SeqID_176073
gatacgtaggagcaaaagcatcgcttttgtcgaccaccccaccttttgttaccgtgacccaagagtctggtggcatgcggagacactcgacggtaacccgcacacaccctttgtcatccaaagacggcgagttcgatgacatgcggagataccttatggttatccgcaccttttgtcaatcagaggcaagtgagcccgttgacacagacagcgagtccgatgacatgcggagataccttatggttatccgcaccttttctcagccagaggcaagcgagcccgttgacacacagagactaacatcgtcatctgcacctttgtcatccagagacggcgagtccgatgacatgcggagataccttatggttatccgcaccttttctcagccagaggcaagtgagcccgttgacatgcagagactaacatcgtcatctgcacctttgtcatccagagacgacgagtctgatgacatgcggagataccttatggttatccgcaccttttctcagctagaggcaagcgagcctgttgacacgcatagactaacatcgtcatctgcacctttgtcatccagagacggcaagtccgatgatatgcggtga

SEQ ID NO: 84389 - DNA, 741 bp, Glycine max
  Peptide Sequence Number=SeqID_176074
gacgaggacaagtctaaggataagaacaagacccgaggaaagtttaacgacggtctttccaaggaagaacgccagaagcgttacgacagtaaggcatgcctccgctgcggcgaagtaggacacttccgcagggactgcccgaagaacgaagtcaagcaaggagcggtcaagatcgggatgctacggatagcaacaccctacccgaccgaggagccagacgaaaccctcagcgatttagacttatacgacgaggcaagacaggccgattatgaggccttcctcagcaagacatacgaagaagtcatggaggaggaattcgaaatggtgaaagaggcactcggactcaaagacttcaagtgggacgaaccactaccaacggattggcaggttgaaggggcagaagtattacgccgcctaagagaccaacagtgctggatttgtggaaataccaggcaccaagccaacgattgcgatatcgaaggacgaatcacaatcacgggaccccgagcagaggagatcgcctgcagggctgcccaggaacaacccagattcaaggaatctgatgacgaggagacgcctcggacgttcgaggaacgaatggagcaacacgagcgcctacgttgggttgactgcccaagacagtgcgattaccacttgaggaagcgagaggaaaccaggaacaacgaggacgattgctgccacatcaacttatggcataacgagatcaagcttatcgatacc

SEQ ID NO: 84390 - DNA, 503 bp, Glycine max
  Peptide Sequence Number=SeqID_176075
ggatcgcgcccacaagacacccagtggacccgaagaagtccaacagggccctggggtttccagctctggttacaggcctctgtcagtcctacagggtgcccgttcccccagcaaggtcatgccatcatgacataggaatcgcacccacaaagacacccagtggacccggagaagtccaacagggccatgggggatcgtgcccgcaagacacccaatggacccgaagaagtccaacaaggtcttggagttgccaagctctaattacgggtctctgtcagttctacggagtgcctgtcacctccagcaatggcatcaggacccctactaatcgagctttcatcaagaagtattgcgtccccaggcaggcacggggcaaaataccacagcagcctggggatggccggcagcgggcaacagacgcaccgccatcacctctagagttcacctctgctcatccacaaaaatgtttgagtattgcttacaccacatggccgagccaatag

SEQ ID NO: 84391 - DNA, 1890 bp, Glycine max
  Peptide Sequence Number=SeqID_176076
atgtcacagagaaacatggtttcttggacatccattattactgggtttgctcataattcgaggtttcaagaggctttgagttcattttgtcaaatgaggattgaaggagaaatagccacacaatttgcactttcaagtgtgcttcaagcttgtacctcacttggggcaattcagtttggtacgcaggtgcattgccttgttgtcaaatgtgggtttggctgtgaactgtttgtgggtagtaatttgactgatatgtattcaaagtgcggggagttgtctgatgcatgtaaagcttttgaggaaatgccttgtaaggatgcagtgttgtggacgtcaatgattgatggctttgtgaaaaatggagattttaagaaagctttaacggcttatatgaaaatggtcactgatgatgtttttattgatcagcatgtgctttgtagtactttgagtgcttgcagtgcacttaaagcttctagttttgggaagtcccttcatgcaaccattttgaagcttggattcgaatatgagactttcataggaaatgccttgacagatatgtattcaaagtctggagatatggtaagtgcttcaaatgtcttccaaatccattctgattgtataagtatagtgtctttgactgctattattgatggttatgttgagatggatcaaattgagaaggctttaagcacttttgttgacttgcggaggaggggaattgaacctaatgaatttacattcactagcttgatcaaggcttgtgctaaccaagcaaagctagaacatgggagccagctccatggtcaagttgtcaaattcaactttaaaagagacccttttgtttcttcaacactagttgatatgtatggaaagtgtgggttgtttgaccactcaatccaattgtttgatgagattgaaaatcctgatgaaatagcatggaatacactagtgggagttttttctcagcatggtttaggaagaaatgccattgaaacttttaatgggatgatccacaggggactgaaaccaaatgcagtaacatttgttaaccttttaaaaggatgtagtcatgcaggaatggttgaggacgggttaaactactttagttccatggagaagatttatggggtagtccctaaagaagagcattacagttgtgttattgatttgctaggtagagctggaaagcttaaagaagcagaagactttataaacaacatgccttttgaaccaaatgtttttggctggtgttctttccttggtgcttgtaaaattcatggggacatggaaagggccaaatttgcagcagacaaattgatgaagcttgaacctgaaaatagtggggctcatgttttgctttcaaatatttacgcaaaagaaaaacaatgggaagatgtacaaagtttgagaaagatgataaaagatggcaacatgaataagttgccaggttatagttgggttgatattagaaataaaacccatgtgtttggggttgaagactggtctcatcctcaaaagaaagaaatttatgaaaagcttgataatcttcttgatcagataaagcgaatcggttatgttcctcaaacagaatcagttctgattgacatggatgacaatttgaaggagaagcttcttcattatcacagcgagaggattgccgtggcattttcattactaacctgcccaactgagagaaacatcatagtcagagatatcagcaggtttcatcatttctccaatggttcgtgttcctgtggagattactggctctcaacagataaagaccccagaaaagagtgtggcaaggacgttggattggcttcagtttcaaaggttactgaagtgttgatgtttcagccacacggtaccaaagaaaagtgcaagggttga

SEQ ID NO: 84392 - DNA, 2154 bp, Glycine max
  Peptide Sequence Number=SeqID_176077
atggacaagtattgtctggtgccgagagtggtaacctcgatcgatgtggcagttgcaagtctgtcaagcttgacaagcccccgagcctggacaagtgttgtccgggctgcttatgttaggttgtctgaggtagacatgtttttggtttcacaggcaaggtctgatgtgtcaggtattccttctctgatcatgtcttcatttctgtctgactctgccatcgacatgggtggtaacgattctagggattcaattcaacaacccctgatggaccaggaggttattttcattggcagttcctcgaaggaggatactcgttccaatgcctccgacaacgaatcctcttccttggagaggttaagggtttcgtgtcatactggtggaggcacctctcgtctccacaggaagacgtggccttccgctacctccccagccagggagcttatcccggtcattgtgattctctccccttcgttttctaagggagcaaggacaagtggtagggacattagggcgtctccccacgtgcgacgtagccatagtgttgggtcgccatcatcctcacctattgttactggatatgattgcgtgagggatgatattttgaagtataagtcctctctcacctttgcggtgagtgtcgctgctatgcaatgccaggtgaagctggaaaatcttgaggactcctgcaaggtagtcgtccagccttgcaggagtaatgacttctctttcttgagggcagcatcgggcaattcacccttcttcttcatatacaggtgtctatttgaggtcttggatctcattctccccttgaccgcatcccaatgtgctctgcttaagcatttaaacgtgttgactggcaagattggttgggtttccttgaacagtgtatccaagaagctatttgaatttgattcaaacatctttcatcacttcaagtaccatttctttaagtctgttcccatcaagtttaagtcatttgacaaggatctgttgactcttatggagagggtcgacaaagatattttggagcaactgtcggcctcattgaatgcacgggccattttgtctcttccctcggaaagtgatcctcttgttgccttgaaccgaattatggatgtcttcccttggaggccacttgtgaagcaggttgtccctattgttggtgctactgaggtcaccctcggtgctccttcctctattttggctaagaggaagcgagatggtgccactagggtgtcgggttttggtgtgccaactgaagtttttgcccttgtcgttgttgcaatccttgttcctgctaaagtcgttgttgttactcttgctcttcctcctcctcccgccgtgcatctgctgaatttgggggtgactgcttcggctcgttctgttgtagcgctttcgtctaccattgttgcatccctgttgagtgctagagtggcaaccatgggtgctcctgtgatggcacctcctccttctttagcttcaccggttcctccctcggttgtgttgacttcgacgtcctcttcctcctcttcttgtccccatgtgccattacataacatctacacctcgaacgatgttgattccctatgtggtatagggtataagcctaaacagaagactctgtttggcgatcttggaaaagaatggacaacagcaccaagaggctctaagcaaggtggcttccttggaggcataggtcgccaaatgaaggcttattgctcgcacagtttagagagtggagcgcccaaaggtagcgagttggacggtgatgaattgttcaaacgttgcaagggcttgcaagaagagaaaaaggacctcgctagcaaggtggagggcattacgatggagagggacaagctttccaaactgattgttgataaaaaagtagatgacattctcaagtttgagttcaaccttattaaaggtcttgccactcatgtggtggtcttgccgatcattatggtggtagttcctcttgtagaacctagacctttgactgtggtcgtcgtgcggccccatggtggacgccaaatgtacttattaaaatccggagctgggacatgtcagggtagacaggtcaaaggtggactccaagactttgcacttcggctagagagcggcccttgttataaggacaagaaggaagacttgtaa

SEQ ID NO: 84393 - DNA, 614 bp, Glycine max
  Peptide Sequence Number=SeqID_176078
atggctgcaaaggctcaatgtccatatgcccttcatgctaggggcaaagagattctcattgaagatgatgaatatacaccctcaacccactatgtaaagacaaggctaagtagactcttcaagcatgaagtagctgctttacaacagaagagggatctaacaagtaaggattggctagctctgaaaagatattacaaattgggagctcactgctctagtctggaatctaaagagaagccaccattagatggagttcatcacaagaccgaacattgttatcagacaaccaatcacaatctctttgaggccttggatcttcttcatcaatggagtcctttgcttcttgaacatcaatggcagcagaatggggaaggaggaaaggtacttcacactccaccttcaccttcattcatcaagttaagcccatcattgaagaaagtgaattctgataatgagatccttgtttttactgaagatacgaccatagaagtttatgatggccctcctccatcttgggagtatgtgcatttacatgaagaagcattgcttaagactcgagggtcgcttgctgaagcttttcaagacaaaactcatgttgaaagaaaagctaaaag

SEQ ID NO: 84394 - DNA, 354 bp, Glycine max
  Peptide Sequence Number=SeqID_176079
atgacgaacgcgtgggatgctaataccttaccctcattttcaaaatacgcagaccctcgaccttttccattttggtttttccaacgttttcctcgaataaacattggtggcgactccacgcgttttgcttcaatggaagatgcacccttagcccgtccaagaggctctttttgcacccccaccgaagggcaggttgcgacaaagggtgtggagctaaagccaatattgctcagtttgattggttcacacccttttgctgaaatggatcatgacaatccatacacacatttgtctaccttcatagagctatgcagtaccatgggagcttccgacgaagacgttaaagctgtctag

SEQ ID NO: 84395 - DNA, 222 bp, Glycine max
  Peptide Sequence Number=SeqID_176080
atgacgatagttgattcatgtacatggagatcccttgtatcaaaagtcttcttggcaggaaagtccatacatggagtccaggcagtgggtctcgtaggcgttgtagaggtgcaagatattagagcatattggtggcaatggctaagcgaggtggggaaaccatggggtgggaataggccaggccggcctacagaggcctacgacctggctaccaatatataa

SEQ ID NO: 84396 - DNA, 255 bp, Glycine max
  Peptide Sequence Number=SeqID_176081
atggatactagacatggcaagaaaattcgtacccgtgggtacccgtttgaatccgtcataactttgacggataatatccgagttgaccggcttttcgtcattactgtaagcgaaacatcacgtggcaggaacaacatggcatttcgccagtggggttggcaaaacaggcatgacatttcgtcattggagttgacgaaacaggcacccatcacatcacgacaacagtgggttttgctggtggtattagcgaaatag

SEQ ID NO: 84397 - DNA, 300 bp, Glycine max
  Peptide Sequence Number=SeqID_176082
atgcctttcttcgttcatgttcgatattctggtgtcctaggcgtagaggaaccacaccaatccatcccgaacttggtggttaaactctactgcggtgacgatactgtaggggagatatccagtggagatgacggggtggggcctgtagctcagaggattagagcacgtggctacgaaccacggtgtcgggggttcgaatccctcctcgcccacaaccggccaaaaaagggaaggatttttccctctgggggtaggaaaatcatgatcgggctagcggacccaaagctatggaacttgtga

SEQ ID NO: 84398 - DNA, 246 bp, Glycine max
  Peptide Sequence Number=SeqID_176083
atgccccgggttattacagccatttggttggcgataagggatggcaaaaggtcttcgtacgtcattgggagtggggtgaattctggaattggcttcgggggaaagttccttattgcgttggaattgccggccgggcgagtcgtggttggagccggaacttggggggcctccctctggatggttgccttaggctacacggatgctgaattggaggagttcccgacacaagctgaaaagctcggatga

SEQ ID NO: 84399 - DNA, 252 bp, Glycine max
  Peptide Sequence Number=SeqID_176084
atgagtgaaacagtaaaaatttgtatggtgtacttcaaatgtatgaaatggccccgaggaaacttgcctcaaagagatccaggaaggataaagcggccgaaggaactagttccgctcccgagtatgatagtcaccgctttaggagcgttgaacaccagcagcgcttcgaggccatcaagggatggtcatttctccgggagcgacgcgtctagctcagggacgatgagtataccgatttccaggaggagatag

SEQ ID NO: 84400 - DNA, 252 bp, Glycine max
  Peptide Sequence Number=SeqID_176085
atggcagagccatcgaagaagagaaagggatcatccttcaccgctgctgctgctgcccatcgccgccacggcccatctggagcacccacagcacctattcatccttctttgacatctccaagatcatcaacattgttttcatccgatgatcagggtctacggtacctttctcagttttcttctagaataatcttagaccctaagtacctagacatagaattctttaatgatgaaacatttgattgctatcaa

SEQ ID NO: 84401 - DNA, 345 bp, Glycine max
  Peptide Sequence Number=SeqID_176086
atgggggataagcttcatcgtcgagagggaaacagcccggatcaccagctaaggcccctaaatgaccgctcagtgataaaggaggtaggggtgcagagacaaccaggagggaaggacccgcgcgagcagtgctggacgaagcggaagcgagaatgtcggcttgccctaacgcaaacgttggtgagaatccaatgcctcgaaaacccaagggttcctccgcaaggttcgtccacggagggtgagtcagggcctaagatcaggccgaagggcgtagtcgatggacaacaggtgaatattcctgtactaccctttgttggtcccgagggacggaggaggctaggttag

SEQ ID NO: 84402 - DNA, 501 bp, Glycine max
  Peptide Sequence Number=SeqID_176087
atgaagaaaaagaaacaagcaaccactaagccatcgggtgaattttcttccattgattctccttcaccagaaaagccacttgtaattgatagtatggccagaagaggaggagaaggaaatataccagctatgaggactcttggtgactatgcttatcaacaaggaccaaagcattacaataaaatagtcattcctcctttcagtaacaaggttgtggagttgaagccaacattgctctgtctgattggtaaggcaaagacatggctccatcacatccaaacaaaagtctcaacacttgtgaagaagtggagagaaaattcattgcaaggttccttcctctgtccagattcatcagtgcaaaatcagccattgctactttttcccaagggtctgatgaacctctttgtgaaacatgggagagatttaagtcttcactgtgaaggttcccaaaccatagttttgatgatgctgctcaactacatattttctacaatggtttga

SEQ ID NO: 84403 - DNA, 171 bp, Glycine max
  Peptide Sequence Number=SeqID_176088
atgacaataatacatgaacaaatctccattggagctgtaggcctaggatcttcttcatcaatggattcctttgcttcttggaagataaatggcagcggaatggagaaggaagagagagaggagacgccacttcaaggagaagatgagtctagaagaagctcaccaccatag

SEQ ID NO: 84404 - DNA, 975 bp, Glycine max
  Peptide Sequence Number=SeqID_176089
gcgcgcaccgccacctcggtcttgccgagagccgacggtcgccgcaggccttccagcgccggtgcccatggtgcgcggtgggcgtggccgtcgcgtgagcacggtccacctcggcgcgcatggccttcatggggtcttcctcaacgtggacgcacgccgaagcggtgctcctcgtcgatgatcaggcaggccgcaggttctactggcgggctggatctccgacagcagcttcggccagcacacgtcgcgtactttctcggcgcccttgcgcttggccttgctccactgctcgccaccgagcgaatgcagcggcgcggtttccgccgacgcaccagaatagcggctgatcaggtgcagctgggcgaccggcacatacaggcggtcgcccttggcatattcgatttcgaggaactcgccgggcatgccgccgacgtccatcgcgatcaggccacgatagcggccgacgccatgatcctcgtgcacgatcggcgcgccctcggtcagttcaccgaggtcgcggatgatcgcttccggctcgcggccggcacggcgcgtgcgccgggtgctgccggcgcgctcggggaacagctggcgctcggtcagcaccgcgatgcgcggatcgtccagcgcgaagccatcctccagcggcgccacggcgatcgcaaagcgcgcatcgtcggcgaggaagctgggcaggtcggccaccaccggcggcttcagctcggcggcctgcagcacttccagcagggcctcgcgacgcccgggcgaatcggcggcgatcagcacccggcccggatagtggccgaggaaggatttcagcgcgtcgcctgcgggggcctcgcgtgcggccaccggcagcggcggcagcggctggtcacccagcgcatgggcatcggcgatgcgcgcgtggtcagccgaccacacctcgatgcgcggggcatcgttcaggcgctcgcgcagcagctccggcgacag

SEQ ID NO: 84405 - DNA, 503 bp, Glycine max
  Peptide Sequence Number=SeqID_176090
atggttgaggaggagtgtaaggaggtaagtgtctcctccaagaggttagctaagaaggaaagacattttgaaataaagacaaatattaaagaaatttcccctcttagacaacctccacattttctcctttgtaaaaagacacttgttagcattgccacaccttataggcttgagtttattcctcaagtaaaggagttgttggatgagggtttggttcgcaagagcttaaatccttgtgttttgtgggtgcccaaaataggtattattaggctcgaaatccctaaaataggtgtgatgatgaatgttttgagtggtgcaatcctcttttgtaaaatcactcgtgcacccaacatcttcatgatttgtgtacatagggactcattaggtagtgatcaagggtttcccatgaaccctaaaagaataaaggtcattcctgagtggcccactccaccaagtataagaaaaatttggggcttccatgacttaacaaacttttacaaaag

SEQ ID NO: 84406 - DNA, 288 bp, Glycine max
  Peptide Sequence Number=SeqID_176091
atgaattgcgttttcgttcacgtgtcctccaccttcgagtttggagccatgcgtagtgattgcttagtgcaattctccattctcaatctttttcggaaccccatgaattgcgttttcgttcatgtgtcctccaccttccagtttggagccatgcgtagggattgcttagtgcaattctccattctcaatcttttcggaacccccagaattgcgttttccttcaagtggcccccaccttccagtttggagccctgcctaataattggttttggcaactctccgatctga

SEQ ID NO: 84407 - DNA, 107 bp, Glycine max
  Peptide Sequence Number=SeqID_176092
atggcgaaggccaagttcgagcggaccaagccgcacgtcaacatcggcaccatcggtcacgtcgaccacggcaagaccacgctgagcgctgcgatctcgaaggtcct

SEQ ID NO: 84408 - DNA, 927 bp, Glycine max
  Peptide Sequence Number=SeqID_176093
atgacgagcgccgtgccaccaagtgctgctccacctctgacctgccctccctcccctcgtcctacgcccgaaggaccccgtgacctcgaccctgccctcctccccgcccggggcggcgccggcggcgctgcccccgggcggacgtcgtgctcaccgccgggactttcctcatgggcaccaccgagcggggctgacgatcacgatcttcgcgatcgggatgatcctcgggggcgctgtggctggtgctggccacctgcgcctggtcaccggcgggacgctgtcgatctacagcttcatctcgccgctgctcaccgagggggccggggtgcccgagctgtgggtgccgttcgcgctgatgggctttgggctggcggccttggccggctcgctgctgggcggccggttgggcgatgcgcggccgttcgcgacccccgtgatcacggcgtcggcgacgttcatggtctgcctggcgctgctgctgaccccctcgcagccggcgctcgtgctggtgctgttcgtgctgctggggctgggatgggcctctccgcgaatccgtgctggtggggctcgcgaaccggtacgggggcgaggcctcgacgctggccacctcctgcccaccgcgatcttcacctcggcacggcgctcggaacggctggccggggcggcgctgggcagcgggctggggggcacgggacccgctcggtgggcagcatcggccccctgcggctcgtgtgggcgctgtggctggtgctggccgagacctgcgccatggtcaccggcgggacgctgtcgatctacagcttcatctcggggagcggcgcgatgggtggcgacggccgcctcggcatcgaccatgaggagcgtgccgtggatgtggccgccggcgagcgcaccgcccgcggccgcggcgccgacctgcgcgctcgg

SEQ ID NO: 84409 - DNA, 924 bp, Glycine max
  Peptide Sequence Number=SeqID_176094
tccccgacggactcgcctacctgaccgagggagacgccgtgggcctgatcaccaacagctggaaccccgaggatccggacccggtgctcacggagatggcgctcggcgcgctggtggatcccccgggctgcaggaattcgatgccgcgatgctcgcccagctcgccgagatcgcccgcttcgcccctcgtccccgggtacgtgctgcgccggctgcaccggcgggcgggcgtcgactggctgcacactcgtgggcgatcgtcaagggccacgccctcgtctaccgtcgccgagggagaggcggccggctgatcacaccagccgggctcccgcagcctactccaagggcacccgaaggtgctcacggagatggcgctctcggcgcgctggtgctccatgccctcccatgcgcgaaccggtcgacctcgtcggcctggcccacgtggctgcgactcttcaccgacatccggctgcgtcgccgcagccgccgtgctcgagctctacgagccactcctcgtgctcaccgacgcctccctgctcgagaagcttctgcgaccgcccggcgacgccaccgcaccggaaggatggacgtcaatgaccgcaccgactcgcccagcgcgccgcatctcacccggccgccgtcgtgccgcgacctcaccagcgattcggtacacacgcgcctggacgcttcgagcctcacctcccgcgcggcaggtgacagggttcctgggccccgacggcgcgggaaagtccaccaccatccgctatcactgctggagcctgctgcgggccagcgagatcctggtcccgaggtgctcggcatgcacgccaccgggctgaccgcggtcagatccaccccgcctcgcctacgtcccctggggacaccaccctgtggccgcagctcaccggcggcgaggcgatcgac

SEQ ID NO: 84410 - DNA, 867 bp, Glycine max
  Peptide Sequence Number=SeqID_176095
atgttccggtgggtgcggtcgtcgtcggaaccgacgggtccgcatcgtcgcgacgggcagtcgagtgggcggctgcagaggccgcccaggcgtggcgtccccgcgctgatcgtctacgtcgccgagtgggcaggcatggggttcccgggcgtacagccggtgtcggagcgggaactgttgaccctgggcgagaaactggtgacgaaggagctggcccgtgtccgcgcgcagttcgcggacgtccaggtcaggggcgagctgacgaccggtgacgcatcggccgttctcatcgaggcgtcgcaccgggcgggcctggtcatcgtcggggcgcgtgggctcgggcctcttgccgggcggctcctgggagccgtctcgcagaaggtggccgcccacgccgcgggacccgtgatggttgttcgtgaggaggcccccacggagatgcccggtccggtcgtggtgggagccgatccggctgacccggctgtcgaggtcttgcgcttcgcgttcgaggaggcccgtcgccgcggtgtcggcgtggtggtcgttgcggcggtacggcagttccgcacgacgctccggtccgatctggccgccgccgagaacctcgaccgtgcggagcaggaccggcagcagctcaccgatctcgtgactcaccttgctgccgagcacgagatccacgcggaggcacagtatccagatgcgcgcccggccgacgctctcctgaccgcagcgggggcagagagtctgatcgtcgtcgggagtcgcggacgcgcgagcgtggccgaggtcgcgctcggctcggtgaccaccgcggtcatctcccgggccatggccgtcgcggtcgtgcgcgtcccgccgtcgtcatga

SEQ ID NO: 84411 - DNA, 975 bp, Glycine max
  Peptide Sequence Number=SeqID_176096
ctgggtggggcggcggtcgtgcatcccgggcgaggcccagccggtccagccaggacgcggcctcggcggtcgcggcgcggcgggaggtgccgccgagcatgcgcggcaggatgacgttctcgagcgcggtgagctcgggcagcagctggccgtcctggaagacgaagccgaagtcgttgcggcgcaggcgggtgcggcggcggtcgccgagggtcgccaggtccgtgccgtcgtgccggacggtgccggcggtgggcgtgaggatcccggcgaggatgtgcagcagggtggtctttccgcagccggaggggcccatcaccgcgagcgagtcggcgcgggcgatgtcgaggtcttcatcaggccgcgggcgcagagcacgggcgacagcggagccgcgccgggctgggcgacgggctgcggggccggggaggccgggtgcgggggcgggccggcgggggccggggagagctggttcgtgttcatggtgcccagcgtcccgcggccggggaccgcggcgcgtcctcccccggagcggttccctgggcgcggggtcagaccgtggtctgatcccggtgtgcgccccggagcgcgcggctcagccgaagcggccggagatgtagtcctcggtctgcgtgttcgaggggttggtgaagatcgtgtcggtgtcgtcgatctcgatgaggtggccgggcttgccggtgccggcgatgttgaagaagccggtgcgatccgagacccgggaggcctgctgcatgttgtgggtcacgatgacgatcgtgtactcctgcttcagctcgtggatgaggtcctcgatcgcgagggtcgagatcgggtccagcgccgagcagggctcgtccatcagcaccacctcgggctccaccgcgatggtgcgggcgatgcacagccgctgctgctgcccgccggagagacccatcccgggcttgtccaggcggtccttgacctcgtttcaagaag

SEQ ID NO: 84412 - DNA, 258 bp, Glycine max
  Peptide Sequence Number=SeqID_176097
atggatgggctagtggatctagcggcaatcaatgcttttcttgcttatcaccatagcaaggaaagtctggtcgttgttgttttggctgatgcctatgacacattcgaccgaagatgcgagaagagcagcgcgagaattgtctgttgtacacccgctctttatgtatggctggcctctcacatttttcgtcatgaaagtagacccatttgtcccctacaaggtcaccgcatgtgtgctgagaaagggaaagcaaattag

SEQ ID NO: 84413 - DNA, 285 bp, Glycine max
  Peptide Sequence Number=SeqID_176098
atgcatatgacacagatgcaatttacgaatatgggagcccgagaaactgtctccttcttagatacaacgtctagggtagcaaagtgccccaacaggggatcaagacagaacccatgtgcgatgcatatgcgaaaggcgcaacacgggaatgtacatagtatgacaatactcactgatataagtaaaagggtatatgacacttatgcatgcagtgtgaaaaatggcacgcagcgtgtttgctccgtgcccctatttaagggacctataagggagagagctaactag

SEQ ID NO: 84414 - DNA, 144 bp, Glycine max
  Peptide Sequence Number=SeqID_176099
atggagatcgtctttggcacttatccattgagttcgtgtttgtcgcaaactgggctgtgcttccgtgactgcaaccacattgtcgagttcgcgtttgtggagttcgtgtctgcgcttccatcgaagttaggcacaaagggttaa

SEQ ID NO: 84415 - DNA, 857 bp, Glycine max
  Peptide Sequence Number=SeqID_176100
atgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggatcgaccggccgaagccgaccttgggtccaaaaagaggggcagtgccccgcttccgattcacggaataactcccacttatcctacacctctcaagtcatttcacaaagtcggactagagtcaagctcaacagggtcttctttccccgctgattccgccaagcccgttcccttggctgtggtttcgctggatagtagacagggacagtgggaatctctcggattcccttgtcgtaccagttctgagttgactgtcgacgcccggggaagaggcccgaagggcccgttcccaatccgtcccccgaccggcacgcgacgacccgctctcgccgcggaagcagctcgagcagtccaccgacagccgacgggttcgggactgggacccccgtgcccagccctcagagccaatccttttcccgagtacgaccgggcgtgggaggcactcggtcctccggattttcaagggccgccgggggcgcaccggacaccacgcgacgtgcggtgctcttccagccgctggaccctacctccggctgagccgtttccagg

SEQ ID NO: 84416 - DNA, 55 bp, Glycine max
  Peptide Sequence Number=SeqID_176101
atgacaaaaatcattcaacttatagaaggagcgaaagatacagttatcattcaag

SEQ ID NO: 84417 - DNA, 501 bp, Glycine max
  Peptide Sequence Number=SeqID_176102
atgagcgtcaacgtggcccaggtgattactgacaccatctatttgtttacaggtatgccacccaccaggcaccccttggactcggataagtctaatagggccctgggtaaggtgatccgaccgccgatcacccgggccttcatcgagaagtactgcacgcctaggcaggcgcagagtgatgcacatcaggccgcagacccaccgccaccacctcatcaggccgatcctgctgggtcactaggcatggagcgttatctacagcacttggttcgccagcaggcggccaaccaccgaggcctcagtcagcaggggcagggtttcgctccttttgcatgccctactccagagcagtttgggactgaggtcgcatggcccggagactggcccgaggcccaggaaggggaggagcccgcaggatcccccaatgaggcagaggaggcccgtatggatgaagaaatgattgacttgctcggtttcttgggaggaagcagagccacgtga

SEQ ID NO: 84418 - DNA, 414 bp, Glycine max
  Peptide Sequence Number=SeqID_176103
atgtcgttgaattggctgagagattcaacattcaattttgagcttctcgttatattacgggactcattcagacatccgagtaaaaagttattgtcgttgaattatctcagagtttcaacattcaatttcgagcgtctcgttatattacgggactcaatcagacatccgagtaaaaagttattgtcgtttcaatttgctcagagcatcaacattcactttcgagcgtctcgatatattacgggactcaatcaaacatccgaaggttcaacattcaatttcgagcgtctcgttatattacgggactcaatcagacatccgagtaaaaagttattgtcgtttgaattggctgagagctccaacattcaatttcaagcgtctcgatatatgacgggactcaatcagacatccgagtaa

SEQ ID NO: 84419 - DNA, 447 bp, Glycine max
  Peptide Sequence Number=SeqID_176104
atggcatggtcactggttgccatgttttcaatcaactccataacttcatcaagtgtcttcaatatgatcttcccaccagcgaaggcatcaagtaactgcttcgaatggggtcgcaagccatcaatgaagagtaaaccatggaagcggttaagagcttcactcagtgattcatcggggaattggtggaatgaagagatcttcacctttcccttagtggtcttcgactttggaaaatatttcttcaaaaatttctccaccacctcttcctatgtccgcaagttgtttcccttgaacaagtgcaaccatctttttgcttcaccagccaaggagaatgggaataggttgaggcaaatggcatcttcaggaactccagctattttcatcgtgttgcaaatctctatgtatgtagcaaggtgggcatatggatcttcattgggtagcccatga

SEQ ID NO: 84420 - DNA, 2823 bp, Glycine max
  Peptide Sequence Number=SeqID_176105
atggcggcatcacctggcatcatttttaatacttcgtcaccccttgaaacaaattcaaaaacaggcttgtcaatttctcagactactctatctcgggaaattacagaagacctacattttggcagagaaacaggcaatacagatatgctgaaggattccaccacagaatcattgaattatcacaagagatcatggtctaatgtgtataggcagtcagcatctggctcatatggtctaattgggagcaagattgtcaccaatgctgcctcacgtgaaagcagtctgttttcaagctcgctgtctgacatgtttagccaaaagttgaggttattggggaatggagtgctgtctggtcaacccattacagttggttcctttcctgaggaagaaccgtacaaatctcttgaagaaattgaggctgaaactattggaaatctccttcctgatgaagatgacctgttttctggagtcactgatgagttaggattcagtactggcactagaatgaatgatgattttgaagattttgatttgttcagcagcagtggaggcatggaattggaaggagatgaacatctaatttccggaaaaagaaccagttgcggggatgaagatcctaattactttggagtttctaaaggaaaaattccttttggtgaaaaatcttctagaacactttttgttagaaacatcaatagcaatgtagaagattccgagctaaaggctctctttgagcaatatggagatatccgaaccatatatactgcctgcaagtatcgtggatttgttatgatttcttattatgatctaagggcagcacaaaatgcaatgaaagcacttcaaaataggtcattgagatctaggaaacttgatatacattattcaattccaaagatatatcttgatttgatgacatatcagggcaatgctccagagaaggatattggtcatggtacactgatgatatctgatcttgattcatctgttctgaatgatgaactaaaacagatttttgggttttatggagaaattagagaaatctatgaatatccacaactgaatcatgtcaaatttattgaattttatgatgtccgggctgcagaagcttctcttcgtgcattgaatgggatctgctttgctgggaagcacattaagcttgaacctggtcttcccaagattgcaacatgtatgatgcagcaatcacagaagggaaaagatgaacctgattttggtcatagtttgagtgacaacatatccttaaggcataataaaggagtgtcatctggatttattgcatctggtgtcagcttggaaaatggatataatcagggatttcgttctgaaacacagctacctgcttttatggataactcactgtttcatgtgaattctagcattcacaagaccacaagaggggcatctgctggaaaagtatctggtgtttttgaggcctgtaatgctattgatgcgatgaaatttgcatccatttcgaggttccatcctcattctttacctgaatatcgcgaaagtttagctaatggcagtccttacaacttttcaagtaccattaacatggctgccaatattggaactggatcgacggaatcatctgacagcaggcacattcagggaatgagctcaactgggaacctagcagagtttaatgcagcaggaaatggaaaccgcccccatcatggactttatcatatgtggaatgggtccaacttgcatcagcaacctccttcaaattccatgctttggcagaaaataccatcctttgttaatggtgcttgttctccaggtcttccacagatacccagcttttctagaacaccgcctcatgtgcttagagcatctcatatagaccatcaagtgggatctgcgccggttgttgcagcctcaccctgggatagacaacattctttcttgggagagtcacctgatgcatctggttttagattgggttctgttggaagtccaggctttcatggtagctggcagttgcatcctcctgcttctcacaatatattttctcatgttggtgggaatggtacagaattgacatcaaatggtgggcagggctctcctaagcagttgtcacatgttttacctgggagacttcccatgactttggtttctaaaaacctctattctcgtagaagtgaaccaaacactaacaacaatgctgataaaaaacaatatgtacttgacctaggccgcattttgcgtggggatgacaaccggacaacgctcatgataaaaaatattcccaataagtatacttcaaagatgcttcttgttgccatagatgagcaatgtcgaggaacttatgattttctgtatttgccaattgatttcaaggcaacaattataaatgtgtttctaaggcaattctacaaatggttgcagaacaaatgtaatgttggctatgcattcatcaatatgattgatcctggacaaattattccattccaccaggcttttcatgggaaaaaatgggagaaattcaacagtgaaaaggtagcggtactcgcctatgcccgaattcaaggaaaatctgctcttattgctcattttcagaattcaagcctaatgaatgaagataaacgttgccgccccattctcttccatacagatggcccaaatgctggtgatccggagcctttccccttgggtaacaatattagagtgaggcctggaaaaattcgcatgaatggtaatgaggagaatggcagccaagggaatccttcatctttggcaagtggagaagagtctgggaatggaacagaatctacatcgagctcttcaaaaagttctgactga

SEQ ID NO: 84421 - DNA, 810 bp, Glycine max
  Peptide Sequence Number=SeqID_176106
atggaaggaagatcaatatcacattcttctgaaagagaagaggaatatgatttgttcccaatatattctgaaaggtctcagcaagacatgtcagccatggtttctgctctcacacaagtcattggtggctccaatagtgattctcttcagcagcatgaaggccttttaacttcttcacataacaacacctcaacccagaataataatgaacaatcccaagcaccacaacaagaacaagggagtgtaagaagaagacactacagaggagtgaggcagcgtccatggggaaagtgggctgcagagattcgcgatccgaagaaagcagcgagggtatggcttggaacctttgaaacagctgaagctgcagctcttgcttatgatgaagctgctcttagattcaaaggaagcaaagcaaaactcaatttccctgaaagggttcaaggcacagctagcgaatttggttaccacctcacaaatcagcacagcactagtagtcatgatcagcaagcttctaaccctattattactccacactttgctactactcaagaaacttattcaccaagtcatcactttcaatatgcacaacaacaactcatgggtggtgggagtaacagcttcaataacaaccaagatatgcttcgtttctatgggggacataacatgtttgtttcttctcagcaatctgcatcatcgtcttcttccactgcactgtctcagaatcagcaggatgagttgctgagattttcgatgcaatttggagcttcttctcattctgaccattcagggaattggaggggtggacaatga

SEQ ID NO: 84422 - DNA, 438 bp, Glycine max
  Peptide Sequence Number=SeqID_176107
atggccatgcatctgcaagcactaacaatcagccttaacactgcaaggtcccccccaccttcattagccccagctaccaatgctggcttgagaccacacttcaaccctttggctttaaacttacttctggagctgccaggatttcgatgcgtgtggcctccaagcaagcctatatctgtcgcgattgcgggttggcttcctctcgacttttgtctcacccttttgtcattagatgattcattttgtggtgctccaaaaggaaggtttaggccctacgctccagctgttgcaagaaacgcaaatgataaagatgttagaaaggcacgaaaatccaaaatcaagaaagaagaagcaatcgggaacgcacttcctattgcagctgccctgggaattgcagtgcttgtgggattatacttctatctgaacaacaaattttag

SEQ ID NO: 84423 - DNA, 1077 bp, Glycine max
  Peptide Sequence Number=SeqID_176108
atgcataggcaccaatttgctccgtggcatgcggagaacgtatgtgatgcaaattacatctcttccatgctcaaggtcccagtaactccaagaacatccaacattcaatttatccaaaaagagatagagaagatggggcacaaagaaaaatcaaaggaccgaaaagaaaagagattgcagcaaatttctcttatgagaaccattccttattctgaccaccagaggtggtggtctaaggaaactattgctgtggtaactggtggaaacagaggaattgggtttgagatatgtagacaacttgctgatcatggagtgactgttatattgacgtcaagagacgaaagtgttggtgttgaatcagctaaggtcttgcaagaaggtggcctcacggaggtggcttgtcatcaacttgatatattggatccttcatccatcaaccaatttgctgaatggatgaaggaaaattatggtggtgttgacattctggtaaataacgctggtgtcaatttcaatcatgggtctgaaaacaatgttgaaaatgctcgcaatgttattgatacaaattattatggcaccaagagcatgattgaagctatgattccgttgatgaagccatccgctgctggtgctcgtattgtaaatgtgagctcacgtttaggtcgattaaatggcaaacgaaatagagtagaaaatgatgctttgagggagcaactaagtgatgaggaatcccttacagaggagctgattgatggaatgatatctaattttctacaacaagtagaagatggaagttggagatcacaagggtggcctcatagcttcactgattactcggtgtcaaaacttgcgattaatgcctatacaaggtttttggcaaggaagttttctgtaaggccagagggtgaaaagatttacattaactgttattgccctggttgggtgaaaactgctctaacaggttattcaggaagtgtcacacttgagcaaggggctgatactgcggtttggattgcccttgctcctgatcaagcaattactgggaaattctttgcagaaagaagagagattaacttttag

SEQ ID NO: 84424 - DNA, 204 bp, Glycine max
  Peptide Sequence Number=SeqID_176109
atgcatggtattgtcgactttggttgcagatctcacagatcgccatgcactggtgcgatcttgttgacgcgcaactgccgcattcgccctttagggaagtggacgtgcatgccagtgagcagtgtctctagtgggtgctccgaccatgtaacaaaggcttcaagatttcaaaactcaaattctggaggaggaaatgggatttag

SEQ ID NO: 84425 - DNA, 2605 bp, Glycine max
  Peptide Sequence Number=SeqID_176110
atggcgagatactaccactccaacatgaagagcgtgtacaacctccacgccacgctgataaaaaatgcccaacacgacaaccctctctccctccgaaccttcattctccgctgcgccaactcatcgtcaccacccgacaccgcccgttacgccgccgccgtgctcctccgcttccccatccccggcgaccccttcccctacaacgccgtcattcgccacgtggcactccacgctccctccctcgccctcgccctcttctctcacatgcaccgcaccaacgtccccttcgaccatttcaccttccccctcatccttaaatcctcaaaactaaaccctcattgcattcacaccctcgttctcaaactcgggtttcactccaatatctatgtccaaaacgcgcttattaactcctacggcacctccgggtccctccacgcgtccctcaaactgttcgacgaaatgccccgccgagacttgatctcttggtcctctttaatctcttgtttcgctaaacgcgggctccccgatgaagccctaacgcttttccaacaaatgcagcttaaagagagtgatatcttacccgatggggttgtcatgctgagtgtgatatccgcggtttcgagcttgggtgccttggaattgggtatctgggttcacgcttttatttccaggatcggggttaaccttactgtttcattgggttctgcacttattgacatgtattcgagatgcggggacattgatcgttcggttaaggtgttcgatgaaatgcctcacaggaatgttgtcacgtggaccgcgctgattaacgggcttgccgtgcatggacgtggtagggaggctctggaggcgttttatgacatggtggagtccggtttgaagcctgatcgcatcgcatttatgggtgtgttggtggcttgtagtcatggagggcttgtagaggaggggagacgggtttttagtagcatgtggagtgagtatggcattgaaccggcacttgagcattatggttgtatggttgatcttcttggccgtgctggcatggtgcttgaagctttcgatttcgtggagggtatgcgtgttaggccaaattcggttatttggaggaccttgcttggagcatgtgtcaatcacaatctccttgtgctggctgagaaggccaaggagaggatcaaggagttggaccctcatcatgatggtgattatgtacttttgtcgaatgcttatggtggagttggtaactgggttaagaaggagggtgtgaggaattcaatgagggagagtaaaattgtcaaagagcctggccttagtttggttcacattgatcaagtggctcatgagtttgtatcgggagataattctcatccgcagtgggaggagattacaagatttttaggttcagttattgacactgtgaaacttggaggctacacccctagtactaaaaatgtgctgcatgacattcaagaggaagagaaggaacattctctgggctatcacagtgagaaattggcagtggcttttgtgcttctttatcatagggatagaaaaaccattagggtcattaagaatcttaggatatgttatgactgtcatagtttcatgaagcatgtttcggcaatgtttgtgttcggagattcattagtggacagtggaaataacaactatctcaactccttggcaagagccaatttcgtgccttatggcattgatttctcagagggtccaactgggaggttttccaacggcaaaacagtcacagacatcctcggggaaattataggtcttcctttactaccagcttttgcagataccctgataaaaagcagaaacatttcctggggagtgaactatgcttcagctgctgctgggatccttgatgagacagggcaaaatttggtgcaagattttaatacaaccgtaaggcagatgaagatccaaatggagcacaaccaattgagtcagcacttagcaaattcattgacagtagtgatccatggcagtaatgattacataaacaactatttcttgcctgaacaatatacttcaagcttcaactatgacccaaaaaactatgcagatcttctcattgaggtttacaaaaggcacattttgagtcttcatgatttgggactcagaagattcttactggcaggacttgggccacttggttgcatacctagacaattagccttaggctctgtccctcgaggagagtgtagacctcacatcaatgacattgtcgacatgttcaatgttttgttgaaatctttggtggatcaactgaatgcggagcaccatggttcagtttttgcgtatggcaacacttacggagttttcaatgatctgattaacaacgcaaaaacctacggtttcacagtaactgatagtgggtgctgtggtattggaagaaatcaagcacagataacatgcttatttgcgttgtttccttgcctggatagagacaaatatgtgttctgggatgccttccataccactcaagcagtgaacaatattgttgctcataaggcttttgctggacctccttctgattgctacccaattaacgtcaaacagatggcacaaatgtgggtgttaccatccg

SEQ ID NO: 84426 - DNA, 1830 bp, Glycine max
  Peptide Sequence Number=SeqID_176111
atgagttcgaaaagagggggtgggagacctgtaaccgtggctaacaatgatatgtccaaagggaaaagcatatctgaagctcatccaaaagttgagcagttgactcagggtatcgctgacactaagctaaactcaggacaagatgatggtgagtgggaggtatatgcaaggaaatccaagaacaaggctggaagcagtgctgcaaaaccatgggcccccccagcccataattctaatcctagggcatgggggaatgcagaaatggctcaaaagccaggcatccggggtcatggtggacttggaagatcttcgggaaatccctggcagacacaaaatgctaactttaggagaccagctggcagaggaaatggaaggcctcagttagcaacaagtggatatgaaagcaactatgttccaaatcctgcaattcggcctccacttgagcatggctggaactggcaatccagacctggtgcattgcagtccaatgcaagggatgaaatttcaccagaggaccttcaaaagaatgatgatgttgatgacgatgatggggaggaggactctgatgcttttgaagataccgatgatgatctgatgagtgatgactatgattcagatgctagtcaaaagagtcatgagacacgtaagaaaatcaaatggtttaagaagttttttgagattttggatggcttgactgttgaacagataaatgaaccagaaagacagtggcattgtccagcttgccaaggtggtcctggagctattgattggtacagaggactgcagcccttggtgacacatgccaaaacaaagggatctaaaagggtgaagattcacagggagcttgctatacttttggatgaggaattacgcagaaggggtacttcagtaattccagctggggaagtatttggaaaatggaaaggtttgaaagaagaagaaaaagaccatgacatagtttggcccccaatggttgtcattcagaatacaaagcttgaacaggatgaaaatgataagtggataggtatgggtaaccaagaacttcttgattattttagcacatatgatgctgtgagagcacgacactcttatggcccacagggtcatcgtgggatgagtgttttgatatttgaagcctcagctagtggctatctagaggcagagcgtctccacaagcattttgcagagcaaggaactgataaagattcttggttcagtcgccctattttatatctccctggggggaatcgccagctctatggatacatggctacaaaagaagatatggactttttcaacagacattcccaaggtttcatttcctctttcttggctgtgaaaggtgcaaaacacacaaaagctcttgaagaatctattggtataatgtctgagaagctgcggaagacaatggaggaaaatcgcattgtgaggaggagaactaaaatgcaacatgaagagaccaaagaagagatgtatatgcaagaacaattcttcaaggaccagatcaaaatcattcatgattcaagggatgcaaaggaagaagatttcgagaggatgcaacaggaggaacgtgagaaggtgaagcagtcaagtactactggtcatgtgaatgctgaggaatatagactcaaggtggaagagtatctgaaatttgttgaggtccaagataaagaaatggagaactttgttgctgaaaaggagaagctgttacatgctcatggcacgggttatgctgcaatgaagcggaggcattgggaggaagaagttcagtatgagcagaagtttgatgaggaattggctaacctcatggaaaagtactccccgtcgtag

SEQ ID NO: 84427 - DNA, 479 bp, Glycine max
  Peptide Sequence Number=SeqID_176112
gggtcggggtcaaggataagctggtagagcaagatgaggacataggcaggacgaaaacagcacaaacagtatggagcagaggtgcctggaagcattatcctcaaggtttcgtacttgaaagcggttgcgacaggcagcaagttgatgacgaagagatggttcccgacacatacacagaagaactactgtgggacggaggtgaggacgttaagcctaagtatcgtggtgacgacatggtactactcatgggccttattgataccaaagaagaggaattgtgtaggaaagaagacgaaagcggattgtccatgtttcatacactggagaaatggagcccaaccttgaagtcaggattcaggttggtttgggtgtggggaatcccattacatgcatgggatctggaaaatatcaaaaagattgcgggcgtggtggatattgatgacgatgttgaagacctccaacgcctagacagggcatga

SEQ ID NO: 84428 - DNA, 693 bp, Glycine max
  Peptide Sequence Number=SeqID_176113
atgatatttggtaagacagacgaaacagctggcaactatgggagaactacagccatgctgctgttgacattggcaatatcagtcaggagttataaggttgggtgggtggtaaaaggagaagggagggagggaaaggcactggaaggtgtccagatgattttgaatatgagcaataataagagagttgattgcgaattattggaaagaatcactaaggaggtggaaaagcggctttcaacaagtaacgtgccccctttgataactgacaataagcctaaaacagatcaattctgcattgttgatcctggatcagaaaatcaagagcaagtatctggagcatctattacaggaagatcacgtgaaactgaacaattattgttattacttggaaaagttttacagcagataattaaaactgggagtggatgtggaccagaaatctggggcttatatgccaaatggcacagaattaatggagatctcatgatgtgttctgaagccctcttaaagcaagttaggtcactccagggatctgatacatggaaggaccgagaccggttcaaaaagtttgcaaaagtttctttggaactttgccaggctcagagcttcaccgatacagaagagttcagggatcttcaggcttgctatgatgaagtgaaaattaaactccaatcgaactcaatgcctagctaa

SEQ ID NO: 84429 - DNA, 180 bp, Glycine max
  Peptide Sequence Number=SeqID_176114
atgacagcatgtggagatataaggttgcggaaggagggtgaaggaagaaggaagagctgttggtgttggtgtgttgtggttacaatttgggaacatgaaacactgttacggattcagagagacattggtgtaggtgagagtaatagaagagaaaggggaagcagaaacagaagagagtaa

SEQ ID NO: 84430 - DNA, 168 bp, Glycine max
  Peptide Sequence Number=SeqID_176115
atggacgaaaccaatcggcctactaagatggaccaaagcaattggcccactgagatgtttctctcaggttggcttcccctctcccctatcgctctctccctaatcgcatctcaacttgtcgtcgtcggtgattcattctccctaatcataaccctaatcgcatcttaa

SEQ ID NO: 84431 - DNA, 966 bp, Glycine max
  Peptide Sequence Number=SeqID_176116
atggataagtacgagaccgttaaggatttgggagctggcaattttggggtagctaggcttatgaggaacaaggtcaccaaggagcttgtagccatgaaatacatcgagcgtggtcccaaggtggttttgactcccacacatttagcaatagtgatggagtatgcagcagggggagagctctttgagaggatatgcagtgctggcaggttcagtgaagatgaggctagatatttctttcagcagctgatctccggtgtccatttctgtcataccatgcaaatatgccacagagatttgaagctagaaaatacccttctagatggaagtcctgctcctcggttgaaaatttgtgacttcggttattccaagtcatctttgctgcattcgcgaccgaaatcaactgttggaacaccagcttatatagcaccggaagttctttctaggcgagagtatgatggaaagttggctgatgtatggtcatgtgcggtgactctttatgtcatgctggttggagcatatccctttgaggaccaggatgatcctaggaattttaggaaaacaattcagcgtataatggctgttcaatacaaaatccctgattatgttcacatatctcaagattgtagacacctcctctctcgtatatttgttgcaaatccgttgaggagaattactattaaggaaattaagaatcacccatggtttttgaggaatcttccaagggagctaactgaatcagctcaagctatctattaccagagagacagcccaaactttcaccttcaaagtgtggacgagataatgaaaattgtgggagaggcaagaaatccacctccagtatctagagctgtcaaaggttttggctgggaaggtgaagaagatttggatgaagaagtggaggaagaagatgagtatgataagagggtcaaagaggttcatgcaagtggcgaatttcaaattagttaa

SEQ ID NO: 84432 - DNA, 1692 bp, Glycine max
  Peptide Sequence Number=SeqID_176117
atgaatgtgtgttcggtgagggagaacagctcagatgagaggaggttttcagtgagtacggggacgaagaagaggctgcatttgagggcggagagcagggaagatagagcctcctgggtggaggcaatgagtgccgtcaaggacttgtttcctcgcttgcccaaatcagaagctatgtcacccttttcctcgccgctagtttccacacagaggttgagagatcgccttttaatggagggtgtgcgtgaaactgctattagggaagttgaggaaatcgtcaagttcgagttctcccagttgcagaagcatattgtggctcttaagcagaaacagtcgctacttatggacacgctgcgccatttagaggcagagaaggttgacttggagaacacacttattgatgaccaaaggcaatcgaaggatgaaacagaatcctatctatcaacgcaagaaaagtatagtgagggaagtggtgatgattctttcgaagagcacgatggggacgatcactcagacgatggagacgatgcattctatgatacatgtgatgatattctatcaacaacaagctctgagcacctgagatcctgccatgattctgaatatgaggagacaagtccaaatggtgatgaaaaatcagccattggatcttttgggtttaactatcctcaaatcaagcgacgaaagaagtttcctgatcctgttgagaaagagagcagcgtcagtctatggtcaatcataaaagataacgttgggaaggatcttaccaaagtttgtcttccagtttacttcaatgagcctctctcctcactgcagaaatgttttgaagatcttgagtactcttttcttctagaccaagcatatgaatggggtaaaatgggtgacagtctaaagaggatgttgcatgtggctgcatttgcagtttcggggtatgctagtaccaatggtagaagttgcaaaccttttaatccactgttgggtgagacatatgaagcagagtatcaagacaaaggcattcgctttatctctgagaagcttgatcctgttggtttattgaccgtagaatttgatgatggagaagtctttcattggagcaaggggaaccgtgagtattcatgtaagatcaaattcaaggagcagtcgatcattgatagaaaccctcaccagattcacggcatagtggaagataagaaaggtagaacagtggcaactatatttgggaagtgggatgaaagcttgcatttcataattggagggaattctgggaaaggaaaacggtcctccaatgtttcctcaaaaccacatcttttgtggaagcggaatccaacaccagagtaccagacaagatataacctcacacaatttgctattacactaaatgaaatcacacctggattaaaggagaagttgccaccgacagattcaaggctaagacctgatcaaaggtgtttggagaatggacagcatgaaatggccaattctgaaaagttgcggctagaacaaagacagcgacaggcacaaaagatgcaagagaagggttggaaaccaaggtggtttgccaaggaaaaaggcaacaactcttaccgttatgttggagggtactgggagaccagggaaaaggggaactgggaatcttgtcctgacatttttggccaattctcaaccgatactgattttaactcaactccataa

SEQ ID NO: 84433 - DNA, 114 bp, Glycine max
  Peptide Sequence Number=SeqID_176118
atggagaggtcgatggtgacgccgattttgcaatgtggaagtgcagtatcgattgcaaggtgggggcctcccgaaagaaagggagcttcgaggaaggacggcctgcaacaataa

SEQ ID NO: 84434 - DNA, 369 bp, Glycine max
  Peptide Sequence Number=SeqID_176119
atggagttacgtaattgtaggtatagggagagagaatcttaccaagagaggaagcggtgtgcagagagagggcaaagaggcttaaagcccatcgttcttcattttgcatctaagcttctttccatttttcgttcaccatcatcattccattcgtttcgtgagaggttattccgagagtttatcggtcgttgttgtgtcctctttggtggttggtcggcaagtggtggtcgtgacgatggctggtttgatcgacgaagatgggtgaagatcaatgaatacgaaggtggtgtgaatgaagaacatgttaattgttctgatacgttcaatacttctcaggtgtttgttacccgtgatgatgttttacaatag

SEQ ID NO: 84435 - DNA, 279 bp, Glycine max
  Peptide Sequence Number=SeqID_176120
atgctgcaaaagttgctcaagaactatgaaattgatctccaggaaggagtagaagcacaagcggaacaagcgcttgcatcaaaatcaactgtgcagcaaaatgaaggcgctataatgtccatagaagtatttgctatattttttacctttcagattccaacattgaggactaggttgaaattcaaggggggtggtaatgtgaaggatgtaagggaaggggattcattctgtatggttagcatttgggaattgaacaagtgctcaactatgaaagaataa

SEQ ID NO: 84436 - DNA, 201 bp, Glycine max
  Peptide Sequence Number=SeqID_176121
atgatgacacctcctccgccaccgtccctggtttcctccgctcccctccttccacgactccactggcactatcctaccccctcctcggctagttctccacccgccgtcgctcccccctccgcccctccatgcgcgaattctcagtcacctcctccctctcctctctctctcccaattctcttcccaaatccaaagtcatag

SEQ ID NO: 84437 - DNA, 240 bp, Glycine max
  Peptide Sequence Number=SeqID_176122
atgggccagcacagatatatgaaagtgataaatgcgcaagttggtggcttgaataggtacattagggagacaatgaagaagtcaaggttggcagctagcatgaaggacgaagaagcttcccagaaaactacttttgatctagacaggcaatatgagcacgacgaacttattgcccaagtaaaaccctaccaagacaaaacaaagtattcatattcaatttcaaacaaagaccgtgaatga

SEQ ID NO: 84438 - DNA, 96 bp, Glycine max
  Peptide Sequence Number=SeqID_176123
atggctgggaaggactttgtggatgtgttgtttagcttcttgatactgcctttaggaaccattgcaaggcttgttgagaaaaagagtctaacatag

SEQ ID NO: 84439 - DNA, 2337 bp, Glycine max
  Peptide Sequence Number=SeqID_176124
atggctttgagaagttgctctgcccttttacgcagcagtttcttccaccaactttctcaaactcaatccacttatgcttcttccagaaccttggtctcaatcttgttgcccaaatgcacttcacctacctgcatttatgaatccaacaaagacatgcacttagcactctcttttagtaagaggaacctcaaccttagcattcttctcacgacgtttctgtggggtgagggtgtgttgatgccaaatgcacgtgatgcactgttgttggctcaggagttggagcttcagagatacacggattccgaggaaggtttcactcttcttacaccctcttcttggactaaggttgataaagcaggggcaactgtgttgtttcaagaggcagatatgggaagtaacaatattggggttgtggtaaacccagttcgtcttaagactcttgaagagtttgggactcctcagttcgttgctgataagcttttacaagcagaaagacgtaaggaaagtacaaaggaggccgagttgattacagttgcagaaagatcaggggagggagggttgcaaatttatgaatttgaatacaaggttgatagtactcggggagggatgaagaggatcttttctgcagcttttgtggcctcaaagaagctatatcttctaaatattgttcactctgataaaccagagagtcctcttgacccacataagagaatgattttagagcaaggaactcctcaactgaaacctggttctatggggagtgaaaacagctttgcagaagtgacaggaaacacaactatggattcagcagagaagaggctcaatgagcttggttacaagcaagaactgagaagagaaatgactatgttcaaaactttggcgatatcattttccacaatgacccttttcactggaattacacctctctatggttctagtcttcaatatgcaggccctgcaactcttgtatgggggtggatagtggtttctttcttcacttggtttgttgggattgcaatggctgagatatgctcatccttcccgacaactggttctctgtacttttgggctgcccatttagctggtccaaaatggggaccattttcttcatggtgctgtgcttggcttgagactatagggcttatagctgggatagggactcaggcatatgcaggatcacaaacattgcagagtataatcctactctcaactggcacaaataaaggtggagggtacttcactccgaaatggctattcttatgtatgtacattggcctcactgttatatgggcagcactaaacacatttgcattggaagtgattgccttgatcgatatagtttcaatatggtggcagcttattggtggattggtgatagtcataatgttacctctggtagcactaactacaaaatctgcttcatttgtattcacccatttggaattagcccctgaatcaacaggagtatcaagcaaaccatatgcagttattctatcatttcttgtcagccagtattccctctatggctatgatgctgcagcacatctaactgaagaaaccaaaggtgcagacaagaatggacctattgcaatactaggtagtattgggatcattacagtatttggatgggcttacatcttggcacttacattcagcattcaggattttggttacctttatgatccaaacaatgagactgctggagcatttgttccagcacaaatactctatgatgcatttcatggaagatatcacaattctgctggagcaatcattctactatttgtcatttggggttcattcttttttggtgggctttcaattactacaagtgctgccagagtggtctatgctttgtcaagagacaagggagttcctttttcacacttgtggcggcaactgcacccaaagtacaaaattccttcaaatgcagtgtggctctgtgctgcaatctgcattcttcttggtctcccaattttgaaggtcaatgtagtctttactgcaataacttcaatatgtacaatcggatgggttggtggttatgcagttccaatctttgcaaggcttgtcatgtctgagaagaacttcaagcccgggccgttttatttaggcaaggcaagaagaccagtctgtctggtggcattcctatggatttgttacacatgttctgtattccttttgccaactctatatccaattacttgggatacttttaattatgcaccagttgctttgggggtaggtttgggtataataatgctttggtggctattggatgctagaaaatggttcacagggccagttaggaatattgacattcaaaatggcatggtgtga

SEQ ID NO: 84440 - DNA, 1086 bp, Glycine max
  Peptide Sequence Number=SeqID_176125
atggaattggaagtcaccgccgctacttctccaccttctcgcgttctcctcatctccgccggtgccagccacaccgttgcccttctctctgggaatgttgtgtgctcgtggggtcgcggagaggatggacagttaggccatggtgacaccgatgatagactcttacccactcatctcagtgcattggatgctcaacaaattgattctattgcattggttacctttggtattcttagattctcaagtggatcgcattctgttttttccaggggtgattttggaaggttgggtcatggcaattctagtgatttgctcattcctcagcctattatagcattgcaaggtctaaggataaagcaaattgcctgtggggatagccactgtttggcagttaccatggaaggcgaggttcagagttgggggaggaatcaaaatggtcaacttggacttggcacctcggaggattctcttgtgccacaaaagattcaaacatttcagggagtacctatcaaaatggttgctgcaggtgcagaacacagtgtagctattactgaaaatggagaactgtatggatggggttggggccgatatggaaatttggggttgggggatagaaatgatcgctggattcctgagaaagtttcttctgttgattgtgacaagatggtcatggttgcttgtggttggcggcatacaatttctgtttcatctttgggtggcttatacacatatgggtggagcaaatatggccagttaggacatggaaattttgaggattctcttgtgcctcaaaagcttcaagccttgagtgataagttaatcagtcaggtatcgggtggttggaggcatagtatggcactgacgtctactggactactatatggatggggttggaataaggttggagttggtgacaatgttgatcgttgctctcctgtgcaagtgaagttcccccatgatcagaaagtagttcagatctcatgtgggtggagacacacaattgctgtaactgaaaaggaaaatgtattttcttggggaagaggcacaaatgggcaacttgggcatggggataccgttgaccggtaa

SEQ ID NO: 84441 - DNA, 285 bp, Glycine max
  Peptide Sequence Number=SeqID_176126
atggatgatgtttctcattttgcagatagtaaaggtgatagcttgccaaccgaaggtgtagaaattgcacacttcagtctggaacaagcacactacatgatatatacaccatccgatccccttctttttgttgctgtgaaggatcagaatggggtgttgcaaattgctgacgatgaactgcttgaggatccggctatcactagcgctatagatgaagagactgagtttaatgccttggtggaggaagaagctgcgctccttgattcactcttgggtaaaagataa

SEQ ID NO: 84442 - DNA, 1863 bp, Glycine max
  Peptide Sequence Number=SeqID_176127
atggaacccgaacatcatgattcttcgaacatgcttttgtttcttcccgatgatgttttcgccatcgtttctcggttcatgtcgccgagagatgtgtgcaatctttgcctatgctgcaagagcttaaacgctcttgtggcatccgagaaactctggctcacgcaatgtgacttattgagcacagtgcctcacaaggaccttgtggaatggagaaagggtgtggcttcttacaaagcgctttgtcgttttctgatgagtgtgaaacctttgattggaatatgggttcatcaaaatcctgagcttgggaacgtggtgataatccctcaggagcttggtcctttggggatcgaagagggtcctatactgtgggcttctgtgtttgaggttgttagtgacttggatggttccatgatgtttttccttcatgggagggagaagggggtgaattatgtttatccgggttcggtcaaggttgcggacaggtcctgcaatgtgctgttgcttgaggttgaacccgggggttgtaggaatgttagtgctttgttgcagagtaagagttttgtgcaccactcgggcgtggaggagtcgtcgtcgtcgaggaaggtttgtaggtcaaatagcgatgtttctagttcacaaagggtggttggaaatggtgaagggatggttagttttgggaagttagctttcagtgataggaggaagttgcttgaggttactactagtcaggttcggcaaaaggttccagataagatgatcggaccgttgtttcctgggttgagggatgatgaggagaattttcagaaggatttggtgcttctgtggaaaaggagatcacttcttagtcaaatgtataaggttggtagtggtcagaatgatgagtataagacgagttctcaagaggcggttgatccaacgcagttagaattggatgatgttagggcgagttttgaccgttcaaggtctatctctcatcctctgcctgaggaggatggtcacactcaatgcatcaagaggaagggttttcggggatatgtctggaatggcattaaacaaatccttggaagatcgaatacgatgaatgcaagtccgttagttgccaagaagcatacttcaaacggcgagattaggcaggcgcggcttcaagaatttcttagatcaagtgacacagtaagactaatgttaaaagcttcaactgtgaagctatcttcgtatcgagcatggccaaatatgcatgacagtcggtttgcgctttacaagttgccattgcgggttcccaaagatgaccaagaatatgctggtttatggggaggaacttttggttggcctcctggaaagccttctgaagacaagcctggaaaggctttattctttcttctgctctcttatgaggagttccagggacaacagcttctcattgcaacaaaaattttggaaggcacacactatgtgttacatcctaacggttcagcaatgtttacagcaaatatcaatgatccttcatccgaaccctttccctgggacactgatgcagactcggttccagtgaatatcaagcaagctttcgtgggagagggtattgcaagtggttacgggttcagataccctggatcaaagcctggttccctctttgttttagaaaatggtatccttgccttcatttggaaggagtcaagggctgttttgaacttgcaaagacttaacttgcaagaacttttgaagaagggtgaaagggtaccttctctgcctccggttaccaatttttcatatctgacaaagtcctactcgaatgtgtttgctggcttccctagctcttccaattttttgtcttcaccaaggtttgccttaaccctgacatgttag

SEQ ID NO: 84443 - DNA, 393 bp, Glycine max
  Peptide Sequence Number=SeqID_176128
atgaggccttcgtcaccaccgttgtgtagatcggtgggcgtcaatccaggtgatggggtcaccggaaacacgtgtgagagcacacctgatgtcagaggaacgccttcgacggcatcgggtagatcggcagcgggagctcttgatggtgggtttgtcggccaaaaagttggccagagagatggtagccaccagaacaatggtggttggccagaaaatgaagcagattcgccgatgggtgatgagcagcaaggtccatcgagatttggagagaagggtgacaacaagagagggccaccagaatgcagaaaaaagtggaagaatcgccggaaaaggtgcggtgagtataaaggtcaatcagaaattggaaaaagaatgatagaagaaaggcagtga

SEQ ID NO: 84444 - DNA, 249 bp, Glycine max
  Peptide Sequence Number=SeqID_176129
atggtggagggatttaaaaatggctctccttcactcacatcagggtcgggtttttcaaaacagactgaaatggaaggttggccagagagaacagcagcaggaagtcaggaggattgctatgaggagttatggagaataaagatttcaagcaaaatcgcggtctttgcgtggaggaggaggaggcatcccacttattcattcactgcagcaaaatccaacctatctggtggaaaaccatgtcctgactga

SEQ ID NO: 84445 - DNA, 231 bp, Glycine max
  Peptide Sequence Number=SeqID_176130
atggtggatccgtcatcagcattgcatacaatccaattcaacatgatcgaacaaagcacagagatagatcgacatttcattagggagaaattggacagtggtcttatagccaccgaatacatcccttcaaagcttcagttggcaaatatgttcaccaagggacttcccacggagcagcttcaagaccttacttgcaaactaggaatgatagatatacattcaccaacttga

SEQ ID NO: 84446 - DNA, 258 bp, Glycine max
  Peptide Sequence Number=SeqID_176131
atggatgacgtcaagaaaggagataaaagcaaagccgaagttttggtaactatcttgcagaagatggaagcttgtttcctagaacagaatccaacctatttggtgggaatccatgtcatggctgaatattcaaggtgccttcccgcaaactccacagcaacatttcattcaacactcatgtgttttgtccgaaggcataaggatcaaaagatggcagttatggtggctggccttaacttggactatatggcagcttag

SEQ ID NO: 84447 - DNA, 696 bp, Glycine max
  Peptide Sequence Number=SeqID_176132
atgaattatatgctagcatatggttccggggaagcttctttgaggctattatggaaatccggtcttctagatatacttctcccctttcaggctgcttatttgctcaacatggatttcaaagacaggatagaagaaccaatatgcttctggcagcaaccttatcgttgcaccaagtctcacactctttcagtgcctgtcactggtctatggacaattcatttttctttttgggatctagaactaaaacctgagaatgggtcagggggaatgggaataaagctaagtacatcgggaatctatgttttcagggttggtatcctagcattacataaagcattgagtgatcgactaagggaccctttggcagttgctgcgtttagccttgcagtccataatggtggaaatttgttggaagcgataaacataacagggatgatcaacaaaccacatgatgccagatttcctgaattattagatccttcaggtctggatgctgaggcattggaagctgagattctggatcttgctgagtctgttagagggacaatattgcagatgacaaatgagcattttgtgtctcaggctatggctgactatcctcaatcccctcgttcgaatctggtgagcatctttttccttgatttttttgctcgaggaaaatgttgtccatttactccggtagatggattacactag

SEQ ID NO: 84448 - DNA, 750 bp, Glycine max
  Peptide Sequence Number=SeqID_176133
atgcccctttacttgccaaggagattgacaattcctgttgtgtgcgaagagagatggtcaaaggtgtatgcagtttcttcagttacactagctccacttctcttgtctttcctgtgggggagtccttacattgtaaacagtttcttcagcaagaacgtaattgtttatggaattggaatcttgtttggaactatacttggtgtgattggatttttcacaaccaaaatgtcagggccaccaaataagtgcttatttccttggcttgcaggagggtttgtaatgagtgtgacatggagctacatcatagctcaagagttggtagggttgcttgtttcaattggctacatatgcggaataagtccttcaatgctagggctaacagttctggcttgggggaactcaattggggatttgatgacaaatttaacaatggctttaaatggtggacaagatggtgctcaagtagcaatgtcaggttgctatgctggtcctatcttcaatacccttattggtttgggcttgtctcttgtaacttgtacatggtcagagtaccctcaagctgttgtgatccctagagacccatatctctgggagacaatggtgtttttggtggctggattagtttgggcacttgtggtgttgataaaaagagatatgaagcttgacggactcttgggaggaggacttttatctgtttacttcctttctctgtttataaggttgattcagacaaaagggtctctccaatag

SEQ ID NO: 84449 - DNA, 570 bp, Glycine max
  Peptide Sequence Number=SeqID_176134
atgagcttcgataagggtggcaacggtctgataacttgtcctcttgtagtttggcgagggccacagcgtgagatagggacaggggctggaaagcctgtacctcgcgacctccttgtgggtcgtcatagtaggaagttgcaaaacgcgattccaatgcctaaagcattgcagaccaggagtgagcctctctgcttctggaataaattgataatcgaaaaattgttggattttgaaaatccaatcgagaggggggtggtgtgggtggtgttttgggcgatggatgagggatgcatagtaaaatcagtgacaagatgcaataacaagaggcaggctattactgatattggtggaaattggctacaaggcctagtaacagaggcgacaaaagcaggcatggaagacgaaagccatagtaatttgccaagtggagtcatcacgggaagccctgaaagcccttgcttaaagacatgcaacaacaaccaccacaacaaagaacaagatcgctttctccctatagccaacgtgggaagaatcacgaaaaaggcaatccctggcaatgggaaaatctga

SEQ ID NO: 84450 - DNA, 498 bp, Glycine max
  Peptide Sequence Number=SeqID_176135
atgggtgacatcgattccgggggttcgatttggcaacccttgatggatcaggaggtcatttccattcgcggttcctcctcgaagaatacttgccatgatgcctcaaacagcgaaacctcttcctcggagaagttgagggtttcacgctacactggtggaggcatctctcatcttcgcgggagggcgtggccttccgctgcttccccggccagggagcttgtccaggtcaccttgattctcctcccttctgcttctgggggagcaaagagaagcgatggagatgttagggcatctcctcgcgtgcgacatagccatagtgttgggtcgtcattgtccccaccttccgttgctagttatgagtgggtgaaggacgatgttctaaaggcgacatcgggtagttcacatttcttcttcatgtacaggtgtttgtttgaggtcttaggtctcattctccccttgactgcttttcattgtgctctttttgagcacttgaatgtg

SEQ ID NO: 84451 - DNA, 315 bp, Glycine max
  Peptide Sequence Number=SeqID_176136
atgctcacctggatgtgtcccaactccgaattttgggtggacgtggttgagtggggtcctgaacttcacacgtcggcttggagaggccgaatcaacatccttgccaaccgcctcgacctttggtacgagtacgcgtccttaagcagttccctaatccgtgaaggcttctccccttcgacaatcgaagaaaccaccgacatctccagcattgatcagaatcgcctcatcgtcggcgcgcaggtcagcgactccctcgtccactccaaggctgaccttaacctggcccaagctcctctaagagattcgcctccttag

SEQ ID NO: 84452 - DNA, 438 bp, Glycine max
  Peptide Sequence Number=SeqID_176137
atggctcaattattggccattcttttgggtcctaataacggcaccgtggtgaagaaaaagcgtgaaattgcttgtgagattgaaactgccggtgagccaagttccggtggggatattaagctgggccccaccgcggttctggaagcgctgcatgtaccgaatcgccctccgaaacgattcggtattggatgttttcccgtctccgacgccgccgaaatcctcgatcgacaagacgaccttcctcggcggaacatcgcggaagaagccggcgcagaggaaccaaacgggcctggcgggaaggtggagggtgagaaaggtgacgagggtgaagaggaggaagatgagggcccaggagggtcgggtacaggttcccaggaccacggctccaaaggtggtggtggtggtggtggtggcggcgatggaggagaaaaagaatag

SEQ ID NO: 84453 - DNA, 537 bp, Glycine max
  Peptide Sequence Number=SeqID_176138
atgtttaaagtaataaatgagaaacctggaggcattaatctgagagtgacaggtagggtgatcatcgtaggagccgctggagctgacgctggagccggaaacagagccagatccgaaaacaaggccttgctcgatgccgaagctttgcgtggaggagacagaggggcgaggcaaggggaggccttggtcgacggcggcggcggcggaggaactgaaatcgcggctgcagcgaggggagtttctgacgacgtcgtcgaagctcttggagggcctgtcgggcctgggcttgttgagcttgttgaaattgaagttaaggacactggtggcggcgcctcctcctccgccatgaggggggtggtggtggtcttcttgcggttgttggtccttgctcttgctggactttttaccccaccaattggaagagggaagatacgacgaaggatacaaaagaaaaaagaaacagctaaggatgagagaggggtttggaggggacggcagacggtggttggatggataattgacgtggcgatttcttag

SEQ ID NO: 84454 - DNA, 2085 bp, Glycine max
  Peptide Sequence Number=SeqID_176139
atggcattgaggaccaccgatggcatttctctgactgtgctcgggaaagcttaccagacagccggggtgctttttgaagtgctttgtgccgttaacaagactgagaaggtcgaagaagtagctcccgagataattgccgctgctagagatgtccaggaaaagacggagatatatgcgcctttccacattcttccgttggactctgccggggcttctcagcctattatgcagcttgaagagcattttgctttttgtagtgtcctaactccatactacagtgaagagactgtctattcgaagaatgaccttgaggttgaaaatgaagatggtgtgtcaatcatatattacctgcaaaagatctaccctgatgagtggataaacttcatggaacggcttgattgtaagaaagatagtgagatatgggagaaagatgaaaacatattgcagctacgtcactgggccttgttacgagggcaaactcttagcctgacagttaggggaatgatgtactaccggcgggctattaagcttaaggcttttcttgatatggaaaatgaacaggagatagttgatggctataaagctgttactgccccatctgaggaagataaaaagagccagaaatccttatatgccagtttagaggccgttgctgacatgaagtttacatacgtcgctacctgtcagaactatgggaatcagaagtgtagtggagaccgccatgcaacagagatcctgaatttgatggttaacaatccttcacttcgtgtggcttatattgatgaagttgaagaaagagaaggaggaaaagtacagaaagtttattactctgtactgatcaaagctgtgggcaatcttgatcaagaaatatttcgaataaaactgcctggtccagcaaagataggagaagggaagcctgaaaatcaaaatcatgccatcatttttactagaggcgaagctcttcagactattgacatgaaccaggataattacttggaagaagcttttaaaatgcgcaatcttttggaagagtttaatgaagatcatggggctgcaatattaaagttggctaggagaaagggagatgatgcactaaaggcagcattagcatctcaatccctagttcaactaggacttataatgactttgcccatgtttatggaaattggactggagagagggttcagaactgctataggggcaaagtacagagcaactgggcgtggttttgttgttcgccatgagaagtttgctgaaaattacaggatgtactctaggagtcactttgtgaaaggaattgagctcacaattttgctcatatgttataagatttatggatcagcaacacccgattcagcgtcctatgctcttctctcatggtcaatgtggtttatggtctgttcatttctgttttctcctttccttttcaacccatcagggtttgaatggaagaagatagttgaggactgggatgattggcaaaagtggataagtaatcgaggtggtattggtgttccttcaaacaagagttgggagtcatggtggaatgaggaacaggagcatctacagcacactgggtttctgggacggatatgcgagattatacttgacatgcgtttctttgtctatcagtatggtattgtgtatcatctaaatgtagccagaggtgacaagagcatattggtttatgctctgtcctggatagtgatagtagctgtcatggttatccttaagattgtatccatgggtagaaagcaattcagcgcagatttccagttgatgtttcgtcttctcaaattgtttctgttcattggagccattgtcgctctaagcttaatgtttactctgctgagtctcacagttggagacatttttgctagcctcctagcctttttgccaacagcatgggcagttattcagataggacaagcatgcaggccattcttgaagggctttggcatgtggggttctgtcaaagctttagcaaggggctacgaatacttgaagggagtggctgctgttcaaccaagcattcagccgagtacttcaaatccagcgcattctgattggcggcaagaagaataa

SEQ ID NO: 84455 - DNA, 1470 bp, Glycine max
  Peptide Sequence Number=SeqID_176140
atggtgaggcttttaggattgactcgtggagaggttgatgaacccagggaaattgcttccaggtccaatttgacaagtgagtccagtgaaaatggttggctcatcagattctttgactcatcattcttctgtgagtggattgctgttagctacttgtacaagcatgatcacgctggggtgcgtgattatctctgtaatagaatgtacacacttcccttgcaggggattgagagttatttgttccaagtgtgttacttgatgatacacaagccgagcccgtctttggataagtttgtcatagacatttgctccaagtcgcttaagattgctttgaaggtgaattggttcttgttggcagagcttgaggactctgatgataatgaagggattagtagggttcaggagaagtgccagattgctgccaccttgatgggtgagtggcatcccttgatacggcctcaaagtgcacctgcatgccccgggggcaagaacctagttttgaataggatattgtcgtcgaaacaacgattgttgtctctaacatcttcaccgcctgctcagaggtctttgtcattctcaccttcttcaggaaacaattttcaggaggatggtagtccacaatctcctgaggaaaacaagttatttaagaaatttatgccgggtccaaaggttagagatgctttgctttttaggaagtcagtggagaaagatgatgatgatgattctgaaaaggatggttttttcaagaggcttttaagagatagcaaaggtgatgatgagttgggtcagaagattcgtgatccttttctcttccgtaagtcatctgagaaatatgatgaagattctgaaaaggacaatttcttaaaaaggctcttgagggatggtgaagaatctgaaaaggatggtttctttagaaggttcttgagagactgtaaagctgaggatgaggatttggcctcaagttcagagggattctttaagagattgtttcgtgatagaaagaatgattctgatgataaaacaaacagtaagacaatggaggatgaagaaaaagagggttttttccgaaagtttttcagagagaagttggaggataagaaggatgggaatgatgaaggagatatagtaaattcagaagagaaatgtgcaaagcctgctgaagaggatgaaaaagaagggtttttccggaaattctttaaggataaatttgacaagaaagaagcaaatgataaaattgatgatggtacaaccaatgttgaggaagaagagccttctgatttttctttgttcaaaagaatttttcgtgttcaccctgaagatggtaaaagtagttcagccaatgaaaacaacggtgggttgtttgaaagtagtccaggtacagagaattttttccgcaaattgtttagagaccgtgaccgatcaattgaagattcagagctattggggtcacaaaagcagaaagaggtatga

SEQ ID NO: 84456 - DNA, 426 bp, Glycine max
  Peptide Sequence Number=SeqID_176141
atgccaccaaaactttatatgatagataggaaggtgaacaaatttcaccgtgaaacattgaagaataaactttgggaagacagatgccatagatcagctgatatcagaaaaagtaacagagcagttcgccaatactggaggtctgaccatgataacagatatccaagaaggagaatagacgctgaacactgccaccttttaattcttacgtctcacaaagtactccaaagccataacacagtgaaccaaccatcctccaatgacttgaaaatgcaaatactaattgatgaacaatcaccgtgcaagcttagtcaaaagggaacaagcaaacgatcaccatcgacaaactatttcacaatatcccgttcaaaaccctctggtaataatcatactgccgtgtccgccatgcatccaggctactgctaa

SEQ ID NO: 84457 - DNA, 1179 bp, Glycine max
  Peptide Sequence Number=SeqID_176142
atggggacttcagtcccacacgggaagtatgagtcggtgtggttggcaacactgatattgcggtgtttgctcatgactatccaaagtgctagtgcacaaccagcctgcatgggtgttagggctgcaaagtgtggtaggatgttaggatcaaattgcaagatatgggacttgagtttgacatcagaagttgcttctcttggagaaggtgtatccctcgaagctaaactgctgagcaggaaggaagctgctctgcgtcaaagagaggctgctctcaaggctgctcaacaaacacagagtgggagagatgaggatattgcagcccttcgagtggaaattcagaacctaaaagatgacgctacagcagctttggaacaacagcaagaagctgaagctgaagcaaaggcccttcgcacaatgacacagagaatgattttgacccaagaagaaatggaggaagttgtcctgaagagatgttggcttgcccgctactggggtcttgctgtaaaacatggcatatgtgcagatatagcacaatccaagcatgaacattggtcttctctagctcctcttccttttgaacttgtcatctctgctggacagaaggctaaggaggaatcttggaacaaaaagcatggaccaggtgctgatggtccagatagaagcaaacttgttcgtgatttgaatgatcttgctggggaaggaaatattgagagtatgctctcagttgagatgggtttgagggaacttgccaacttaaaggttgaggatgctgttgtgctcgcattagcccaacacagacgaccaaattcagttcggcagtctgttttagattccaaatcacatggtgatgccaaatattcagaagcatttgaattaagtgaagaggaagcagaagatgttcttttcaaagaggcatggttaacttatttctggagaagagctttatttcattgcgtggaagaagatattgcagaagagcgtcttcagttttggattgcccgcagtgggcagtcaccaagttcacatgatgctgttgatgttgagcgaggcttgttggagttgaggaagctgagtatagaacaacaactttgggaagcatcacggaagggaattgatcagcttcaagggtcagcaaatgctaatcataagcatgccactgactctgatgcctcatcctga

SEQ ID NO: 84458 - DNA, 361 bp, Glycine max
  Peptide Sequence Number=SeqID_176143
atgtcatacctggtcagcaagcggaggaggcgctgcaggttctcggcgtcaccaccgccatggggacggatgcggtcgagaatttgggcggcggatagggaagtgttggaaccatcttgtcacatggcctcgggaactttaagattaataacaactagccatgagggacataggcacactgatcatggtgcacatgatgttgtcaacttcgtcaaagccttatcggtttgtgatttgataaaactattgaatcaagatatcgaaatcaaggggccttcttgtccaagatctaggggtgacaatgacgggtcgttggaggcagtggacgggttgtcaaaggcagcgtataggctcgtcagag

SEQ ID NO: 84459 - DNA, 975 bp, Glycine max
  Peptide Sequence Number=SeqID_176144
atgtctacttctgggaagcccggtgatcatgtgcttccagtcttcactggggagtgcaaggagtgtgatcattgcaaatcaaaggagagtaacatgtgtgaccttctaaggattaacaccgaccgtggagtgacgctgaatgatggcaagttaagtgagtacactgtagtacatgttagttgtgttgccaagatcaaccctgctgccccactttacaaagtttgtgttctgagctgtggaatctcaacaggtcttggtgctacattgaatgctgcaaaaccaaccaaaggttcatcagtggttgtatttggattgggagccgcggggcttgctgccgcagagggagctagacttgctgttgcttccaggataattgggggatggggtgttgctgtgccaaataaagatgatgcgatcaagactcatctggttaatctcttgaacgaaaagactctcaagggtactttctttggcaactataaaccgcgttctggcattccatcagtagtggagatgtacatgaacaagagaacttgcaagaacaccaagtactacaatctatgcttctcttccctcaaatctgatccaagcagtccaaacgcagatcctaagggcctagctgtgatcatgattggaataggaatgaccaatgccacttccacatcctcctacttgtcttcaaagttgcctaccccctccaacaacacaacctggaaaagggtcctcaaggagtgtgctgataagtactcctatgctggtgatgccctccaagattcggtgcaggatttggctaatgaggcttatgactatgcttacatgcacatcactgccgccaaagattacccaaatgcttgccacaacgctttcaaacggtaccctggtttggtttatcctcgtgatcttgctcgtagagaagatggtttgaagcatatatgcgatgtggcaatggggattatagataatcttgattggtag

SEQ ID NO: 84460 - DNA, 429 bp, Glycine max
  Peptide Sequence Number=SeqID_176145
atggttttgcatgttaaattttttttttctatctgctggcccctttctctcccaaagggtgacgtcccatttcagctgtgtggacagtgcgttataaacgcaacgcagaaactatcatcagacttacagtgctccttgtccaaaggagtgcatggttcgctatttcaaccgctcctttttctccaccgtagacacaagacctgctattggcataagaagcggaggaagagtgtgattcggtttcggattcggaggaagagtgctggggctgaaggtgcgtgggagatcttcctcggaagtggtgggtggctcgttgaaaggagaaggatgcagttcaacctctgcagctttgagaacgggattacctgccgtgcgctgccgccgcatctactatcgatgggggcaggggaagcgccacagcgaagttga

SEQ ID NO: 84461 - DNA, 1998 bp, Glycine max
  Peptide Sequence Number=SeqID_176146
atgctgatctctgatgaaggagatagtgatgtgttctttgactcagtggattgtttctcaccaacccgagattctgttttgacagaacaagagtttggttatgagatttgggtgaatgagcctgtgagtgtgatggaaagaagggaaaagtttttgcaggagatggggttgggtgatggatcttccaaggtttgttctcaagaaaataatgtgatgagttctgatgattcatcggagagattgggactagagaggatcagggatagtggggcagtgtcaaatgcttcttgtagttgtatcttgcctgatgatgatcaagtttctgagctggttctctcgggcagcgaggccacttctgaggcacaaggcttgtttgatgaacataaggggtgccccaaagatgaatcatgttttgaagggaaggtttatgaggtttcttgtacagatcaagaggttagacatagaaaagccgaggttcgagaaaagtatatgggggaaaaggagaagaaaaactggtggaagcactttataagcagcaagaaaggaggtgggggtaaagtcagatcaaaattgaattcatcgacaaataaaactcgaagaataaatgttaggcagaataagaagaggtggatggagctcagtgcactgtatattggacaagagattagagctcacaaaggcctaatttggactatgaagtttagtcccaatggccaatatctagctagtggaggtgaagatggtgttatacgcatatggcgtgtaaaaacactcaatacatctagtatttgcttcaatgcagaagacagtgcagctaacaaagtgaaacatgacttctctagttctcagaagaaacactcaagccagtccttcgtcgttcttcccagtaagattttcaaaattgaggaatcaccgttgcatgaattttctggtcatgccagtgatgtcttggatttggcttggtccaattcagatactctcctttcatcttcttcggataaaactgttcgcttgtggaaaattggttgtagtcaatgtctaagtgttttccatcacaaagactatgtgacttgtattcaattcaaccctgttgatgaaaattacttcatcagtggttccatagacggcaaagtccgaatatgggggatacatgaagaacgagttgttgactgggcagacataagagatgtgattagtgctataagttaccggccagatggaaaagggtttgtagtcggttccctcccaggcacttgccgcttttatgttgcctcaggcaaacatttccagcttgagactaagattcatgtcaatggaaagaagagtacatctggcaacaagattacaggcattcagttttctcagaaaaaccatcagagagttatgattacatctgaagattcccgagttagaatattggaaggcactgaatttgttcagacatataaaggccttccaagatccggaagtcagatgtctggttcatttacctctggtggagaacatatagtttcagttggaggggactcgcgtgtgtatatttggaacttcaatgacttgggaaacgcttcttccaaacagacaaaatccaaatattcctgtgagcacttcggctctgaaggggttactgttgcattaccttggtcttgcatgagtgcagaagaacaaagtggctcttccaatgattttgcccaccattcatcgtcacaacaccaactagaggcatctcatggcgttagggagtcggaacgattttctttcggaagttggttctccattgatggctcatgccgcggttcggtcacatggcctgaggagacgcttccccgttgggatctacctcttgtagaagttgaatttgatcaccagaagctatgtaccaaagatccttcccatgaaaaacatgtatcagaaacatggggactatccattgtggcagctggttgtgatggaaccatcaagacattccacaactttggacttcccattaggctttag

SEQ ID NO: 84462 - DNA, 1581 bp, Glycine max
  Peptide Sequence Number=SeqID_176147
atggcctccattttcaccctcttcctcatcttcttcttcctccaccaccctcactccgccgtggctcagatccaccaagcctgcaaagccacgcgcttccctctccaatgccactcctccctcctccccaacctcccctccaaccccacccccctccaaatcatccattccgccctcacaacctccacctccaacctcctcctcgcgcgatccaaggtgcagtccatcgtcgacgcctccccagacaaccacacccgctccaccgccgcaaagagctgcctccaggtcctccactactcccaccaccgcacctccctcgccgcctccgccctcccccgcggcgccaccaaacacgcccgcgcctggatgagcgcctccctcggctaccaatacggctgctggaacggcctcaagtacatcaatcacacctccctcgtcgcccaaacgatgtcgttcctcgactctctcaccattctctccagcaacgcgctcagcatgatcgtctcctacgacagattcggaaacgacaccgcgtcttggaggccgcccatgacggagcgcgacgggttctgggagccatctgttacggagggattcggggtgggacccgcggtgccgtcaaagttgacggcggacgttacggtgtgtaaggggaaggggaagggtgaggggcgttattacgagacggtgcaggaagcggttaatgcggcgccggatgagggggaaaagaggtttgtgatatatataaaagaaggggtttatgaagagagggtgagggttccgttgaagaagaggaatgtggtgttcttgggagatggcatgggcaaaactgtcattacgggatcagctaacgtgggccagcccgggatgacaacctacaactctgcaacagtaggggttgctggggatggatttatagcaaaggatctcacaatccaaaatacagccggtgctaatgctcaccaagcagtggccttcagatcagacagtgatctttctgtcattgagaactgtgaattcattggcaatcaagatactctttatgctcattccctgcgccaattttatagatcttgccgcataattggcaacgtggacttcatcttcggaaactctgcagcaatcttccaagactgcgaaatcctagtccggcccaggcaagccagaccagagaagggagagaacaacgcaattaccgcacatggcaggacagaccctgctcagtcaacagggtttgttttccagaactgcatggttaatggtaccgaggaatacatggcattgtattatagcaagcctaaagttcacaagaactatctggggaggccatggaaggagtattctagaacagttttcatccattcattcttcgaagcccttatcacaccacagggctggatgccatggagtggggattttgcactgaaaacactttattatggggagttccagaactcaggacctggttctaatctgactcagagggtgccctggagtaaccaggtcccagccgagcatgtgttctcgtattcagtgcagagttttattcaaggagatgattggaatcatcatctcagttag

SEQ ID NO: 84463 - DNA, 1875 bp, Glycine max
  Peptide Sequence Number=SeqID_176148
atggaggtgcaaacattaactacagtaaatgaattatacaaacgaagacttccaagaagcaaagtcaaagatgcagagaagcctttccacttatctgtccaagataggagctcaagatgcaaattgtctttcttaaaacttatactattgataaccatatgcggcacttttgtaacactcctgtactctccggaagtttacaataccaaccatttatcaagctctggctctcggtggatatggggtggctcagatcctcgttacatgtccaatgtagccactgactgggatgacatattgaaaattacagaaaagctgacaggggaagatgaacttgaaggaattgggcttgtaaatttcaacaagactgaactagcacaatgggagcatcttattcctgaggcaacacatgttgttctgcctctggagtatgctgcaagaaatgtgacatgggagtccttgtacccggaatggatcgatgaggaagaagaaacccaagttcccgtttgtccttctctgccaagtctaaggtcccctggcataagacttaacctcattactgtgaagcttccttgtaggaatggagggaactggtctagagatgttgctcggttgcaccttcagcttgcagctgcttcccttgcaacctctttcaaaggcaactaccccgtttatgtgctcttcgttaccaactgctttccaataccaaatttgtttacgtgtaaagaactcgttgcacgccaagggaatgcgtggttatacaaaccaaacttgagtgttttgagagaaaaggtccagcttcctgtagggtcttgtgaacttgcacttcctatgagaggaaaagagttggtttacaatgggaatgctcccagagaagcatatgcaacaattctgcattcagctcatgtttacgtttgtggggctatagctgcggcacaaagcatccgcatgtctggatcaactcgagaccttgtaatacttgttgatgagacaatcagcagctatcacagaagtggtctggaagcagcaggttggaaggttagaacaatacaaaggatcagaaaccccaaagctgaaaaggatgcttacaatgaatggaactacagcaagttcaggctatggcaactgactgattatgacaagataatattcattgatgcagatttgctcatactaagaaatatagattttctatttggaatgccagaaatcactgccactggaaacaatgccactctctttaactcaggtgtcatggtggttgagccatcaaattgcacattccagctcctgatggatcatatcaatgagattgagtcttacaatggaggggaccagggatatttgaatgaaatattcacatggtggcacaggataccaagacacatgaacttcttgaagcatttttggattggtgatgaggaagagaagaaacaaatgaaaactctgttgtttggcgcagaacctccaattttgtatgtccttcactatctaggtgtgaagccatggttatgcttccgggactacgattgcaactggaatgctgatatatttcatgaatttgcaagtgatgttgcacatgcaaagtggtggaaggtacatgatgcaatgcctgagcttttgcagcagttttgcctgttgaagtcaaagcagaaggcacagttggagtgggatcgtaggcaggctgaaatagcaaactacacggacgggcattggcaaattaaagttaaagataggcgcttgaagaaatgtatagataatttgtgcaactggaaaagcatgttgcggcactggggagagacaaattggacagatgatgagttttatactccaacaccacctaccgttaccacaacatctctttctgctctatga

SEQ ID NO: 84464 - DNA, 150 bp, Glycine max
  Peptide Sequence Number=SeqID_176149
atggagggagacatagggaaaataggcacaggaggagcaacaggggacccagcacagcactctttggctcttggaaagttgaaaccctttgtagtttgtagtaggactcagattgcaatcaaagacacacagggcaaagcagtgtcataa

SEQ ID NO: 84465 - DNA, 261 bp, Glycine max
  Peptide Sequence Number=SeqID_176150
atggtggtgcgacaatgctgtttggtggtggtcgaagtttggtcacggtggatgaagggtggaggagatggttctggtcagagatggtgcggcacgacgacaatggtgcaacagtgttgtttggtggtcagagatgatatcaacaattcaaaaaagttggctggagaggctactagcaagagaggatctacacctgtgaaaagatggaggaagaaaaagagaaagacaggggagagggatttggtggagaaggcgacatga

SEQ ID NO: 84466 - DNA, 435 bp, Glycine max
  Peptide Sequence Number=SeqID_176151
atggtgctcaccatttccctcgcgttctgccacgtggcgtcgaaggcaatgaggacgtggccgaaggaggggccgagggaggagatgtggagagtggaggcggatgaggggaagaggaagatggctaggggaaagcggtcgaggaggggggagaggtggcgggcggtgagggaggaggaagtggaagcgcgtggcagagacaaacgcgactgggatggtcgcagatggagcagtgctggcaatgaggttcctccgggacttggtgggaaagtaggaaaggaagtgcagaactcttacaagaagagagaagaacttttcactgagcaaagaagaaatgttgacttaaagacattcgcaagttgggaggattcacctgagaaaatgatgatggacatgatctccgatccaaatgctgttcgaagggaagaccactga

SEQ ID NO: 84467 - DNA, 1119 bp, Glycine max
  Peptide Sequence Number=SeqID_176152
atgctggaaatctcaactttaccggaaaccgcgacggagaacgcggacggcggttccgcggcggtatccgacgggtcgaaagcggagcacagcgaagacggtgaccggaattccgccgcgaaccggtggccgagagaggagacaatggctttgctcaagataaggtctgaaatggacgttgctttcaaagacgcaaaccccaaagcccctctctgggaacaagtctcaaggaagttagcagagctaggatataatagaagtgctaagaagtgcaaggagaaattcgagaacgtttacaagtaccataggagaaccaaagaaggtcgttttggaaaatcaaacggtgcaaaaacttatcgatttttcgagcagttggaagccttagacggaaaccactcacttcctcctccgacaacaacaaccgacaacaacaacaacgttgatgatgatgatgttatcctcaacgcggttccgtgttccgttatagctgcggcggcgcacgagcattcgagttcgacgacgtcgtcttcggggaagatgaagagaaagctgacgcggtttctggaggggctgatgagggaagtgatagagaagcaagagacgctgcagagaaagttcatggaagtgttggataagtgtgaaaaagatcgaatggcgagggaggaagcgtggaagaaggaggagctcgagaggatcaagaaagaacgcgagcttctcgctcatgaaagatcaattgctgccgccaaagatgaagctgttcttgcttttcttaaaaagttcgcagaagcagaaggcacggtgcagttgctcgagaaaattcaggttcagaacgacaaacagaaaaacaagcatcaaaatggtgctaatgctaatagaggtggtgatgtcacggttgtcactgatatggataaacaagaatgtggaaataatggtgttagtgttgggaattttgtgcacatgagtagttcgcggtggccgaaggatgaagtggaggctttgataaggttaaggactgagtttgatgtgcaggcacaagggaataataataatagtaataatgggtctaaagggcctctttgggaggagatatcttttggctatgaagagcattggttatga

SEQ ID NO: 84468 - DNA, 354 bp, Glycine max
  Peptide Sequence Number=SeqID_176153
atgggtgaactaaagccatatttagcagtgtttataatacagttaatatattccgggctgactttgttgtccaaggcagcgtttaacggaggaatgaatacctgtgtgtttatctcctatagacagttgactggtaccgttattatggtccctttggccttgatacttgaaagactcactctggctttaaatatgcaagctattgcccttgtttacacgtctgccacgttagccgccgcaattgttaattccctccccgcatctacgtttttctttgctgtgcagaatggagaagcgacccctagcatcttacaagggaccccagttaaggacagaacatcacattttatctag

SEQ ID NO: 84469 - DNA, 2949 bp, Glycine max
  Peptide Sequence Number=SeqID_176154
atggctagggttttggctcagtctgttaatgtccctggtctagtggctgagcataggcatggtcagcaaaagggatcaggaaaattaaaaagatcgaccaaaatgatgagtgctttacggacaaatggattaagaatgtcaggtttctcagggcttcgtactttcaatcctttggatactatgttgagacctggcatagattttcattctaaggtatccattgcaacgtcttcgcggcaagcaagagctaccagatgcgtgcccaaagccatgtttgagcgtttcactgagaaagcaatcaaagtgattatgctagcccaggaggaagcaagacgtcttggtcacaattttgttggcacagagcaaattctattgggtcttatcggcgaaggaactggtattgctgctaaggtgctaaagtcaatggggatcaacctcaaagatgcacgagtggaagtagaaaaaataattggaaggggtagtggatttgtggctgttgagattccatttactccccgtgcaaagcgtgttttagaactttcactggaggaagctcgtcaacttggtcacaattatattggatctgagcacctgcttctgggtcttcttcgagagggtgagggtgtagcagcacgtgttctggaaaatctgggtgctgatcctactaatattcgcacacaggctagcattatgccttcatttacctttttcccacaaacttctgtttacatggagacattctcttctaatctgaaatttgatgttattcgcatggtgggtgagagtgctgacagtgttactgcaactgttggctcaggaagtagtggtaataagatgccaactttggaggagtatggtaccaatttgaccaagctagcggaagagggaaaattggatcctgttgtgggaaggcagccgcaaattgaacgtgtgactcaaattttaggtcgtcggactaaaaataatccttgtcttattggagaacctggtgttgggaagacagcaattgctgaaggtctcgctcagcggattgcaaatggtgatgtacctgaaaccatagagggaaaaaaggtcataaccctcgacatgggtctgcttgttgctggaactaaataccgtggtgagtttgaggagaggttgaagaaactgatggaagagatcaaacaaagtgacgagataatacttttcatcgatgaagtgcacactttgattggagcaggagcagcagaaggggcaattgatgctgctaacatactaaagccagctcttgcaagaggtgaactacaggtagtactctctcttgacatgttcagaatggatttactgcttgctgattctgatcttgaagtcaatatgatatgtaaagagggagaaagaatgagtctgtgtattggagccacaacattagacgagtacaggaagcacattgaaaaagatcctgctttggagagacgattccagccagttaaagtgccagagccaactgtagatgaaaccatacaaatactgaaaggacttagagagcggtatgaaattcaccacaagctccgctatactgatgaggctcttgtagctgctgcacagctgtcctaccagtatatcagtgatcgatttttgccagacaaagctatcgatttgattgatgaagctggttcacgagtccggcttcaacatgcacagttacctgaagaagcaagagaacttgacaaggaggtgaggcagattattaaggagaaagaagaagctgttcgcaaccaagactttgaaaaggctggagagctacgtgatagagagatggatcttaaggcacagatctcaacacttgtagagaaaggcaaggagatgagcaaggcagagactgaggcaggggatgaaggtcctattgtgactgaagctgacatacagcatattgtctcatcctggactggtattcctgttgagaaagtctcaacagatgaatctgatcgcctcctgaagatggaagagactttacataagcgagtcattggtcaggatgaagcagttaaagccattagtcgggctatccgtcgagctcgggttggactaaaaaatcctaatcgtcccattgccagcttcatcttttctggtccaactggtgtggggaagtctgaattggccaaagcattggctgcatactactttggctccgaagaagctatgattcggcttgacatgagtgaattcatggaaaggcacactgtctccaaacttattggttcacctcctggatatgttggttacactgaaggtggtcaattgaccgaggcagttcggcgtcgtccttacactgttgtactgtttgatgagattgagaaagcccatcctgatgtgttcaacatgatgcttcagatcctggaagatggaagactaacagacagtaagggcagaacagtggatttcaagaacacacttcttataatgacatcaaatgttggaagcagtgtgattgagaaaggaggccgcaaaattggatttgatctggattacgatgagaaggatagcagttataacagaatcaagagcctggtaactgaggagctaaaacaatacttcaggccagaatttttgaatagattggatgaaatgattgtcttcaggcagctcacaaaactggaggtgaaggagattgctgacataatgctcaaagaggtgtttgatagactgaaggtgaaagatattgaacttcaagtgacagaaagattcagggacagagtggtggaggaaggttataaccctagttatggagctagacctctaagaagagccataatgcgacttttggaggacagcatggctgagaagatgcttgccagagagatcaaggagggcgactctgttatagtggatgttgattctgatggtaatgtgattgtgctcaatggtagcagcggagcccccgaatccttgccagagacgcttcctgtataa

SEQ ID NO: 84470 - DNA, 471 bp, Glycine max
  Peptide Sequence Number=SeqID_176155
atgaattggaccctgcgagtggaagagttgggcgagcttagtggagacttggctgggtcttcgggatcgtcgcgagatgcattggagaagaaagaaagttttggtgagctgtggaaagtatcagtgatacctaaggcggcacatttagtttggcgtctcttctctaatggtgttgccatcaaagtgaatttgcagagacgaaatgtccacattggtgagtacactgcaagccagaaaatcactttttgcagcagcattggttacccagttatgaagcactgcaagccagaaaatcactttttgcagcagcattggttacccagttatgaagcacggacatccaagttctttgtcgtgtttggtgtccgacacgacaccgacactgatgttcatgtctggatcgagtttgatgtgtttaaaagatgtccacgtattcatatccgtgtagtgtcggtgttccttagttactaa

SEQ ID NO: 84471 - DNA, 504 bp, Glycine max
  Peptide Sequence Number=SeqID_176156
atgtgggcatgggaacgctgcacgactttggctccaaagagaactcctcctataatggaaaacaaaccactcggacacaggtggctgcgacgtggaaaccaacatattggcaatgatgatctaatagttttccgtcgcaaattggatatcatgaaacgacatgagtttctgtgggagccttacacaacaactgttatgtcgatgttgcctcccatttgtttggttggcagtatggcgtggtgcgcagtggtgccactcatttgtttccatgttgtagagtggcaccaaccggatagagtgttgcgacaatttggaatgcaacaacctattccggagtctccttcgcaaccatggaatgtccacgggctaacactgaaaggcaaaatggatgaaaattggttccagctgttggccccatttatcagtcagtggaataatcaagctgagtttagggcgcaaacaaaaatgtttatcgacccaaacaatgcaaacacggctacattg

SEQ ID NO: 84472 - DNA, 609 bp, Glycine max
  Peptide Sequence Number=SeqID_176157
atgtcggctcttacatgtatctcctttttcctaccctttttgccgactagcacgaaagagttgccaaaccgccaatggagagaaacgagggatcatctaattaaaccagctttcatcagggtgtgggtgatttattgtaagctttttcttattatcttcgattgtgtttacacgtgtgtgttaaaggtggcgaatcctaaagagaagggaaatgaggttgatgacaataaggaattgatattattccatgaagggataatgaacaaccctacattgtcaaggctatttccgggtttgaatagggagagggagatgtctgctatggtctcagctttgacccacgtggtctccggagaggtgccaataaccggtgattcttcttcttcttcttctttggttcttcatcatcaacctcatgatgatactgttattgttacaccaaccatgccttcttcttcttcttcatctacttatgttgttggcacctcttctctcaagagaagtagggaaaatgatacatatacatcatccttattctcacatccaccttcatcatcccctgctatgccaacaaaatacaacagttcaaccttcaagattgcagtctaa

SEQ ID NO: 84473 - DNA, 891 bp, Glycine max
  Peptide Sequence Number=SeqID_176158
tcagatgactctgaaagcagtgactgttactctgccaacaagatgtatttgttaaaaggttctcctgatgatgatcctgcagtgagtggggattctataaaaaatgaaaagccaattgaagttcttagaaaggttggcgggaatgaaaaatgtgctgattgtggtaaacctgatccagattgggcatccttaaaccttggcatccttatttgcattgaatgttccggtgttcaccgtaatcttggtgtgcatatatcaaaatcactggggaatctttttgcaaactcagtttggaaggaactgttgcattcaacaagtacttcgcaaactgatgacactcccgatgggtattacttgaatcaagttgaatacgtgggagatagagaacttgaacttgaaggtttcccttgttgcagtatgcttgccaatgacaagaaagcagtgtacagacacgttgtgaagtcagatgtggatgtcattgctattagtggggaagcaggtttttcttccaacatgccttcttcaagtaatccaaacacatcatgtaaaactaagactcgacaagaggaggatatacaagatggctctagtgtgcttcacctgtatggtgcagacgtaaatgctattgattctagagggaggacacctctacattacagcactatgagaggggagagtgcaattacaaaagtgctttattacaaggaggaattgaaacctcatccaaatgatatggtttatgctttaactatggagggggccaatccacttgccggagacaaagaaggcaacactccttttaagcttgcaccggaacctgacactgttgtcaaagatactcttgctctaaaccagcaaacgacatgccctcaaaacttattagaaaaatga

SEQ ID NO: 84474 - DNA, 87 bp, Glycine max
  Peptide Sequence Number=SeqID_176159
atggtgattttcagccatggagttgcagcggaagataaaggagaagagcacatgggaagcgtccttgagaagcaagatagcttctag

SEQ ID NO: 84475 - DNA, 174 bp, Glycine max
  Peptide Sequence Number=SeqID_176160
atgtcgtgtctccaatcacctttcctacttctccattccgctgccattgatcttcaagaagcaaaggactccattgatgaagaagatccaaggcctacaagatctacatggagctacatcactaagttggggaaaatcacattcccctcacttacaggtgcaaaggcaaactag

SEQ ID NO: 84476 - DNA, 132 bp, Glycine max
  Peptide Sequence Number=SeqID_176161
atggtgacaaaaaggtggaagttggaagttggaagtggaagttattggaagttgaaagttgaaaatggaagttggaagtggaagttactggaagttgaagttggaagttggaagatggaatttgaaatttga

SEQ ID NO: 84477 - DNA, 431 bp, Glycine max
  Peptide Sequence Number=SeqID_176162
acttgcctccacctattcctgatgaacgtgccccatctcctccaccaccaagggttgattcctcttctcttttgaccaaagtcctcatagaactttgtgctcttcgagcttttgtaggtgaacgatttgatgcgatggatacttgccttgatgcaatggatgcacgctttgatgggatggtggttgtcatcatcaaaaagggggagaatgtaaatcatgcaggttttgatgatgtcaaaaagaattttcttgatatcatcaaaaagggggagaatgtgaatgtatgtatacatgattttgatgatgccaaagaagaatcaaacaaggctgcttcaaaggataagaattgcttcaagattaatataagattgcttcaacaaacaaagttctatgaggactttggtcttgtgattttatgttgttccttttga

SEQ ID NO: 84478 - DNA, 153 bp, Glycine max
  Peptide Sequence Number=SeqID_176163
atgagtggagagagagggagagaggggggcatgaattgtatgcctcaactgaggttaattaggcaagctttggaaagtgtagtttttcaccttctcgctaagccaatatgctggcttagtgagcgtccgctaagcgcaacactcatgggctaa

SEQ ID NO: 84479 - DNA, 510 bp, Glycine max
  Peptide Sequence Number=SeqID_176164
atgccgcaacgcttgcaagggttaggaaaaggtttcttctgcttttgggttgtctttcttttcgtgaaaaattgtgtcttctggttcgagaaaaagggaaaggggaaagtgactggtggcggaggcagagatggagtgaggaaggtgcggtgcggcagtagggggtgcaaatgcgagattcaaacgctgattgaaactacgaatgtgatatctgtggtgggaacaacagaatctacaaaccctaattgctctggtgttgtgtgttggaattccttggtaaagagatgtgaaaacgggccagcccggtccacgtgggctggtatgcaacgggttaagttaaaagtgggttggtccagttcggtccatttttgttgcttgaacattggaaggaagaaactagcacaatacttgtttagcacacgagcaccaatgctaaatgtcgatttactagcaacagttgttataggaagacttaacacctcacatgccaatctacaaagatttggataa

SEQ ID NO: 84480 - DNA, 51 bp, Glycine max
  Peptide Sequence Number=SeqID_176165
atggatgaattcgagtatcgaactcagggaactagtattagacaagcctaa

SEQ ID NO: 84481 - DNA, 945 bp, Glycine max
  Peptide Sequence Number=SeqID_176166
atggcttccaagaagagaaagtctcttgcttcttcctctacccaagcaagatttgacagatctaggtttcattctcaagaagcttgggagagcatcaatgttgccattgtgaaggaattttatgctaacctctacgacccggaagacaagtcactcaagcaggtgagggtcagaggtcatttgatcaaatttgatgaagatactttgaacaccttcctgaagccccctgtaattttggaagagggggagaatctctatgcttattctaggtttgcactcctgaggcctgatcctcaagagttggctgctaagctctgtatcccagggaggggattcgagctaaatgctgatgccttaatcacagctttgtgtaaagctagaggagtcacatcagattctagatccctggagagcctcagccccgccattaacttggcgtacattaagaagaactattggaatctggatgatccaatagtcacattcagagggcctaagaagaccaggggcaagagaacagaggcccctactacttcagcagcaccagagacaaccacaccttcttcatccacaactccagcacctcccagttcgactccaattattcctgctccatttccatttcagcttccaaccctttcatcttttggaccatcacagtttttatttacaccagagatgcttcattctatgctccagagcttacacagggggcaggccattatcattggtggctcaggaggaagtacctttaccagaccctatcccagagccatctctgcccctacagctatttctgaggatgcacctattcctgaagacaccatgctagctgaggatacccaaccatctgcaccagtattagagcatgagcagctcaccattcaagattcatcagcagctccaatactggatctgaatgaagatcagccacaggaggattaa

SEQ ID NO: 84482 - DNA, 477 bp, Glycine max
  Peptide Sequence Number=SeqID_176167
atgaagcttgagttaagcaaacctaatgagcgattgaggaggcgtaattcagagagaaacagaaattttttgcaggacttagaagtagcaggaactccagaagaagaacctcgatcttccgaggcatcttctagttttcctgttgtagggcattctcagatagaacctattgaagacttaatcatggctgaagagctaagaggagtaaccctggaggattattcaagttctactatgccacaatttttcaccagtattgcacaaccagaagttcaagctcagacaattacttatcctccctctttgatacagttgattcaaaataatttgtttcatggtctacccaatgaggacccttatgctcacttggccacctacatagagatatacaatactattaggctggcaggtgtgccagcagatgcaatcaggttgagtctgttctcattttctttagctggagaagctaagaaatga

SEQ ID NO: 84483 - DNA, 549 bp, Glycine max
  Peptide Sequence Number=SeqID_176168
atggtgacaacaaaagagcttgagacacgcatggattcttatgagaagatcgtctctaatcttcaagaatcaatgcaaaattcattcgagatgatgcagaaatcaatcgagggactaatggtttcgattgcaacccaacataagggacctaaaatcgcaactaaggatgaaaatcatagtgggactcatgaacccatcgtctcggtggtggatagggcgcaaatcccttttccttcttttgatggttctaattatcgagaatggaaggcaaaatccgagcaattttttaaattggaaggaacactggaagagcaacgaattcgtttgttgctattgtccatggatgtggcagaacttgcgagactgatgcaagaagattccttgattgattatattgagaggtttgacacacttttggctcgtattgctataccagaagagttggcattaagcttctttctctctggtttgactatcgaattggagaaatctgtcagggtttatagaccttcttcaattcaagaagttgtcagaatagccagactttaa

SEQ ID NO: 84484 - DNA, 138 bp, Glycine max
  Peptide Sequence Number=SeqID_176169
atggagggagtgatggctggacaaaatgattgtgtgataattgatgctcttgaaaccttagctcaggctatggggaatcaaaataagggagaagttgctggagctattgagtatcaagggttggatttcttccaatga

SEQ ID NO: 84485 - DNA, 1062 bp, Glycine max
  Peptide Sequence Number=SeqID_176170
atgagtcatcattcatctagtgttaatggtgagagtactagtcataaggaccctctatctagaatcttagatgagttgagtttcctcaagttatggaaagaaaagaaaaaggaaaaaaagagggtagaaataaatcaagatgaaagagaacaaataagagaggaagaaagaagaaaaataatgaaagaaatgaaaagagaaaaccatgcctcctatagtagtcatgactcttgcaagagtttaagagaagaacttagctactattatagaaggcgccatagttcacatattaaacatcattcccaaagaagagaaaaggatataaggcctcaagaggttaacattagcctcccatatttccatggaaaagataatgttgaggcctacttagattgggaaatgaaggttgaacaactctttgcttgccatcatattagcgaagaaagaaaagttccattggctacccttagctttcaaggagtgcccttaggaagaggcgcattccctcctactatgaaagggagcttatggacactctttgctaacaagaatgtcacacatgttcatgcggtattcttggacgcatttcgtgacctgactcagagtggagcaaagggagctgctgctctagtgcatatgtatgacaatttgaatgatgcgccaaagagcacggccagactacttgcaggatatattacacttttacagtgttggatctatgaacactttccttatgttggttctgttgttgctactgaggattatgatgagaggaaaccacgtgcctgtcattggaagtctgggaaggcattaccagtatcgatgtatcgtaggcattcagatagattgatgtctgatgttgtatgctggatttggtatggtgaccatcgtgcatttagagagtttaagatatgtttagcgcctagccagtgttcaccggactacatgaattggttctacatgatatatcatccctttatgagtccggcacagcctggggatcctcctagacatccgcctgtgcagcaccatgacacatttgttgaactagatgttgcttag

SEQ ID NO: 84486 - DNA, 534 bp, Glycine max
  Peptide Sequence Number=SeqID_176171
atggcttcgaggaaacgcaaaagtattggttctagacccacaacacaatatgatacaaggagattttcgtccttagatgcttggaactggtacacagataatgtcttggggagaaacatcttgcctgggaggaaggtaaagctctatcacactgagctagatgattttaagactgaattggagaggcgtaatttccataaacgcctcaccaatttggttgatgggagcatagacttggttttggtgaaagagttctatgcaaagttatacagctctaagggcccttcaccaaagcaatccagagtcagaggccatttagtgaagattgatgctgacagtctcaacacattcccggagacacttgtgatattggcagagggtgagactttacccacatactccagatactgtaggttgcccacaaattacagagagattgaggttgccttatgcataccaggccgagggttcatcttgaacactgagggccatcctgggaagattctcaggaaggatttgactactctagcttag

SEQ ID NO: 84487 - DNA, 198 bp, Glycine max
  Peptide Sequence Number=SeqID_176172
atgtttgcttacagtcctttcgctaagcgcaagcctcgcgctaagcgcatctctattcatgtgctaagccgcgagtctcaagcgcttagtgcccaacccttgcatctgaggctgatttggtccactaagctggccaaggctgagctaagccaacttcaattcgatctgaatgcggttaagggacagccaaactgctaa

SEQ ID NO: 84488 - DNA, 291 bp, Glycine max
  Peptide Sequence Number=SeqID_176173
atggaagtaaccatcaagctcatccttaacacgttttacggtgcccttaccgaacctgtgctagagctagctagagtaatgcgtgaagtagaagaggtgcaagagaaaatgaaggccgacatggaagccatgaaagagcaaatggccacaatggtggaggccacgatgagcatgaagaagataatggaagccaatgcggttacagttgccgctaccagcactgttgctaaggtgaacctgatgcccccatctgacctcaaccatatgaatcatccaacctcaatatggtag

SEQ ID NO: 84489 - DNA, 492 bp, Glycine max
  Peptide Sequence Number=SeqID_176174
atgacaacaccctcgagatcctctccaccaccagattcttctagcgcaaccacaaaaaggaagactagacaaaatcaaccacgaccaactgtccacgtcgacactactactggtagaggatgtggccctcataaagaaaaatttcatagttacttgggggtagtggcgcgggagaaaatccctattgttcattctacttggaaagatgtccctgaaactcttaaagttcttatatgggatgatattttggcaaaatttgacatccctgaaggtttaactgcgaagaagaagtcattatttattgacttgtatttgataacgctgatagggaatatgcaaaaagaacaggaaattcaaaaattcaacgactctccccatgtactatctcatggagggtatgatatgcttgaaaaaaaattgatggccgagaaaacaaagtcaagagtgaatcaaggtgagggtactgaaaatacagatatggaagaaggctag

SEQ ID NO: 84490 - DNA, 357 bp, Glycine max
  Peptide Sequence Number=SeqID_176175
atgtaccctctcttgttctcagttacaacaacccaagtagatgtaccctctacttgtaccacaaaggatgtaccctccaatgtgttaagacaaagttctcaggtggttagtccttcgaaacattgtgaaggggatacaaaagatatctcaggcaggagaagagagacacaaaaagagttcagacggttagtccttggcgaattctttttggcaaagggagaagagaataaaagatataacacacttctgttttcaaggtttggaaaaccagaaaactttagaaagcttttgcaagggaagaagaagaacaagaagaagaagttcaagaaaatgttcaaagagattcaaaggttgtaa

SEQ ID NO: 84491 - DNA, 216 bp, Glycine max
  Peptide Sequence Number=SeqID_176176
atggttgttgtgactgagaacatgagagggtacatctctggtggatcagttgtagtggagggtaccactaggttgttcaaagagaacaagggagggtacatcccttgtggatctttgcttattaaacaagtaaataacacaagagaattgttaacccagttcggtgcaacgtcacctacatctgggggctaccaagccagggaggaaatccactaa

SEQ ID NO: 84492 - DNA, 51 bp, Glycine max
  Peptide Sequence Number=SeqID_176177
aagtattgactaatcaaggtttaggtctagttgacttgttggggtttaagg

SEQ ID NO: 84493 - DNA, 250 bp, Glycine max
  Peptide Sequence Number=SeqID_176178
atggaggattgccttgaggttcctttcttaggcaatcctgaaacacaactccaaactcaaagtggaggacacatgaatgacaacgcaattcattcatgtggctccggaaaaggacgagaatggaggattgccttgagggcaatcatgaaacacagctccaaactcgaaaatggaggacacatgaacgacaacgcagttcattcatgtggctccgaaaaagggtgtttggcaggaccgaatggtccaccgg

SEQ ID NO: 84494 - DNA, 603 bp, Glycine max
  Peptide Sequence Number=SeqID_176179
atggcctgggtcttctacaacctgattatcctcggtggcgcggtggcggtgtctgtggagagcaaacaggttcgccgtgcgcatcgcgtggaaatctgcatgccggcggccattgcccgtgaagatgggcatcttttctcctgtaccgtgcacgacttctctgacggtggtctggggatcaaaatcaacggccaggccaaggtgctggaagggcaaaaagttaacctgctgcttaaacgcggccagcaggagtatgtcttcccgacacaggtcgttcgtgtgacgggcgatgaagtgggtctgcagctgatgccgttgaccaaaaagcaacatattgattttgtgcagtgtacgtttgcccgcgcggatacgtgggctctctggcaggacagcttcccggaagataaacctctggaaagcctgctggatattctgaagctggggttccgtggctatcgtcaccttgcagaatttgccccgtcgtcggtgaaattaattttccggtcacttacttcgctggtttcctgggtcgtgtcgttcattcctcgtcgtcctgggcgggatgaggcgaagcaggcggacccggttatggctcaacaatga

SEQ ID NO: 84495 - DNA, 786 bp, Glycine max
  Peptide Sequence Number=SeqID_176180
atgattgcccgctacacgctggacgaagtcaaggacccgcaggcttacggcatcggcatcatggagctgtggcagatcgacccggccaagcatgagccgggcctggtggtgcatgccgccggctggccgctggacagcgatacctacggcggtgcgttcctgtaccacgccgacggcggcaaggtcgccatcggctacgtggtcggcctggactacaagaatccgtggctgagcccgttcgaggaattccagcgcttcaagacacatccgtccatccgcaagcacctggaaggtggcacccgcatcggttacggcgcgcgtgcgatcaccgccggtggcctgctgtcgctgccgaagacggtgttcccgggtggcgcactggtcggctgcgaggccggctacctcaacgccagccgcatcaagggcagccacgcggcgatcaagaccggcatgctgtgcgccgacgccgcgttcgacgcgctggccgccgaccgccagcacgatgaactgagcgcctacccgaaggcattcgaagccagctggctgttcaccgaactgcagcaggccaagaacttcaagcagtggttcaagaagggccagaccgtggccacgctgatgaccggcgtggagcagtggctgctgcccaaggctgggcgtgcgcaatccgccgtggacgctgcaccgcacccagccggatcatgtctgcctggaaccggcgtcccaagcacacccgcatcgcctaccccaagcccgatggcgtggctgaccttcgatcgtctcagctcg

SEQ ID NO: 84496 - DNA, 306 bp, Glycine max
  Peptide Sequence Number=SeqID_176181
atggagtgtgaagaaattgttgatgatgtgactgatggtgtagaagaaatagatcacataggaggtactaaagaaagtggtgatatgataatggatgatagaaggggtgagccagatgcggggttcgatgaacaagccacacaattacctctaggaaagaaagcacttggttgcaagtgggtgtacaaaataaagcataaatatgatggaagtgtagagcagttcaaagcacgggaccttgaggaggttgtgtacatgaagccgccctcttggctttcttcctcagcattatggcatggtgtgtaa

SEQ ID NO: 84497 - DNA, 753 bp, Glycine max
  Peptide Sequence Number=SeqID_176182
atggcaatcgtgcgtgaagcacagtctcgaggattgaccatcccggcggcgaccgcgcagcgagcgctggtagggtcagggattgaggccaccgttgacggtaaaaaggtactgattgtcgcggctggcaagtcttcaaatccagaggtcgaggcgttagagaaagccgggcagacggttgttgccgtcatgctggacggcgtcgtgaaaggcattctggcgctgcgcgataccctgcgtgacgatgccagagaggccgtagcggcgctgcatcagttgggcgtgcagggtgtgattttaaccggggacaaccctcgcgcggcggcggccattgccggtgagctggggctcgagtttaaagccggcctgttgcctgcggataaggtcagcgcggtgacggagctgaacgcacacgccccgctggcgatggtcggcgacgggattaacgatgcgccggcgatgaaggcatccaccattggcatcgccatgggcagcggtaccgacgtggcgctggagaccgctgacgcggcactgacccacaaccgcctgaccgggctggcccagatgatcgcgcttgcgcgggcgacgcgggccaacatccgccagaacatcggcatcgcgctgtggctgaaagggattttcctggacaccacgctgctgggcatgaccggattatggctggcggtgctggcggataccggggcaacggtgctggtgacggcaaacgcgctccggctgttgcgtcgccggtaa

SEQ ID NO: 84498 - DNA, 85 bp, Glycine max
  Peptide Sequence Number=SeqID_176183
gtgcttggcacccatcattatgcaagttgcgaagttccgggacatgccggaaatcaaaagaaaatactgatgcacaatccgcaag

SEQ ID NO: 84499 - DNA, 483 bp, Glycine max
  Peptide Sequence Number=SeqID_176184
atgcatgatggagaaaagagagaacaagagaaagaaaagaatgaggtaccaaagaggaataggaaaaagaagagtgattcacctgagagaaagagtgatacacatgagagaaaatttaattgcttagcaaaggcaactgaagtgaggaaagtgttacttgctcgtgagccactctatctactgtattgcaaagacgatactctgggttccttgttgaaccaatctcaaacttatcaagatactctgggttccttgttgaaccaatctcagacttatcaaggtaacccttgtagcatttaccctgacttatcttccctctttggaagtggcgtcatccaaaactctataacctatatcaagcgatcctctcctagtaaggatcacatcaagtttcctctagtcgatgtattaatcatcctcctacaatctttggtgattcctttcatgaacattgaaatttgcatgaatgggttgtatccatga

SEQ ID NO: 84500 - DNA, 474 bp, Glycine max
  Peptide Sequence Number=SeqID_176185
atggttatgggagatttcatcagcagactctccttccccgcatgtttgcattttagtggagaaaacaccgagactttttcaagtctcacaagttatccagaactacgtaggtctgagttcctcattggaggatacgggggagcaagagctttgcttttgtgggggcgccccataatctttgtcatactgaccctgaggtcatgtgacgtgcacccttgtatcatccagaggcggcggggcccgatgatacgcggagataccttacggttatccgcacccttttgtcatccaggatacaacagagccagtttgcaccttgtatcatccagaggcggcgggcccgatgatacgcggagataccttacggttatccgcacccttttgtcatccagaggcggcgggcccgatgacaagcagagaccaagtttggtcattctgcacccttgtatcatccagaggcggcgggcccgatga

SEQ ID NO: 84501 - DNA, 461 bp, Glycine max
  Peptide Sequence Number=SeqID_176186
atgttggatggctgacattccaagaggatcggcccaacgtgaaaaccaacccgctcgccaatcatggagggggggcggttaacgccattgggtcagataggccgcgtaggtctaaacctttaaaggacgtggcaacccctaggaagtttatctttgaggccctacaaaaagggggtgtgattccccacggtgggcataaagaggactcttgcttgttgcatcccgatgagctatatagcaaggaaacatgtttggcagtagaggaattgttgcagcgaatgatagatcaaggccgactggaagtcagtgatgagggaggagaagagcaacatatatgtatgcagtccgtggatgagagaagttttggaaggcctaaacctttggtgatatatttcaccaagggcacagcttcgcaaaaaccccgacacccctcggcacctaagcttgtccctttcccataa

SEQ ID NO: 84502 - DNA, 493 bp, Glycine max
  Peptide Sequence Number=SeqID_176187
gacaatgtagaggctaacttagattgggaaataagggtggagcaacaacttaaaaagaagtctacttcaaaatcttatggctctcactcttatccaaagaaagaccaaggtcaaggcatcttaggggtgacaccttctaagcccaaagatgataaggggaagacaatagaaaagcaagcccctaaggctagtctacgttcaccttcctctagtgaaagtgaagaagcaaaagaggaagaatctagtgaagaaatctacccccaagaagatggacaaccattaatggttaaggaggagtgtaaggagacacttgttagcattgccacacctcttgggcttgaggttattcctcaagtaaaggagttgttggatgagggggttcccacgaaccctaagagaataaaggtcattcctgagtggctcactccaccaacgccactcattgagttggtgaggaaccatcttccctcatgggaagatgcccaggaaatgg

SEQ ID NO: 84503 - DNA, 480 bp, Glycine max
  Peptide Sequence Number=SeqID_176188
gccaaggggaaggaaaaagaggaaaaggattccgccaagaagattgttaagaaggaaaaccattttgcaacaaaaggtgatatcaaaagagcactccttcttaaacaatccctctaccttctcctatcaagggaaaaatcccttagcactgccatacctcttgagcttaaggttattcctcaagtaaaagagttgttggatgagggtttggtttgtattatgaggcaccaaatccctatgataggtggttgttcacactccgggatacaacttgtttgtgtggatgcgaaatctactggcaagtgcaccgggtcgtcaacaataaatgtgagcaagtgtgaaaacaaatatctaaaggtgttgggtcctcttactgagcaaattgatgcaattaaggatgtttctctaattaaagatgtttttgtgttctatgctgaaggctcaagtactaaacaccgatgtctcatgagtttagcctaa

SEQ ID NO: 84504 - DNA, 433 bp, Glycine max
  Peptide Sequence Number=SeqID_176189
atggcatccaggaaaaggaaaagcgccgcttccaggcctcaagctcaatatgataccaggagattcgaatccttggaagcttggaaccgatacacagataacattctggaccggaggatcctttcggaaaggaatgttaagatttatcataccgaatttgacaagtttaaggcagagttggagaggcataacttacacaaacgtctcaccaatctccaagatggaagcatagatgtagctatggtgaaggagttttatgctaatagcctgggtgagacactgcctacctattccagatttacgaggatgaggattgatcctcaagagtttgttgcccgtctctgcatccttgaaaggggttttgttttgaatgcagagggccacccttggaagcttttgaggaaagatctcaccactcttgcacagacatgga

SEQ ID NO: 84505 - DNA, 198 bp, Glycine max
  Peptide Sequence Number=SeqID_176190
gattcctttgaggagcaggccacacagggatccttcgtcccctatggacgtcaggatgttctcgccgctgctattggacgtccagagcaccttatccgtgtccgtgctgcaggagccggtatcatcatcaagcaatactttggatcggcttcacagacgtcccgcaacgcttcctccctgcctcctgacgaattgtag

SEQ ID NO: 84506 - DNA, 282 bp, Glycine max
  Peptide Sequence Number=SeqID_176191
atggaggtaggacacctgtcacctttcttaggtaggcaaataatccacatggaaaatacaaaaaaagatgaaggggttctcacggatcctaagagaataaaggtcattcctgaggggcccattccaccaacaccactcattgcgttggtgaggaaccatgttccctcatgggaagatgcccaggaaaggggttttcagaccttaccttacttcaacataccaaacaccacttatttttgggccttgtatttagggctctatagtgtagggagggtaccctag

SEQ ID NO: 84507 - DNA, 495 bp, Glycine max
  Peptide Sequence Number=SeqID_176192
atgtaccctcccttgttctctttgaacctagtggatgtacctccactagaactgatccacaagagatgtagcctctcttgttctcagtcaacaacccaagtagatgtaccctctacttgtaccacaaaggatgtatcctccaatatgttaagacaaagatctcaggcggttaaacctttgatactttgtgaatggggatacaaaagaattctcaagcgggagaagggagacacaaaagaattcaggcggttagtccttcgttcttttggaaaagggagaagagagacacaaaaaaaattcaggcggttagtccttggcgaattctttttggcaaagggagaagagatgaaaagaatgaatagcacaatttttcaaggtttagaaaaccagaaaactttggaaagcttttggcataaagaagaagaagttcaaagagattcaaggcttgtaaaggattgtataagattgattggattgatagaaagattgatataa

SEQ ID NO: 84508 - DNA, 411 bp, Glycine max
  Peptide Sequence Number=SeqID_176193
atgtgggcatgggaacgacgcacaagtttggctccaaagaggactcctcctgtaatagaaaataaaccactcggacacaggtggctacgacgtggaaatcaacatatcggcaatgatgatttgttagtttttcgatccaaattggatattatgaaacgacatgagtttctgtgggagccttacacaacaaatgttatgttagtgttgcctccaatttgtttggttggaagtgtagcgtggcgaaaaacaaagatgtttgttgaccctaaaaatgcaaacacaactacattggctgaagttacggagacattacagtacatggtgtctccacaagggaggaatacatggacagttgatgatctcgtgccttatgtggagaaaataacaattttatcggaagagcaagagtga

SEQ ID NO: 84509 - DNA, 306 bp, Glycine max
  Peptide Sequence Number=SeqID_176194
atggaaataattgttggtgttgatgctagttttgttgatactgctagtcctatgggatcaatccatcaattatccaaatctctttttgcaaacttgtcagccccacacgctttaactgtcaaaagagcaaatttgaaactccccattgcgatgatagaagaggttggagtccaggtttggccttggtatggttgtgttggtgattatgaatatgtgatgatgaaagtggtgaagggttttccatggcaatgtgaaatatggatatttcaaggagattgtgaagaagcaatagtctctatgaagtag

SEQ ID NO: 84510 - DNA, 440 bp, Glycine max
  Peptide Sequence Number=SeqID_176195
atgctccccactgggaaggtcaccgccttcaacctctgccacttcttctctaaaactgacccccacgccttctacgatgcgatggattttctatcggtgcactatgacagcaagctggacttggatgcgttgactctaaggggaggacgagtgacggtgatggcaaggcaaagctatagcctcatccttttcaactcagtgttctatgttgtgttgtgtttcactgtgctctctttgttcacactcggtgcttcgctgttgttcttcatttccttgcgctcggttaggttcggtgaaggtgaaggtaccggtgttcagcattgtggtggtcgtcgatggcatacgaggtacgcatttgcgttgggtgtgcgttctggtgtaccgcaggtcgtgcagatcaagaaaacaatctacatgcggatcaacttgatctgtaacag

SEQ ID NO: 84511 - DNA, 1103 bp, Glycine max
  Peptide Sequence Number=SeqID_176196
tacacgccctcaccttcgtagggctacatgccctcaccttcagaggactacacgtcctcaccttcaaagggctacacgcccttgccttcagaggactacacgccctcgccttcgtagggctacacgccctcaccttcagaggactacacatcctcgcctttagaggactatacgtcctcaccttcagaggactacacgtcctcgtcatcagagggctacacatcctcacctttagagggctacacgtcctcaccttcagaggactacacgccctcaccttcagaggactacacgccctcaccttcagaggactacacgttctcgccttcaaagggctacacgtcctcaccttcagaggactacacatcctccccttcagatggctacacgccgtcgcctttgtagggctacacaccctcaccttcagaggactgcacgtcctcgccttcagagggctacacgccctcaccttcagaggactacacatcctcgcatttagagtgttgcatgcccttgccttcatagggatgcacgccatcaccttcataggactccacatctgcgccttcagagaactcaagggatcaagcccacatgacacccagtggacccggagaagtccaacagggctctggggtttccagctctggttatgggcctctgtcaatcctaccgggtgcccatcccccccccaacaagggatcgcgcccgcaagacacccagtggacccggagaagtccaacagggtcctagggtttccagctctgattacgggcctttgtcagttctatggagtgcccgtcgcccccaataaggtcatcagggcccctattaatcgggatttcatcaagaagtattgtgccccccaggcaggcacagggcgagacaccacagcagcctggggatggccagcagcgggcaatagacgcaccgctgccacctctagagcccctcagctcatctacaaaggctggagtgttgcctacgacccatggtcaaccagcaggcgaccaagtccaaagccaaaggtaagcaaaagtactaggtccatgaccaacaagtcatcacgcgtccagcttaagacgttaaagaagcgctactag

SEQ ID NO: 84512 - DNA, 373 bp, Glycine max
  Peptide Sequence Number=SeqID_176197
agaagtccatgaggtggccacggattcatcttcatctactgaaaataaaaagcttgaaggaaaacttgatgccttggtcaacctacaaaaccaacaacaacagaataattatgacctttcaagcaacagatacaatcctggatggagaaatcatccaaatctgagatgggcaagtcctccacaacaacaacagtctatccatccttttcagaatgctgctggtccaagcaagccatatgttcctcctccaatacagcagctgtcacaacaaagaaaacaagcaactgacgctcctcctcaaccttctttagaagaattagtgaggcaaatgaccatccagaatatgcaatttcaacaagagacaagtgtttga

SEQ ID NO: 84513 - DNA, 153 bp, Glycine max
  Peptide Sequence Number=SeqID_176198
atggcaaagtcaatgaatggtacgtcaacaagtgaagaaattgaggtgtgcctaaaagcaagagattcactatggtacttggatagtggctgctctaggcacatgacgggtgacaagtccaaactctctaactttgtgtcaaaagatggatga

SEQ ID NO: 84514 - DNA, 132 bp, Glycine max
  Peptide Sequence Number=SeqID_176199
atggtcaggaacttgatgacgcccatgggggtgcgccacctggtagggaactcccttgtggcccaggctgatcaccgagggggggggggagttacagtgcacgactgggtggcctcgacaattattgcatag

SEQ ID NO: 84515 - DNA, 99 bp, Glycine max
  Peptide Sequence Number=SeqID_176200
atgtttcctcatgggaagatgcccaggaaaagggttttcagagctgatcctactgtgttaaggaaaaaagtccaacgtttcaagaacctcgggatttga

SEQ ID NO: 84516 - DNA, 183 bp, Glycine max
  Peptide Sequence Number=SeqID_176201
atggttgccgcccagctcgcccaggcgagctcagctcgcccaggcgagccagggtttctttttcctagatgtttgatcaactgggtacttgttatggaggactattctgatgtggaggaggatgctttcgaggctgagagtgaagcgaaggagttgttagggacccaggaggacccgtcatag

SEQ ID NO: 84517 - DNA, 189 bp, Glycine max
  Peptide Sequence Number=SeqID_176202
atggcttctccacctgcctcccctcctcctcctcctcctcctccttctcctcctcttgctcctttcgacgcatcggcttcgctgtctgccgtgaagcggacatgcaaagcctcacgtctaccatcattgtctactagaccacctggtgctgagagaccagtggtccatattgatcctgctatcggcaag

SEQ ID NO: 84518 - DNA, 333 bp, Glycine max
  Peptide Sequence Number=SeqID_176203
atggataagagcttgaaggtagaagaagatgagtggagggagaaggagaaaagggaacaaaattttgagagagaggagaggaagaatgaggatactctaaacttttggggtacccttgttgcaacctacccttcggcgggagggcgacgtgaggctcacgggtgcatcttccaagggaggaaaatgcgtggagtcaccactaaggtttatttgagaaaaacgttagaaaaaccaaaagtgggtctacgaactttaagtatgaaagtttcaggagttgtttttacgcacggggaaggtattagcaccccacgcgtccgtcacaagggtcggtag

SEQ ID NO: 84519 - DNA, 417 bp, Glycine max
  Peptide Sequence Number=SeqID_176204
atggccacgaaatacaacaccttcttagtcaaggtcctcatcattgttctctgcattatcctttcaacctatacaccctccttcacagtaacttccatcacagtctccaaattcaacgtcaacacacatgtggagttagcggtgaagttgtcaaactggaacatgaggttgaggctctcgtacccgatgaagtacgccacattaactccacgtaactccgacaacctcattttggagcccaccaacaccagccactacctcgacatcctctcacttgccgcccacccccttgtctacatcaccaccgcctcctccctcgatagcttcatccgtgtcttcattgtcgattcaaacgccaccatcgccaccctcgaggcttctccctctaaagtctggcaaatgcactttgatcccaag

SEQ ID NO: 84520 - DNA, 827 bp, Glycine max
  Peptide Sequence Number=SeqID_176205
atgggtcacggtcaagatgttgtctttgtacggataaccacttgggtatttctgcctgccatcgactcatgggtcaggatcaacagatgttgtctttgtacagataaccacttgggtatttacgcctgccacatgactcatggtaggatcagtagatgttgtctttgtacggataacgacttgggtatttccgcctgccacttgactcatgggtcaagatcaacagatgttgtctttgtacagataaccacttgggtatttccgcctgcctcgtggctcatgggatcagcagatgttgtctttgtacggataaccacttgggattttcagctgccacctgactcatgggtcaggatcaacaaatgttgtctttgtacggataaccacttggatgttgtctttgtacggataaccacttgggtatttccgcttgccacctggctcatggataagcacttgggtattttcgccttccacctgactcatggatcagaatcaacagatgttgtctttctacggataaccacttggggtgcagatgaccacattggtctctgttgtcaatcgaacttggggtctccgaatgacgaggtgcggataagcgtaagggtgtgtgtggattaccgtatagggcatctccgtgtgccacctgactcacatgtcatgatagcaaaaggtggggcgcttctcgctaagccaatctgccggcttagcgagtcattcgctgagcgcaccactcttgtggctgagcacgaggaagaatctggaagaaggatgagctgtgtcgcaacctacccttttgcgggcgagcgaggcgaggctcacgg

SEQ ID NO: 84521 - DNA, 1011 bp, Glycine max
  Peptide Sequence Number=SeqID_176206
atgggattgaatcaagcaccgacttttaagaaaaggttctatcatgtcaaaatcaaaagcatagaagttgccagtttgcaaaaattagggcagcggatgaatcaactccaacgtcaagctttctgcaagacatatggaatgatctgggatttggttatgatagaagtgtttgttgaagccatttcatccttcgctcaatattacgatgagtcgctaagagatcttgggatgctcgctaggaggaagaaagccatatctcttttctgggttatatccctccatggagaggatagccaaagtggtcaaaatctcggcacaagaattggaccgggtgaatgggcttcgttcattaatgtcttagcgctactggtgttcagagtcgtcctctttccgaatgtggatgggctagtggatctagcggcaattgacaccttccttgcttatcaccacagcaaggaaagtccgatcgttgctgttttggccgatgcctatgacacatttgaccgaagatgcgagaagagcggcgcaaggattgtttgttgcacacccgctctttatgcaaattgggagcagctattggctggtatggtaggggcatctattaattggttcccccgatggaaggaaggaggagtcggagttttgtcctcgtgtgagggaggagcgttgtcggaagaaagtgtcatgcctttcatcgcacgaggttttagtgaccccaatgcaaggacgtttcaaaaggttacaaaagcatggagtgcggtgcaaaggaaggataaggagcttaggggaagcagcaatggtatcattgatggttatcacaagctaaaggtctcaagtgaggaagagactgaaacccctgaggagaacgaggaggaaaagttcaagacaacggccactaaggtccggaaagagtgcgacaagttaacagatgtcaacgtggccacgacgaaagcattggaacgggaaacgaagagggcccgaaaggaagaatggggccgaaacaagttttga

SEQ ID NO: 84522 - DNA, 1118 bp, Glycine max
  Peptide Sequence Number=SeqID_176207
cctctgaggaggatttgattttgatgtgggctttccttaccggtcgtcagatcgactgggctcacttggtttggtaccgaatgcataaggcattacgggccaatgcacctctcccttaccctcaattggtcactctatttctctgtgattttcaaattccgcttgatgatgaaccatttgttcaagtcaagcgttcctttgctattggtgctggtgcggtgacttcttttggataccgtgaggattggaatggtcaatggctgaagaaagatgcacttcctcttcaagatgagcgtactccttctcctcctcctcagcgagatgattcagccctcatgactgagttctttccaagttacggggtcttcgttcttatgttggtgaacgtttcggctcgttggatactcgctttgccggaatggatatccgtctcacacagcttgaagaatatgtgggtgtggatcatgcgcactagcatgaccactctgactcaaatctggatgatactcctgctcagtaacatccctcccagtgagcataactttgatcttctgctacccaaatgccagctggtctatagcatcatgacccagattagtgttcttgtggcacaacttatcttggatgccatccacctgtttgtaggtattgcacctctgagacacccagtggacccaaacaagtcaaacaaggcattgggatctccagcattgattacaggcctctgccaattctatggggtaccggtcgcgccgacaaagctcattcagcctcctattaacagatccgtcattgagaaatattgcatgccaaggcagggacaacagctggggcaagaccagcagcagcagctggtagccaaccatagaggccagatgaagttgaatgacagcttctatcagtatacattgcaccatcatcgccaggaccctaacccatatctatggcctactctcaaggaattcaaagccactatcgcatggcctagggataggcccaattttcaggaggaggcatgtcctacaggtgctcaaggagctgcccaagggggcaaaggcggagctgaggtggatggagacatggcagatttgcttgatttcttcattggaggagactga

SEQ ID NO: 84523 - DNA, 255 bp, Glycine max
  Peptide Sequence Number=SeqID_176208
atggcggacaccaacgaggagcacacacaaattgatgaagatgaaccacagattgatgaagatcaaggagctatgaagaataagccacatcattctcactttttcatggatcttaatcttccacaaccacttgaagtgattatgaggagtcaaagaggggagatggatctccataaagtcttgaggaagcatggagataatgttgttgatggtcctgctctaatcctggatgagatctctactgcaaatatctag

SEQ ID NO: 84524 - DNA, 314 bp, Glycine max
  Peptide Sequence Number=SeqID_176209
agaagtattgcacgcctagacaggcgcagggtggtgcaccgcaggccccagacgcaccaccgccacctcatcaagctgatcccgctgggtcatttgacatggagcagtatttacgacatttgagccagggtttcacttcttttccgtgccctactccagatcagttcagagcagaggtcgcatggcccggtgattggcctgaggcccaggtaggggaggcgcccgcagaggctcctggcgatggagaggaggcccgcatggatgaggagatgacagatttgctcgatttcttgggaggcagcggagccacgtga

SEQ ID NO: 84525 - DNA, 342 bp, Glycine max
  Peptide Sequence Number=SeqID_176210
atgtccaaaacttgtggaggtgggatgaccggccctctcgatgagtcgatctcttgctttctcataagggtggacccttgggtacttgtacctatcatctttagaggactacacgtcctcgccatcagagggctgcacgccctcaccattaccctcaccgttgagaggactacacgtcctcgccttgagaggactacacgtcctcagcaccagagggctacacgtcctcaccatcagaggactacatgtcctcgccttgaggagggctacacgtcctcaccttgggtactagttaccctcaccatcagagggctgcacgccctcaccatcagaggactacat

SEQ ID NO: 84526 - DNA, 210 bp, Glycine max
  Peptide Sequence Number=SeqID_176211
atggaggttgatgaaccttggctagggttatggctaccattgaattatcaagtagatatgggagcaagtggtgttcgtcattggaataatgacattgttgggtttggtgggaaacttggccgtacaggaatggcaatcacaacatgggtttctccttcatcctcaccctctttatttgccccagttttctcagtcgtcctagtaggatga

SEQ ID NO: 84527 - DNA, 390 bp, Glycine max
  Peptide Sequence Number=SeqID_176212
atgccgatctccccctacggaaatatcagttggtctgtgccgtcccgacatagggatcgcgcccacaagacacccagtggacccagaaaagtccaacagggccctagggtttccagctctggttacgggcctctatcaatcctacagggtgcccgtacccccccagcaaggtcatgccatcccgacataggtaaggatcgcgcccgcaggacacccggtggacccaaagaagtccaacagggttctggggtttccagctctgattacgggcctctgtcagttcaacggagtgcccgtcgccccaacaaggtcattaggccccgcattaactgggctttcatcaagaagtactgcgcccctagacgggcgcagggcgagacaccacagtag

SEQ ID NO: 84528 - DNA, 192 bp, Glycine max
  Peptide Sequence Number=SeqID_176213
atgactcttccttgtaaattgactttccaaacatttgtcttcgtaggaaatggctccgaaaaagctttccacgaagaggttgtcgcaacctacccttcggcgggagggcgacgcgtggctcgcgggcttttcaaaaatctacacttaaccaataaaagcggaaaagaccatttccaggcgttggacctttga

SEQ ID NO: 84529 - DNA, 249 bp, Glycine max
  Peptide Sequence Number=SeqID_176214
atggagcggtatttccagcacttggttcgccagcaggcggccaaccacagggggcaggtgcagatccataagtgtctctaccagctcagcctcaatcagtttagggctgaggtcgcatggcccggagattggcccgaggaccagacagaggaggcacctgcaggagttccggacggtgcagaggacgcccgcatggatgaggagatgacagatttactcggtttcttgggaagaagcggagccacgtga

SEQ ID NO: 84530 - DNA, 426 bp, Glycine max
  Peptide Sequence Number=SeqID_176215
atgcacgagacattggggtttagctgtccaagagagaacataaaacacaagaacattgttagatctcccataggtagtttagttcctctggacttggaaattgaagctaccttaaaaaggaatagagccgagaggagaacaaagttgttgcaagataggacaacaacttccattctagaagaagaagctcaatcttctgactctacatcatctgattcacagtcatcaagggaatccgctacagatctatcggaagcctttttcatggttaaagaacatcaatacagggttacccttgaggattattctagtagttcagtaccgcaattctttacaagtattgtgaggccagaagtccaagcacataatataaactaccctcattctttgattcatctaatacaggggaacctatttcatggataa

SEQ ID NO: 84531 - DNA, 312 bp, Glycine max
  Peptide Sequence Number=SeqID_176216
atgagtcttcattcttcatctagtgttaatggtgagggttctactcctaaggaccccttgtataagatattagatgagttgagatcccttaagcttgtggaaagaaaaacaagagagaaaagcaaaaggaaattggaacaggaggattgcatatcttgtagaattgatcttaagaagcaagaggcacaccctcatactgtgaaagggagctgtatagaacactccaaattgagtaataagagagaatataagcaccacaatggaacttttttttttagggaggaggaaagaacaagcatagctaatttttaa

SEQ ID NO: 84532 - DNA, 546 bp, Glycine max
  Peptide Sequence Number=SeqID_176217
atgaaactggccaaatacaggctaaaggcccaagtggagaaggacgaaggcccaagtggagaaggacaaagcccccgagtggagaggggtaatccttgtggcgtctaccctgacttatcttccttcaccggaagtggcgtataccctgacttatcttccttcattggaagtggcgtctacccggacttatcttccttcaccggaagtggcgtctaccctgacttatcttccttcacgggaagtggcgtcatccaaatctctgtaacctgtatcaaacgatccgctcctactcagacttatcaaggtaatccttgtggcgtctaccctgacttatcttccttcaccggaagtggcgtataccctgacttatcttccttcattggaagtggcgtctacccggacttatcttccttcaccggaagtggcgtctaccctgacttatcttccttcacgggaagtggcgtcatccaaatctctgtaacctgtatcaaacgattcgctcctactcaggttcacatcatctggtatcagagcttcagctcttga

SEQ ID NO: 84533 - DNA, 375 bp, Glycine max
  Peptide Sequence Number=SeqID_176218
atgaaaaaaaacctgtcgtgcatctcgctgaattatcgaaaagtagcgggggcctctgctcccgtgctcgtcatcgacttttgcaacgagaataacgagcgctacaccctgcgctacaacctgccgccggataccccggaacgcaccgagcggcgggctgggctttttactgggcaatcaggctattctggcaacaacgcacggtgcgagtcggcacgaggcttttacgttggagggccggtggttcacggtgggcaaagtagcgccccaattggcgtggagggtaaaatagggcatcgagcaagatgtgttaaaacatcggttcttctcagcgcaggaaaaaagataaaagaagctccctattacgatctgtga

SEQ ID NO: 84534 - DNA, 723 bp, Glycine max
  Peptide Sequence Number=SeqID_176219
atgtggaaatggttacatcaactggcgcggcctgaacggctgtatcacgtctgcggccgctttatcccctggctggggctggcggcggcggcctgcctgctgcttggctgggcatggggctttggtttcgcgccgaaggattatcagcagggcgacagcttccgcatcatttatattcacgtgccggcggccatgtggtcgatgggcatctacgcctcgatggcggtggcggcgtttatcggcctggtgtggcagatgaaaatgtccgataccgtggtggcggcgatggcgccgatcggcgcggtgttcacctttatcgcgctggtgaccggctccgcctggggcaagtccgatgtggggcacctggtgggtgtgggatgcgcgtctgacctccgagctggtgctgctgttcctctatatgggcgtcatcgcgctgtacaacgccttcgaagaccgccgcctggcgggccgcgccgccgggattctggtgctggtgggtgtggtgaatatcccgatcatccatttctcggtcgaatggtggaatacgctgcatcagggctcgaccaacatgcagcagtccatcgcgcccagcatgcgcaccccgctgcgctgggcgatcctcggctacctgctgctgttcgtcacgctgacgctgatgcgcctgcgcaatctgatcctgttccaggaacgccagcgcccgtgggtcgccgggctggtgaataa

SEQ ID NO: 84535 - DNA, 174 bp, Glycine max
  Peptide Sequence Number=SeqID_176220
atggacatagattatgctataaggaaagacgaaccaactgcaatcacaaatgaaagtagcccagctgacgttgcgctatatgagcggtgggaacgatccaaccggctcagcgtgatgttcattaagactaaaatctcggctgggatacgtggttctgttgaaccagctgaacag

SEQ ID NO: 84536 - DNA, 579 bp, Glycine max
  Peptide Sequence Number=SeqID_176221
atgatattggggaatctcattgctattacccaaacaagcatgaaacgtatgcttgcgtattcgtccataggtcaaatcggatatgtaattattggaataattgttggagactcaaatggtggatatgcaagcatgataacttatatgctgttctatatctcgatgaatctaggaacttttgcttgcattgtatcatttggtctacgtaccggaactgataacattcgagattatgcaggattatacacgaaagatccttatttggctctctctttagccctatgtctcttatccttaggaggtcttcctccactatcaggcaggcttatatttcttagtttcaataggactccttacgagtgttgtttctatctactattatttaaaaataatcaagttattaatgactggacgaaaccaagaaataactcctcacgtgcgaaattatcgaaggccccctttaagatcaacaattccatcgaattaagtatgattgtatgtgtgatagcatctactataccaggaatatcaatgaaccctattatgaaattgctcaggatacccttttttagcttctag

SEQ ID NO: 84537 - DNA, 267 bp, Glycine max
  Peptide Sequence Number=SeqID_176222
ggccctatacccgggttcatgggagcataaggagtggagtccctactgctacaatatgttcttcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 84538 - DNA, 489 bp, Glycine max
  Peptide Sequence Number=SeqID_176223
atggctccgaaaaagctttccatgaagaggtctagaaaggaggccgcgggagaaggttccagtaccaccttggaatttgatggtcaccggtttcggagcgccgagcaccagcagcgctttgaggccatcaaaggatggtcattccacagagaaaggcgcatccaactcagggaagatgagtacacaaactttcaggaggagatagctcatagacattggacgacgctggtgactcccatggctaagtttgaccctgagatagtcttagagttctacgctaatgcttggcccacagaggagggagtgcgagacatgcgttcatgggccagcaatgtgagttcagccagaggaaggatagggccgacgggttcgacgaggaggcgggtgcggatcatgcggatcatgcacaccagggtaggatttcgcccggaccgctctagggaggtgggtgcggatcatgcgcaccagcatgaccactttgacccagac

SEQ ID NO: 84539 - DNA, 1721 bp, Glycine max
  Peptide Sequence Number=SeqID_176224
atggcaggtgcaatccacgccacaaagcaccaaaaactcccacttgcacaacaccaagaggaccaaaataagttctattaccatttcctctacaaagccacactagtcctcatcttcttcgttattctccctctcttcccctcacaggctcctgaattcatcaaccagtcactcctcaccagaaactgggaactcctccaccttctcttcgttggcgtcgccatctcctacggcctcttcagccgccggaacgatgaaacggagaaagagcataacaacaacaactcaaagttcgacactgcacaaactcttgtgtcaaggttccttcaggtgtcatcttttttcgaggacgagagtgagagcccggtcgagtccgataacgaaacaaaagtccaaacgtggagcagtcaacactacaggaacgaacctgtggttgttgttgctgcctctccacggttgaaaaagcattctagttttgatgaccagagtggagataagcctttgcttttgcctattcgaagcttgaagtctcgattatctgatgaagctgaagatgttgatgttcaatctctgaacaggtcgatgaactccaaaagattttcaagcaattcgaatagaaaagcagaagttgaagctgatgctgatgttcaatctctaaataggtcaacaaccttcaaaaggttttcaagcaattcaaacagaaatggagaagttgaagctgatggtgttggtgttgatgttgatgttcaatctataagtaggtcaacaatttctcaaagattttcaagcaattcgaatagaaaagctgaagttgaagctgatgatgttgatgtccatgttcagtctctaaataggtcaacatcttccaaaagattttcatgcaattcaaacagaaacacagaagttgaaagttctagagttgagaacaagaacaaagagagcgtggtgcttccttctccgattccatggcgttcaagatcaggaagattggaacctaagcaagaagaatttgatgatgccttcaacatgatgctttctccttcaaaggaggaatctcgcccagtgaagtctcaaccttcacgtgcttcttcgcgagcaagttcggtgtctccttcgccttctttctcatcagaatcgcttgcgaagaactcagaggactcggtgaggaagaaggccttctacaagtcatgtcctccaccgcctccgccaccgccaccaatgatgtttcacaaatcagtgtccatgaagccaaggtatggtggttcattcaatgaagaaccttccttcaataaggagttgaagagaagcttcaaaagtgagaggaacatgccagtgggaaaaaaaattgatgaagaaaataaacccatgcaacgcacgtcgtttagaagtgacaagatcatggggcatgcaagtgtgcctcttgtgtcacagccagcagagaaagaaagctttcttgtggaatctaatgatgatgaagacgaggatacggaaaccgaggacgaggatgttggaggaggaagaatcattgttcagaatcagaacaatgacagtgggaagggtccacaagttattggtggagaaagttcaaaaacagatggtgatgaaggaccagatgtggataagaaggctgatgagttcattgccaagtttagagagcaaataaggcttcaaagaattgagtgtatcaagaggagtacaaagagtgcaagaaactccacaag

SEQ ID NO: 84540 - DNA, 273 bp, Glycine max
  Peptide Sequence Number=SeqID_176225
atggaagccagaattgaggcttgggtaagggtcaatgaggacaagaaattggcaaaagaggataaccgcataggacaggaaagtccaagcatttttaatggaaaaatcaatggtataatgtcattagctagaagatacaagaagcctaccctagaatacaagctatgtagtaacaaacctctgatagcagcttttcttcatggttataaagatttgaaagttctcctttcaattcagaatgctttctcctgtatatcacagcacatgacatga

SEQ ID NO: 84541 - DNA, 384 bp, Glycine max
  Peptide Sequence Number=SeqID_176226
atggccggaacaaatttcgaggggctttgtggggcagtaacagcgagcttaagctccgaagagaagaaagggaccaatgtcttatgcgagaccgaaacaaacatgttagccatcatcagcaagtaccaagaagaattaaatttagccaccacccacgagcacaaagtggcaaacgactacgcccgagtgtatgtggaaaaggaggctagaggaagggtgattgactcgttacatcaagaagcaacgatgtggatggaccggtttgctcttactttgaacgggagtcaagaacttcccagattgctggcaaaggccaaagcaatgacagcgcctactccgcccccaaggagattcacgggctcctcaactattgccagcatatga

SEQ ID NO: 84542 - DNA, 267 bp, Glycine max
  Peptide Sequence Number=SeqID_176227
gggattgtgcccgcaagacacctagtggacccgaagaagggccaacagtgtcttggagttgccagctctaaatacgggtctctttcagttcaagggagtgcctgttgcccccagcagggtcatcaggcaggcgcagggcgaaacaccacagcagcctgggatggccggcagcgggcaacagacgcaccgccatcacctctagagttcacctcagctcatcccgcaaaaaggttagagcgttgcttacgacccatggccgaccaataa

SEQ ID NO: 84543 - DNA, 438 bp, Glycine max
  Peptide Sequence Number=SeqID_176228
atggatgatatattcaaggacttatggaagctaaagatcccagctaaagcatcaatttttgctgggaggttaattagagatagattaccgactaagtctaatatgcgaaaaaggcaaattgatataaatgacagcctgtgtcctttctgcagcacctcaggggcctatcctataaatccaaggctccattttctgcagcacaacaatgggatgaaaggtgggaagaaatacaataggtggaagtgttggtgggtagctctaaattggtctatttggcagcatagaaataagattattttcacgaatgctccattcaatggcagtaacttgctggaagatgcactgtttttggcatggacatggttcagaacaatggagaaaaattttacaatgcatttcaaatattggtctagcaatctaccagctggttttttgtaa

SEQ ID NO: 84544 - DNA, 1419 bp, Glycine max
  Peptide Sequence Number=SeqID_176229
atggccgggctgcacttcttcaacccagcgccgctgatgaaactggtggagatcgtcagcggtctggagaccggtaccgataccctcgccgcgctgcaggccctggcgcagcgctggggtaagcaaagcgtcgtgtgccgctcgacgcccggatttatcgtcaaccgcgtggcgcggccgttctatgccgaaaccctgcgcgcgctggaggaacgggtggccgacgccgccacgctggacgcggtattgcgcgacgccggcggtttcgccatgggcccgctgcagttgaccgatctgatcggccaggacgtcaattacgccgtgaccgaatcggtgtatcaggcctttctatcaggatccgcgcttcacgccctcactggtgcaacaggagctggtggcggccgggcgcctcggccgcaagtccggccgcggttttctaccgctacgacgcaccgcgatccgccgccgcgatcgccttttgcgcctccggcgcaggccgcactgccgcaacgcgttacgctgcacggcgactgctggccgacgaacgtggaacgcccgtggtgctgttcgatctctgtgccgactatgcgcacgcctcgccattgccatcagctgcgcggcgcaaaacgatgcgcaacacaatgccaaagcgattcgcctgttgcagtccctcggcaagcaggtcattcaactgccggattaccccggcctgctgacgatgcgcaccctggccatgctggccaacgaagcgctcgacgtggtgaacaaaggcgtcgccagcgccgaagataccgatctggcgatgctgcgcggcgtcaactatccgcgcggcccgctggcctggggcgccgcgctcggctggtgccacattctggcgacgctggaaaacctgcaacgctattacggcgaagcgcgctatcgcccaatgccgctgctgcgccgctacgcttcccccgcctctttcccaggagccgaacgatgaacgccaatacgccgcgcgcgctggctcagcgctgcgccgaacagatgttccagcaagatacctgcgctcaggcgatgggaatgcacatcgacgccgtcgacgccggatacgctcaggtcagcatgaccgtcggcccgcagatgctcaacggccaccagacctgccacggcggccagctgttcagcctggcggacaccgccttcgcctacgcctgcaacagccaggggttggcggcggtggcctccggctgcagcatcgacttcgtccgcccggcgctggccggcgaccgcctcaccgccagcgcggcggtgcgccatcagggcaaagccaccgggctgtatgacgtcgagatcgttaaccaacggggcaaaaccgtcgcctggttccgcggccgcgcgcaccgcctcggccacagcattttaggagatcaggcatga

SEQ ID NO: 84545 - DNA, 591 bp, Glycine max
  Peptide Sequence Number=SeqID_176230
atgttgtatttcaatgtaagggtatatgaagagaatgatggtgtaatatttgaaggcagtaaaaaaacgattcagattaaacttgaaattagtttcaatgctttggaaaaaaaaattggagataaggcgcaaccgccaacaaatgtgaacaacttacatggtgatgaagaagatgatgatgatgattatcttgtgtctaactcatacgctgaagagtatttagaagaagatgatagtgttgatggtatatctgatacagacgatgaagtcgccgacatgattcaaccagtaagaattgttcacccagcagaaggtgtacaaggaattgaaaatccattttggaatgatgctttgcattataacaatatcaactggagtcatcctgatgaggaagacatttgtggtttggagatgccatcgagttttaatgttggacaagaattatatgttggcatggattttgatactaaagatgcagtaaaaaatgcattgaaacaatatgttatgaaggtgcatcaaactttcaaagttgttgaaagcaaatcgaacaaagtgtccttgtccgttctatatgagggcaattttatctaa

SEQ ID NO: 84546 - DNA, 360 bp, Glycine max
  Peptide Sequence Number=SeqID_176231
atgaagcaggccgcgcttgcttggcgacggtgcgaacgccctacacccgcacgacacgttgcattcacggccaccgacatccgtactggccacactgcaggttcattccagagcaggaggtgcccgatggctacctgtgatgtgtgcggcaacgactacgacaagagcttcaccgtgcagcagggcgggcgtagcggcacgttcgattcgttcgaatgcgcgatccatgcgttcgccccgcgctgcacccactgcgattgcgccatcatcggacacggtgtcgagggaaacggccagatcttctgctgcgcacattgcgccagtcatgctggtgtaaagggtgtcgcagaccgggcttga

SEQ ID NO: 84547 - DNA, 372 bp, Glycine max
  Peptide Sequence Number=SeqID_176232
ggtgtgcgaaaaaaggcacaaatcttccagaaaccagacactgcccctcgcatgatgtctcgtggaggttatgaatatttagaaaagaagttgatagatgaaaagagaaagaaaaaactggaggaagctgctcaatccagaagcattgacaccgccattgatcctccatcttccatcaaacaacacgtgaaatggaagctagcccgcactaagaaaactggtcacatgacatctgaggcagcaaaagaaattgctgacaagattgatgcatttgaggagcaagcctcacagggttcttttgtcacccaactggaggattcgttcacagaaaaagttactcgacagctaatgttatgctttagccagatgtag

SEQ ID NO: 84548 - DNA, 741 bp, Glycine max
  Peptide Sequence Number=SeqID_176233
gtattccagcccgatgccggccttgccccaccaggtcgaggcgacgcggttcagcgtcttgaccccgcgcactttcaggatgacgcgcagctgcaaatggtcctgcaggttctcgcccacgccgggcaaggcgtggcgcagcgcaatgccgctttcgcgcagacgcgccggctcgccgatccccgacagttccagcagttgcggcgtattgacggcgcccgccgccagcaccacctcgcgcgccgcgcgcacgctggcggacaggccgtcgcggcgcacctgcacgccgacgcagcgcgtgccttcgaacagcaggcgctcggcatgcgcgcccgaacgccttcgcggtgttccacgccagccgcggcgctggttcacgtcgaaatagccgacgccgaagttgtcgccccggttgaagtccgccacgcgcggaatgccttcctgttccgccgcgctggcgaaggcgtcgaggatgtcccagcgcagccgctgcgcctcgacccgccattcgccgccggacgccgtggaattcatcggccccgcgataatggacggatcgccggcgatctcggcccattggtcgtagtcctggcgctgcccgcgcatgtagatcatgccgttgatcgacgagcagccgcccagcacccggccgcgcggatagatcagcgaccgcccgcccagccccggctcggcgccggtgcggtacatccagtcggtgcggggattgcagatgcaatacag

SEQ ID NO: 84549 - DNA, 246 bp, Glycine max
  Peptide Sequence Number=SeqID_176234
atggctcgctaccgtggctctagtacgatcgggtggtcctccctcttcctgttcctgttcaccgccggttcgcccactgctgctttcatagatgtcgtgcgaagggacagagctaatggatacctattccgttctcctgcggaagctgctaaaaagagttcaaatggcgggccgggtggcttcctttcccgattgaaagctgtttcggtggaggggacgaaggagatccagtttacggttctttga

SEQ ID NO: 84550 - DNA, 705 bp, Glycine max
  Peptide Sequence Number=SeqID_176235
atggtcatgctgcacctttggtcatcaagaggcggcgagcccgatgacatccggagacaaattatggtaatccgcacaccttttcggcatccagagacgatcgagtccgatggcacgcagagacaaattatggtcattctgcacctttcgtcatctacaggatgcgagctcgatggcatgcgcagacaaattatggtcatccgcacaccattttgccatccagagacgatcgagtccggtggcacgcagagacaaataatggtcattctacaccttttgtcatcaagaggcggcgagcccgatgacatgtggagacaaattatggtaatccgcacactttttcggcatccaaagacgatcgagtccgatggcacgcagagacaaattatggtcattctgcaccttttgtcatctacaggcggcgagctcgatggcatgcgcagacaaattatggtcatccgcacacctttttgccatccagagacgatcgagtccaatggcacgcagagacaaataatggtcattctacaccttttgtcatcaagaggcggcgagccctattgcatgcgtagacaaactatggtcatccgcacacctttttggcatccagagacgatcgactccgatggcacgcagagacaaataatggtcattctgcaccttttgtcatccagaggcggcgagcccgatgacatgcggagataa

SEQ ID NO: 84551 - DNA, 288 bp, Glycine max
  Peptide Sequence Number=SeqID_176236
atgcaatcatcccttctttggcttccggaatgttaccgaacatcacgaattgtgcaacaatgcttccttttgacttccggcatgttacggaacctcacggattgtgcaacaatgcttccttttgacttacggtatgttacggaacttcacggattgcctaatgatgggtgccaagtacctcgaagtggtcaaacgcgggtcgcatcccaacaaatggatggcccccggatgaaattagggtatgacaatctccttacttcagattacttcttttccaccatgacttag

SEQ ID NO: 84552 - DNA, 329 bp, Glycine max
  Peptide Sequence Number=SeqID_176237
gtgggggtgaagagggtggtggaggtggtgttggttcaagttgtggagtccattgcttgacctatcatttctttcacttaatctctggtcacaatagttgggggagcatagttgagttggaagcaaagcttcatggtgaatcaaaggtgattcaaaggtgttttgatgataacaatgatgataacaaagagttcaagataagaatcaagaagaattcaagactcgagaagaaaatcaagagtcaagaatcaagattcaaggttcaagatctcaagaatcaagatcaagattcaagattcaagaatgaagagaagactcaatcaagataa

SEQ ID NO: 84553 - DNA, 294 bp, Glycine max
  Peptide Sequence Number=SeqID_176238
atgagaaagcgccacgcttcccgaagggagaaaggcggacaggtatccggtaagcggcagggtcggaacaggagagcgcacgagggagcttccagggggaaacgcctggggggcggagcctatggaaaaacgccagcaacgcggcctttttacggttcctggccttttgctggccttttgctcacatgttctttcctgcgttatcccacgattatgtggataacagtattaccccctcagactgacacgataccgctggcggcagcggatcgtccgagcgcagcgagtcagtga

SEQ ID NO: 84554 - DNA, 240 bp, Glycine max
  Peptide Sequence Number=SeqID_176239
atgactatgttagtctctgcgtgctaccggacccttgggtctgacggtagaaatgagactttttcgtggtctcggccggaagatgctgacatcttcgggaaaggtgcagatgactacgttagtctctgcatgtcaatcaggcttggggtctctgaaagacgggatgcagataaccgtaaggtgtctccacgtgccatcggactctcgggtcacaggatagcaaaaaatgtgtgcggataa

SEQ ID NO: 84555 - DNA, 354 bp, Glycine max
  Peptide Sequence Number=SeqID_176240
atggctcaaaaacttggaatccctattagacacaatgctcctaggcaatccatgaagacgcactacctctttgaagaaaagatctaccacatgacaagcgtcgtccaccttgtgacatggaatgaagtgtgccatattggaaaacctatcaacaaccacaaaaatcaaatccttggccctctcggaccttggaataccaagtacaaaatccatggaaatgttggtccaaggggaggtaggaattggcaatggagtatacaaaccatgatgcatgactttggactttgccttatgtcatacaatgcaattagaacaaaacttgataacatcatgtttcattttaggccaaaataa

SEQ ID NO: 84556 - DNA, 183 bp, Glycine max
  Peptide Sequence Number=SeqID_176241
atgcaaatttgtcccaaatttgggggaggtatgaaagctaagtgccaaagaaaaaggggcaagtgtggggaaggaatgaaaaaaatgaaggttattctatggatgaatgctctcctagaacctaagcttttgaatcctagaaaaaccatgaattgttggaagcctaacccattacaagcctag

SEQ ID NO: 84557 - DNA, 249 bp, Glycine max
  Peptide Sequence Number=SeqID_176242
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccaggcgcagcatccaccacgtccgcaaaaatcacacgcttccttggcccctcccctctctcacatcacatccagcgccgccagcaatcatagggttccagtga

SEQ ID NO: 84558 - DNA, 550 bp, Glycine max
  Peptide Sequence Number=SeqID_176243
cgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtaaaaaccttgacgccttccaaggcttctacaagttcaccgccgagatggaaaccctaagccgcctctgccacccaaacatcgtcaaaaacctcagttactgggccttaggccctgaacgcctcctcgtctacgagttcatcgaaaagggaagccttgaccagtggctccacaagcccgatatctctctctccctccccccacttccctggcccatactcgtcaacatcatccgcggcatggcactagaggaagtcatcagacttgcgggtctccacgaaggtaaggttgcggcccaacacctccacggcctccgggatggaagcgtaggggagcattgtcactggaaccctatgattgctggcggcgctggatgtgatgtgagagaggggaggggccaaggaagcgtgtga

SEQ ID NO: 84559 - DNA, 291 bp, Glycine max
  Peptide Sequence Number=SeqID_176244
atggcgagggcgtttagccttctgaaggtgaggacatgcagtcctctgatggcgagggcgtgtagccctctgaaggtgaggacatgcagtcctctgatggcgagggcgtgtaaccctctgaaggtgaggacatgcagtcctctgatggcgaggacgtgtagccctctgaagggcgtgaagccctacgaaggtgataggtacaagtacccaagggtccacccttatgagaaagcacgagatcgactcatcaagagggccggtcatcccaaatccataagatttggacattag

SEQ ID NO: 84560 - DNA, 465 bp, Glycine max
  Peptide Sequence Number=SeqID_176245
atgcttccttttgatttccgatgtgtcacggaaacttacggattgtgcatcaacatttttttggtttttcggcatgtcctggaatttcataaattgcctaatgatgggtgccaagcacctcacaaggaccaaagaatggtcgcacgtcatcgagcaaaggctggtgtagataccattgagatagaatggcttgtgaagactgttgaggaattacgtgcgggtgctgagaagctttcacaaggaaatgatcttcttgcaaagggaatagatgggttttttgaagttgttatgactagtggcgatactttgctcagatctgtgaggattgataaaactgtaaatgatcgttccccaggccataacagagacatgcaagtagttcacgaattatgcaatagcctaactctgcacaagctggatttcaaagatagctttaggggaggactattgacagatactcattag

SEQ ID NO: 84561 - DNA, 75 bp, Glycine max
  Peptide Sequence Number=SeqID_176246
atggctaggagactccaagaagattgtgctagagatataagagaagggatccatagtgtagggaaggtaccctag

SEQ ID NO: 84562 - DNA, 210 bp, Glycine max
  Peptide Sequence Number=SeqID_176247
atggatgcttttgaaaatgagaatgagataaatgtttattttcatcatgaagtagatccaattttagaagaagtcccacagatgttgtacttggaatgtgatccaattccagaagctgtagagaatgaggatcatttagatgatgtacctgttgctggccatgaggaagatgatggtggtggagagagagaggttggtgctggtgagcat

SEQ ID NO: 84563 - DNA, 573 bp, Glycine max
  Peptide Sequence Number=SeqID_176248
atgcaccaaatggtagaatcatctaagaagcgcaaaggttcaacttcaactactaccgctacaagccaacgttgccacggcacttccggtgactctaccgcaccaccaaatcccaccatttcttccccatgctccttaactctattttccttcaacgatcaatgtcaaagtcaaggtgtaccttttgaggacactttggttgatgactggaagcatatttattcaaatcatgatgcccgcaaaatggcccatcttgtccggtaccgtgtgcataaggcattacgggcaaatgcacctctttcatacccccaacttgtcactctttttctccaacattttaatgtccctttagatgaggaaccctttgttaaggttaaatgttcttttgccattggagctgcggctgttgcatcctttgggtatcggaaagatatggatggtcagtgggtatggaaacaagacctttcacctactgttcctgatgaaagtacaccctcaccaacaccacaaagggattcctcgtcttcattgctgcatgatgttctcacaaaacttcaggatcttcgggccttt

SEQ ID NO: 84564 - DNA, 217 bp, Glycine max
  Peptide Sequence Number=SeqID_176249
gatccacgatgtcggatacaatgtcctggacatcctgcccgaaaacactggaggtgctgcacaatgcacaacgcagattttcaggaagaatgatagatctcatccagcacaagaagttgcagtccagaaacgcacactgctatataaacatggaggctgcacgagttcggtactaagtccgggattgaagagttattttgtgagttttgggacttga

SEQ ID NO: 84565 - DNA, 366 bp, Glycine max
  Peptide Sequence Number=SeqID_176250
atggagatgggaggagatctccacaaccacatcaataagttcaatcagctactaatgaggtgcaaacaaatcaaagaggacttgaagaaattgagagatatgaacaaagatggcaccaactcccaaactaatgtagtaaaaagtgttgaagatgaagatgttgtgtttttggcaataaacaatgaggttgctaaaacaaaatgggtgatggattttgctgcctcgaagcacatttgcatagatcgagagatgtttgatactttgaaaaccgatggagaattcgaccatttcaagttagggaatggtaaaaaaatgaagtttggcataggaagtgtgaggatgaagctccatgatggtgttgtttga

SEQ ID NO: 84566 - DNA, 594 bp, Glycine max
  Peptide Sequence Number=SeqID_176251
caccctagtagcaacaatgtatgtaaggttttcttcgacgtaggacaatgtgggttctgtggggttccagcgacgacaatatgggttttccggcactgtagggggttttgtgggttccagcgaggacaatgtgggttttccggcaatgtagggggttctgtggcttcgactgacgacaatgtgggtgttgagggagcagtttccggcagatttcaggcgggaggagaaagaggagcgatttcaggcaggaggatgacaaagagaagagggagggcaagtgctaaagttgatgtctcgctaagcgagctcaatgcgcttagcgagtgtcatccgctaagcgaggcatcaacgcgcttagcgaataggaggaatctggaagggaatctgtcacacaggcacacgctcagcgcgtcattagctcgctcagcgagtcgtttgtctccttccaggcttagcgcgagtttggcaccgagcgaaaattcacttactcgcgctaagcgtgagaatggcgctaagcgtgacgtcgagatttgtgagtttttgagtgattgtgagattcctaaaagtggaggagacatccctactcctttgtaa

SEQ ID NO: 84567 - DNA, 162 bp, Glycine max
  Peptide Sequence Number=SeqID_176252
atggagcatggcataccatgcgatccaccacaactgatgcaatcctaccccccaagcgcgttggatagaagactccaagaagattgggctagagatgcaagagaaggccctagggttctcatgagccttagggtagattttgagcccatgggcttagtatga

SEQ ID NO: 84568 - DNA, 672 bp, Glycine max
  Peptide Sequence Number=SeqID_176253
atgcatgctttgttagggtcattcaacagtggaaactggtctgattctgatgaccttgataggacagggctaagttgtgtactatcccgaggaatcgaggcgtggttaaagatcaaaccttaccaacaaaagtccatcactaaagggcctttgcaaaaattcctttgtcgatatcctggcccgttcaaagttagaagacgtattagggtggtggcccaccttctcgacttgttggcatcagctaagctccattcagtgttccatgtttcacttctatgttgctacatcggaccgccacccacaactctgacgtcccttccaaaggaagtatgctccatcaaagaagaccaagagttcatcgcaacagaaaaagaaaaggcaacatttgaatctccacactcgcctgatgctcaagtacctagtacttggaaagtggaactcaacatcgccctttttgaccaatcaacatcatttaactccaattccaagacagtgtgtctagctagcactcacactactcaagacacaaacacaggctcttctccatcctccgatcaagtgatgattcgtgtgcatcccgctacaagcgaatctacaccgttggcaacaaacacagatgtgccacaacaaattctagacacttctttggtcattgaggacgagaccttttga

SEQ ID NO: 84569 - DNA, 141 bp, Glycine max
  Peptide Sequence Number=SeqID_176254
atggatattttgattctcgccagtcgacttgagctgttcgacaccagttactgcgcaagacgaaggatcattcaatattttggtcaaggatgcggaaaatacccaagggaggggcaaaaaggcgtgagggaggctgagtaa

SEQ ID NO: 84570 - DNA, 393 bp, Glycine max
  Peptide Sequence Number=SeqID_176255
atggagattataattcaacaagctcagggttcaactcaatcaatcatatataagctcaacatgggtgcaagggattcatcattcatgaacaagcactaccaaatttgtcattcaaaatttgctacggaggttccagagggtagtggagtggcaggagtgggagctggtagtgctggtggaggagctggaactggaggagtggaagaagaaggagtagaagtgtcaggtcccctagccctagtcttgcgggttcccagaaaggtgatcatgggatcatccagggctaagggactcaaaagtcagagaatcggatactactcctctggctatgcacaaagctgtaaaatgtgcaagaaagccaagccgagaggagttgaactgggccatctgtaa

SEQ ID NO: 84571 - DNA, 189 bp, Glycine max
  Peptide Sequence Number=SeqID_176256
gtatcgactgctacggattggcaaaaagtacttgccaacttcagtgttactgcaacaaatactgtcatactgctcatcttcggagtaaaaaagtgtcttcctgaatggggtagggtcacacctttttacaataaaaaagagaggttcgcatgcatatcagataatgaacctcgtttgacagtacactaa

SEQ ID NO: 84572 - DNA, 201 bp, Glycine max
  Peptide Sequence Number=SeqID_176257
atgacggatgacagctatggcaagaaagagtctaatagaaaggaaccagctcccaagtaccattatgctccaaagcctgcatttcatcaatcatggcttgtcgccatcctggatgatcaagtgcttcacaaagacgtttggatattcaggttgctgtttggacaaagggacaaatacgggactttaggttctactgactag

SEQ ID NO: 84573 - DNA, 495 bp, Glycine max
  misc_feature (30)..(30): n is a, c, g, or t
  Peptide Sequence Number=SeqID_176258
atggaggcaggataccttctcttaggtagnccatggcaatatgataggaaaatcatctataatggcctaactaatgagataaccctcacccaccttggaacaaagtttgtgttgcatcctcaaacaccttcacggaaaaagaaggatagtaaggccttgtcttcaaaggccaagggaaaggaaaaagaggaaaaagattcctccaagaagattgttaagaaggaaaaccattttacaacaaaaaggaatatcaaaagagcactccttcttgaacaatccttctaccttctcctatcaagggaaacatcccttagcactgccatacctcttgagcttgaggttattcctcaagtaaaggagttgttgaatgagggtatggctcgtaagagcttaaatccttgtgtttttggtacccaaaataggtattatgaggcaccaaatccctatgataggtggtatgatgaatgtgttaagtggtgcaaccttcttttataa

SEQ ID NO: 84574 - DNA, 453 bp, Glycine max
  misc_feature (50)..(50): n is a, c, g, or t
  Peptide Sequence Number=SeqID_176259
gactctgccagtcgttcggagtccccgttgcacataccaaggtgattcgnccgcccatcacccgggcttttattgagaagtactgcacccagagacaggctcagggtgatgctccacaggccgcaggcgcgccaccaccacctcatcaggctggcccggttgggtcgtttgacgtagagcagtatttacggcatttggttcgccagcaggcggccaaccaccgggcacacgtacagacccatgattgtctttaccagctgagcctcagcatgcagagccagggcttcgcttctttttcatgccctactccagaccagttcagggcagaggtcgcatggcccggggattggcccgaggcccaagcaggagaggcacccccaggggctcccaacgatggagaggaggcccatgaggacgaggagatggctgatttgcttgacttcttgggaggga

SEQ ID NO: 84575 - DNA, 402 bp, Glycine max
  Peptide Sequence Number=SeqID_176260
gcgctggcggcgcttctgcccgagtatcctcgcgcccgggcgtggttctcgtttaccctgcgtgatagcgagcacctgagcgacggcacgccgctgcgtgaggtggtcgacgtgctggcaaactccccgcacattgtcgcgctgggcatcaactgcatcgccctggaatacaccaccgcggcgttgaaacatctgcaaagcctgactgcgctgccgctggtggtctacccgaactcgggcgagcactatgatgcggtgactaaaacctggcaccaccacggcgaagcgtgcgagacgctggcgggctatttgccacagtggctggcggctggagcgaaattaatcggtggatgctgtcgcaccacaccgaaggatattgctgagctaaacgcaaagcgctga

SEQ ID NO: 84576 - DNA, 453 bp, Glycine max
  Peptide Sequence Number=SeqID_176261
atggatgaaatagagaaggtgcaagagcagatgaaggctgacccggaggccttgaaagagaaaatggccacaatggtagaggccatgatgagcataaaggagatagtggaggtcagtgcggcttaccaaacccgtgctagagctaaaataatgggtgaagtagagaaggtgcaagagcagatgaaggccgacatggaggccatgaaagagcaaatggtaggcaaagatttgggaagtacggacgaccccatgatgtgcaaattcaaaacgagcacgccttcccatcatatggcttgcctcccaactatacaccacccaatgtggcttacactctcaatgaaaatctcaataactccattccgatactcattgagaaccaataacctcaatctgatcaggcatatatctctcaaaccatgggggagacacatgaaattccccaccaggatctag

SEQ ID NO: 84577 - DNA, 458 bp, Glycine max
  Peptide Sequence Number=SeqID_176262
ccggtgagcgtgggtctcgcggtatcattgcagcactggggccagatggtaagccctcccgtatcgtagttatctacacgacggggagtcaggcaactatggatgaacgaaatagacagatcgctgagataggccaccacttcaagaactctgtagcaccgcctacatacctcgctctgctaatcctgttaccagtggctgctgccagtggcgataagtcgtgtcttaccggcgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagtga

SEQ ID NO: 84578 - DNA, 327 bp, Glycine max
  misc_feature (138)..(138): n is a, c, g, or t
  Peptide Sequence Number=SeqID_176263
atgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcgngcatcagagcagattatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 84579 - DNA, 288 bp, Glycine max
  Peptide Sequence Number=SeqID_176264
atggcacaacctccaccccatgagaggactctaagagaaatggctgcacctgatttcacctacaaaagcttgtgcatccaataccctgatgaggatgtcccatatgttcttaaaactggactgatccatttgcttccaaagtttcatggccttgcaggtgaagacccgcaccaacatctgaaagaattccaaatcgtttgctccaccatgaaaccatcagatgtccaggaggatcacatatttctgaaggcctttcctcattctttagagggagtggcaaaggactag

SEQ ID NO: 84580 - DNA, 549 bp, Glycine max
  Peptide Sequence Number=SeqID_176265
atggttagaactagaagtttaggtcgtactttaggcaaagttataggaagaaccctgaagagagaagataatcgagattcagatgaagcttcccaacggcgaaggcccataacatccgcatgtagacaacaggaagttgtcgttgttgctaaggaacatcctcatgtggatgacgcaattgaagaggaatgtcctgaattgaagctatcctcccatggaagggaggttcagaaattcgggaggcctactgctgagatcgaagggttagtcgctgtcacaggattaagtcctttgattgcatgttcattggacactagcgatcagggacttatatcgacttttatggagaggtggcataaggaaactagtagattccatcttccagtaggagaggtcaccatcaccctcgatgatgtggcctctttgcttcatttgcccatcataggcgcattccacaccttcgagactctttatgtcaacgaaacagtgttgatgttagtggagttacttgaagtcagtggagatgaagccagagctaagacagtatag

SEQ ID NO: 84581 - DNA, 477 bp, Glycine max
  Peptide Sequence Number=SeqID_176266
atgactacaccacctaggtctcctcctcctcctattgatgcaacatcatattccccttctaccttgaagcggacaagaaaagccacacgcctaagatcgttggctactagaccagttggggcagagagacccctggtccatgtggatcctgcgaccgggaaagctgatggtccccacagaaagaagttacgaacatatttggggattgtcgcttgtgataaggtggatgtgacatacgagaattggaaacaagtcactactgcgcagaaggatttaatatgggaggatattcagccaacaagaacagtgtcaatgacactatatgcgaaaagtacaacattagcaaggagaagtggacccaattttgccaaagccgcagagacccttcatgggtggatgtgcgaaagaaggcacatgtcattcggaaacaaaacgctgtccctcacgtgttgtcccatgggggttatgagtttctga

SEQ ID NO: 84582 - DNA, 369 bp, Glycine max
  Peptide Sequence Number=SeqID_176267
atggagaaaatttttcagcactggtcgttgggagcgtcgagaaactccaatagaaggaggaaggtctggtggatagtaggtacaagatccatttggaacttcagaaatgacatgatttttaataatcagcctttcgtcatttccaaattggtggataactcgatctttctcacttggtcatggctgcgggggtgggaaaaggacttcaatgttcctttccaccaatggtcttcaaatattttattcagcatatttgtggtgcttctgcagggttccagggaaaaagatggcagtggtggtgctacaatggctgctgaattcctagaggaaacagtagggctagcagtacagcaacaaggagcagactga

SEQ ID NO: 84583 - DNA, 516 bp, Glycine max
  Peptide Sequence Number=SeqID_176268
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccaggcgtttccccctggcggctccctcgtgcgctctcctgttcctgcctttcggtttaccggtgtcattccgctgtatggccgcgtttgtctcattccacgcctgacactcagttccgggtaggcagttcgctccaagctggactgtatgcacgaacccccgttcagtccgaccgctgcgccttatccg

SEQ ID NO: 84584 - DNA, 312 bp, Glycine max
  Peptide Sequence Number=SeqID_176269
tcccacatcgggttgaagtggaaaggtctccttatgtggtggctcgtggtccacaggtgtacccctcgaatctccccaacaattggtatcagagccaggttcaagttggtgatcgtctcagacgagtatgcaagtaccgcaggtggccagaatggctagcgccacagcatgccccgcaggtggagcggggtgggggagatgtgttgggttacaagtgtgaggtgaagtcccacatcaggtctccttatgtggtggctcgtggtccacaagtgtacccctcgaatctccccaacatcgccctcctgccaaagg

SEQ ID NO: 84585 - DNA, 81 bp, Glycine max
  Peptide Sequence Number=SeqID_176270
atggctttcttgtgcttcttgagaactagcagcaacaagggatgcagagatgattgccagaaatttttccttgtcctccag

SEQ ID NO: 84586 - DNA, 462 bp, Glycine max
  Peptide Sequence Number=SeqID_176271
atggaaagtcattttgcaataaaggcaaacattaaagaaacttcccttcttagacaacctccacatcttctcttttgtaaaaggacacttgttagcattgccatacctcttgatcttgaggttattcctcaagtaaaggagttgttggatgagggtttggttcataagagcttaaatccttgtgctttgttggtgcctaaaataggtattattaggcaccaaatccctaagataggtggtatgatgaatgtgttgagtggtacaatcctctcttgtaaaatcacccatgcacccaacatctttatgattcgcatacataggggctcattaggtagatttgctcttaattttggtttcaatacaaacctaggggctcatatgggacaccttagtgatcaagaggttcccatggaccctaagagaataaagatcattcctgagtggccactccaccaagtataa

SEQ ID NO: 84587 - DNA, 537 bp, Glycine max
  Peptide Sequence Number=SeqID_176272
atggcatcgagaaaaagagttagaacagaagacatcccttcatcatccactccagttcctccatcagtaaccgtaggacaggatgtccaaagctcacaaactttaatccctatgctacaaagcttatttcgaggacagtttattatcatgcacagcctgcaagagttggctcataacaagccaatcataactatggagcattttcttgagcaagtagcctggcctcaagctcaacttccattggtgagacccaacaaggctgctctgcctgagcccacacctgtgcaggttgatccagagccaactgacccacaatctccagtggtgaatccactgtcttctcctgagcgtgaagtagttcccccatctccacctctgattatcatctctgatgcatcatcagatgaagcggctacccctcctgattcaccagccagagaaacagctgaccttcctacttccccagttggaggaattgccgatcttttttattcgccatctggagaagttgttgctctcactgattccccagtttag

SEQ ID NO: 84588 - DNA, 288 bp, Glycine max
  Peptide Sequence Number=SeqID_176273
atgcaaagttcaaaacgcaatgtctaccttggagcctacttgaatgggggacactggcagatggtggtcatcctgcccaaggaatacctagttgtttggttttgttcattgcataacaggccatacaactaccttaaggggataattaacagtgccttaaaaggtcttgatgatgctccacagcctaaatcaaagactgctgctaggtggattgtcgtcaagaccattggagccagagagattaaaggcgcttcggatccagtgggcacaatattatctccgagttaa

SEQ ID NO: 84589 - DNA, 818 bp, Glycine max
  Peptide Sequence Number=SeqID_176274
acgtggcccgcaacggtctgcgtgcctgggccgtgacttccggcaacgaagtgatcgaccgtccgtacgaaacctggaaggacggcatcgacaagtcgttcaccccggaagccttcgctgctggcctgcctgggtgcgctgctggccgccgcctcgatcggcctgtcggcctacgcctcgcacggtgtggccgacccgctggcgcagcagcatctgaacatggcggcgctgtatgcgttcgcgcatggtgcggtactggtggcgctcggaccgcgcgcgcagggagcgatcgcgcacctggcgctgtacgtgctgctgctgggagtgctgctgttttccggcagcctggtgggcggcgcgttgtggcagtggccgacgcggatggcaccgattggcggcaccagcatgatggccggatgggtgttgctggggatcaatgcgttgaggcggtgacggcagcggagatcggccaagcacgacaccgctgcgccgtcagcttctgtagagccgagccatgctcggcttcgagcgaagcgacccgcttttgtctttgctctcttgttccatcctgcggccatgcactgattgccccaggctttcgccacgaggggctcagccgttggccggcttccagcaccagtgccacggttcgtagacgattccgtgcgggttgtcgcgggggtagctcagatggaagccgtgttcaccggcatgggcctgcagccacgcgaacgcgtcggtggcttcgaacgattcttcggccggcgcgtcgcccggcgtgccgatgtccagcgcgtggccgctgtggtgttcgctga

SEQ ID NO: 84590 - DNA, 1095 bp, Glycine max
  Peptide Sequence Number=SeqID_176275
atggaggaaggcacgctttccaaatggcttaaaaaggaaggcgacaaggtcacctccggcgacgtgatcgcggaaatcgaaaccgacaaggcgaccatggaagtggaagccgtggatgaaggcgtcatcggcaagctgctgatcgatgcaggcaccgaaggcgtcaaggtcaacaccccgatcgccgtgctcatccaggaaggcgaaagcgccgacgacatctcttcctctgccaagaaggaagagccgaaggccgaagctgccaattccggttctgatgccgctggcggcaagacccgcgaagcgaccgaagagccgagcgcttccaaggaagccgcgaaggttccggcagcgcccaagatcgaggttgccgctgacccggacattccggaaggcaccgaaatggtgatgacgacgggccttctcgatgagttcggtcccaagcgcgttgtcgataccccgattaccgagcacggttttgccggcgttggtgttggtgcggctttcgcaggactgcgcccgatcgttgaattcatgactttcaattttgccatgcaggcaattgaccagatcgtgaactccgctgccaagacgctttatatgtccggtgggcagatgggcgctccgatggtcttccgcggtccatccggtgcggctgcgcgcgttgctgcccagcactcgcagtgctacgctgcctggtacagccatattcccggtctgaaggtcgtcatgccgtacacggctgctgacgccaagggcttgctgaaggctgctatccgcgatccgaatccggtgatcttcctcgaaaatgaaatcctttacggtcaccatttcgatgtgccgaagcttgatgatttcgttctgccgatcggcaaggcccgcattcacaagcagggcaaggacgcgaccatcgtttcgttcggtatcggcatgacctatgccgtcaaggcggcagaagagctggccgagcagggcatcgatgtcgaaatcatcgatctgcgcacgatccgtccgatggacattccgaccgtcatcgaatcggtcaagaagactggccgactggtgacagtggaagaaggtttcccgcagtcgtcg

SEQ ID NO: 84591 - DNA, 129 bp, Glycine max
  Peptide Sequence Number=SeqID_176276
atggataagagcttgaaggtaggagaagatgagtggagggagagggagagaaggagcatgaaattttgtgcctcaaataagcccactaatccaagatcaagtccaagattctcctctaagtgttcttag

SEQ ID NO: 84592 - DNA, 231 bp, Glycine max
  Peptide Sequence Number=SeqID_176277
atgggtggatctgatgtgacctctcgtgacctctcagaagtagcagcaacttcctatctaacttgtgtctcaccttcctcttcctctacaatgaatgactctggaacggtggcctcagatgacgcatcctctacatgctatgaaggttgggccccaggccaggctaccctctccagaaattgctcaatggaaggaatggatcctggaggcgccaccacctataaactctaa

SEQ ID NO: 84593 - DNA, 426 bp, Glycine max
  Peptide Sequence Number=SeqID_176278
atggtgaaaggaatggacccaaagagtttattttctcgaaggagcatggagtccaaattgaccaagttgcctatggaagtagggattggttcaatgagttcatttaaggatatagataatacagcaagctttgacaaatttccaatggtgaagggtggacccagagagtttattttttcgaaggagcatggagtccaaattgaccaagttgcctatggaagcagggatgggtccaccaaatgcaaggattattgccactccatgaagagagagaagcatgactttggttgtcaaggctggatttccacttcaacaaagcatttgcttctgaagcaatgtcagaagaagcagcaaatgcacagaagtacatcacaagaagcagcaaaagtggttggagcttcatggacagaagcgttggaaatatga

SEQ ID NO: 84594 - DNA, 840 bp, Glycine max
  Peptide Sequence Number=SeqID_176279
atgaaaggaatagatccagagagtttattttcatcaaggaacaaggagtccaaatggaccaagttgcctgtggaagctgggattggtccatccaaattgaccaagttgcctatggaagctgggattggtccagtgagttcattcaagaatatatataattcactaagctttgacaaatttccaatggtgaaaggaatggacccagagagtttatttttaaaaaggtgcatggagtccaaattgaccaagttgcctatggaagctgggattggtctagtgagttcattcaaggatatatataatccactaagctttgacaaatttccaatggtgaaaggaatggacccagagagtttattttcttcaaggaacaaggagtccaaatggaccaagttgcctatggaagctgggattggtccaatgagttcattaaaggatatagataatacactaagctttgataaatttccaatggtgaaaggaatggacccagagagtttatttagatcaaggagcataaagtccaaattgaccaagttgcctatggaagctgggattggtccatccaaattgaccaagttgcttatggaaactgggattggtccagtgagttcattaaaggatatagataatacattaagctttgacaaatttccaatggtgaaaggaatgataccagagagatcattgctggatttccacttcaacaaagcatttgcttctgaagcaatctcagaagaagcagcaaatgcacagaagtacatcacaagaagcagcaaaagtggttggagcttcatggacagaagcgttggaattatgaacaccatgaggaaattttga

SEQ ID NO: 84595 - DNA, 1854 bp, Glycine max
  Peptide Sequence Number=SeqID_176280
atgcatatagatgacctgcgagccttggcacctatgtggctttcaaaaacagaagaagtacgacaagatagggctcactggggagtgaacataactggtgacatatatgaaaaaggatggattagtgagatgtatggatactcttttggtgcagcagaagttggtctccggcacaagatcaatgataacttgatgatttacccaggttatgctccccgggagggagttgagccaattcttcttcattatgggctgccatttagggtagggaattggtcatttagtaaggctgaccatgatgaggatgccatcgtttataactgtggccagctctttcctcaacctccttatcccagggaggtaatgcagttagaaacagaccccaatctacggcgaggactatttttaagtatagagtgcataaacattttaaatgaagctcttctgttacatcatgtggctaacggctgccctaaaccaccatggtctaaatatgtgaactttttaaaaagcaaagcctttgctgaactaactaaaccaaaattagtaactcctgcttctctagaaatgatggaggatacagtacaagaacatattgatcatgatactaccaggccatatcctaaaatccatactgttttttccactgaatgcaccccatactttgattggcagactgtagggcttatgcatagtttccatttaagtggacagccaggaaatatcactagacttctcagctgttctgatgaggacttaaagctatataaaggccataacttggctcccacccattatgtcccttctatgagtcaacatccattaacaggcgactggtatccagcaattaacaaaccagctgcagtcctccactggctcaatcatgcaaatattgatgctgaattcatagtgattctagatgctgatatgataatgagaggcccaattaccccatgggaatttaaagctgcgcgaggcaaacctgtttcaactccttatgactaccttattggctgtgacaatgagcttgcaaaattgcatattagccatcctgaggcttgcgacaaggttggtggtgtaatcatcatgcatatagatgatttgcggaaatttgctttactctggctgcataaaaccgaggaagttcgggctgatagagctcattatgccagaaatataacaggagatatatatgaatctggttggattagtgagatgtatggttactcatttggcgcagcagagatgaaattaaggcatactataaacagagagattatgatatatccaggatatgttcctgaaccaggcatcaaatatagagttttccactatggattggaattccatgttgggaattggagttttgacaaggcagagtggcgagagatcgacatggtcaacagatgctgggtcaagtttccagaaccaccagactcctcaacacttgatcacaatgacgaggataattttcagcgaaaccttctcagtatagaatgcatgaagacactaaatgaagcattgcatctgcatcatgaaaaaaggaactgccccaaagatggttccgtactcgaatccaaagaggacgcgacagaggaaagcataacttcctggaaaatcagtaatttcagtgaaaattttgactcaaaggtaaatcataagtcagcaaatgattctgaggagatggctagtgttcttaaagatgggacagggatacctagttccttcatggttctatttttatgtgcattttctgtatctggtttcttggtcatcatttttttggtgcattctggtcataaaagaaaagggatgaaaatgaaacaccatagaaccaggagaagaaacttgtaa

SEQ ID NO: 84596 - DNA, 1500 bp, Glycine max
  Peptide Sequence Number=SeqID_176281
atgtatgtagcagagaaattaaacaagggagactcatcagcttgtctcatgcaacaacaaccattctgttatgcctctggctttcccaaagaagccaacaagagcaacccaaataatgcacttggacaatcagtctcatttgggaggttcatgccagagtccctggcatgggagaaatggtctactttctctcacaaccgctatgttgaagaggcagagaggtttacacggcccggttcggttgcacagaagaaagctttctttgaagctcactacaagaaacttgctgctcaaaaggcagctgctttgcttgaacaagcaaacagtgcctcacagacacagcaagaacaagaagaggccatagttgataacacgcataatttgaacatgactagtccaaaatctaagctagttctccttgaagaaaatgcacaggtttttaactctgagccagatgccactacctataattcaaattcaaatacagatgctgctttacctcaaagtgacatgttaggaggagctcaaccactgatagatcaccaagcttttgtggttaagttgcaaaatcagcttggaaaagttgataactacaaggagccaagtgaagagggtacaaactttgatcagaatattttgcaatcaacgggcaagaagaaacaagctgtttcttcattcaagttgttaaaagttattggtacccccaagttcaactctacaccagtgaaatcaaaatctcctagtcattctagtaaagatggtattgctaccccaatgagcaataatcctgcactaacctcttctaaaaaagaaggatcaacttctaagttacctcacatgtcacttaatttcacactagttagagaaatcaataaattgaccgtatcattggtgaggaaatttggaagtactggagttggcgctagttcttccaaggcttcaaaggatagctcgactcttataaagaccacaactaaggcttctaagaatgagtctcaaaagcattcttcattaactccgttaacagaagcgcaaagaagtaaaaggaaaacccccattatatcctccccatttaggttgagcaccgaagaaagagcttcaattagaaagaagaaacttgagaaagtgtgcaatgctagtgaatcacagaaagtgcagccacatacaaaattcaaggagaaagcagacacaaagattagaaaactacgtcagagcatttgtttcatagcagggtcatcacctgatttttaccaggatagagaagcatcaaaaaaggatcgattgacacctcctgagtcacccaaagagggaagaaaacccactttaagtgtcgtagagagtaaaagttctttacctcgtaatagacctttccagggaaagaattgtggcaccatgactctgcctcgcacttcaaattcctctatgattactactcatgaaaatacatctccaaatattcagcatagaaatcaaaatgatagaaattacaaacaattttag

SEQ ID NO: 84597 - DNA, 246 bp, Glycine max
  Peptide Sequence Number=SeqID_176282
atgacgaggaccactacgacgcgattagctcagcagtccagcacgacaacgatgacgacaaccaccaccacgcgagtagttcagcgagagtcattttggggggggttgttgtacgacgctgtttcgggttttcatgaactcgtggactcggagcggactcatgagtctactcaaactcgttcgagtctacgcaaattcgaacaagtctattccgatttcgattctacttccgatttaactcgctaa

SEQ ID NO: 84598 - DNA, 366 bp, Glycine max
  Peptide Sequence Number=SeqID_176283
atggttctgatgatgccaaagaataatcaatacaaggttgcttcaacaaacaagcattgcttcaagattaattcaagatcaagcttttgccacaaaacaagtgtttccaaaagatcaaggctttgggaaattcctctaggatcttcaatttgtatcatctactctaaaggagagaaatctttttgttcatctcagaaagccagttgtaatcaagaggctggttgtctattggattgtgagaattgtaatcaagagactggttgtctcatggagaatcttgaacacaagggtgagggatcccaaggtgtattcaaagtctataaaggatttacagagatagtgcaaaatctcaagtgtgttgcttga

SEQ ID NO: 84599 - DNA, 129 bp, Glycine max
  Peptide Sequence Number=SeqID_176284
atggttggctcatggtaccgaatatatgctaccaagaataggaaaatgcaaggatcacgcatgagcgaacatgaaaacaaaaggtatgcagtttgtacaacaaaaagtatgttgaacgcatatgcatga

SEQ ID NO: 84600 - DNA, 186 bp, Glycine max
  Peptide Sequence Number=SeqID_176285
atgaaagaacttagcttagagggtagcgaaccttcgttgatgcattggtatcgtgtgaggagaggtcacggtgataatctcgtaatttctgctgttggttcgcaagggttattggagaagggttctggtaagattgtgctaggttccatgcatgaaggttgtgtgttaatgatctgtggaaagtga

SEQ ID NO: 84601 - DNA, 99 bp, Glycine max
  Peptide Sequence Number=SeqID_176286
atgaattcttgttatgtttattgcaatgtggttggacctgtttgtggagatcttgaccttggtattgtgggactcgatactttcagtgaacatggccag

SEQ ID NO: 84602 - DNA, 441 bp, Glycine max
  Peptide Sequence Number=SeqID_176287
atggaccaattgagtcaaagctatggtctaggatcggtgtatggattccttgagccgcaggctatactgaatgcaaacgataaatgtggacaatgtcaagaatacattgaaaaatggcttaaggaatcgaaccgagatgtctatctaggcgcttatttgaatcatgcatttaacactttggaaaccaagagtgaggggaaatttggtcacagtacaccgcggtggattgaagtgaagagtcacgttcaaagcggaacctatgagtgtggctattatgtcatgcattggatgtggaacataatcgtcgggcagttgaagactaattggacgctgtggttcaatgatggcacgccgctagacatcaacatgatgacaacattacgaaaaaaatgggcagaatattttgtaaaacttagaagcatccaatgtacaaagctgtag

SEQ ID NO: 84603 - DNA, 384 bp, Glycine max
  Peptide Sequence Number=SeqID_176288
atgtatcctctcttgttctcagttacaacaacccaagtagatgtaccctctacttgtaccacaaaggatgtaccctccaatgtgttaagacaaagttctcaggcggttagtcctttgaaactttgtgaaggggaaacaaaagatatctcgggcgggagaagagagacacaaaaagaattcaggcggttagtccttggcaaattctttttggcaaagggagaagagaatgaaaagatgaatagcacacttttgttttctgtgaaagaacaaggtttggaaaccagaaaacttagaaagcttttggcaaaggaagaggaagaagaagaagttcaaaaagatgttcaaaggaaactggtaatcgattaccagagagtaaaaactctg

SEQ ID NO: 84604 - DNA, 138 bp, Glycine max
  Peptide Sequence Number=SeqID_176289
atgtgggtgtcgagggagcgatttccggcagttttcaggcgggaggagaaagagaagagtgatttcacggtgacaaagagaagagggagggcaaggttaaattcaaagacttatacttacagtttttattataggtaa

SEQ ID NO: 84605 - DNA, 315 bp, Glycine max
  Peptide Sequence Number=SeqID_176290
agatattttgccattggtgctggagcggtaacttcttttgggtaccgtaaggatattgatgaacaatggattaggaaacaagatttaccaccaccgattcctgatgagcgtactccgtctcctctgccacagagagatgtttcctttactcttatgcatgaagtcctttctgaactacgtggccttcgagcgttcgtaggtgaccgtttggatgccatggatgcttattttgaaggcatggatacacggattactcagcttgaagacgacatgggtttcattttccgttgcttcgatccaccggctgccccatag

SEQ ID NO: 84606 - DNA, 267 bp, Glycine max
  Peptide Sequence Number=SeqID_176291
atgggtttagctttttccgggatccacaaaattcagaagaagctcaatgaagtggaggatttagcatctaatagaagcctatctgatgatgagataaaggctaagagagaattacaacaagaattgtgggaggcctcaatagcttatgaatctttattaaggcagaaatctagagggagacaagcggagacatcaactcagatcaagaacaggagacaagtgcaggctctattcagacccaggaagctcttaaaatgtggaaaatga

SEQ ID NO: 84607 - DNA, 225 bp, Glycine max
  Peptide Sequence Number=SeqID_176292
atgagacactttgcagcccaggagcctcagccggaccaggaggatgacattctagaggcctcagagcccactgcacctgagcctttcatttttgagactgatccagtagcagctaccccacaggtgacaccagtaccagacctacctctttctcaagattcatcagtagtcactactgcactggacctaaatgagcatgccatggactctgcacaggatcattga

SEQ ID NO: 84608 - DNA, 459 bp, Glycine max
  Peptide Sequence Number=SeqID_176293
atggcagaacaagctagacaagtattttacgggcaagacccttgtgatgaaaggtggtgcgtggttctgcagggcaaaacaattggtgttaatgtagaagatgatgattcatacatggacacctatagacagaggtcaccaaagcaagacttcatacagcttatgtttgtcgccagtttcatcatccaccacccttttcttctctgtcttctcactgtagtttacaaaagcaaaggtgaaacgaaagatattgagctggtagaggaggaacaggcacggattggtgctgatccttctagtgagacctccaataaatctgagaattataaggaggaagcacggaatgcaacacagaagcataaactaaagaaggtagagagtgtcaacgctgatgcagaagcctttggtgatcactggaaaattctgattgctctatgcattctgaagctgaaccactag

SEQ ID NO: 84609 - DNA, 336 bp, Glycine max
  Peptide Sequence Number=SeqID_176294
atgtcggctattgagttttcgattcaatctcttaatgaaataggcatgaggtcggtttaccatcgaggtcgcctttggtatttcgtgggaactcaaccgccgttgtgtttcggtcgacattggcctgcgctgcccgcatctgatgaggacatgttcaagagcaagggcaaggatccacttgaaggacttggaggacctatgacaagggctagagcaaggaaagccaaggaagctcttcaacaagtgctgtccatactatttgaatacaagcccaagtttcaaggagaaaagtccaaggttgtgagttgtatcatggcccatatggaggaggactaa

SEQ ID NO: 84610 - DNA, 840 bp, Glycine max
  Peptide Sequence Number=SeqID_176295
atgacgtcagaggcaccaaaggaaattactgagaagattgatttgttggaggagcaggcatcacaacgttcctttgtctcctatggacgtcaggatgtccttattgttgccattgggcgaccagaacaccctggtcgtgtgcgtgctgttagagccggtgtgaccatcaagcaatactttgaatcgaatccacaaacctcccacacttcttcctctatggctcctgaagaactagagcagctgactcaacaaatcagggaccagttggaggagtcgatcaaagaaaaaggacttgcactgcctctggagcctaaggttggcccctcaactgctcatgttagcataaaggagagttgtgttaatccctcagggaatgatccagacacgagtgattcagacaaatgcgggttgtacatcgaagaaaatattccccacctggttgccctaggaagagtttatgagggatccataaccattcacaacatccctttgttacatgatcaagtgaaggtcagtgttgaggaggttaaagatgcagatgctcccgttcctgtacctactgacgaggttaacttaatggggcactcacttaacaccttccttgcttggctgagacatctcgccaaacgtttatcagaacaaggagttgtgggaccagcaaaacctatagataggctgcatcatgaggttatgtgggatgctaccgtgttcggggtgtttaatgaagacttccccctgccagacaactaccttaaaggaatcattaatagtgctttgaaaggactggacgatactccacaacctaaatccaaggctggtgctaggtggattgttgttaaa

SEQ ID NO: 84611 - DNA, 474 bp, Glycine max
  Peptide Sequence Number=SeqID_176296
atgaacaaaattcaatttgctacatcaaggataattgattcaaagggtgacttcctaaccttgtgtcttttgaaggaaaaattagagaggaagagtggtcaaagagaggaagggaggacgcaggtccaagtgagcgagactttgcgggtaggtttgcactgcggactttgcaccgagaggatgagacataaggcaaagggtttgtgccacaacaacattgacaattgtgacgctattgggggtggtcgtgaagcagcttctacgagagcaagagagacgatgagagcaagaacatttgggtcgaagaactcaagcaatgttttactcattgttgcccccataccaacatcagcagcttcattcaaagattcaactgtcacacaaataggtttagtcaacttcttacccacaccattatcaatagctaaaggttttctccaaaacttatcagtatttctactagcatacaaatga

SEQ ID NO: 84612 - DNA, 366 bp, Glycine max
  Peptide Sequence Number=SeqID_176297
atgagcgtccacgtggctcagttgattgctgacgccatctatttgtttggtgatgcacctcaggccgcaaacgcaccgccaccacctcatcaggccgatcccgctgggtcactaggcatggagcgttatctgcagcacttggttcgccagcagggggccaaccaacgggggcaggggcagggtttcgctccttttgcgtgccctactccagagcagtttagggctgaggtcgcacggcccggagattggcctgaggcccaggcaggggaggtgcctgcaggatcccccgacgatgcagaggaggcccgtatggatgaggagatgacagacttgctcggtttcttaggaggaagcagagccacgtga

SEQ ID NO: 84613 - DNA, 516 bp, Glycine max
  Peptide Sequence Number=SeqID_176298
atgcaattaccgcaagagcccttgaacaagagaccaagagggctcgcaaggaagagtatggccggaacaaatttcgcggagctctatggggtagcaatagtgaactcaagttgcgaagggaagaaagagaccagtcgcgaacacatagcatggtccaaaagaagcttgtctcagcgtttatgcgagacagagaccaacatgctagctatcatcgccaagtaccaagaagagttaggtctagccgcggcccacgagcataggattgcggacgaatatgcccaagtatacgcggaaaaagaggctagaggaagggtgatcgactctttacaccaagaggcaaccatgtggatggatcggtttgctcttaccttgaacgggagtcaagaacttccccgattgttagccaaggccaaggcgatggcagacacctactccacccccgaagagattcacgggcttcttggctattgtcagcatatgatagacttaatggcccacataattagaaatcgttag

SEQ ID NO: 84614 - DNA, 210 bp, Glycine max
  Peptide Sequence Number=SeqID_176299
atggcgttgccatttagcaatattctgccagcgatcgtaatgccgatctccccctgcggaagtatcagttggggtcgcgcccacaagacacccagtggacccggagaagtccaacagggccctagggtttccaactttggttacgggcctctatcagtccacagggtgcccgtaccccccggcaaggtcatgccatcgcgacataggtaa

SEQ ID NO: 84615 - DNA, 96 bp, Glycine max
  Peptide Sequence Number=SeqID_176300
atgaattgcttgcctaacgctgttcatgcgtcgtccgttatcaagcgcagagcctccgagaaagaagaaagagagacgggagtcgtcatagactaa

SEQ ID NO: 84616 - DNA, 339 bp, Glycine max
  Peptide Sequence Number=SeqID_176301
atgacatacggagatgcacccatgacaaaggttcccactacagaatccgttgcaagcacccttaccctctaccgccaactgtttaaccacctcgatcttagcgctttcaatccctcagaactcttagacctggccgcactctctgccgagcaggcggaagggctgtgccacggcctgatgctgtttggccagttactgcaaaaacacccacagctggatgccgaaggctgggaacagctgaatcgctatctcaactccacagcgcatctggttcctgcgttgtgtaacctttatgggcgtgcgctgcgggagatggaaggtcacgctgtagatgaataa

SEQ ID NO: 84617 - DNA, 297 bp, Glycine max
  Peptide Sequence Number=SeqID_176302
atggtagcagacatacttagcaaggcccaagtggagaaggacaaaagcccaaatggagaaggacgaagaccgaagtggaaaaggacgaagtcccaagtggagaaggatgaagacccaagtggagaaggacgaaggcccaagtggagaaggacaaaagacccaagtaatccttgtggcgtctaccctgacttatcttccttcacaggaagtggcatcatccaaatctccgcagcctgtatcaagcgatccgctcctagtccggattacatcatctggtatcagagcttcagctcttga

SEQ ID NO: 84618 - DNA, 279 bp, Glycine max
  Peptide Sequence Number=SeqID_176303
atgccttctttcaccataaaatggcatttctcccagttgagaaccaaattggtctcttcacacctttccaatactctctctagattagatagacaacattcaaacgaggatccaaaaacagagaagtcattcataaacacttcaatacatttctccaccatgtctgcaaagattgccatcatacatctccaaaaagttgcaggagcattacaaaggccaaaaggcattctcctgaaagcaaacacaccaaaaggacaagtaaatgcagtcttatcctga

SEQ ID NO: 84619 - DNA, 285 bp, Glycine max
  Peptide Sequence Number=SeqID_176304
atggagataaaaattggaggtgtaacaagcaaaaagggaagaaaaattgaagaaaagaagaaaatttggagaaggtccaacccaatacgcgcgcgtcacgagctaagcgggccaggaagtacacgcgctaagcgcgcctacgaaggcccaaagcctacttcagcagctataaatagagagccagtccaagggacagaacacatcaccacagaaccccctctcctaggggtttcatttactccctttctttctttcacccctcctctcattgtaaagccctcatga

SEQ ID NO: 84620 - DNA, 1401 bp, Glycine max
  Peptide Sequence Number=SeqID_176305
atgccgccgatggccagagcgtcaactggtcgagcacgcccaagcgcaaggccgcgccgatcacggccaagatcaccccgctgcagaccagcaagctgtcgggcgaccgcacctgccgcctgctggaaggggatttcgcccgcaccagcaccaccgaaacctggaagttctggttctgcaagcaaccggacggcacctggaaggccagctcgaactgagcatcgcggcccttgcatcggccaaagagaacgcccgcgacatcccaggatgaagcgggcgttttgccatccggccgcgcccgtggcgcgggccggcagccgcgatgtgcaccggcgcattcgcgcccagcaggatcgggccgaccgccacgttgccgcccgcggccgtcttgagcaggttgtaggcgatgttgccggcgtccacgttcgggcacaccagcaggttggcctcgcccttgagcgtggaggacggcaggatccgcaggcgcagcgcttcatccagcgcgcagtcgccgtgcatttcgccgtcgatctccagttccggctcggcttggcgcaccagttccagcgcgcggcgcatcttggcgcccgaggccgagctgcccgaaccgaagttcgagcgcgacagcagcgccaccttcggcgccaggaacatgcgctgcatttccttggccgcggcgatggtgaactcggcgatctgctcggccgtgggttcgtcgttgacgtgcgtgtccaccagcaccaccgtgcgctcgttgagcagcaggatgttcatggcggcgtagacgttgcggcccggccggcggccgatcacttcgtcgatgaagcgcaggtggtcgtgataggcgccgaccgaaccgcagaccatgccgtcggcatcgcccaggtgcaccatcatcgcgccgatcaaggtcatgcggcggcgcatttccacgcgcgccatttccttggtgatgccacgtcggcacatgcgctcccagtacgtggtccagtactgatggaagcgttcgtcgtattccgggttggtgacttcgacgtcctcgcccaggcgcaggcgcaggcccagtttctcgatacgggtcaacagcaccgagggacggcccaccaggatgggacgggccaggccttcgtccaccactacctgcaccgcgcgcagcacgcgctcgtcctcgccttcggcgaacacgatgcgggccgggccgccttcgcgcacgatgcgcttggcggccgagaacagcggcttcatgaaggcgccggagtggtacacgaactgctgcaattgctcttcgtaggcttccaggtcggccagcggacgcgtggccacgccgccttccatggcggccttggccactgccggcgcgatgcgcacgatcaggcgcggatcgaacggcttgggaatcag

SEQ ID NO: 84621 - DNA, 222 bp, Glycine max
  Peptide Sequence Number=SeqID_176306
atgcattggatctggaacatcataaccagcgacataaagagtgattggtccatgccctttgatgatgattatcgtagccatcatgggtgccttcatcctttcagaaaaaatatatcttggaggatacgcagcatcagcaggaggattgtggaagattgtctgagctggcaatttcctatagattccttaagacaaagtccttcagataagtgggctttttga

SEQ ID NO: 84622 - DNA, 1695 bp, Glycine max
  Peptide Sequence Number=SeqID_176307
atggcatcaaagaagagaaaggcacctgccacaccttcccaggtccgatatgaacaatccaggttcacttctcctgaggcctgggaaagttacactgacattcttgtacctaggaagctgcttccggaaagaaatgtggtaatctaccacactgagtttgatgagttcaaggaagaactggagagaagaaaatgggatgaggaattgaccagttttgatgaatcacctaagcaggtgatggtgagaggtcatttggtaatcttctggaaagagttttatgctaacatctatgatcccgaggataaatcacctaagcaggtgatggtgagaggtcatttggtgaagtttgatgtagacactctgaacactttcttgaagacccctgtgataattgaggagggggaagagctgactgcctactctagatttgcactcctgaggcttgatcctcaagagttggctgccaagctctccatcccagggagaggatttgagcttaatgttgatggcttgccactgaagatccttaggaagaacataaccatacatgctcaaacttggagtgttctttcttactccaacttggtccctacctaccacacttttgacatcacactggattgggccaacatgactcctctaggcttggatttccaagccttaatcataactttgtgtaaagctagaggagtcacatcagattccagatctttggagagtcttagccctgccattaacttggcatatataaagaagaactattgtaatctagatgatccaatagtgacattcagagggccaaggaaggtaaggggtaagagatctaaggctccctctacttcagcaacaccagatgctcatgctccttcttcatctactttaccagatccttcaacaccacccatttcaactccacatcttccatctgttcctgctccagctcctcctattggaccctcctcattcacttcagagacattatttgccatgctgcagagcctgcacaaaggccagatcatcattcaagaacaattcaagaatcaagagaaatttgatttcaagattcaagaatcaagtttcaagattcaagaatcaagtttcaagtttcaaggtacatcctttgtggtacaagtagagggtacatctacttgggttgctgtgactgagaacaagagatggtacatctcttgtggatcagttctagtggagggtacatccactaggttgttcaaagagaacaaggaagggtacatcccttgtggatctttgcttagctctggccagcagcctgctatgagtgtggaggagttccttgcacaggcctccgtagcccaagagcctgtgccagtagaggagcctatgccagatgcagaggatgagcctgttcctcttgagccatttatctttgagattgatccagttgctcaggaggaagcagcagctcaggagcctacttctccaccatttgcaccagcatcggagccagaccagcctattgttcaggatccatcagctgctccagtgttggatcttaatgaggatgcagaggatcacccgcaggaggattggcaggatctttatcttcttccattagaagaaaaagaacatgtgattagaagtataactgaaaatgttagtcagtttgtcaaattgattgtgaaggaatgcattgaccgtatcccggtgaaagtgtga

SEQ ID NO: 84623 - DNA, 405 bp, Glycine max
  Peptide Sequence Number=SeqID_176308
atggttgatgtggaacctattatggttgaaaagcttggtgtaaatgatcagaaggataaaattgaagatagggatatcaagggtggagataagtccttgtatggatcgtggatgttagttaaaaggaagaatattcaaaagcttcattgtgctcagaaaggttgtcttacaacatctgtcaagagtatagaactcagaagattccttgaagtccatttgcaagatgaagaatgcttctctttgagtacttgtttatggaaatggacaagacatctaggccttatatggaagatttatcagatgctacaaacaaagcatccaacatcagaatggagttatattaaagtctacatcagaatgatgaagaacttgactctaaagactaaacttcagaatggagtttaa

SEQ ID NO: 84624 - DNA, 360 bp, Glycine max
  Peptide Sequence Number=SeqID_176309
atgaggtccttcaattgtgattttccaccatggagatgcagcggagggaaaaggaaaagaggagaggggagacaccatccactagggaataagccatggaagaaggagcttcaccaccaagaatgtgccttagataagaagcttgaagaggatgctttaatggaggaaaggaaagagagaagggggcagcatggaattgaaggaataaaagagggagagaagtggaactttgaagtgtctcataagactttcattcatcaaaaaagagcttcaactttcacaagcaagtcatggtctaaaaaaacttggatcatggacaaaattgtgcctaaggttgtagatgctgatatacttggatag

SEQ ID NO: 84625 - DNA, 447 bp, Glycine max
  Peptide Sequence Number=SeqID_176310
atgaccctttcaaggaatggatgcggatcccataatggatccttcactgaagtctataaaagatcatctccatcgaggaagcaagtgacgagaatattacaagaaattaggagtggcttagtgttaaacagtacttggattcttagattcaatgagagtttaagaagaaaatcaagaagctcattcaaagcccttaaagttgacaattcctctgatgaagattccaaggaagaatttgatgaagatgagctcgcctttatctcacgaaagattgaaggatgtagaagaaaaaagaaagataaagacaaaatctccataatttcctacagatgcaagaagactggacacttcaaatctgagtgcccaaaactggagaagggtcaaagcaagaagaaacactacaagaccaaagaaaagaagggtcttatgagcacttgggaagtctag

SEQ ID NO: 84626 - DNA, 261 bp, Glycine max
  Peptide Sequence Number=SeqID_176311
atgccgttcaaagatcatataaaacttcgtaccccattgcccagaggctcttcactatgcgaagggaaatacagtgaacaacacattgactcagactcagagacatatcttatcttcacttcaactcattgcagctcgcaagttgctttcaaaggaaagcgtgaatggtacaacatccctccttcataccttcgcatagcgaagagccctctgaacaatgggaaatggaaattggagttgaaggagttaattggagcttaa

SEQ ID NO: 84627 - DNA, 168 bp, Glycine max
  Peptide Sequence Number=SeqID_176312
atgaagtcgttgagaggaaaggagatcgcgttggtgaaggtgcagtggggaaccgatgagggtgattctacatgggagttggaggataggatgagagaattgtacccaatgtatgcatatgtgttcttgatagaagtaggaatagtgggggcaagatatgcgggttag

SEQ ID NO: 84628 - DNA, 324 bp, Glycine max
  Peptide Sequence Number=SeqID_176313
atgattgtcatcatgaccactggcattgccaccaacatgaccgttgtcactgccaccgccaccactgccaacaatgacagtcatgttggtggcgacgacagtggtcatgacaacgatcacagtggtggtggtgacaacaataacaatgataacaatcatgaacacggcgaggtgagtgtcgacacggtgggaggacacgtggaggccgtgggacacatcaccaccttcaagaccatcgccaaaacacaccaccgccgccaccaaaccgccaaggcgcaccaccaaacggccagatttagtctcaacggccaaatccaagcctga

SEQ ID NO: 84629 - DNA, 1407 bp, Glycine max
  Peptide Sequence Number=SeqID_176314
atggctagaaccgaagaaaagcttcacattgtaatgtttccatggctagccttcggacacttaatcccaaaccttgaactggccaaactcattgctcaaaagggtcacaatatcagtttcgtgtccaccccaagaaacatagagcgtctccccaaactgtccccaaacctggcttcattcatcaaatttgtgaagcttccactgcccaaagtggacaaacttccagaaaacgcagaagccaccactgatgttccctacgacgtcgttcagtatctcaaaaaagcctacgacgatttggaagaacccttgacccgttttctcgaatcttccaaagttgattggctcttctacgacttaattcccttctgggcaggtactgtggcttctaaacttggtataaagagcgccttttacagcatttgtactccaccgtgtatgggcttccttggtcctccttcagttctcatgggtgaagatcccgtccggacaaaactcaaaggtttcaccgttactccgccgtggatctcttttccgactaccgtggcatatcgatacttcgagatgatgagaaactctgacgccgtctccgataatgactccggaatttctgacatgtaccgttttggtgcggttatcaagaactgtgatattgtagtgattagagggtgtaccgagttcgaaccagagtggtttcaagtgttggagaacatttatcagaaaccggttcttcctgtgggtcaactcatcaacagagagtttgagggagacgaggataacatcaccacgtggcagtggatgaaggattggttagacaagcaaccatgcgggagtgtggtgtacgtggcctttggaagcgaagcaaaaccaagtcaagatgaagtgacacagatagctctaggtttggaggaatcaaagactcggtttttctgggtgcttagggttcaacgtgggccatgggacccagatgtgttacggttaccagaagggttcgaagagcgaaccaaagggcgtggaatagtgtgcaccagttgggcaccacagttgaagatactgagccacgtagcagttggtgggtttttgactcattctggttggacctctgtagtggaggctgttcagaacgagaaacctctgattttgttagcatttcttgcagaccaagggttgaacgcaagagtgttggaagagaagaagatggggtattcggttcctcgggacgaacgtgatgggtcgatcacgagtgacgcgatcgctaactcaataaggttggttatggttgaggatgaaggaagggtctacagggagaagattaaagaggtgaaggatttatttgtcaatactgtcagacaagaaaaatatatcgatgaattactacactaccttagtaggaatctttcgaattgttaa

SEQ ID NO: 84630 - DNA, 486 bp, Glycine max
  Peptide Sequence Number=SeqID_176315
atgaccatccatcatcctaatcaactagccataccccacattgcagtgatacaaaaccctaacgtaactttctctcttatcgtctctagaatacccctccatgtcgctataagaatccccaagcacaaaagatccctattgttaagcaagggttcaaagatgacaggagatctgatgaacacatcctttgagctcacaagctatggtcaatactccattgaaacagatattgatcccttggatgaatccatctcgaggtcctcttcctatgaattctcctctagatcatcctcgggatcttcttcctcgacatcatctttaatgttggatggttgcatagaggtggggcacgatgttgttgggtggttggatgttgtggttcgtttggctcattttaagtctttatattttcatatgtacatcatgcatcatcatatagaggaaagaagattgtttctaaaagttaaaaacttcttcggtgcataa

SEQ ID NO: 84631 - DNA, 591 bp, Glycine max
  Peptide Sequence Number=SeqID_176316
atggtgagcaatccttcaagagcacagaagaaagtgaaaacttctaagaagaagcaagatgaatgctcacaggctgctctcaatcgcttggacaaatggttcacaaatgaaagcaagaagaatggctacaagatgacaggaaccttttatccagagctagtcaaggttttctacacttgtgcacgtgatgaccttaaaggtaaccttttctctactgtaaatgaagtagaaatggtcattgatgcagctgtgtggaaggaagtagctagtctggacatgggtggagtccgcaagttcgatgaaacacctgatgggaacttgaggaatagctttggagttggtggactgactgcaaaggacagaatgttagtttacctcatcacctacactcttactccaaggtcaagtaatcacgctcagagtaatcttctggtagattatgaattttcttatattgtacttgccttaagattcattgactacttcaatgttgatgtctctaatgagattgtggactataccaaagcatccagtgagattaccgaaaggcatctcaagaagcttggaatgaggtttgttgatcatgaatag

SEQ ID NO: 84632 - DNA, 1179 bp, Glycine max
  Peptide Sequence Number=SeqID_176317
atggctggtgccaccaaaaattggcttacgttttcgttgactcccatggaaacgcagttcggtccatacgacatcaccactccctctcactgcttcaacgacaacaacttttatgggtgggcgaattcaaagggtgtgatggattcacagagtgagacccaacaacttgcggtgccgaaaatggaagatttttacttcggtgatcaccagcaagatctgaaggcgattgttcctgggttcaaagcgctctctgggaccaactcggtggatgactcggcccccaacaagacgacgactcgggttgcgcccgctgagttgactggtgctcactcaggcgagtcttgcaaaggatctgctttgtcgttatgcgatgttgctgcaaatggttctgatgatagtaatgataataaggccattgttgcggtggggtttgatactcggaagaaggttgcggttcagttgtcatttattgaaattgaggtcatggtcgtcatgaattttggccagcaccgatggacgggcagatatgaagcgcatctatgggataacagctgtaggcgagagggtcaggccaggaaagggcgtcaaggtggttatgacaaggaagataaggctgcgagggcttatgatttagcagctctaaagtactggggaccaaaagcaaccactaactttcctatctttttccttcccatccctttcactttccatcctccaccggtctacaccgtttactctcctttcctcttttccattgtcatcatcaccgccacaacgaccttggtttcgtggcaaccaccgccatcacctattacatcctttacggaaagtgcgtctccaccatggactttttttgtgagatcgaaacccttggggacacagtcacgcagaatgagaatattgtgcgtcttggactttgatggcggtcgtgccctttgccaacgactatcgtatctcgtcggagtcgtatgtttacatggcaatagacttgtcgctccgccggaggcgttttacagagaagttttgtcagcaatgaggttgaggatcgtgccaaggatacaaaggaggacctccttggtggcttttggcagtgcggaagggaaactgacggcggcgacaacggtgtcgtcggggacgagattttcatctgcggtggatgacgatgacgaaacaatttaa

SEQ ID NO: 84633 - DNA, 681 bp, Glycine max
  Peptide Sequence Number=SeqID_176318
atggagttggatgagttcaaggctgaattggagaggcgtaacttccataagcgcctcaccaatttagctaatagcaacatcgaactagccttggtgaaggagttctacgccaacctctacagtcccgaggggccttccccaaaacaagtcagaatccgaggccacttgataaaaattgatgcagacagcctaaacaccttcctggagacacctatggtactggctgagggagaatccttacccgcctactccagatactgcagaatgtccattgatatcagagagattgaggctgctttatgtatacccggtcgagggtttgttttaaatgctgaaggacatcctaggaagatcctcaggaaagatctgacaactcttgctcaagtttggagtgttctctcatactccaacctggctccaacttcccacacctcggatttgactttagatagagctaggttaatttttgacctagtctctcagctggacatgaatgtaggagctctcatctctatccagatcacatctatagcccagtctaactcctctagacttgggttccctgctcttatcacaactctatgtaggtccagaggggttgcttctgacagcctagtctttgaacgcttgagcctggtcattaacttagcctatatcaggaagaactgttggaacctatag

SEQ ID NO: 84634 - DNA, 93 bp, Glycine max
  Peptide Sequence Number=SeqID_176319
tcggaggaaaaactggaggaatctccggaaaccgctagagatgccactatcgttgtcggaagacacgtgagtccgcttagaagtaagggatga

SEQ ID NO: 84635 - DNA, 363 bp, Glycine max
  Peptide Sequence Number=SeqID_176320
atggcagcgcagttaatccatgattgcatggtgatggagtgcctagagggagtttgggagaccctcgaaggcaatgagaggtgccgattccgtggcacgattcgactcactgctacttcattgatactacctacacctactccatatcgactagtggagcaagtccaagtgatagaggtgtcatcctctgaagaagatcctgaggagaacccagaggagctacctcctgaacctgttgtggatgaccttggcttacctgaggatgatgaagacccactccctgatgttgattctccagaggatatcatgtcagcatctgagcagactctacagaagagacggccctggagggacagcgagtag

SEQ ID NO: 84636 - DNA, 264 bp, Glycine max
  Peptide Sequence Number=SeqID_176321
atggcggctcgtggcggccaccggtgctcgtggttggtggagaaggagatctcgcttagcgagcttgtctcgctaagcgggagtccactttttgcgcttagtgcaactccctctacactaaggcttgctcagcgggccaattctcactcaacgcaattccctctcgggttggaattgcgcttagagcgcccttcgtgcttagcaagacatcaaaagatgttattttcaaaatcccaacggttggactatggggagatgtcttag

SEQ ID NO: 84637 - DNA, 668 bp, Glycine max
  Peptide Sequence Number=SeqID_176322
ggtccagtgccgcctcagagtttgatagtcatcgtttccggagtgccgagcaccagcagtgcttcgagggcatcaggggatggtcgttccacaaggagaggcatgtccagctcagggaggatgagtatacggactttcatgaggagatagctcgcagacgttggacaccgctggtgactcccatagccaagtttgaccctgaaatagccctggagttctatgctaatgcttggcccacggaggagggagttcaggatatgcgctcatgggtgaggggtcagtggattcccttcgatgcagatgccctcagccagttcttgggcgacccgcttgttttggaggaaagccagcagtgtgagttcagccagaggaggaacagggccgacgggaggcgggtgcggatcatgcacactagcatgaccaccttgacccagacatggatgacactgctgctcagcaatgtcatgcctagcgatcacaactccgatctccctctgcctaagttccagttggtgtatgccatcctgacacggatgagcgtccacgtggcccaagtgattgctaacgtcatttatttgtttgcagttcccatcacccccagtaaagtaatccgaccgccgatcacccgagccttcatcgagaagtactgcacgcctaggcaggagtag

SEQ ID NO: 84638 - DNA, 456 bp, Glycine max
  Peptide Sequence Number=SeqID_176323
atgaccgaccctctcgatgagtcgatctcttgctttctcataaaggtggacccttgggtactagtacctatcacctttagaggactacacatcctcgcctacagagggctgcacgccctcgcctttagaggactacgcgtcctcgttttcagtgtgctccatatccacaccttaagagaatataaggggtcacgcccgcaagacacccagtggacccgaagaagtccaacagggtcttggagttgtcaagctctaattacgggtctctgtcagttctacggagtgcctgtcacctccagcaagggcatcaggccccctactaatcgagctttcatcaagaagtactgtgttcccaggcaggcgcagggcgaaacaccacagcagcttggggatggccagcagtgggcaacagacgcaccgccatcacctctagatttcacctcagctcatccataa

SEQ ID NO: 84639 - DNA, 345 bp, Glycine max
  Peptide Sequence Number=SeqID_176324
ggtacatctactagggttgttgactgagaacaagagaggatacatctcttgtggatcagttctagtggagggtacatccactaggttcaaagagaacaagggagggtacatcccttgtggatctttgcttgtaaaaggatttttacaagggtacatctacttgggttgttatactgagaacaagagagggtacatctcttgtggatcagttcaagtgaagggtacatccacttggttgttcaaagagaacaagggagggtacatcccttgtggatctttggcttgtaaaggattttacaaggttgaaagaaatctcaagaaccgttggttgcttgaaaactggag

SEQ ID NO: 84640 - DNA, 332 bp, Glycine max
  misc_feature (323)..(323): n is a, c, g, or t
  Peptide Sequence Number=SeqID_176325
atggccccgaggaagcttgcctcaaagaggtccaggaaggataaagcggccgaaggaaccaccaccgctttaggagcgttgaacaccagcagtgcttcgaggccatcaaggggtggtcatttctccgggagcgacgcgtccaactcagggacaagttcgccggcggtgggcatcactggttacccccatggccaatggatcccgttcgatgcagatgctatcagccagttcctaggatatcctttagtgctagaagagggccaggagtgcgagtatggccagaggaggaaccggtccgatggttttgatgaggaggccatcgnccaattgct

SEQ ID NO: 84641 - DNA, 564 bp, Glycine max
  Peptide Sequence Number=SeqID_176326
ttaggccaccacttcaagaactctgtagcaccgcctacatacctcgctctgctaatcctgttaccagtggctgctgccagtggcgataagtcgtgtcttaccggcgccacgcttcccgaagggagaaaggcggacaggtatccgggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 84642 - DNA, 267 bp, Glycine max
  Peptide Sequence Number=SeqID_176327
atggtggtcttgtgcaaattcagaagaaggcatcaaagagcaataattgacatttatgtgggaaatttggacacttccagaaggactgccccaagtcttgattcgaaaagaaagggattccttataatccaaaccataagtccaaatgagaagttcgtcttcatggggaatagagtgaaatctctagtggaagtagtcaagacttatcgtttaaaacttgacactggtcatcatttagatttattggaaactctttattttatttaa

SEQ ID NO: 84643 - DNA, 619 bp, Glycine max
  Peptide Sequence Number=SeqID_176328
atgagaggccctctcaaagagtcaacctcttgctttcttgtaaggttaaagtcctttggtacttgtacctattggctcgcctttagaggactgcatgtcctcaccttcagagggctacacgccctcgccatcagaggactgcatgtcctcaccttcgtagggctacacgccctcaccttcagaggactacacgtcctcgccttcagaggactacacgtcctcgccttcaaagggtcatggctgcatgtcctcacctttgtagggctacacgccctcacctttagaggaccacacgtcctcaccttcagagggctacacgccctcgccatcagaggactacacgtcctcaccttcgtagggctacacgccctcgccttcagagggctgcacgccctcacctttagaggactacacgtcctcgccaacagagggttgcacgccctcaccttgagaggactacacgtcctcgccagcagagggctgcacgacctcaccttgagaggactacacgtcctcgccaatagagggctgcacgccctcacctccagaggactacacatcctcgccttgagagggctgcacgccctcacctttagagggctacgtgtcctcattttca

SEQ ID NO: 84644 - DNA, 346 bp, Glycine max
  Peptide Sequence Number=SeqID_176329
atggggttgttggaataccgaaaggagaatgctgaactgagagatataaatgtagctaccaccaaagccttggaacaagaaaccaagagggcttgtagggaagagcacgactggaacaagtccaaaagaaacttgtctcagtggttatgcgaaacagagaccaacatgctagccatcgtcagcaggtaccaagaagaactaaatctagccacgacccatgagcatagagtggcggacgagtatgcccaagtgtacgcggaaaaggaggctagaggaagggtgatcgactcgttacatcaagaggcaacaatgtggatggacctatttgctcttaccttgaacggga

SEQ ID NO: 84645 - DNA, 1159 bp, Glycine max
  Peptide Sequence Number=SeqID_176330
tcctactctgagcgtcggtgtaagccttatagcaagaggacacgaagtaaaatggttcgggattacccagctaggagatgaacatattccggaaggaggatcgtatttctaccctgaagaagatcttattccgtatcaggatgagatcaaacgtattttaaaaagacaggatgatggacccgcctgttccgggcctgaagttatgaaactggcattagaggaaacttatgttccttttgccaaaatgatgatgccgggattaagccgtcttactgaaaactggaaacctgatgttatcgttaatgactgtattactttcggaggtgccctttttgctcataaacacaatattccatgtgtaacaactactcctgtacccccggatgttatgggagatacagaaaaaagtgctccgaaaatatttgaatggcaacaaaacctcatcaaagatctacaaaaagaagtggggattgatgatgatggaatttttatccattcccataaattaaaccttgtatttacatctcaggctttcgcaggttttgaaacagtacctgaccatatgaaatttgtaggtcctgtgaaaggacgtcccaatgatgctccttttgactgggatcgtttgcatgcggctactacacctaaaatatttgtatcattaggaacactccttgtagacatcagaaaagcctttttcgaaaagatcattgcggcattctcggatcagccggtaactatcgttgcggccacgccaccggatatttttgaagaatggccttctaatttcattgtaaacagttttgtacctcaatcggcattaatgcctcatatggatatggtaatttgccacggaggttttaatacagttaatgatacattccgtaacggattaccaatgctgatcacaccgattgcctacgatcatttccacatcgcaaaactcatcgaacaggctggttgtggcaagagtatccgttataaaagattacgcatagattcactccgtgaaacggtttttgaattgctggaagatcctgcttaccgcaatgcagcaaaagaagttcagacaacattccttactgccggaggtaatgataaggctgtagagctactggagaattttgtacaacaagaacaatcaacattagtttctgtttaa

SEQ ID NO: 84646 - DNA, 228 bp, Glycine max
  Peptide Sequence Number=SeqID_176331
atggattccttagaggagcagacctcacagggttcttttgtcgcccatggacgtcaggatgtgctgattgctgccattgggcgaccagaacaccctggttatgtgtgtgttgctggagccggtgtcatgatcaaacaatactttggactgaccccaaggacctcccacacgtctttgttcatggctcccgaagacctggagcagctgacacaaaaaatcaaggactag

SEQ ID NO: 84647 - DNA, 558 bp, Glycine max
  Peptide Sequence Number=SeqID_176332
atggatgggcacattgatgtggccctagtcaaagaattttacttgaacctgtacgaccttgaagacaaatcaccaaaacaggttcgagttaaagggaagttgataaagttctatgcgacatcgctaaatgcctttctagagacaccaccacttatccagccaggggaccagtacccctcatattccatcttctgtaggatgcgcactgatcctcaggagcttgcctccaagctttgtattccagggcacgaatttgttcttaatgctgaaggagcgccctgggagctcttgaggatggacttgaccaccctggcccagacttggagtgtattatcatactctaacctcgccaccacctctcacacgttcgaccttaatatggacagggcgaggttattccatgggctagttatgaagatggacatggatgtgggcttcctcatatcacatcagatcttgcaaatggcccaatccaactcctcacggctcggtttcccaaccttgatcaccgcattatgcgtagcccaaggagttatctcagattctctgactttctag

SEQ ID NO: 84648 - DNA, 428 bp, Glycine max
  Peptide Sequence Number=SeqID_176333
gatttacacgcaattctcctcaaatttcagccagcccgcatcaattagaccttgcaccttacgcttcagagccctacaatgctcaatggaacgccccggggcttctccgtgacaagcacacgttgcgttcgagtcgtattctcggagaaatggaggttgatgaaccttggctagggttatggctaccattgaattatcaagtagatatgggagcaaactttgtggttgatttagggatggcctttgtggataaatgggcggtaggtaaggagaaggtttgttattggctgagtaatgacattgttgggttggtgggaaacttggccgtacagggatggcagtcacagcatgggatgattaaatttgcctcctttcagatccacttcgatcctttcactggcgaagaccaaatccgcaaagctttgagg

SEQ ID NO: 84649 - DNA, 320 bp, Glycine max
  Peptide Sequence Number=SeqID_176334
accttgcaccttacgcttcagagccctacaatgctcaatggaacgctccggggcttctccgtgacaagcacacgttgcgttcgaatcgtattctcggagaaatggaggttgatgaaccttggctggggctttttcactgcaaaattcatttcttggttggtgttttggtttatgctaaagggatggcctttgtggatgactgggtggtgggtaatgagaagggttgttattggctgagtaatgacattgttgggttggtgggaaacttggtcactcactttgatcctttcgtcggtgaagaccatatcatcaaagcttga

SEQ ID NO: 84650 - DNA, 106 bp, Glycine max
  Peptide Sequence Number=SeqID_176335
gttgttaaaattgcaaacacttgaccagacacttgtgagcagagagaaacaccagctttgtaaggaagtaaggcaagccggacctgttggaattccagataattga

SEQ ID NO: 84651 - DNA, 1203 bp, Glycine max
  Peptide Sequence Number=SeqID_176336
atgctgatctttagagagcttgctagaaggcccaaaaggggtaacaaccttgaaaccttagggttaattagccttcgttacgatcaaatccaaaagattgagaaattgccagaacactggagttcctacaaacttacgctcagtgactggcacgattttctaaaaatctgtattgattattacgtaagagcgggaagctcaattgagacaaacggaaaaccatggcgcgactggctatccttgcgattacctcagacctggcttaaacctcaagatgcggagccagctaaagggattaggttatggcctaaagtcaaacgtgcgaactcaagatcgatcttagttaacctattacaaaatgtactaaatatcgatgcttcaactgcctatggtgaagatattgttgattcaatattaaattctgcgtggaaagcgctagagtcaaatatctttaaatcgtcttcttctggatacttactgtcactggagagtgtctcttttgccattccagaaaaactttggatttgcccatacacccgccgctttcttgatacgaccttaaatggtttcagcccatatacgccattaacagagaataagcagcgctctgaacgcgttgatatgccactgtttcccgatgacatcgatatctcatcgccaacgtttacgattagtgcaagagaatggattctgaaaaaccaacaacttgggctatttagagaggatgcactatggtctacttatgcagaccaagtgttggagtctgcgccgttttataaaaccgcagaacattccgcacaacaaaaatcatcggtgttagatcaatatgaacgtgagtttaagtccggtgacatcaatattctctcttgctctaccaccatggaaatggggattgatattggtggcatacaacttgtcgcgatgaataatgtgccccctcatccagcaaactatttacagcgtgctggacgtgctgggcgacgatctgaaacaaaatcagtctcactcactttatgcaaagccaacccgcatgatcaaaatgtctttaaccaaccgctctgggcttttggaaacaagtttccaacgccaaaaatggcccatggcaaaagtatatcaatgcatttagcctcgcaacaggtcttaaatctcagatcgatcccgttatcaagcaactggtcagaggttcaccatttgaagggctaa

SEQ ID NO: 84652 - DNA, 1054 bp, Glycine max
  Peptide Sequence Number=SeqID_176337
atgaacaaaaacagagggttaacgcctctggcggtcgttctgatgctctcaggcagcttagcgctaacaggatgtgacgataaaccggctcaacaaggagcccagcaaatgccggaagtcggtattgtcacgctcaaatccgcacctctacaaatcaccactgaacttcctggtcgtaccaatgcttatcgtgtcgcagaagtccgtcctcaggtaagtggcattattctgaaacgtaacttcactgaaggcagcgatattcaggcgggggtgtctctttatcagatcgatccggcaacctatcaggcaagctatgaaagcgctaaaggcgacttagcgaaagcccaggccgccgcaaacatcgctcagttgacggtcaaacgttatcagaaactggttggcaccaaatacatcagccaacaagaatatgactcagccgttgccgacgctcagcaaagcaacgccgccgtcgtcgcggcgaaagccgcagttgaaaccgcgcgtatcaacctggcttataccaaagtgacgtcgccaatcagtggacgcatcggtaaatccgcggtcaccgaaggcgcgctggtgcaaaacgggcaatctaccgcgctggctaccgttcagcagctagaccctatctatgttgacgttacccaatcgagcaacgatttcctgcgtctgaaacaggaactggcgaacggtaaactgaagcaagaaaacggtaaggcgaaggtcgaactggtcaccaatgacggtctgaaatatccgcaagagggtacgctggaattctccgacgtcaccgttgaccagaccaccggttctatcacgctgcgcgctatcttcccgaacccggaccacactctgctgccagggatgtttgttcgcgcacgtctggaagaaggtattaacccggatgcgctgctggttccgcaacagggcgttacccgtaccccgcgcggcgatgccagcgtgatggtggtcggcgaaggcgacaaagttgaagtgcgccaggtcaccgcgactcaggctatcggcgacaagtggttagtgaccgaag

SEQ ID NO: 84653 - DNA, 375 bp, Glycine max
  Peptide Sequence Number=SeqID_176338
atgtcgatctccccctgcggaagtatcagttggtctgtgctgtcccgacatagggatcgcgcccataagactcccagtggacccggaggagcccaacagggccctagggtttccagctcgggttgcgggcctctgtcagtcctacagggtgcccatcccccccaggatcgcgcccgcaagacaccctgtggacctggagaagtccaacagggtcttggggtttctagctctgattacgggcatttgtcagttctacgaagcacccgtcgccccaacaaggtcattaggcgccccattaaccgagttttcatcaagaagtactacgcccccaggcaggcgcagggcgagacaccacagcagcccggggatggctga

SEQ ID NO: 84654 - DNA, 806 bp, Glycine max
  Peptide Sequence Number=SeqID_176339
acttggtctacgccggagaaaggatcaaggtgggtttgatgagggtaaagtttgattacgtctccccgataggtgccagtagtaggaggactagaatagctggggcaaagaagaaagagggagatgcccataccgttacttcaacacctgcgtggcccaagccaccacaaaccccccacggtacccaccaatatgcacaacatcacctgagtttttcggctcgtgccgaggcctcttccgatacagcactcacccacaggggggagctcttcaggctccggctccgactcggcctcactcggccaacaacgctcactttgacgcaaacacggcgaggaacttttcacctcgatcccaatgacatatggggaactcttgccatctttcatcaccaaccaattggccgtggtggtcccgggaaagatcatctggtctccattcccaaaatggacgggcccaacataaaaatgaacccgcttgccaatcatggaggggaggcggttaatgccatcgaggtgagtaggtcacacgggccaaagcttttgaaggacgtaacgacccccggaaggtttatcaacaaagtcttgcaaaaggcgggcatgattccctgcggcgggcgcaaagaagattcttgcttaatgcatccgggtgtactccatgacatggaaacatgttcggcgataagagatctattacaacagatgataaaccaaggccggcttgaggtcggcagtaagagggaggaggaacaacatgtatgcatgcagtcggtggatgaagaaggacctaaaatgcctaaacccttg

SEQ ID NO: 84655 - DNA, 627 bp, Glycine max
  Peptide Sequence Number=SeqID_176340
ggtcatgttgcgccgatgagaacaatttcctcttccttcgacgaaggcattgatgagcaagtttgtgacgcgtgcgttatcatcatagaacttgttatggtggctggcctcaatttgcacaagggacttcacaacgaggatgctattggtggtgttgacgttgtcgatgataggatctggtcatcggagatgaaaggaccagtcactagagccatgagcaagaagctccaagaggattgggctagagctgttgaagaaggtcctagggttctcatgaaccttagtggtgtctcctctctctcttccttctccattccgctgccattcatcttccaagaaataaaggaatccattgataaagaagatcctaggcctacaagctccaatgaagcttacatcatgtgggatgtgacaaagagccttgcagctgttacaactgatattttgtggattcagactttactcaatgaacttgcagctccttatctcactcctatggtgctttgtgataattccaatgttgtgcagatggctcatggtccagttcttcatgctaaaactaagcatatggagttggatctatctcttctttgtcagagaaaaagtcttgtccaagaagctgattga

SEQ ID NO: 84656 - DNA, 1582 bp, Glycine max
  Peptide Sequence Number=SeqID_176341
atggctaggaaaaaggcctctctagactctgctatagaagaagagcttagtgacaatgaatccttggtagaaaagaagacaactaggtcatctaaaactaagaaggagacgactaggacaaggaagaaaacaaaagatgagtctcctggagatacagatagcgcctccattgaaggaagcacagctgcctctagtgataattccaagaaaactcaaaggactcggaaaaaggatgcatctagttctgctggcttggaagaaaagaaggaagtcaaggaagagaaaaaggttagaagacgaaagaaaactgaagaggagaaattaattgtagaggataaaggtagtgaagctgaaatcagtgaccaagatgagccttcatttcttgaaaatgtggaggatgatagtgacagtggcttggaactgataaaagatgatggagaggacattagctttacttatggatggcctcctcttgtttgttgctttggagctgcgcagcatgcttttgtgccttctgggagacctgccaataggcttataaatcatgaaatccatgaaagcatgaaggatgccttatggagccctgaaaattttgttagggcacctgggagctctgctggtagtgtggccattgcgcttgctacattgggtggcaaggttgctttcatgggaaaacttgcggatgatgattatggtcaagcaatgctgtactatatgaatgcaaataatgtccaaacccgatcagtgcgtattgatagtaaaagggcaacagctgcatcgatgatgaaggttggtaaaaggaatcgacttaaaatgagttgtgtaaaaccctgtgctgaagatagtttgacgaagtcggagctaaatattgatgtgctgaaagaggcaaaaatgttctacttcaatacacattccctgcttgaccgtaacatgaggtcaactacattacaagccatcaagatttcaaagcattttggaggggttgttttctatgatctaaaccttcctatgccactatggcactctagggaagaaactatgatgttcattcagcgagtgtggaatctagcagacattattgaggtcacgaagcaagaactagagttcttatgtgggatcacaccatttgaagaatttgacaccaaaaataatgctaggtcgaagtttgtacattatgaacctgaagtggttgccccactttggcatgaaaatctaaaggttttatttgtgactaatggaacttccaagatacattactacacaaaagagctcaatggtgctgttcttgggatggaggatgccccaattaccccattcactcgtgacatgtcagcaactggagatggcattgttgcagctctcatgcgaatgttgacagttcaacctgatttgttaaccgataaaggatacctggaacattccataaagtatggaatcgattgcggggttatcgatcaatggatattcggccgcgtacggggctttcctccatgtgaagatatggaggaggacataattcctgacccaaatggcattagatcaatttcagaaactgaataccgcacagcagtagggtctgcta

SEQ ID NO: 84657 - DNA, 228 bp, Glycine max
  Peptide Sequence Number=SeqID_176342
atggaacgaaggaggaggaggagttttatagggaggcgtggaaggaagtatctggcagaccaacacgtgtggtcgcgcctgcgaaggtcacgattcaacggaaagaaagctttgcctctgagtgattattgtgctgctcgtaagcaccgatgttggagtcgggtgattaccagtgcaaggcacatgttagctatgcagtggctgctgaatattggggacaaggagtag

SEQ ID NO: 84658 - DNA, 1077 bp, Glycine max
  Peptide Sequence Number=SeqID_176343
atggatcggagctctttctcaccgggaaccggaaaaacccgaaccaaaccggacatatactctaccttcgtggtccacgacgacgaagacgatgacggaggaggaaccttccggcgccggaaatccggcggcggcgcgcagccacaggacgatccgtacgcgacaatggtgttcaaagacaacggccacgacgacgaggacgacgaagactcctctcttcctccgctcctcaagcgcctccccaaggacttcggcggcggagcgccgctggactacgacgacgaagacgatgacgccggcgacttcggcacaatgatcgtgaagtccgaccggagccggcagcgcgaccggccttcttccggcgtggcttcgccagcgtggaaggctcggagtcctctgaacagattcggtggcggcgatgacgacggcgatgacgacgacgacgacggaggaggattctcgacgttcgtagtgcgatcaacggtgaagtccggcgagagagagtcggtgagcggaaccgtggttcgacggaccagtggcggcggcagcgtcggtgtcggtgtcggtgtcggttcgacgatggagagagcggtggcgagcatgcaagggatgggagagttcggattcggaaagcagaggaagggaagtggatcttcgcagaacgatgaaggaaggcatcaatcgataacgacgaaggtttcgacgagttcgatccctgatagtgttaccagagaggaccctacgaccaaatacgaattgctcaatgaacttgggaaggggtcttatggagctgtttacaaagcaagggacttgagaacctcggagatggttgctatcaaagtaatatcgttatctgaaggggaggaggggtatgaggaaatccgtggtgagattgaaatgttacaacaatgtaatcatccaaatgttgtccgttatcttgcaagctatcagggagaagagtatctttggatagtgatggagtattgcggtggtggtagtgttgctgatttgatgagcgtgactgacgagccacttgatgagggtcaaatagcatatatctgtagagaggcactgaag

SEQ ID NO: 84659 - DNA, 852 bp, Glycine max
  Peptide Sequence Number=SeqID_176344
atgaccatgattacgaattcgagctcggtacccgtgaaagcagacatggttggactaggtcgtagccttgagcaattctgggaagatgcggatatggcagtgatcgatgatgcctaccgccgcgctgcacgtatctttagcccagctattgcccattcgtatgttgatcatctggcgagtcaggtagctcatcgcaatgatgatcccgaaggctttatcgaggcaattgtcgaagcgcgtgtcacagttgctggtttaggactggtgatggaagcgcatgcttatttcgataccgaggctgaaaagcttgcgatgaattggttgtcaaaatataacaaacagatcaaaatgttaagtgatgatcgtagggagtcctatcgccagattatcgaaatgagtattgagccacaggatgttgagttattaaagcctgaagcccgttatgaagcgactaaggtgaacgaaagtggaaatgtgaaagttcttcctgtctggaatgaccacttgttgtgtggactagatggaaaatacccagcagagcttaatggctgggagcggatagtcgttgagactgaatccggtagatctggattctgctactggtatcgcaacccgcagcagccaggacaatcttcgcttggtatagcttatgaaaaggctgggcaatatgggattgttcgtcctgattttctattctttgccgaacaggatggttctatcgctgtcgacttagttgatccacatggactgcatttgagtgatgcacttgctaagttacaggggttggcacagtacgccgcaaaccatatgaatgtataccgccgaattgaatccatcgcggggatcctctag

SEQ ID NO: 84660 - DNA, 495 bp, Glycine max
  Peptide Sequence Number=SeqID_176345
atgggtgaagcagaggaggtgcaagagaagatgaaggccgacatggaggccatgaaagagcaaatggccacaatgatggaggccatgatgagcatgaagaagataatggaagccaatgcgcatgccttcccgccatatggtttgcctcccaaactatacaccacccaatgtgtgtacattcccaatgaggatgtcaataactccactcccatactcattaagagccaacaacctcaatctgatcatgcacatgtctctcgacccatggaggagacacatgaaattccccaccacgatctagccaacttcgagccttgcctcggatatgctgctgaagggcaagcagttggtggtatacccctgcaaaacactttggagggccctcaatatcatccacaaccacaaccctcacgttccacagcggttaaaaaccctcatgactatggcaggaatgggaaagttggatcatctagaggaaaggctcagggccattga

SEQ ID NO: 84661 - DNA, 456 bp, Glycine max
  Peptide Sequence Number=SeqID_176346
atggagagaagcatgatagatgctgccaatggtgaagcccttggagacatgacccctactgaagccataaatttaattgagaagatggcttcaaactcccagcaatttagtgccagaagtgatgctattgtcattagaggagtgcatgaagtagccacaaattcatcttcatcaatcgagactaagaagcttgaagcacctgtcaccagactctgtggtttatgctcctctgccgaccaccacacagacctttgcccttctgtgcaacaatctgaagcaattgaacaccctgaagcttatgctgcaaacatctacaacagacctcctcaacctcagcagcaaaatcaaccacaacagaacaattatgagctctccagcaataggtacaatctcgggtggaagaatcatcccaaccttagatggttgagtcctttacaacagcagcaacaacaatag

SEQ ID NO: 84662 - DNA, 225 bp, Glycine max
  Peptide Sequence Number=SeqID_176347
atggttagcaaagcaaagagagttggagatgattcatggaaactgagaagaattatatgccaacctgccaaaacttttgggagttttgcaatcttgtattcccggaactgtggtcgatgctcaattagaattcgtgttacacatacacggagaaaatgcaccggtaacatcttagggatatccgttcgaataagccaagtgcaactgaatggcttgatcaactaa

SEQ ID NO: 84663 - DNA, 189 bp, Glycine max
  Peptide Sequence Number=SeqID_176348
atggaatgtagtgattggatgaagacgacaaaatccccgtaccgatttgatgaagacgacaaaatccccgcacggtacggggcagggatcaccaataatagctcaatggggccttcctatttgcagatcaagcttatcgataccgtcgacctcgagggggggcccggtaccagcttttgttccctttag

SEQ ID NO: 84664 - DNA, 599 bp, Glycine max
  misc_feature (596)..(596): n is a, c, g, or t
  Peptide Sequence Number=SeqID_176349
tcgtcagtgaagagagttttgaagcaccggaagaggacgaagaagtccgagctctcaaaagcgagttaggaaaggcgaaacttgcccaagagaagttcaagttggccgctacacacatccggaaggagtgtgccggattacgggaagagaatgcaaccaccgcacgagcccttgaacaagagaccaagagggctcgcaaggaagaggaccagtcgcgagcacatagcatggttttgaaagaggagttagttgcctgttcaaggtccagaagaagcttgtctcagcgtttatgcgagacagagaccaacatgctagctatcatcgccaagtaccaagaagagttaggtctagccacggcccacgagcgtagggtcgcggacgagtatgcccaagtatacgcggaaaaagaggctagaggaagggtgatcgactctttacaccaagaggcaaccatgtggatggatcggtttgctcttaccttgaacgggagtcaagaacttccccgattgttagccaaggccaaggcgatggcggacacctactccgcccccgaagaaattcatgggcttctaggctattgtcagcatatgatagantaa

SEQ ID NO: 84665 - DNA, 129 bp, Glycine max
  Peptide Sequence Number=SeqID_176350
atgatgtgggtaaagaaaatggctccgaagaaactctccatgaagaggtttagaagggacgccactggagaaggctccattgccgcctcaaagtttgatagtcaccgtttccgaagtgtcgagcactag

SEQ ID NO: 84666 - DNA, 554 bp, Glycine max
  Peptide Sequence Number=SeqID_176351
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccaggatgctggcgctaaacgcctccccaggcggcgctgctgacctgcttgctgccacgcttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaaccccccgttcagcccgaccgctgcgccttatccggtaactatcgtcttgagtccaacccg

SEQ ID NO: 84667 - DNA, 633 bp, Glycine max
  Peptide Sequence Number=SeqID_176352
atgggtgaagtagaggaggtgcaaaagcagatgaaggctgacatggaggccatgaaagagcaaatggccacaatgatggaggccatgatgaacatgaagaagataatggaagctaatgcggttgcagataccgctactagcgctgtagctaaggtgaacccgatgcccccatctggcctcaaccaaatgaatcatccaaccttagctatggtaggcaaagatttgggaagtacgggcggcccccattattcgcaaattcaaaacaagcacgccttctcgccatatggcttgcctcccaactatacaccacccaatgtggcgtacactcccagtgagaatgtcaataactccactcccatactcattgagagccgacaaccccaaactgatcattcacatgtctctcaaaccgtgggggagacacatgaaattccccaccataatctagccgacttcgagccttgcctcggatatgccactgaagggcaagtagttggtggtatactcttgcaaaacactttggaaggccctcaatttcgcccccaaccacaacccttgcattccacagcaggtaaaatccctcctattatggaaggaatgggaaaagttggatcatctaaaggaaaggcttag

SEQ ID NO: 84668 - DNA, 366 bp, Glycine max
  Peptide Sequence Number=SeqID_176353
atgacgttgttagtgatgatcagggggattcattgcccttgtcggatgtccttggtgggggaaaatagagtggttaaagagtttaagcatctccgaggggatgtcttaggatctttaatttatccatggtcagtgtacttgacggtgcccatgtttccgttggatgttgtgtatgttcggggggggggggggtgcattgaccttgtcggatgtccctggagggggaaaatagagtggttaaagagtttaaacatctcagaggggatttttaggatctttaattcatccatggtctttgtacttgatggtgctcactgttcgctttcggcaagtgcaccaaatcgcacaagtagtataaaacggtaa

SEQ ID NO: 84669 - DNA, 396 bp, Glycine max
  Peptide Sequence Number=SeqID_176354
atgtctaccagcagtgtcattgggacgctccttaacattcaaggcaagacaaaagatggtttgaatacttgtcaagatctagctgagatgggtatacgatcacagttgcatccaagcttgtcatactttgtccagaaaggagaagatcagtttttgtcagtgtctgcgccagaagaagtcattgaattttgttcaaagtacattgaaaaagctaaaccttttggccttcccgagtctcagcatgtcgaaagaatgggagctttcatcccttactttggtttcattgaagaaatttgggagcttaactatgtcaaatttactgtctgtgttttcaaatgtaaatgggttgacagcaatactagtgtgcagaccgatgatgtagatttacgttggtag

SEQ ID NO: 84670 - DNA, 256 bp, Glycine max
  Peptide Sequence Number=SeqID_176355
atgttggaaagttttaaacaacaagaccaaatgtcagttctgaaattgtacatagaaaaggatgtggctggtggttcaatgtttcattctgccaattcgcttacatcatgtggaaattacttatctaatgatgagacacaatcggcaacaaatatgagtaatttacctattgacgaagacgatgatgatgatgatgattatcttgtgtctaactcatacgttgaagagtctttagacgaagatgacggtgttgacg

SEQ ID NO: 84671 - DNA, 213 bp, Glycine max
  Peptide Sequence Number=SeqID_176356
atgagtttaggtggtaactactatgacctagtaattgctgatgattattccagttttcccgccccaagagcacctcaacaaaatggtgttgtggagaggaaaaataaagctcttgaaggagttgatatgaatggcagcggaatggagaaggaagagagagaggagatgccacttcaaggagaagatgagtctagaagaagctcaccaccatag

SEQ ID NO: 84672 - DNA, 752 bp, Glycine max
  Peptide Sequence Number=SeqID_176357
gattacacaccctcaccatcagaggactacacgtccttaccttcatagggctacacgccctcaccttccgaggactacatgtcctcaccttcagaggactacacgtcctaaccttcagaggactacatgtcctcgcctttagaggacaacacgtcctcgccttcgccttcgtagggctacacgccctcaccttcaaaggactacacgtcctcgccatcagagggctgcacgccctcaccttcaaaggactacacatcctccaattcagaggactacacgtcctcgcctttagatggcttcacgtcctcgccttcagagggctgcactccctcgccttcagaggactgcacgtcctcgtcttcagaggtctacacgtcctcatcttcagaggtctacacgtcctcatctttagaggactacacgtcctcgccttcaaagggctacatgtccccacctttagagggctgcacgtcttcgccttcagagggctacgtgctcttgccttcagtgggatccatatccgcaccttaagagaatttaagggaggctatcacgcagctactatgcatactgggtcaagatttcaccagtgcctcaggggaaagttccttatcgcgttggaatcggcaccaaagtgggcattgccggccgggcgagttgtggttggagccagagcttggggggcctccctctggatgggggcgggtgctctaggctgtacgagtgctgaattggaggagttcccgacgtga

SEQ ID NO: 84673 - DNA, 528 bp, Glycine max
  Peptide Sequence Number=SeqID_176358
atgtttcatttcagccaaaccaccaaggcgaaaacagcccggaatccgcgcaaaaaccgctctgaaaggagtgaattcgggttcaccgaaacactttcagcagcaaccatccttgtgccgcaagcgattgcgcgggatgcgccggaaaccgatagaaaatccgtcgcgagggttgacagcgccgaaatggctgtgtttctctcgatcacatgttgcatcacaacacgccaccgcgaacccacattgaagccgccgacaccggcgccgcctcgctgcgttcgattcttgtgctcgtacttattacccagccaacaggtgcgggacgagccagcgtgtaagcaacaaacacaccggaactcatcaaaacccgcacccgccccggtgcgggttttttcatttcaggacctggtttcagacgcaaccaccatgaacaacgccaacttcaaaacctggaccagcaccgccacgacgcctcgtagcggctgtgcctgtgcgacgcatggcgcctcctccaccgctttcccctga

SEQ ID NO: 84674 - DNA, 297 bp, Glycine max
  Peptide Sequence Number=SeqID_176359
atgaaaattctttggaagatgaagatgcaggtgtttagtataaggattctgctcttgaagatgaaaccaaagttgaaaagcttgaacaaagcaatgaagtcactgccacacctcctaaagacctccttagagaatggagaactcaaaaagacatgtccttggacaacattattggagaaatatcatagggagcttctactcactctagactcaggattttatgcaataacatggtttttgtttctcaaattgaaccaggaaacatacatgaagccttgtacgatgaatactggttga

SEQ ID NO: 84675 - DNA, 540 bp, Glycine max
  Peptide Sequence Number=SeqID_176360
atgctggaaaaagtctatttgtatcatttggaaagaataagttcatcaaatacttacactaagacatttattgggattgatggagttgaaaagcgattagctaatgaagtcttgcaagttgttaaaaagacaaagagcctgaaaagaatctcctttctagcccattcgctaagaggcttgtttgctagatatgcaattgttgttctttattcacctgatacctatagtagggaccaaccagagagtgtttttgtggaggttgagccaattctaagatctgcaatggacggacgcaatgtgtgtgtttttgcctatggtcaaacaggcacatgcaagacattcaccatgcatggtacaaacgaggagccaagaattatttcgcgtgcacttgaagagctctttcatcaagcctctttggataattcatcttcttttacttttacaatgagcatgttggaagtttatatgggcaatctcaaggatttgttatctccaagacagtctggtagaccacatgaacaatatatgacaaagtggtaa

SEQ ID NO: 84676 - DNA, 141 bp, Glycine max
  Peptide Sequence Number=SeqID_176361
atgcaagcatgtggaatttccactttgccatcttttattgcatctggactaagttctgggcatgatggcaaaggaaatatcagaaaacaagagctttttcaggcttctgtagccctcaaggtgatttacaaaatgtcataa

SEQ ID NO: 84677 - DNA, 429 bp, Glycine max
  Peptide Sequence Number=SeqID_176362
atgcttcacagtctacgtataaaaagagtaaacaatccagaacgactaagaagattgtctgtcaggcgtttggaggagcagaagctactggttcatgtggatcttgacactaggaaagctttaggctcacatagaaagacattcaagtcctatttagggatcattgctcgagaaaaggttgatatcctttatcacaattggaaacaagtgcctaaagttaaaggaacaactgatttaggacgacattctgaaatccctgcaagagtagtgcaccctgggtacctttgtacccccaaggatgtgaagatgtactcactgctgccattggatgaccaaagcaccctgattgtgttcgtgctgctaaagtcagtgtcaccatcaaccattactttagaagatcatgtggctcctagacttcatcattgttga

SEQ ID NO: 84678 - DNA, 378 bp, Glycine max
  Peptide Sequence Number=SeqID_176363
atgacttctagaaagaggaaagcatcagcctcccaaccttgggaaccatacgatacgacaagattcgtttctaaggtcgcatgggaacgttatgctcagaacgttcactcctggaaaatccttctagaaaggaatgtgaatctttttgtgactgagtatgacgagcttagacgggagctgatccagaggaactggcacagggccttgacctatctaagggaagctgatcaagtcgcgtccagatcctcaggagtttgcggccagattatgcatcccagggcgcgggtttgttctgaatgctggaggagcgccctggaagctcctaaggaaggatctcacgacattagcacaaacctggagcatcctctcatattctaa

SEQ ID NO: 84679 - DNA, 333 bp, Glycine max
  Peptide Sequence Number=SeqID_176364
atggaagacaatcatcagatgggaatggctatacttgattcaacaagttccttagctgagtttgcttgtgaagtggaaataacagagtgtgaaccacttccagatggtcgtttttatatagagaaggacttgagaatattgtggacaattgacaacttgtacaagttcactctcagagtcaattgtaatgaaagtgttgttacatgcaaattgaaagtcgtaggagatttcatatcattcgttcctgggatcaagaagggtaccgtgttgcagaggttgaatggatacaagatattataccaccagaaggaacaagtgaaagagagactataa

SEQ ID NO: 84680 - DNA, 303 bp, Glycine max
  Peptide Sequence Number=SeqID_176365
atggtggttccaaagtcaaaaaagatgcaaagacaagatgaaactaacaaggaacaacatgaaatcatgggtttcgttctctaccgaaaccgcaagtcaagttggaagattccgctccaatcgatgggttcctctcgttgtggagttttaacggagaacaacaacggtttgcggtggctaatggtggctgtgggtgatggagaaagtgcttggaactttagaaatggctttggaagaaagaaagaagaagaaatgacctttttcctaagctacacgaaagcaaaggctgaagtgcttaaataa

SEQ ID NO: 84681 - DNA, 711 bp, Glycine max
  Peptide Sequence Number=SeqID_176366
atggaagaactcaattctcagcctaagatgaaagatgatggtggcgatgtgacaattgtctttatgatgattaagttggatgggaaagccactaacgggagcttcaagctgaaagggcctaaggcctatgccttggcatccctaaatgcaatcctagtgaggagtgacggtaaaagagcgcttggacctactataagtgagtgggtggctataattggtacctggggtattgagtggaaccatgatccatggtttaaggaggataattttgtcgataatgttagatttggtctctcaccagcggtcagggaaccatacatttcaccattttattttgatttacctctagtgcttactcaatatccaatgctcggttacatgtgtgtttcgtcgactccattttcttcaccttcccgctcttcatcatcggcattgtctatggctgatatcgtgatgatgatcgaggagatatttgctcagccaattgtgagggagtatgttctgtcatctctcaacaatgagattcccttgttagtagatccgtcatacaatctagtttcacagacacgattccttttgtccgaacatttgattgattggtcatttgtcttggaggactatgttgatggtgccaatgacaaggaggatgatccttctaaggatgcaagcgacgctagagagaccccagggatcgatgaagattcttcttag

SEQ ID NO: 84682 - DNA, 615 bp, Glycine max
  Peptide Sequence Number=SeqID_176367
atggcatcatctcagtcgaggaagagagttgacgccgtcgattgtcgtgctgcttccgttctcgtttgtgccaaagatggcagtgcttttgctcattgctacgattgcaagaagaatgtgccggttgcactcatcgacatgcacagttgtagccttgaagctaaaattaaaatgaacctagatgctcaagttgtggaacaggctgctgaagctaagaagccagagaggaagaagcccaaatctaaagagcctatggcaaaaaaggctaaagttgggaaggggaagaaggtcaaggatcctaacatgcctaagcgtcctcccacaactttttttgtcttcttggatgattttagaaaatctttcaaggaagctaatcctgattctaaggatgctaaaagggttggcaaagaggctgtgtggggcatggtgattgtggccattggattttcctatggctttgtggagtttgaagtggcaagtgctgtgcaaagtgcacttgagattgattcattgaaagccaatctaactgaactggaatcacgtcatagcaataattatcctgaggaagagttacattctgataattactggttttcttgtcctctagaaggttga

SEQ ID NO: 84683 - DNA, 818 bp, Glycine max
  Peptide Sequence Number=SeqID_176368
atgatcaacgtctacggtactcttcgcaattgtctactagaatcatattagaccctaagtacctagacatagcgttctttgatgatgagacatttgatgactatcaagtatttcaaaactctgacttagttgattttatgtctttaaagttgcctcattatgttgaactagttagagtcttttacaataacgtaagaattcaggatagtacactttactctgaggtgcatggtattcctcttgtcattgatcaatctctgtttttctcattgactaaattacccactcaaggtgttccttttgagggaactgttgttgatgactggaagttcgattatttgagtcatgatgctcgccgtatgatcgactgggcccacttggttaagtaccgtatgcataaggcattacggaccaatgcacctcttccgtatcctcagttagtcactctatttcttcgtcactttcaaattcctctcgatgatgaaccttttgttcaagtcaagacatcttttgccattggtgttggagtggtaacttcttttgggtaccgtaaggatattgatggacaatggattaggaaacaagatttaccaccactaattcctgatgagcgtacttcgtctcctctgccacagagagatgcttcatctactcttatgcatgaagtcctttctgaactatgtggtcttcgagcgttcgtaggtgaccgtttggatgccatggatgctcattttgaaggcatggatacatggattactcatcttgaagacgacatgggtttcattcgccgttgcttcgatccaccggctgccccatag

SEQ ID NO: 84684 - DNA, 126 bp, Glycine max
  Peptide Sequence Number=SeqID_176369
atggacacatcatctgctcctaatttttcaaagaagctatgtaaattcgacccatcttctgccccaacttttgcaagctgggtacttccatactttgaccttgacttgataaaatccttttcttaa

SEQ ID NO: 84685 - DNA, 504 bp, Glycine max
  Peptide Sequence Number=SeqID_176370
atgagttcaaggaggaacttgagagacgccattgaggagttgactaactttgtggacggcaacattgatattgccattgtaaaagaattctatgcaaacctctatgaccccgaggataaatcacctaaacaggtgagggtgagaggtcatctgattaagtttgatgaagacacacataacactttcttgaagacccctgttattgtggaagagggagaatcactctgtgcttattctagatttgcacttctgaggcctgatcctcaggagttggctactaagctctgtatcccagggtgggaatttgaacttaatgctgacgggcagcccttgaagattctgaggaagaacatgactacactagctcaaacatggagcggtctttccttctcgaacttgattcccagctcccacacttttgatgtcactcttgacagggccagactcatctatggcattattatgaagatggacctgaacgtggggtacctcatctcccaatag

SEQ ID NO: 84686 - DNA, 297 bp, Glycine max
  Peptide Sequence Number=SeqID_176371
atgacggaacgaaagaccaaggaaagaaagaagaatgcaccaaaatgcaggtgctgcaccaaacgctggtggttgtttcttgttgacaggatgatccacaagaaaggtggcaggattcgaacctatggccggcccgcccctgacctgctgggttgggtggccgggttagcacccctcgtcgcccctgtacccgaaacagatgcgctgcgctacccagcgcgtaaccttgtctcccctactcctcttctggttatgccattaccaatcgcgggtaacccccgggccggccgcccctga

SEQ ID NO: 84687 - DNA, 288 bp, Glycine max
  Peptide Sequence Number=SeqID_176372
atggtgacccttaaatggagcaatttccaccctagtggatggggaggatatgccctcaagcaaaaattgaagttcattgcttgcattcgacagtggagctcatccaatggagttattaatgctaagaaaattcaggttttaaagaaggagctgaatgctttggaggctggtatctctgacagaattctgaatcaatttgaagtggagctcaagaagtctcttcaggagcaattgtggcatgctgctaatgcctatgaatctaccttcccttggtcggggatcctctag

SEQ ID NO: 84688 - DNA, 511 bp, Glycine max
  Peptide Sequence Number=SeqID_176373
gtcgactctagaggatcccctgcagagcgtcctcgccatcagagggctgcatgccctaaccttcagagcgctctacgtcctcaccatcagagggctgcacgccctcacctgcagagggatgcacgtcctaactttcagagggctgcacgctctcaccttcagaggaccatacgtcctcgacatcagagggctggacgccctcacctttagaggactacacgtcctcgccatcagagggctgcacgccctaacctgtagaggactgcacgtcctcaccatcagagggcttcacgccctcaccattagaggactacacgtcctcgccatcaaagggttgcacgccctatcctttggaggactacatgtcctcgcaatcagagggctgcactcctccatcagttgtaccctcacctttagaggactacatgtcctagccatcagcgggactgcacgccctcatcttcagaggactacatgtcctcatcagagggctccacgccctcatctttag

SEQ ID NO: 84689 - DNA, 594 bp, Glycine max
  Peptide Sequence Number=SeqID_176374
gactgcatgtcctcgccatcagaggattacaacctcgccattagaggactacacgtcctcgccttcagagggctgcacgccccaccttcagaggactacatgtcctcaccttcagaggactacacgtcctcgccatcagagggctgcactatatgtcctcgcctttagaagactacacgtcctcacctttggaggacacacgttctcgccttcagagggctacaagccctcgccttcagagggctgcacaccctcaccttcagaggcctacacgtcctcacctttagagggctacatgccctcgcctttagaggactacacgtcctcaccttcagatgactacacgtcctcacctttcgagggctgcacgcccttgccttcagaggactacatgtccttgcctccagaggactacacgttcttgtcttcagaggactacatgtcctcgccttcagaggattacacgttttcgcctttagaggactacacgactacacgtcctcaccttcagaggactacacgtcctcgcactttagaaggctgcacgccctcgccttcagaggactacatatccttgccttcagaggactacac

SEQ ID NO: 84690 - DNA, 385 bp, Glycine max
  Peptide Sequence Number=SeqID_176375
atgtcagttctagaattgtacatagaaaaggatgtggctggtggttcaatgtttcattctgcaaattcccttacatcatgtggaaattatgtatctaatgattacacacaaccgccaacaaatatgagcaatttaaatcttgacgaagatgatgataatgatgatgatgattatcttgtgtctaactcatacgttgaagagtcgttagacgaagatgacagtgttgacggtatatcagatacagacaatgaagtccccggcatgattccaccagtaagaattgttcacccagcagaaggtgtacaagcaattgagaatccattttggaatgatgctttgccttataataatatcaactggagccatcctgatgaggaggaccttt

SEQ ID NO: 84691 - DNA, 264 bp, Glycine max
  Peptide Sequence Number=SeqID_176376
atgtgtcacccaactgcatatgtttgtgcttactacaagggcaaatctgcaatgctaatgagggcaccaccttcgttagtaacaacacaaaaactttcatggtcatcaagcaaccaacatggctcaacctccaatcttgaggacttatcaaatgaatacgagacttgggtcaaaaaccatgatagtaatactgactcctcttccgggcccgaaggaagtaacatgtctccatcccacgaaacaatattcaaacaggattggtaa

SEQ ID NO: 84692 - DNA, 345 bp, Glycine max
  Peptide Sequence Number=SeqID_176377
atgatgttgttctttagccaaatgcagtcccagtttcaatcgcagatgcaatcacaaggactcgcattgcctcttgagccaaaggttggtccttcagctgcttatgtcagcactaaggagagttgtgttgatccgttagggaacaacccagacacgggtgactcagagaaatacgggttatacgtcgaagaaaatcctccccgcctggttgctcgaggaagactttatgagggttccataatcgttcacaacatccctttgctccatgatcaagttatggttggtgttgaagaagttagagatgcagatgctctcattcctgtacccactcaagaggttcaatga

SEQ ID NO: 84693 - DNA, 192 bp, Glycine max
  Peptide Sequence Number=SeqID_176378
atgttcatgacccctaggctatgcattttggctattttgggtgaaaaaacacgtttccgtgaagaaaaattgagtcgaagtgcttccgtaacgctttcgagacgtttctgtgagcaaatatgtgaagattttctgccgctcttcaccgttctttgttcgttcttcattcttcaaccctgttatcttgcctaa

SEQ ID NO: 84694 - DNA, 532 bp, Glycine max
  Peptide Sequence Number=SeqID_176379
taccctcaccttcagagggctacacgctctcaccttcagaggactacactccctcgccttcagagggctacacgtcctcgcctttagagggctgcacgccctcgccttcagaaggctacacgccctcgccttcagaggactacacgccctcgccatcagagggctacacgccctcaccttcaaagggctacacgccctcaccttcagaggactacacgtcctcgcctttagagggctacacgccctcgcctttagagggctgcacgcccttgccaacagaggaatacacatcctcgccttcaaagggcgacacgtcctcgacttcagaggactgcacgccgtcgcctttagagggctacgtgtcctcactttcagtgggctccatatccacaccttaagagaatttaagtcccatggtcacctccctgatctcggaggagggtcaactgtgcgagcaataccagagggaggctatcatgcagccattatgcataccggggcaagatttcacccagccgttgcaaggagatga

SEQ ID NO: 84695 - DNA, 255 bp, Glycine max
  Peptide Sequence Number=SeqID_176380
atgcgggatgtgttcacaaaggaatacgcgcggagtcccacgttatttgaggaaaacgtcatgaaaaccggaaatacgcgatctacaaactttttaatgaaaggttcgggagttgtatttacgcacggggaaggtattagcaccccacacgcccgtcccaagggacggcagcctttaaaggcaatgattattttcaaactcgaatgtggaggacaacatgactgggcaataacattcatgcggctccgagggtga

SEQ ID NO: 84696 - DNA, 1153 bp, Glycine max
  Peptide Sequence Number=SeqID_176381
gccagcgcctgagatagaagacctagtcacgaccaccgaattaagtccattgatcgggtgttcagtagtcaccgacgatcctggacttatatctgcatttgtcgagaggtggcatagggagaccaacacctttcatcttctagtaggagagttgacgatcacgctggacgatgtggcatcactcctccatctttcgatcataagcgcgttccacagctttgagcctctacttgtggacgatgcggtcttcttgttgatggagttgtttgaggtcttcgatgaggaggctagatctgagactgtacgggcggatgcggcatatgtacgactttcgtggcttcgggatgtctatcagagtagatgtcgtgcccgatggtggattgtagcagcccgtgcttacctcctccacttggttggttgcactcttttttctaacaagagtgcaacacatgttcatgtggtgcatctagaggctttccaagaactgggtcagagtgggggctatgcctggggagctgccgcgctgtgcgtcattgatgatgcgtacgacgaaacgaccccacgtgcctcccagtggcttactatgaaggctcatatgaaagggataacaggagtatcataccgggcacgtttaaatgctttgacaatcgcagacaccatcccttcgccgcttgttagtgcttcgttgtcatatgaggatatagacgacaggtggatgcatttctcagaccatgtaatagctgcgggtgagatttgtgttgtgcctgggcaggaatacgtccagccagatatcccagaggttccaatggcatttgatccccctagagatgcaatggatgcttgtgaaggttgtgaagcgatcgcagaaaggttggaacgtgtgctcaacttaaggatggtcactgaaggcacagagttacatgacatcatggaagattgcctcaggatcgctaggggggtgacaactcagatggaaatgttagggctcgacgaagacgacgcacaaatcattgatagatcatgcctaggatcttcttcatcaatggattcctttgcttcttggaagatgaatgatagcagaatggagaaggaagagagagaggagatgccacttcaaggagaagatgagtctagaagaaactcacccccatag

SEQ ID NO: 84697 - DNA, 733 bp, Glycine max
  Peptide Sequence Number=SeqID_176382
atgtgcgatcatcatcatgctgcgcggcacatattgtgcccacaatgtgatctgctggtggctttgccgccgctggagcatcgccagaaagccgcatgcccacgctgcggcaccacgctcaccacatcgtgggacgcgccgcggcagcgccccacggcctatgcgctggtggcgctgttcatgttgctgctggcgaacctgtttccttttgtttatatgaaagtcggcgggatcagcagcgaaattgagctgctggaaatccctaatgtgctgttcagcgaggattacgccagcctcggtacgttctttttactctttgtccaactggtcccggcgttttgtctggtgaccatcttattgttggtcaatcgcgttcatatgccttcacgcttgaaggcgtttctggcgcggattttgtttcacctcaaaagctgggggatggcggagattttcctcgccggggtgctggtcagcttcgttaaactcatggcctatggtgatatcggcgttgggctgagctttgttccctggtgtctgttctgcctgctgcaattgcgggcgtttcagtgcgtcgatcgccgctggctgtgggacgacattgcgccaatgccggtcattaagcagccgctgcgccctggcgtgccggggcttcgtcagggattgcgttcctgctcgtgctgcacggcggtgctgccagcggatgagaaagagtgtccgcgctgtcacaccaaag

SEQ ID NO: 84698 - DNA, 201 bp, Glycine max
  Peptide Sequence Number=SeqID_176383
atgctgacatcttcgaaaggggcacagacaaccacattggtctccgcttgtcaatcagacttggggtctacaaatgacgaggtacagataaccgtaaggcgtctccgcatgctactggactcacgggtcacggtagcaggatggggtggtcaacaaaagcgggacttttgctcctacggcgaaaaagtcatcggtgcatag

SEQ ID NO: 84699 - DNA, 177 bp, Glycine max
  Peptide Sequence Number=SeqID_176384
atggcctatgccccattaggcaactctacaaagttccaaactccgttactgatgatcttcttcatgaatggattcctttgcttcttggaagatgaatggcagcggaaggagaaggaagagagagaggagacgccacttcaaggagaagatgagtctagaagaagctcaacaccatag

SEQ ID NO: 84700 - DNA, 516 bp, Glycine max
  Peptide Sequence Number=SeqID_176385
atggaggaacaggcctcacaggattcctttgtcgcccatggacaacaccctggtcgtgtgcgtgctgctggagccaatgtcacgatcaaacaatactttggaccgactccaaggacctcccacacatcttcgtccatggctccgaaagacatggagcagttgacgcaaaaaatcagggaccagctggaggagtcgatcacagaaaaagtgactcgacaagtactcgcactacctcctgagcctgtggatggtcgttcagctactcatgtcagcacaaaggaaaatgttgtcatctggttttgttcgttgcataataggctagacttcctgaaaggaatattatcaggatttgacgatactccacaaagtaaatccaaggctactgctaggtggattgttgttaaatgtaatagacaaaaaggaagtactgcgtgcgagtattacgtcatgcaccggatgtcaactataatcttaggaagtttcaagaataattggaaaatggttactttggggtaa

SEQ ID NO: 84701 - DNA, 474 bp, Glycine max
  Peptide Sequence Number=SeqID_176386
atgcagtcgagtgatagaaaaccaagtaagcctaagcctttggtaattcatttcaccagagatattaccactcagatacctcgaggtttccagccctatatagcaaagacgccagcaccctttccttataagagtgacaagacagtaccgtggaggtatggtgtacagggattcgatggaaggcatgacgtgtccgtcatgcgtgttgggactggcatgccgactgctgagatcatgaatattttcggtacgagcaacatgactcgtagtggacgtatttttgctcttcccaaactaccgacaaggtcgaaagacaatgggaaggcaaagacatatatgggtgagagagagaagacgggcctggccgcgaataacgaggcctttgtcagaaagtttgcaaaagaaggggacaaccttagcaagagagagatatcggctgaggaggcaaccaaatttctaagaatcattcagtag

SEQ ID NO: 84702 - DNA, 605 bp, Glycine max
  Peptide Sequence Number=SeqID_176387
atctgaagaagctcgcttatcagattaagcctttcatcatggcaaaacaagctaaacaggtgttttatgttcaagatccttatgatgaaaggcacatggctacaccacccagctcccttcctcttcctcccgagtcaacagcaccttcatcgtctacgtcgaagaagacaagaaaaacaacatggcttggatcattggctaccaaaccagttcgggcagagagaccaacggttcatgtggatcctatcactaggaaaattgatgacaagatggatgatacaattgataattggaaacatgtccctgcatctcaaaaggatttgatctgggaggatattcagggactcgcactgcctactaagcctgaggttgatccttttgtttctcgtgtcagtacaaggggaagttgtgtcgacccctcgggggaagacccagacacaggtgactcaaataaatatgggttgtatgtcgataagaatcctccccgtctggttgcccttggaagagtttatgaggggtcaacgatcatccacaatgaccctttgggaaatgatcaagtcaaggttggtgttgaggaagttcgagatgctaatgctcgtgtttct

SEQ ID NO: 84703 - DNA, 321 bp, Glycine max
  Peptide Sequence Number=SeqID_176388
atggcatttttccaaagctacttggactataaggctcaaaacgcacaagtgactaatgctcttggaaacggaaatttcgcgcacactccagatgtcttctcaaagatcccaacagtcaaatcatgcatggctccctacaaagctctgtatggtagaaggtgtaggacacccttatgttggctagatcccaaagagaacctcaccttagaacatgaagtggcgaacaaagcacctaagagaagagggaaggagattccattggtcaaggtgatctggggaggtgcatcaggagaggacatcacgtgggaactagagatttag

SEQ ID NO: 84704 - DNA, 2058 bp, Glycine max
  Peptide Sequence Number=SeqID_176389
atgggtgatattagcttgaggctatggttggataaacccgaacgatcagtgaatgtctctgaatgcttgcacatatttagggaaatagtagaaattgttcatgtggctcattctcaaggaattgttgttcataatgtgaggccctcctgctttgtcatgtcatctttcaaccatgtctcgtttattgagtcagcaacttgttccgattctggctcagatactttagaagaagctgttgagatcaaaactccaacacctactcctagctatgatatgcatcaacagagatgtttaggaagtgaagattttgtgcctgtcaagacttcaacagcttctttgacagactctagttgcatgttgtcaagtttggtgtttgtggcacctgcatcattaatagatgatacagaagaaaataaaatgaaaaacagaagaaaggatgaggaagttgcagtaaagaagcaatcattttcaacaaaacaggtactgcagatggaggcgagttggtatactagtcctgaagagtttgctggtgcttcaccttcctgtgcttcagacgtttaccggttgggagttcttctttttgagctattttgtccactcatctcaagagaagaaaagagcagaaccatgtccggcctaagacatagagttcttcctccacagttacttttaaaatggcctaaagaagcttcattttgcttgtggttattacatcctgagcctaatagtcgtccaacaatagggcagttgttgcagagtgagtttcttaatgaaccaagagatgatatagaaaactgtgaggcagcggtagaagttagagaaaggatagatgatcaggagttgttgcaagaattcctttcattaattcaacagaaaaaagaggaagctgctgagaagttacagcatactatctcatttctgtgttcagatattgaagaagcgactaagcagaaaactctatttaatgagataactggcactggactagatgattgtaccacatcgactttcccgtccattacagttgtcgataatgaggaatctgcttgtctagggaccagaaaacgggtcagaactattccgtgtgttgatgacactgaagggattgataataacatgagtgatgatcagaaaaatgacaggagtattctttcaaaaactccacggtttttgaataatttacagaaactagagtcagcatactttttgacacgatgcaaatcagcctattcctcagggaaacttgcggttcaacattcacctattggtactgatgaaaggagttgtgtcaataaagtagcattaaaagagaagttcagggagggaaaaagtccttggacaaatcctttccttgagggtttgagcaagtacctatctttcagtaagttaaaggttaaggctgacctgaaacaaggggatcttttgcagtcttccaacctggtatgctcactcagttttgatcgcgatgcagaatattttgctactgcaggagtaaacaagaagattaaagtttttgaatgtaacactaccataaatgaggatcgtgatatccactatccagtagttgagatggttagccggtcaacattgagtagtacatgttggaatacttacatcaaaagtcaaattgcttcaagtaactttgaaggtgttgtacagttatgggatgtgacaagaagtcacgtgcagtctgaaatgagggagcatgagcaaagggtatggtctattgatttctcatcagcggatccgacgttgttagcaagtgggagtgatgacggttctgtcaagctatggaatatcaatcaggcaatcagaccaaacattcttttgtatgttttgtgtttaattctagatggaattagtgttggtaccatcaaaacaaaggcaaatgtgtgttgtgttcagtttccccttgaatttgctcattcccttgcatttggttcggcagatcatcggatatattactatgatcttcgcaacctgaaagtgcctctttgtacattggttggacacgataagacaaatttgtctcttctctggaaaatgaagaagctttga

SEQ ID NO: 84705 - DNA, 840 bp, Glycine max
  Peptide Sequence Number=SeqID_176390
atggcacgcaaaccgaggcaggattttagcgtttcaaagcttgagaggattgatggggacccggtgttgagagaaacgaggatatgggctacgtgggagtacgtgagctcagttggaggtgggcaacaggggatggggtcaggagaccttggggacgtcaggcgagctcctggcagtcaacagataaaaggaacaaagaccacaaagcaaggaggcttgtggcttaaaaatgaagacaggaggctaagatggtctctggaagccatgagggcttctggtaatcgattaccaagggggtgtaatcgattaccaggcttagaaatgaaggcagcaggttgtggaggcctctgtgcctttttcaggttttcatgccctgaagctgtgattcaagtttggcctctgatcgtgagggcagcgcagctaatccatgatcgagtagagatggagtgcctagagggagcttgggagaccctcgaaggcaacacgaggtgccgatttcggggcacgattcgatttacgactacttctttggtgcatctagatgaacccgtgcgcacgcttcagcgcactgtggagtggatactacccacgcctacaccataccgtctagtggagccagtccaagtgatcgaggtgacgtcatccgaggaagaccctgaggaggatcccgaggagctacctcctgagcctgttgtggatgctcttgactttctagagggtgatgaggacccacttcctaaggtggatcctcctgaggaagtcatgtcggtatctgaggcagactctacggaggatagtggcccgggggagatggcaatcagcggaggctcttcatcctag

SEQ ID NO: 84706 - DNA, 471 bp, Glycine max
  Peptide Sequence Number=SeqID_176391
atgaaggccaacatagaggctatgaaagaccaaatgaccaccatgatggaggccatgatgagtatgagaaaaatgatggaggtcaacgcggctgcagtcgttgccacaggtactgccactaaggtggacccgactcacccatctggtatcaatcaagtaaatcgtctagtcctagatatggtaggtcaggaaggcaaaacattgggaagtacgggcagcccccattttatgcaagtccaaagcaagcgccccttcccaccatatggcttgcctcccaactatgcaccacccaatgttgcacatgtgtccgatgagaatgtcgataactctgctcccatacccattgagagccaacaactccagtctggtcatgcacacgtctctcaacccatgggagagacgccaaaagtacctcgagaccacgttctagctgacttcgagcctcacctcagatatgctactgaggggtag

SEQ ID NO: 84707 - DNA, 744 bp, Glycine max
  Peptide Sequence Number=SeqID_176392
atggcagcggaatggagaaggaagagagagaggagacgccacttcaaggagaagatgagtctagaagaagctcaccaccataggaggccatggataagagcttggaggaagaaggagatgaatgaagggagagggagagaagagcacgaaattttgtgctcaaaaggagctctgaaatctgaaacttataaaggtaatccttgtggcgtctaccctgacttatcttccttcactggaagtggtgtctaccctgacttatcttccttcactggaagtggtgtcatccaaatcctcgttgcctgtatcaaacattctgccccgcaagtgttacctgctcatgaaccactcaatctacagtattgcaaagacagtaaaatttctactgataattctaatgagtttactatttctatttctcctagtgttcaacccttattgcaggaatttaaaaatgtctttcctaaggagattcctcatggactatcaccttcaaaaggcatagaacatcaagatgcacatgccaaagttgagtatgtgaaaagattgtatgacgaagtgaatgtgcaaattgcaaagaagaatgaaagctataccaagcaagccaacaagaaaaggaaggaagtggtacttgaactcggtgatgatcttggacatttgagggcaaatgttttccaagaaggagggaatgatgagaatcctgaaactggccaaatacaggctaaaggcccaagtggagaaggatga

SEQ ID NO: 84708 - DNA, 153 bp, Glycine max
  Peptide Sequence Number=SeqID_176393
atgacacagcatgacaacggagaatgcgatgaatcggagaaaggcgatgaacatagagatggcgatgttgaagagtgcaggggaggagggggtgatgatagacgtgtggtggggtttagtggagagaaaggaacaaaaagagaaggaagatga

SEQ ID NO: 84709 - DNA, 558 bp, Glycine max
  Peptide Sequence Number=SeqID_176394
atgataaaatctaaagtcaaagaagacagcaggatgctgatatttgcagtcaaggcagatggaagagtgatatattcaaataaagtaaatggacactttatttgggatgttgctcctgaaatgtgtgattcagactgctcctacgatgaccatgatggagacacaaatgatgaaggatatgatgatgaagatgaaggtgaaggcagatggaagccgaaacctaggccttgtaaaccacctccaccgccacaaagaagaagtgacccaaaaaatggaccatggacaacaataaagaagaaatatccagaagaccctttttggaaggagaaaaggatggcagaaattcttggatggaatcatccatctttaaagatccttgaggcacctataccttgcatgatgttttcttccacatcctatgaacaagagtttccatctcttgacagaaagacagactcagtgacaaaagtttcaactaagccccacataattcctacagaagtaggaccagaagggaagcttaaatctcctagccgagttgaagaagtcttaaactag

SEQ ID NO: 84710 - DNA, 114 bp, Glycine max
  Peptide Sequence Number=SeqID_176395
atgaagatgctcttaataccacatgatatgaatggcagcggaagggagaatgaagagagagatgagacgccacttcaaggggaagatgagtctagaagaagctcaccaccatag

SEQ ID NO: 84711 - DNA, 351 bp, Glycine max
  Peptide Sequence Number=SeqID_176396
atgtcaaatcataaaagcactgagtcaacactgaagaaccttgaggtccaggtgggacaactggccaagcagatagctgacaagtcatccaatagttttgtggcaaatacaaaacaaaatcccaaggaggaatgcaatgctgtgatgacaaggagtaaaaggtttatggaggttgaggatgaggatagtgttgtgtataagaagaaaactgctgacaaaaaaagtactgatggcaagaaaaacgaggaaaacatcatagtggaaggaaattgcagtgctgtgatccagcagatccttccacccaagcataaaaatccagggagtgtaactattccttgttcaattggataa

SEQ ID NO: 84712 - DNA, 307 bp, Glycine max
  Peptide Sequence Number=SeqID_176397
atgggtgaccgagttgacgctttggagacacagatggggaatgtgacaacaacgcttcaagagctcgctctccaagtgcagcaacaaagcttgattctcgcaaaattaagcaaacagatcgggaagagaagggagcctcaagaggaagaagcctctgctggtgactctgcacagagtgaatctcgcctcgccgggaggaaggtgaagttgcctctgtttgatggtgatgatcctgtggcttggattacacgggccgaaatttatttcgatgttcagaatacatcggatgatatgcgtgtgaagttgg

SEQ ID NO: 84713 - DNA, 192 bp, Glycine max
  Peptide Sequence Number=SeqID_176398
atggagaataatatgacatgccgatccataattggatcaaaggagatgaacgaaaatgcaaaaaatgaaagcaaaagggtgcaatggaagcttggggctgctgccaagagggactcccgtaagcttgctggtgattttgagttttggggaagaaataggggtgaaaatggcttcacccctccccccttttaa

SEQ ID NO: 84714 - DNA, 162 bp, Glycine max
  Peptide Sequence Number=SeqID_176399
atgtcgcagaactttgcggattacctaacgatggatgttaagtacctcgaggcggtcaagcgaaggttgcatgccaccaaacaatggtctccggatgaaattagggaattggtcactacgaattttgagctgaaatatttactgaattttctagacatctag

SEQ ID NO: 84715 - DNA, 405 bp, Glycine max
  Peptide Sequence Number=SeqID_176400
gtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccatggttttccccagtcacgacgttgtaaaacgacggccagtgaattgtaatacgactcactatagggcgaattggagctccaccgcggtggcggccgctctagaactagtggatcccccgggctgcaggaattcgatgctatacggactcgaaccgtag

SEQ ID NO: 84716 - DNA, 336 bp, Glycine max
  Peptide Sequence Number=SeqID_176401
atggtgaaagttggaacctcttacgtgccgatcaacgtctcattttcgccaaaagttggcccagggcttcccggtatcaacagggacaccagggatttaatttattctgcggaaagtgatcttccgtcacagtggcttctgttttctatcagctgtccctcctgttcagctactgacgggggtgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 84717 - DNA, 168 bp, Glycine max
  Peptide Sequence Number=SeqID_176402
atggaaaatgtgagccacttttgggttccctatgaaatgagggcatggaacggagccactgtgaagaagttttacgagttacgaaggaaacttcgagctcatattggtcatgggttgagaacgggaattgaactctatgagctcgaatttcccgttgttcctcagtag

SEQ ID NO: 84718 - DNA, 429 bp, Glycine max
  Peptide Sequence Number=SeqID_176403
atgctttccaagtttattttgatgatgccaaagactcaagtcaagaatcaagagtcaagcaagtttcaagaatcaaagagtcgttcaatcaaagcaagtttcaagaatcaaagagtcgttcaatcaagaatcaagattcaagaatctgaagttgctgcatctgaagctcacatcatggtggacgagcaaccacagagggttactcttgaggactactctagctctaccgtgcagcaatttttgacaagcattgggtggcaggaagttcaagcacacaacatttcatatccacattccttgatccagttgattcaaggaaatctatttcatggtctgcccaatgaagacccttatgcacacctttcaacttacatagaaatctgcaatacagtgaagatcacaggggtaccggaagatgcactaggttga

SEQ ID NO: 84719 - DNA, 783 bp, Glycine max
  Peptide Sequence Number=SeqID_176404
atggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgcgctggcgattcaggttcatcatgccgtttgtgatggcttccatgtcggcagaatgcttaatgaattacaacagtactgcgatgagtggcagggcggggctggtgcttttgcatgtctttccgggttggactcaagacgatagttaccggataaggcgcagcggtcggactgaacggggggttcgtgcatacagtccagcttggagcgaactgcctacccggaactga

SEQ ID NO: 84720 - DNA, 228 bp, Glycine max
  Peptide Sequence Number=SeqID_176405
atggcttcctatggtgagcactgcattgttttgttgagtggccatgcttgcaatgtgtcgcaacctacccttttgcgggcaagcgaggcgaggctcatgggtgcgtcttacacaggaggaaaatgcgcggagtcgccaccaacgtttattgaaaggaaaatgttagaaaaatccaaaggaaacagtcatgaagaatattccagattcgggagttatctttacatttga

SEQ ID NO: 84721 - DNA, 522 bp, Glycine max
  Peptide Sequence Number=SeqID_176406
ctggtgtatgccatcctaacacagatgagcgtccatgtggctcagttgatcactgacgccatttatttatttgcaggtctctgccagtcattcggggttcccgtcacacctagtaaggtgattcgaccgccgatcacccgggccttcattgagaagtattgcacgcctaggcaggcgcaggacgcaccgccgccacctcatcaggctgatccagctgggtcatttggcatggagcggtatttacaacacttggttcgccagcaggcggccaaccacagggggaaggtgcagatccatgagtgtctccaccagctcagcctcagtcagcagagccagggtttcgctccttttgcgtgccctactccagatcagtttagggctgaggttgtatggcccggggattggcctgaggcccaggcaggggaggcacccacagaggctcccagcgatgcagaggaggcccgcatggatgaggagatgacagatttactcgatttcttgggagggagcggaggcacatga

SEQ ID NO: 84722 - DNA, 243 bp, Glycine max
  Peptide Sequence Number=SeqID_176407
atgtgcacgtgtgcaatttttggtagccggaatgctttgagtatgcatgaaatggccccgaggaagcttgcctcaaagaggtccaggaaggacaaggcggccgaaggaactagttctgctcctgagtatgacagtcaccgctttaggagcgcagtacaccagcagcgcttcgaggccatcaagggatggtcgtttctctgggagcgacgcgtccagctcaagacgttaaagaagcgctactag

SEQ ID NO: 84723 - DNA, 219 bp, Glycine max
  Peptide Sequence Number=SeqID_176408
atgtcaatcttgccctcggaagaaaacaaagaaaagaaggttcctgatcaaagaatcggaagaaagaaaaaagagaaaattcccaatcaaagagtgggagaaagcaaaaaaaagaggaaagaaaattcccgatcaaggatcgaaagaaaacagaagaaatatgcagaaaggtctttagaccagacaacatctaaacaatacagaattgtcaccaagtaa

SEQ ID NO: 84724 - DNA, 327 bp, Glycine max
  Peptide Sequence Number=SeqID_176409
atgttttccaagaaggagggaatgatgagaatcatgaaactggccaaatacaggctaaaggcccaagtggagaaggacgaaggcccaagtggagaaggacaaagcccccgagtggagaaggatgaaggcccaaacttatcaagggtaatcccttgtggcgtctacccagacttatcttccttcactggaagtggcgtctacccagacttatcttcttcactggaagtggcgtctaccctgacttatcttccttcactggaagtggcgtcatccaatctctgtagcctgtatcaaacgatccactcctactcaggttcacatcaataa

SEQ ID NO: 84725 - DNA, 231 bp, Glycine max
  Peptide Sequence Number=SeqID_176410
atgggaaataggagtggagttattgacattcttattgggagtgttcaccttagcaacaacgctggtagcggcaattgcaaccgcattggcttccattatcttcttcatgctcatcatggcctccatcattggtgggccatttgctctttcatagcctccatgtcggccttcaccttctcttgcacctcctctgctttacccattactctggctctagcacaggtttggtaa

SEQ ID NO: 84726 - DNA, 338 bp, Glycine max
  Peptide Sequence Number=SeqID_176411
gattccatggaggaggaggcttcacaggattccattgtcgcccatggtcgttaagatgtattgactattgtcattggccgaccagaacaccctggtcgtgtgcgtgctgctggagccgatgtcacgatcgaacaatactttggaccggctccaaggacctcccacacgtcttcgtccatgtctccgaaagacatggagcagttgaggcaaaaaatcagggaccagctggaggagtggatcacagaaaaagtgactcgacaagtaatgttgtcctttacccagatgcaatcccagtttcaatcgtaaatgcaatcacaggtactcgcactacctcctga

SEQ ID NO: 84727 - DNA, 366 bp, Glycine max
  Peptide Sequence Number=SeqID_176412
atggtggtcatatctctcttgatggtttctagaggtatcatccccttcgaaaaacatactgtggcagtagggactaccaacaacaatatgttatcaaagagaaaaactctagatgaaggttcactgttatcaagcaattccccagtggagtcaccaactgtcacaacctaccctttggcgggagggcgacacgagactcacaggtgcgtcttccaagaaaggaaaatgcgcagagttgccactagcgtttattcgaggaaaacgtcggaaaaaccggaaagatatattgtgaccaaacaaaagtcgtttaaggagttggaccatttgaacgaccttttgattcttttgaagggagagaaacattaa

SEQ ID NO: 84728 - DNA, 384 bp, Glycine max
  Peptide Sequence Number=SeqID_176413
atgacgaagaacgatgaagaacggtggaaaatcttcacagaaacgtctcagaagcgttacgaaagcgcctcagcttggattttcttcacgaaaacaatttttctcactaatttcaagggaaaagagggaggtggttgccgcctaactcgcccaggcgagctgggttgcttccaccaggaggcaccggccttctgttggaacaccctgacaggtccaagtgagcctggttgctattttcacacccatgttgcgcaacaatgcttcctttcgactcccgacattttgtggaacttcacggattgcctaacgatgggtgttaagtacctcgaagcggtcaagcgaaggttgcatcccaccaaacaaatggtcccccgacgaaattag

SEQ ID NO: 84729 - DNA, 174 bp, Glycine max
  Peptide Sequence Number=SeqID_176414
atggcatcatcggtggttatcatgaatggctacgagttcatacgcaagggaagaattagctgcttgctcaagatccaagaggagtttggctcaacacttggaagccacggagcgaagcatgctagccatcatagggtagtacaaggaagagttaaaccagtctttgacccatga

SEQ ID NO: 84730 - DNA, 309 bp, Glycine max
  Peptide Sequence Number=SeqID_176415
atgttgctgctgatattctctctcgttttgcaaggatacaacaaaatgaagccttgtaaggtttcctaccaaaacataaagcagaagatgaagttcggtattcaagaattgccgataaccatggagttcctcttcttacaaaagcctctccttctggaaaaggttatacagcttttgtcctgttatcaggaccgcataaaggtgtttataccaattttaaagacctttgccttgcaaaggagggtattcaaagcccaatctataaaggtttctattcaagggaagaagcagaaaaagcccttgaattaa

SEQ ID NO: 84731 - DNA, 462 bp, Glycine max
  Peptide Sequence Number=SeqID_176416
atgtcggttactaaagctaatcttcttaaagtgaaggtcttaattgctgataaagagtatgagagtgctattgctgagtctgggtttcttctcaaggaagatgaaaataatttagaggcattgttgttatgtggctgtgcatattactatttagctgatcatgatattgccacaagaaaggcacattttggattgaaaaatctaccaaaaaagagtaaaagtatctttcattttggcctatgtaaagtgctagtcaagtatggaagaggaaaagatgccttggacagttgtagtgaagctcttaagattgatggaggagcttgtggaagctcttgttcaggcaatagtatgctagaaatttgtgatggaatcctacccccaagggtattagatagaagactccaagaagattgggtcaaagatgcaagagaagaccctagggttctcatgagccataggtaa

SEQ ID NO: 84732 - DNA, 450 bp, Glycine max
  Peptide Sequence Number=SeqID_176417
atgcctcagcagcaagtgcctagtctctatgagcataccacaaagctggaagagactctagctcagtttatgcaggtttcaatgtctaaccagaagagcacggagtctgccattaagaatctagaggtccaagtgggccagctcgcaaagcaattggcggataggttgtcaagcagctttactgcaaatactgagaagaatatgaaggaagaatctgagaagaaggtggaggagcataaacaacatctggtagctgagttgacacttgaacccatttctgattttgttgaacttgaggaagttgtggaagatgaagatgaccaacatgagagagagacaccaataaaagagagtgaaatagaaataaagatgaaggaagaacaagaaaaagaaaatcaaaaagaaaaaggaaaaagaagaagaaaaagaaaaagaaaaagagaaggttga

SEQ ID NO: 84733 - DNA, 387 bp, Glycine max
  Peptide Sequence Number=SeqID_176418
atggttaggaccagaggactaggtcatgtcttaggtcacgttactggcagaggtgtgggcagaggaaatagtgatgattctgatgatgctccacagcatcgaaggcctaccacatccgcatgcaggcagagagtagctgtcacagctgagcatgatgagccagtggtccctgtgacaaaggttgttggagcttcgattgagcctgccgtatatgcggatgagccgatggcaggaggtgatgtacatgacactagggcagacactcctgtagacacaagcgcacaggctgctgaggatgagcctgagggatttctaggtggtccgagcgacccatccctgctgaccgagtatgaagatcacattgcaggctatgtatggacaggagag

SEQ ID NO: 84734 - DNA, 684 bp, Glycine max
  Peptide Sequence Number=SeqID_176419
atggcaccctcaaaccatgacatggctcgactagtcgctgagaagaaaaaggttgatcaagtggttaacgttgttgttgttaatacaattgcggcaagaaatgtgattgatgctggcgaaaaatcaataactctgactgtggactctaaagatagcctcctagcaggatcgacaaggactgatgggcaattgcctatagaagaaataggggacaacgataatcccatggacttcgggaaccctcagaatgaaggtagttcattatgggacgtggttttccctcactcagtttataaccatacacacaacatgccaaaagcttaccacacggatatggaaaagttgagcttcgtcagcagtgtgaaggatgcacatgtggagataactcgacttcacgttattctttgtgtggtcgaagaccaatggtgggacatgatgaaagagaagaagactcttgagaaggagaagttgtgccttgttgccaaggctaagaaattaagaaagcaagtgtcagatactgaggcaggtctggtcactttggatcaagccaaagtcaatcttgaaaaagataaggaagttttggctaagaaggagaaagagataatggatagcttggaaaattttaaaaatgagaagaggaatttgcaagagagagtgaccaccctagaggtgcaattgacctag

SEQ ID NO: 84735 - DNA, 342 bp, Glycine max
  Peptide Sequence Number=SeqID_176420
atgcttaatctgctaattgagtatgagaatcaaattgcttctaagaagaagaaaggaactctcatgatagttagcaagagctccaagaagaaaggcaaagtaccaaaaaggaagcatcttggacctaagtgtgatttgaccaaacccaagaacaaaaggaacaagattaaccaaactgatgttgaatgtttcttctgtaaggaaaaaggtcactcgaagagaaattgcaagaagtatcttgattctttgaaaaacaagaaacaagtcagagtgttagaaagagccttaggtagagaggatgttgagaatgtggataatgctattgacgagcctcatgagtag

SEQ ID NO: 84736 - DNA, 183 bp, Glycine max
  Peptide Sequence Number=SeqID_176421
atgccacttcaaggagaagatgagtcaagaataagctcaccaccacaggaagctatgaataagagcttgaagataaaagaagatgagtggaaggagaaggagagaaggagcacgaaattttgtgccttaaatgagcccactaatccaagatcaagtccaagattctccactaagtgtgcttag

SEQ ID NO: 84737 - DNA, 1140 bp, Glycine max
  Peptide Sequence Number=SeqID_176422
atggagagcctgtcagcggtgccaagcgataaccaaacgcatcgtgtgcttcagcatgagaagcttagcgccggtcatgtttccacctacgtccagcacaatcaccaaattcattggcgcattacaacggtggcgctttgctccaagaaggaggtggtggcggaagagtgtgagattggcacaacagcgaaaaaagccattttggtcggaataaactacccaagaacaaaggctaagttgagaggatgcataaacgacgtctggaggatccaccgctgcctgatcgagaagtacgatttctatgaacacgacatcaccgttttgatcgacaccgacgaatcctacatggagcccaacgggaagaacattcggtctgtgcttactaggctggtccaatcagcggagcccggggatgttctattcatgcactacagcggacacggcacgcgcctcctcgcgaaaactagagaggatggtgacactagttatgatgaatgcattgttccttctgatatgaacctcatcattggttgtgcattttcggtcaacgtcagtcaaggatgtttttggtcaatctcagtgttgaccgtgactggtttttggtcaacgttggttaggatttgtttggccaacatcgataaggtttttcacagcactactgatgatgatagggacattgaactcccacataagcaatgtggctatgtaaagaatagactctcactttatgacatttttggggaagatgctagccctaaagttaacaagttcctgaaggttatcttaaataaactcgaacatgggaatggtagaatcttggggttggtgggtagtcttgcccaagagtttctcaagcaaaagctggattcaaatgatggtggtgggtatgcaaaacctgccatggagacaaaggtagaaagaaaatatgaggcatatgttggatcaagttcaatgaagccacgcctttccaaatggaggaattttgatgagtggttactagacagaccaaacagtgatggttcagtaacaaatcaagagattattttgaaggcaagagagaagctcaagagggtaggtttcaaacaacgacctggactttactatagtgatgaccatgttgatggtccttttgtgtgctga

SEQ ID NO: 84738 - DNA, 267 bp, Glycine max
  Peptide Sequence Number=SeqID_176423
atgaagccggaatcgctagtaatcgccggtcagccatacggcggtgaattcgttcccgggccttgtacacaccgcccgtcacactatgggagctgggccatgcccgaagtcgttaccttaaccgcaagagggggatgccaaggcagggctagtgactggagtgaagtcgtaacaagccacatggatagtttaatgtgctcatcggcgcctgaccctgagatgtggatcatccaaggcacattagcatggcgtacttctcctgtttga

SEQ ID NO: 84739 - DNA, 117 bp, Glycine max
  Peptide Sequence Number=SeqID_176424
atggaagttcggcctctttgctctaccatcgtatcgaggtgccatgtcgtggtttcatttgattaccccgagaggggaaaattgtctttaggactggctcggtttaagtcccgatag

SEQ ID NO: 84740 - DNA, 453 bp, Glycine max
  Peptide Sequence Number=SeqID_176425
atgggtgatcaagaggagacgcaggaacagatgaaagccgacatgtcggctctgaaagaacaaatggcctccatgatggaggccatgttaagtatgaagcagctcatagagaagaacgcggccaccgccgccgctgtcagttcggctgccgaagcagacccgactctcttggcaactgtcgcaccatcctccctcaaacataccctcacctgggatacaaccgagcggcttacccttatggattgccgcccaactattcaccacccgtcttgcaagaagatgcgggccacattgcttctcccgtccttgaaagagagcctcctcagcagcccgacgaagtccacaaagaccctcaagactatgctcgaagggatgtcgagttctatcccccgatccccgaagggccggcaccaggcacgttgcctcaacccaacatcgcgacaccaccaatag

SEQ ID NO: 84741 - DNA, 327 bp, Glycine max
  Peptide Sequence Number=SeqID_176426
atggtcttgcttaacttgtttctagatgaatttgatcgagcattcatccgtctttttcctggaattcgttatgcgcgatatgtccacgaagtctttgtggctcttcctatgagcagtagcgaaaaggtgtctttagaggacatccaaactctcttgaaagtgcaagatccaagactcgcatcaaaggttgacttctctgtcggcggggtaactagaagcagaaaaggaagtacgcattccgctgtgaaagacgttatttcctcaaacgatttgatccaagggaatgaaactagttcaatgacccgaccccttagcctcttagggtga

SEQ ID NO: 84742 - DNA, 378 bp, Glycine max
  Peptide Sequence Number=SeqID_176427
atggaggccataaaagagcaaatggccacaatgatgaaggccatgatgagcatgaagaagataatggaagccaatgcggttatagttgccgctattagcgctgtcgctaaggtgaacccgatgctcccatctggcctcaagcaaatgaatcatccaacctcaaatatagcccctcctgctatggccgaaaagggaaaggcggatcatctagaggaaaggctcagggccattgaaggaggtgaagattattcctttgctaacctagaagagttgttcctagtacccaatatcatcacccctcccaagttcaaagtgctggactttgacaagtacaaggggactacttgtcccaagaaccatctaaagatgtattgttag

SEQ ID NO: 84743 - DNA, 573 bp, Glycine max
  Peptide Sequence Number=SeqID_176428
atggcccgcaccaagaaaacaggggagatgacaactgaggccgcaaaggaaattgctgagaagatcgattcctttgaggagcaggcgacacagggatgcttcatcccccgtggacgtcaagatattttcaccgcttctattggacgtctagagcaccctggacgtgtccgtgctgttggagccggtgtcacaatcaaacaatacttcggattggctccacggacatcccgtagctcttcctcgctgcctcctgaagaattgcagcagctgacccagcaaatcagggaccagctagaggagtcaatcatagaaaaagtgactcgacagctcttggcgatgtttagccagatgcagtcccagtttcagtcccaaatgcaatctcaaggacttgcactgccttcggagcctctggttggtccctcaagtcctcgagtaagcacaaaggagagttgtgttgatccctcaggaaacgatcttgagacggatgactcagacagccaagtaaaggtgggtgtggaggaggttaaagatccagatgctcccattcctgtacccactaatgaggttccttag

SEQ ID NO: 84744 - DNA, 560 bp, Glycine max
  Peptide Sequence Number=SeqID_176429
ttggaacctctttacgtgccgatcaacgtcttcatttcgccaaaagttggcccagggctttcccggtatcaacagggacaccaggatttatttattctgcgaagtgatcttccgtcacagtggcttctgtttctatcagctgtccctcctgttcagctactgacgggggtggtgcgtaaccgcaaaaagcaccgccggacatcagcgctggcaaagtgtagcggtcacgctgcgcgtaaccaccacaccccgccgcgcttaatgcgccgctacagggcgcgtcccattcgccattcaggctgcgcaactgttgggaagggcgatcgtcacgacgttgtaaaacgacggccagtgaattgtaatacgactcactatagggcgaattggagctccaccgcggtggcggccgctctagaactagtggatcccccgggctgcaggaattcgataacgtacatctacttgggttgtgatacggagaacaagagagagtacatctcttatggatcagttcaagtggagcgtacatccacttggttgttcaaagagaacaatggagg

SEQ ID NO: 84745 - DNA, 132 bp, Glycine max
  Peptide Sequence Number=SeqID_176430
atggttaaagcacgtcaaaagggggggaaaagagggaggtggttgcagaactttacggattgcacgacaatgctccctttcgactttcagcatgtcgcggaacttcacggattacctaacaatgggtgttaa

SEQ ID NO: 84746 - DNA, 1001 bp, Glycine max
  Peptide Sequence Number=SeqID_176431
aacatccggacaaactggaagagaaattcccgcaggttgcagcaaccggcgacggcccggacatcatcttctgggcgcatgaccgtttcggcggctacgcgcagtctggcctgctggctgaagtcaccccagacaaagcgttccaggacaaactcttcccgttcacctgggatgccgttcgctataacggcaagctgatcgcttaccctatcgcggttgaagccctgtctctgatttacaacaaagacctggtaccaaacccaccgaaaacctgggaagagatcccgaaactggataaagagctgaaagcgaaaggcaagagcgcgctgatgttcaacctgcaggagccgtacttcacctggccgctgattgcagccgacggcggttacgcgttcaagtttgaaaacggcaaatatgacgtgaaagacgtgggcgtagacagcgctggcgcgaaagcaggcctgaccttcctggttgacctcatcaagaacaaacacatgaacgcggataccgactactccatcgcagaagcggcgttcaacaaaggcgaaaccgcgatgaccatcaacggtccgtgggcctggagcaacatcgacaagagcaaaatcaactacggcgtgacgctgctgccaaccttcaaaggcaaaccgtctaaaccgttcgttggcgtgctgagcgccggtatcaacgccgccagcccgaacaaagagctggcgaaagagttcctggaaaactacctgctgaccgatcagggtctggatgaagtgaacaaggacaaaccgctgggtgctgttgcgctgaaatccttccaggatcagctggcgaaagatcctcgtatcgccgccaccatggataacgcccagaaaggcgaaatcatgccgaacatcccacagatggccgcattctggtacgccactcgtactgccgtcatcaacgccgcaagcggtcgtcagactgtcgatgccgcgctgaaagatgcgcagggtcgtattactaagtaa

SEQ ID NO: 84747 - DNA, 321 bp, Glycine max
  Peptide Sequence Number=SeqID_176432
atgctagctctaaagccaatcaaaactcagtgcaaaatcaagaaatttaatttggcaagagctattccatggaaaattatcaagggggacagtagtttcaaccctacaatcaaaaggaagaagaaagaggaaacaactgaatcgactcaacgagcatttaaaagtgtagtaattcaggttggtaagctggcagaagaagtgactaaagttatggctaggagagaagaaaactttgtagtggttgaagctcaagaggaaagccctgtagaagagcatgattcaagagaaaaagatgaagaggaaatggaagaggaagcatga

SEQ ID NO: 84748 - DNA, 273 bp, Glycine max
  Peptide Sequence Number=SeqID_176433
atgaagtggaagatggtctgcacgaaaaaattaagtcaaatgacatataaggcaacaaaggaaattgcagataggattgattccctggaatatcaggtctcacagggaagctttgtcacccatggacggcaggatgcactgactactgccataggacgaccagaacatcatgctcatgttcgtgttgctagagccagtgtcacgatcaaacactactttggaccggcttcaagggctcccgcacctcttcgtccatggctcctgaagacctag

SEQ ID NO: 84749 - DNA, 56 bp, Glycine max
  Peptide Sequence Number=SeqID_176434
atggacccagttaagtacatctttgaaaagccagctctcacaggacgaatcgcccg

SEQ ID NO: 84750 - DNA, 400 bp, Glycine max
  Peptide Sequence Number=SeqID_176435
atgggtaccccggcgaataaatcgatgctggagtcgaccggattctggcacccggatttcgccgaggcgacgcccaacgatatttgtgtcgcagtccgcacgcaggaagcgcagccggaaattctcgatttaatccgtgaacaattagagaaagagctgagtgctatcgctaatgcatcgggcagttcaacgcagctggtcaaggcgcggcgctgggagagcgcctgccagaaattaccggacgcgaatctgttgctggtttcggtggcaggcgagtacgccgccggggtggcgaaagagggattgttagccaataagagcgtgatgctgttttccgataacgtcccgctggagcaagaagttgaactgaaaacgctggctcgcgagaaaggggctcatt

SEQ ID NO: 84751 - DNA, 294 bp, Glycine max
  Peptide Sequence Number=SeqID_176436
atggtgcaagtgtgcacaattaaatttcgaacagcatatccaaatttcatgaaaatccaatggctacaatgcgaagggttttcctctaagctcagatgtaatattgaaatacccaacggtgaaaatgctcagaattgggttgcgaacatggtgctcaaatttcacgatgatccaacggtgaatgagcccaagatcgtcgtttttctaagacaggtttggtggactgcgggaaaaagaaagggttttgagaggagaaagggaaaaacaaaaatgaagccaaaaagagccacctga

SEQ ID NO: 84752 - DNA, 828 bp, Glycine max
  Peptide Sequence Number=SeqID_176437
atgacatactccgaattatggccttcattactggagaatcatttggtggtagccatacccaggagggtcctccagccaccctaccgcaagtggtatgacccgggtgccaagtgtgcgtaccatagtggagttcccggacacaacattgactcctgccgcctattcaagtataaggatgggccatcgcgggcaaagagtttaggagaggtagctacttccagacgcttcatctaccaatcgctgcaagcagcgtgtatggtctcccgtggcggaggcgaaagggacgagtgtttgtttcaccttggggagtcacacgacatggaaacctgtcccgtggtagaagaattgcttcagtggctcatggactgggggcagcttgaagtgtccaaaggagggaaggaggaaccacatatttgcatgcagttggaagaaaggaaggttcccttaatgcccaaggccctagtaatatgttttactaggaaagagaccggctccacacccatatacccccggacagcgcctaagccaacgccatttgcgtatcaaagtaataaggtcgttccgtggaagtatacccctcccgcgttcagcgaaagagttgcaaccgaagttgactccctatcagctaaggtgaccaacatcaccggcctcaatggcataacctgcagtggtcgggtgttcgcttcccctcacccggcggagttgccctccaaggggaaagcgcccatggtccaagagcccacagacgtagccaccccctcaaaagaagtagatcctccagtggtaagaggggctgaaaagaaagaagtcttcaaggggatcctctag

SEQ ID NO: 84753 - DNA, 210 bp, Glycine max
  Peptide Sequence Number=SeqID_176438
atgggttggtacaagggtccttgtggcagccatcatgcacaacaatgcaaattccctgacttggtaaaaaaggctaggaaggaattcgtaataaccactgaatcaaagtcttctgtaacatttggaaatatttatagtatcaaatttggtttctttccgttaggcccatattacgcaccatgtccaaagagtgctagacgtgaggggtga

SEQ ID NO: 84754 - DNA, 115 bp, Glycine max
  Peptide Sequence Number=SeqID_176439
atggccgatactactggaaggattcctctttggataataggtactgtaactggtattactcgtaataactcacctgggatccactcgaattcgtcaaagaaagagtggatcccag

SEQ ID NO: 84755 - DNA, 219 bp, Glycine max
  Peptide Sequence Number=SeqID_176440
atggaaaaaccgctttgccccggccctctcccctccctgttaagtatcttcctggcatcttccaggaaatctccgccccgttctaagccagtatacactccgctagcgcccaatacgcaaaccgcctctcccccgcgcgttggccgattcattaatgcagctggcacgacaggtttcccgactggaaagcgggcagtgagcgcaacgcaattaatgtga

SEQ ID NO: 84756 - DNA, 367 bp, Glycine max
  Peptide Sequence Number=SeqID_176441
atggcctactatgaccccttgcaacgtcatgctctagttccaacacctaatgccctattaggtactcaatggaatgtacccggagcaatacctgatatggatgaattattaggtgttgatttacgtcaccagttttctgctgaggctgatcaagttgaagataggagacatcgtggcagaagaaatcttgatagacacgcacaaaaatggaaacaaccatgtggcacatcctcacatggttcgagtcaatccatctcattcctcatccttgttgattttggccgacctttcgcacgaattgtacttggagtagggataagtgtcaatgagccatcagaaggaggaattgttgcttcattcccaagag

SEQ ID NO: 84757 - DNA, 464 bp, Glycine max
  Peptide Sequence Number=SeqID_176442
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaatggtggcgaaacccgacaggactataaagataccaggcgtttccccctggcggctcctcgtgcgctctctgttcctgcctttcggtttaccggtgtcattccgctgtatggccgcgtttgtctcattccacgcctgaacactcagttccgg

SEQ ID NO: 84758 - DNA, 312 bp, Glycine max
  Peptide Sequence Number=SeqID_176443
atgggtgaccaagccacaagcattcataacataaaagcaaagcttcatgatgaatcaagattgattcaaagatgttttgatgataacaaaggtgatgacaaacagctcaaaggtcaatcaaagaatgagttcaagatgtttaagatagaatcaagaacacttcaagattcaagaggaaagttgatttcaagaatcaagaatcaagattcaaggatcaagcttccaagaatcaagatcaagactcaagattcaagaatcaagaaaagacttaatcaagataagtatgaaaaggttttttcaaaaactgagtag

SEQ ID NO: 84759 - DNA, 999 bp, Glycine max
  misc_feature (981)..(981): n is a, c, g, or t
  Peptide Sequence Number=SeqID_176444
atggcggcctttattgtggccatccgcggcacgctgaagcaggcggtgctgctcggtctggcagccacactttcccatacggcagtagtctgggttattgccatggccggattatggtttggtcggggctgggatgcgcatacttcagagccgtggttccagctgatctcgggagtcttgatcgtcctgatcgccctgtggatggcatggcggacctggaaagagagccagccgcacgatcatcatcaccaccatcatcacgaccatgaccatgaccatgaccaccagcatgatcaccaccacgaacatccgctggttgatgacgagtggcaggacgctcaccagcgcgcccacgcgcaggatattaaccggcgcttcagcggccaaaacgtcaccaccggacagatcgtggtgtttggcctgaccggcgggctcatcccctgcccggcatccatcaccgttcttctcatctgcctgcagctcaagcattttgcccttggcgcgacgctggtcttcagcttcagtattggtctggcgatcaccctggtcgcttccggcgcgattgccgccttaagcctcaaacatgcgacaaaacgctggcccgggcggccacgccctgtggccgcctctcacgggtcagttaagcgtctgccgccagctgaaggtataacgcagctggcgttgctggagaataaattccggcgagacgctggggctccaggagtcatcgccgcccacgcccatatggaatgcatcaagattgagccagcatccgggctctgcacgcagcagatgctgatgggttgtctctcgcagctgctgctggctgtagcggctcaccgagaaatggaagcggccatccagctgatgcgttcccagcaccagctcgcgggtatcacagcgcaagccattttccgtcgggaagatatacggcgtatgcctggcctccaggggcaatctccagcgcccctgctgtgccgncagctttcggtccggata

SEQ ID NO: 84760 - DNA, 657 bp, Glycine max
  Peptide Sequence Number=SeqID_176445
atggaaaaggcgcgtgagaaagggaatggggtggtactcgttggtatgcactttcttacccttgagctgggcgcgcggatctttggcatgcttaacccgggcattggggtctaccgtcccaacaataatgcgctgctggactggctgcagacccgcgggcgtctgcgttccaataaaaccatgctcgatcgccatgatttaaaaggcatgatccgctcgctgaagcagaatgaaatcttgtggtacgcccctgaccatgactatggcaaaaccaatagcgtctttgtgccgttttttgcggtgccggatgccgccacgacggcgggcagctatatgctggtcaaaagcgcacggcctgccgtcgtccccttcgtgccgcggcgcaaggcggacggctcaggttacgaactgattattcttgaggatatcagcgaggcgctgcagggcggcgataaagaagccgtggcgacgcagatgaacagggcgattgagcacgcggtacggatggcgccagagcagtatatgtggctgcaccgtcgcttcaaaacgcgtcctgaaggggtacctgaccgctatgcccgccagaaacagacggcgacacggcatgatattctctccgacggcgatttttctgaccgctcaggcgtacagcactga

SEQ ID NO: 84761 - DNA, 1914 bp, Glycine max
  Peptide Sequence Number=SeqID_176446
atggccaaatatcttgcaaggtcctcaactccatttgctctgtggtatcctgaatctttctgcatgggtagttgttatttctccaattctggtgcttatcatttggggctcttggttgattgtaatattgggtcgagacctgattggtttggctgtaataatggctggcactgctcttctattggcattttattcaattatgctgtggtggagaactcagtggcaaagctcaagctttactggattcagtgcaaacctggttcccaaaaaaaaaaggtcaaaaaggttgctggacttgttggggctgttgcaatcctgcttcttttggctgttgctcttctttgtgcatatgaactttgtgcagtatatgttacaactggatcacgagcatctgatcgctattctccttctggtttcttttttggagtctctgcaattgctttagcaatcaacatgctatttatttgcagaatggtgtttaatgggaatggcttggatgtggatgaatacgtgcgaagggcttacaaatttgcttattctgattgtattgaagtaggtccagtggcatgtttacctgaacccccagaccctaatgagttgtatccgcggcaatctagaagggcttcccatcttgtactgctctatcttggttcactatgtgttctgttagtatactccatcttatatggtctaacagcaaaggaggagaattggcttggagcaattacatcagttgctgttattattcttgactggaatttgggcgcttgcctgtatggttttcaacttcttgatagtcgtgttgcagcattgtttattgctggaacatctcgtgtgtttcttatctgttttggagtgcaatactggtatttaggccactgtatcagctatgctgttatggcatctgtactgctaggagcggctgtttctcgccatttatcagccacaaacccattagctgctaggagagatgccttacaaagcactgtagttcgtctgagagaaggattccgtagaaaggagcacaacagttcttctagcttttctgaaggctgtggctcaagtatgaaacgaagtagtagtgttgaagctggtaatcttggtaatgtcattgaagttggcagggctatggctgcaggtgatgggagcaattggaataatgtcctgtctcaaactactagtttaccggatggaatcaatagcgataaaagcatagatagtggaaggtcaagtttagcattacatagcagctcctgtcgctcagctgttcatgagccagaagttggaacatcatccgatgatagaaatttggatcacaataattctttggtggtttgttctagtagtggtcttgatagtcaagggaatgagtctagtgcatcaaactctgcaaatcaacaaacactggatttgaatttggctcttgcattccaggaaaggttgaatgaccctagaattgtaactatgctgaaaaggacaagacaaggtgatcaagaattgagtagtttattacaggataaaggattggatcctaattttgctatgatgttaaaagagaaaagtttagaattagatccaaccatactggcattgttgcaaaggagtagcatggatgcagatagagatcataatgaaaatactgataacaccagtgttgacaatgccatgcctaatcaaatttcattatctgaagaattgaggctacacgggcttgaaaagtggcttcagttgtgcagacttgtattgcatcacattacggtttggtttggcggtgctcctgttatctcctgtgatatgttcaattatggctttccttcgatcacttacggcagaagaaatgtccatgacatcaaaaccaaggaaggtactagattggctgtttttaggattaaaaatgccaagttcatctactga

SEQ ID NO: 84762 - DNA, 2133 bp, Glycine max
  Peptide Sequence Number=SeqID_176447
atggccccttatggttttattgcttggctactcagcacttgtgttggattgttgctctcctttttaagcaaatcatctgttctcctcggtatatccttgactgtgccactaatggtggcatgcctttctgttgccattcccatatggatttgtaatggttaccaattttgggttccccgcctgaattgtaatggaagtgctggaaatgatcgaattcctcgaacaaaggagggtattgttcttcttatcagtatgtcagtatttgttggatctgtactggctttgggagcaatagtttctgcaaagcccttagacgatttaagatacaagggatggaatggtgatccaaaaatcttgggttccccttacacatcatctgtttttcttggctgggcaatggcatctgcaattggtttagttgttacgagtgtgcttccaataatttcatggtttgcaacatatcggttttccctttcctctgctatctttattggactttttgcagttattcttgtggcattttgtggggtgtcttatttagaagttatcaaaaccagggatgaccaagttccaacaaacggtgatttcttagctgctttacttcctttagtctgcattccagcagtgctgtcactttgctgtggattgctcaagtggaaggatgatgattggaaactttctcgtggtgtatatatttttgttataattggtcttttgcttctgcttggtgctatttcagctttgatagttgttgtcaagccttggactataggagtagcatttcttttggttcttcttcttatggtattagcaattggtgccattcaccactgggcatcaaacaatttttatttgagccggacacagatggtctttgtttgcttccttgcttttctgttggctttggcagcatttcttgttggatggtttgaaggtaaaccatttgttggagcatcagttggttatttttcatttctttttcttcttgctggacgggcattgacagttctgctttcaaatcccattgttgtatattctcctcgagttttgccagtgtatgtgtatgatgctcatgcagattgtggaaagaatgtcagtgtggcctttctcatgctatatgggattgccctggcaaccgaaggctggggggttgttgcaagcttaaagatatatccaccctttgctggtgcagctgtatcagcaattaccctagttgtttcatttgggtttgctgtatctcgtccttgcctaactcttaagatgatggaagatgctgtgcatttcctcggtaaggaaactgttattcaagcaattgctagatcagcaacaaagaccagaaatgcattatctggaacctactcagcaccacagaggtcggctagttctgctgcacttttgattggagaccctaccattatgcgtgatagggcaggaaattttgtgcttcctagagctgatgtgatgaaattgagagaccgcttgagaaatgaagaattagttgcaggttcattctttagtagattaagatatcataggacattccgccatgagccaaccagcgatgtagatcatagaagagtaatgtgtgctcatgctcgaattctggcactagaagaggccattgatactgagtgggtgtacatgtgggacaagtttggtggttatttgcttttgttgcttggtttgacatctaaggcggaacaagcacaggatgaggttcgtctgagactctttcttgatagcattggattttctgatttaagtgctaagaaaataaagaagtggatgccagaagatcgcaggcaatttgaaatcattcaggagagttacataagagaaaaggagatggaagaggaagtcttcatgcagaggcgtgaagaggagggcagagggaaagaaaggaggaaggctctacttgaaaaagaggaacgtaaatggaaggagatagaagcttctctgctctcctccattcctaatgctagcagcagagaggctgctgccatggcagcggcagtacgtgcagttggaggcgattctgttctagatgattcctttgctcgagagagggtttcaagcattgcacgtagaattcgtgcttcacaattgtctcagcgtgcacttcaggtttattaa

SEQ ID NO: 84763 - DNA, 1134 bp, Glycine max
  Peptide Sequence Number=SeqID_176448
atggagagatcagatgctgccagggttccccaagatcttgtgacaacaggagggaagtgcatgatcttaaaatgggtaacagaggataccttgaagaccttgaaagaaaaggtaaaagagccttcagtgccagagccagaacctgagccaactactgaagtactttttctttgcagctatgatggctgtggaaagacattcatagatgctggtgcattgaggaaacattctcacatccatggagagaggcagtatgtttgtcactacgatggatgtggaaaggtagtggttttaatacttacagatgcacacccatacacatgtctatttagcagtgctgaaagtattttgttcacattgcagaaatttctggatagctcaaagttgaaaagacattttctcattcatacaggggagagggattttgtgtgtcctcatgaaggctgtggtaaggccttctccctggatttcaacttaaggtctcacatgaaaacacattcccaagagaactatcatatctgcccatatccagattgtggaaagagatatgctcatgaatacaagctaaagaatcacattgcatctcatcatgaaaagaatgcatccgtggatgtgacaaagtacactactcccccttcagagaagcaaacaaaaacttctaaaccatctggaggggcatatggttctgcatcatctgaccgtccctatgcatgtccctatgatgggtgcgaaaaggcatacatccatgaatacaagcttagactccatttgaagagggagcatccggggcttatggctgatgaaaatgcagagcatgctcaggctaatgttgacaatgaaatggatgaagcaagtgaccatgatgcctatgttgcgaaacgatcaaatggtaaaattcagaagcagagtaagcctaaaccaaacctcaagttgcctccttccaaaattgcaaaacgcaaactgtccactccctctttaactgtaaataaaaattcttggcccgtgaaagatgaacctttcgatgaagaagatagcgaagaaacagaagaggatcgtgacaatgttgaagatggttggagatatgcaggaggaaacaatgaagatgatgatgaggaaacagaatatgaagactga

SEQ ID NO: 84764 - DNA, 1128 bp, Glycine max
  Peptide Sequence Number=SeqID_176449
atggcaaattcaaagggctcatcaggtttcagaaattttatgtatcctggaaagcatcctctacttcctcctaaaagtccgtttcctagtgtttcccaagcatatgctgattatgtcccaaatcctgctgttggtttaaaggctggtaacagacctagagatggaaacacacaccaccaacgtacttcatctgagagcctcgttatagaggagcagccttcatggcttgatgatctccttaacgagccagagacacctgtccgaagaggtggccatcggcgttcatcaagtgattcttttgcgtacatagacactgttaatgcatctaacattaattatgctaatcaggacgagtataaatataagaatatgatgtctattccgtcttggtcatctcaagactttgaccgcagcaaagatgctcgtcatgtacctgtttatgcagaaatgaactccgtaaaacagaaaaataggtcatgggactctttttcaaatgccatgacaaatccagttggtgttccctcaggcaaagacagtgctgcttttcagagttcaggattgcaatgtacaccacatgaagcagatggtcttccaccagcatcaagtgaaaagcacgattcagtagaatcaggcttacaggatgcaaaaccatttcctgaaaaaaaggacagttcacatgcaaagtcatctgcctctgaaactgatacaaaacgtgctaaacagcaatttgctcaacgttcacgggtccggaaacttcaatacatagctgagctggaaaggaatgtacaagttttacaggcagaagggtctgaagtctcggccgagctcgagtttcttaaccagcagaatcttatcctgagtatggagaataaagcactcaagcaacgtttagaaaatatagcacaagagcagcttatcaaatatttggagcaggaagtactggaaagagagattggaagattacgtgcattgtatcagcagcagcagcaaccacagacacagccacaacagcaaccatctggaagtcacagacgcacgaacagtagagacctcgaatctcagttcgcaaacctttctctaaaacacaaggacaccaattcagggcaagaccctgctctcagaatttag

SEQ ID NO: 84765 - DNA, 561 bp, Glycine max
  Peptide Sequence Number=SeqID_176450
atggctccttctcgtctagcaggaatgaagttggtggagattaaagtcccagccttcatatctatatctgtatcagttaaaaaattcagacgttttatgatttatgttcatgccaaaggaatggtagttgatgacgaatacgtaattattggatcagcaaacattaaccagagatccttagatggttcaagggacacagaaatagctatgggtgcctatcaaccaaaatatacatggacagaaaagaatgctcatccacgtggccaggtgtatggatacagaatgtcactgtgggctgagcaccttggcagtcttgatcattgttttgctgaacctcacaacctggaatgtgtcagacatgtcaacaaaattgccaaacgaaactgggacatatatgtgtctgaggaagagaatcggatgaggggacacttgatgcaatatccagttaagatcagcagggatggaaaagtcagtgcacttgatgattatgaatcctttcctgatgttggtggcaaaattcttggatcaccaaattcacttccggatgcattaaccacctga

SEQ ID NO: 84766 - DNA, 2304 bp, Glycine max
  Peptide Sequence Number=SeqID_176451
atggaggacagtgaaaggtttgaagaaaggtccttttcaaatggggatgtctacattggtaaaatcaagggcatgcttccccatggcaaaggaaagtacacatggtcagatggaacagtatatgaaggtgattgggtaaatgggaaaatgacggggaaaggactgattacatggccaacaggagcaaagtatgagggtgaattctctgggggttaccttcatggtcatggcacctttacacattctactgggtgcatttatagtggtggttggaggatggatgctcatcatgggattggacgaaaggagtattccaattcagatatatatgaaggtttatggaaagaaggaattcgtgaaggctgcggaaggtattcttgggagaatggaaatacgtatattgggaattggaaaagtgggaaaatagatggcagaggggttatgaagtgggctaatgatgatatttttgacggctgttggataaatggacttaaacaaggatctggagtttatagatttgctgatggggggctttatattgggacatggagtaagggactaaaggatggaagaggaacattctatcctgctgagaaacatacagctacaaaacaaaaatttactcgtagtttttctgaaaagatttctgtcagtggtagatcaaaaagttcacgtcaaatatctcacaggacttcatcattagatgcaaattgtatcattcaagatcctgctggagattgcatatgtcgtgactcttcacccacattatcgcagacttttaatgaaagtcaatctgaggcatctggtgtgaactctttgctttacgaaagggaatatatgcaaggagttctaattatggagagaattagaaactattcagaaataccacataaaaacaaacgtcaaaatacgtttagtgtgaagcaagctaagaagagttcatggattgatatttttggaggcagccgaagctattatttgaagctaaatttgcagcttggcatcagcaatactgaccgatatatttgggcatgggtagagaatgtaaagacatttaagtacactgttggaaaaattacaccagtgcctgcacgtgaagttcggtcatctgattttggagatcgagctaggataaggatgtacttccccaaggagggttcccagttgactcctccacattgttctatagacttctactggaaggattattgccctatggtattccggaatttgagagagatgttcaaattagatgctgcagagtacatgatgtccatttgtggtgattctggtctaagggacatatcttcacctggaaaaagtggcagcatcttctttctttctcaagatgatagattcgtgataaagacactgaaaaaatatgaactaaaggttatgctcaatatgcttcctaaatactatcatcatgtaggaagttatgagaatactcttattacaaaattctttggtctccatcgaataacactaagaggtggtaaaaaggttcgctttgtggtcatgggaaatatgttctgcacagaacttcatattcaccgtcgttatgatctgaaggggtctactcaaggaagatatacagacaaagataaaattaatagcaatacaacattgaaagatcttgatctaaaatatgaatttcatatggataaaaaattacgagaatccctattcaaacaaatttctctagactgcatgttcttggagtctcagcacataattgattacagccttctgttgggattacattttagagctccggagaatctaaaggccttagtggaacctcccagactaccgcagcctcaacatggcttaccctctgaagatgatgcacaaaaacaaggggagcagttgattattcctaaaggcttgttattagttgctcatgaacctagctttgtcaacactgcacctggaccccacattagaggaaatacattgagggcatactccataggtgacaagcaagttgatcttttacttcctggtactgcaaggttgagagtgcaattaggagtaaacatgccagctcaagcaacacgcaaacttcaggaggataaggtggaagaatcagaagtagagctttttgaggtttatgatgtggtcctatacatgggcataattgatatattgcaagaatacacagtgaaaaagaaacttgagcatgcctgcaaatcactgcaatatgaccctatgactatttcagtggtggaaccaaagacatatgctgaacgtttcatcaatttcatggagaaaaaagttttccctgagccagagacttcttga

SEQ ID NO: 84767 - DNA, 744 bp, Glycine max
  Peptide Sequence Number=SeqID_176452
atgggtgcatctgctccattttggcggtattcagctgcttcttatccagatcttgaaggaagaacacctgttaatgcccttgtgggagcaaaaaatatgaaacctgttgccaaacttgatacacctgtggggggagatgtttatcctatagaaccatcagatggttttacagtcaatcaagttcttgacgctcactggggtgtcctcaatgatgaagataccagtggaattcgatcacacacgttatccatgcttgtgaacgatgctcctggagttctaaacattgttacaggagtttttgctagaagaggctataacattcagagtttagctgtaggacatgcagaagttgaaggactttctcgacttacaactgtggttcctgggacagatgagtcaattagcaagttggtgcagcaactctataagctagtagagctacatgaggttcgtgatatcacccacttgccatttgctgagcgagaattgatgctaataaagattgctgtaaatgctgctgcacggcgtgatgtccttgatattgctagcattttccgggctaaagctgtcgatgtatctgatcacacaataactctggagcttactggagatttggacaagatggttgcattacagagattgttagaaccatatggcatttgtgagaatattcatactggaggaaagaactcagttttgctagtcttggctaagatgtacttgttttcttttgaagctctgtag

SEQ ID NO: 84768 - DNA, 99 bp, Glycine max
  Peptide Sequence Number=SeqID_176453
atggtggtggtgttgatgaaaaaggagaagaatgtaaagattgtgttgagtgtgagtatgactgttagtttgcatggaaaagggtgtgagatgaaatag

SEQ ID NO: 84769 - DNA, 1257 bp, Glycine max
  Peptide Sequence Number=SeqID_176454
atggaaaacatgcattggtcacagcatacacatttagtggtactgtttttcttgggaatggttctaataccttccgtgtgtcaaagtgattcaactacagctgtttacattgttactctgagacaagctcctgcttctcactatcatcatcatgagttaatcacagtgggcaacaactctaaacatggttcatctgggagaagaagaactagagttcacaaacaaagacatcagaatgtttcaaagccagttatgaaacgtggttcgtactttgcccgagttcacgactcattgttgaataaagtgtttaatggggagaaatatctgaagctctatagctatcattacttgattaatggatttgctgtgctggttacccaacaacaggcagaaaaactttcaaggagaagagaagtgtccaatgtggctttggatttttctgtgagaactgcaaccacacacactccacaatttttgggtctgccacagggagcttggttgcaagcaggtgggtttgaaactgctggagaaggaatcgctattgggtttgttgacactggcattgatcctacacaccctagttttgcagatgataaatctgaacatccattccccgttcctgctcatttctctggcgcctgtgaggttacgccagattttccgtccggttcttgcaataggaagcttgttggggctagacattttgccgcttctgctataaccagaggaatatttaactcatcccaggactatgcttctccctttgatggcgatggccacggcacgcacacagcttctgttgcagccggaaaccatggaattccagtgattgttgctggccaagtttttggaaatgctagtgggatggctcctcattcacacattgccatttacaaggcactatacaagagatttggaggatttgcagcagatgttgttgcagctattgaccaggcagctcaggatggggttgacataatatgcttgtcaatcactcctaataggcgtccttctggcatcgcaactttcttcaatccaatagatatggcattgctatcagctgtgaaagctggtatttttgtagtgcaagctgctggcaatactggaccatcacctatgagcatgtcctccttcagtccatggatttttactgttggtgccacctctcatgatcgagtttatagcaactccctatgtcttggaaataatgtgaccatacctggtgttggacttgcacgtaaaattctgttgctctaa

SEQ ID NO: 84770 - DNA, 2070 bp, Glycine max
  Peptide Sequence Number=SeqID_176455
atgggggatgtttctgaccggataggacgtcccacagataatggccagattggcattattgatcctgattgtaggttgattggactccacttgtatgatggtttgtttaaagttattcccttcgacaataaaggacagctcaaggaagcatttaatataagtgctagtaactatgagcctatgaccttgattaaggattaccagttaccaaagccctggttgtgtaagaatgaactgcgaacctatgtcaagcttgaggagctccaagttttggatatcaaatttctttatggttgttcaaagccaactattgtggttctttaccaggataataaagatgctcgtcatgttaaaacatatgaggttgcactgaaggataaagattttcttgaaggtccatggtcccagaacaatcttgataatggggctgatttattgataccagttcccccacctctttgtggtgtgcttattattggggaagaaaccatagtgtactgcagtgctaatgctttcaaggctatcccgatcagaccttcaattacaaaagcctatggaagagttgatcctgatggttctagatatttacttggtgaccatacagggttgcttagcctacttgtaataacccatgagaaagaaaaggttactggactcaaaattgagccccttggggagacttccattgcgtctacaatatcataccttgataatgcattcgtctacattggttctagttatggagattcacagggccaaggtcaggttgtaacttgctctggagcttacaaggatggttctcttcgcgtcgttcgtaatggaataggaattaatgaacaggcatcggtagaacttcaaggtatcaaaggaatgtggtcacttagatcctcaacagatgatccttttgatacttttctggttgtgagttttataagtgaaacaagaatcttagcaatgaatcttgaggatgagctggaagaaactgagattgagggattctgttctcaagtgcagacattattttgccatgatgcagttcataatcaacttgttcaagtcacatcaagctctgtcagactggtcagctccacaactagagagcttcggaatgaatggcatgcaccatcaggctattcagtaaatgtagctacagcaaatgctacccaggttttgttggccacaggaggagggcatttggtttaccttgaaattggagatggcatattacaggaagtaaaacatgcccagctggagtatgagatttcatgcctggacataaatcccattggtgaaaaccccaatcacagtcatctagcagcagttggaatgtggacagacataagtgttagaattttttctcttcctgatctgagtctcatcacaaaggaacaattaggaggggagatcatacctcgttctgttcttctttgtgcctttgaagggatatcgtacttgctatgtgctctcggtgatggccatctcttaaactttatgttgaatacaagtactggtgaattagcagataggaaaaaggtatctctagggacacaacctattacgctacggacgttctcctccaaaaatactactcatgtgtttgctgcatctgatcggccaactgtgatttacagtagtaacaaaaaattactttatagtaatgtgaatctgaaggaagtgagtcacatgtgtcctttcaattctgctgcttttccagacagtttggcaattgcaaaagaaggtgagcttactattggcaccattgatgatatacaaaaacttcatattcgctctattccactgggggagcatgcacgacgtatctgccaccaggagcaatctaggacttttgctatttgtagtttgaaatacaacccagcaagtggtgaagactctgaaatgcactttgtccgtttgctggatgaccagacttttgagttcatatcaacttattctcttgacacttatgagtatggttgcttcataattagctgctccttctcagatgacaataatgtgtattactgtgttggaactgcatatgtactgccagaggaaaatgaaccaaccaaa

SEQ ID NO: 84771 - DNA, 492 bp, Glycine max
  Peptide Sequence Number=SeqID_176456
atgaaaaacaaagggaagcaggttcagcttatggattcttctcactctgattcacccaagaacctgtcagagtctaggtgccctccttataccaagaaacgtttgattccagattccactgtcatttctacccgccatgcctctttgagatcagcaaagaagcttattgaaactagaggaacatctgttgatgtagctcaaatgaaaaaagcaagtgaggatgagaacccggtggctaatcactcagttcaaatggaagagcacaatgcatttgaagcccaatttatcccttttgagcaggaacatttggaagaggatattgaagcatctaactctggggaaagttcagacaagaacaatgacaagtccatttcaatggttggacatccatccttctgcctcaatttactgaatttattaatatggggaacaatgaggttaattatgttggacaaagatcatggattgataaggttgaaggatactaagtga

SEQ ID NO: 84772 - DNA, 594 bp, Glycine max
  Peptide Sequence Number=SeqID_176457
atgttcttttgcctagaagtcattgaagaaatccagaagagaggtaccagagaggcaccgggagatctcttagatgataaatttgttcaaaatgacaacttgcactcttctcttaatccagctgccccaaattctaaccttttaccttccaggagtgctgtgcttcaagcttgcataataacttctggtctcatagctgctttgggaatagtgattcggcaggtgtctcatgttgtgtcagtggaaggatttccagtcttggactgctcttcagaagtatcatttggttttgacatgtggcattttgagttgattacaggacttgtagttttaatatcatcatgtcgctatttgctattgaagacgtggccagattttgctgagtctagcgaagcagcgaagcagccaatcagcaggtccttagctcacttcagcctttggattatattgttgttgcatttttgcctgtatgaacaagacggaaagccactacctaagttcggggaatgggatgtgaatgatcctgcctcagctgaaggattcactgttatattcaaaccatcgttgcagagccttctcaaaccatcgttgtag

SEQ ID NO: 84773 - DNA, 138 bp, Glycine max
  Peptide Sequence Number=SeqID_176458
atgactacagctggacgagaagtggatctgcgactgagatccgagagtaagcgtgaagcagaggatcatggtcgtgaaaagcggaacaaggaagaagaaggtgtaagtgatggtgacagaggctttgctcccaagtga

SEQ ID NO: 84774 - DNA, 1962 bp, Glycine max
  Peptide Sequence Number=SeqID_176459
atgggtaggtggtggtcgagcacgttggttttcactgttctctctgcaccaatacttataatagcattactctcctccacgttcgaagaagttgaccatgataacacagtgcctgtgacgggtcttcttcacacggattcccgatggatcctcgaccaagatggccgaagggtgaaactagcctgtgtcaattgggtgtcccatttggaagctgtggtggccgaagggctcagcaaaaagcccgtggatgtcatttcaaagggaataaagtccatgggcttcaactgtgtcaggctcacttggcccacacttttggtcaccaatgactctcttgcttctctcaccgttagacgatcctttcagagccttggcctccttgaatccattgctggtgtccaaaccaacaacccctccatcatcgatctttctctcatccaagcttttcaggcagtggtgaagagtctcggggacaacgatgtgatggtgattttggacaaccacgtgacccagccaggatggtgctgcggtaacacggacggcaatggcttcttcggtgacaaattttttgacccaaatcagtggatattgggcctcaccaagatggccacccttttcaagggagttacagcagttgtgggcataagcttaaggaatgagctccgaggatctagacagaatgttaatgattggtacaagtatatggtgaaaggagcagaagctgctcatgcagcaaatccagatgttctagtcattctatctggcctaaattttgacacagacttgtcattccttcgggatcgaccagtgagcctcacattcaaagggaaactagtatttgaggtgcacaggtatggcttcactgatggtggagcttgggctgatgggaacccaaaccaagtatgtggaaaagtgacagcaaatataaagaaaacatctggcttcttagtggaccaaggatggccattgtttgtgagtgagtttggtggggacttgagaggtaccaatgtgaatgacaaccgataccttaactgttttctggcactggtagctgagcttgacttggattgggcctattggacacttgttggtagttactactttagagaaggggttataggaatggaagagttttatggccttctcacttgggattggaatcaggttaggagtaccagtttcttaaacagaatctctgccctccaaattccatttcgaggaccaggcatcatagaaggcaatccacacaaactgatattccaccctttgacaggtctctgtgtcataagtaaatcacagctaacatcactaacgttggctgcttgctcttcttctgatgcctggacatacacacctcaaaagaccctattggtaaacaacacagatttctgcatacatgcagaggaagaaaggaagcctgcaacacttagcatgacatgctcagatcctaactctaaatgggaaatgatttcagattcgaacatgcacctttcatctaaactaagcgacggttctaatttatgtctagatgtagatgataacaacatcattgtgaccaatgcttgtaaatgcttgagcaaagataagacatgtgaccctggaagccaatggttcaaacttatcgacagtggaaggagcggtggagatgtacatgccacaaccatgggaatactgggcatgctctcaagctattcatgggatgccaaggtggtgatagcgttagcagcaaacttcaaggagttttggctgtttcaaacaattaacaaccttctcaaggcaatgttggatgtaaccaataacgttgtccaattccatgagcttccctctcagtacattgaccctgaggcaccggagatgttgactgcctccaatcttattcccggtgctgtctattggaccattcggagtatagtgtcctgtgcatcgcatgttttggacataactggcttgggtcaagggtattga

SEQ ID NO: 84775 - DNA, 471 bp, Glycine max
  Peptide Sequence Number=SeqID_176460
atggaggaaaaattattaaaagaagaaattgataatttaaagaaagaacttgagaaagagtctacaataaattcaaacaaggaatctgtggatgaggctggtggagaccaaaccagtacacatgcaatattacaacagaaagaaaaggagctggaacttcttatccgtgatttggacgacaaagttcgttttgggcagaaagccattgaaaggccaggttcatcggcaggaaagtcttctactttttctgataggccacattctagatctggctcctttgaggattctagaagtgtggattttacagacagacctcgatctcgtggtacaggagatatgtggatgcatcctagtgatgacagaagacagtttcaaggtagcagggaaaggggatggttttctggcagccgagacttgaataggcaattggagcaacaatcattgagtactggcactaaaacttttgcctaa

SEQ ID NO: 84776 - DNA, 978 bp, Glycine max
  Peptide Sequence Number=SeqID_176461
atgtggttaaggagctatgttgtttgctttgttcaggtgtatgttagaccagctggtagttatgtgatggatcggttggagctgcggcgggttgcactgtaccctggagatgcagaggcagagggcattgtcattcttgtgggtcattttaatattcctgcaggcttgcgtgctgccgaggccacgctttccaattcacaagttaatgttgtccctgaatgtaaggctgtggttcttccgatggtgaaacacccatttgttgttggtttcttggttgctgagcttccattggtggagcaggaacagtgtcagaaatctcaaagtgatgggccagaaaacctcatgtctgttgaggaaccttattcatttcctccctttttggatttagataagaagtcaagggaaattcagaatcttcaggtcaagaatgaggcagttggtatgcataacttcacttctgagcaaagatcaaatgctgtcaacatttcacagtctctagctatggcatatgtcatggatcagaaagcaatgttacttcagcaatcaacatggcaaaataatgtcaggatgggtaatctggttgagcaaatccgtggtccactttcaagtattcaaaccttaagtaaaatcctgtctacacagacaaagagaactcagatttcacatgacattgttgaagacctcttggtgcaaggtgatcgtctgagggatgttctccaacaactacaggatgctgtttatttgacaaagacaaatatagtgcgctacaatgaagaagcaatcaagaaaatgaatggttctactcacatacttgctgaatcatcaagatctcagttgttagatagctctccaggtgatgtctctgcaaataaaatgaaaaaatctagtgagtcactatctctaagtgctgctgtccaagatatagagatgccactaccacctttggcccttgctccattgcaacatggaatcaggtag

SEQ ID NO: 84777 - DNA, 2214 bp, Glycine max
  Peptide Sequence Number=SeqID_176462
atggagattcttccactatacaaaagaatggtaggattacaaagatatgtttacaaaattgactcactctacggtgactcattcaagcttgaggatagagatttctcaaggaagaactttgtcaccgtcattgcgaaagtcattgtcattggtggcagagggagaagagtgagtgtggcgacaacagtggaggaggaagacagtgatggagaagagagtaacaacaacaacaacgaccgcggcggcggtcaccggagaacaacacattcccgatcagtttcctggaccgaccggtctccggttacccggaaaccgccgcgtccgcttcagcctctcgccatcaacaaacgcagcgttatggagtggccgagcgccggctgcgacgatctcggcgattggtctcttccaccgaccccaagaggttccaccataacaccagattcgggttcgggtaaagtatttcaattcaagaaagactattatgcgttctacgacaaggaatgttcgagaatcgcggagcacgtgtacctggggagtgacacggtggcgaagagccaggagctgctgcggcggcacggaatcacgcacgtgctcaattgcgtcgggttcgtgtgccccgagtatttcaaaacagacttcgtctacaaaacgctctggctgcgggactcaccctcggaggacatcaccagcattctctacgacgttttcgattactttgaggatgtccgccaacagggcgggcgcatgttcgtccactgctgccagggcgtctcgcggtcgacctcgctggtcatcgcctatctcatgtggagggaaggccagagcttcgaggacgcgttccactacgtcaagaacgcgcgtggcgtcacgaaccccaacatgggcttcgcgtgccagctgttgcagtgtcagaagcgggtgcacgctatgcctgcgagtcccagttctgttctcaggatgtataggatggctcctcattctccttacgaccctcttcatcttgtccctaagttggtagatcatccttcccctcgcgcgcttgattcgcgtggcgcgtttgttgtgcacgtgccctctgctatatacgtgtggattgggaaggagtgtggctccgcaatgtgttgcaatgcaagatcagcggctgctcaggttgttcggtatgagagagcaacgggggagattgttagtgtggttgaggatgaagagccgaaggagttttggattgctctttctaccaaggaagtggtggtggagattatggagattgatgtggggattcgtcccaggagagttgaggagtatgatttagattatgggatttttcataaggcgcttgctggtggggttgttccacctttttctttgtctaatgctggatccgaaaattgccttcccgctagagaaaatgggtgggggagattgactaggaagcttgctagtggtatcatgaaaggcttgtttacatcctctaagtgctgtgagtctagtgtgaacatcattgaagaggggaatcaacatatgaatgttgatcctcttccaccttcttccaacaatgtgggtggttcgcggggttcctttgagtgttttggctcggagaggggaaaggataatgttcaagtcagggatcagtttgttgtccctagtgttgttggttcatcaatgccgctgccaccatcgcctcatcatcgagcatccgattcttttgcttgttttctaaggagcagccccaaattcagttccaactccccaactctgtcgcccaccagttcggattatgcaagttcctttacattttcgccttcatcgactgacttgtcaattgtgtcttctcggcagctatccccttctggtctggaatcagctgaacccgctcatgtgaaagacgcatcttcctcagagtttcgctccttagttaagaaagaaggtgagacatttctggctaatcacaccttggtaggagcaaagtccagtttgcggcgcaaaggaacttccctctccattgcagagcgcagagggaataaccccccacctcgcatgttgctaccctcagccagcgaatcatcccgtgccagcaaggtccgggtaagatccaggtcattctcattgcctgtcttggatgatactttgatgaaggatctgttgagagtaaggttaatggcagaggatcattgtaatatggtactgtgtcatgttaaggtaggttgttatgcttga

SEQ ID NO: 84778 - DNA, 162 bp, Glycine max
  Peptide Sequence Number=SeqID_176463
atgaagtcctacatcgctccaccaccaccaccactttaccaatctcctcatgagaagccacccatttacaaacctccaatttatgagccaccaccattggagaagccaccggtctacaatccaccaccttatggccgctatccaccatccaagaaaaactaa

SEQ ID NO: 84779 - DNA, 225 bp, Glycine max
  Peptide Sequence Number=SeqID_176464
atgctaacatgtgcccttaagacacttgttagtgtattatacatagttactattggaagtatccttaacatgtaccctaagtgcgcatgtcgttctgatgaatttccagtggaacctactgacgagtcttcatcttcatcttcagtgttaccaaattacgaagacaatgatcatgaacccattgttcaaacacaagagcaggaacgagaagatgctaatatatga

SEQ ID NO: 84780 - DNA, 1161 bp, Glycine max
  Peptide Sequence Number=SeqID_176465
atggtgaaagctactcgcaggattatcacttccaccactgtcaataacaaaggtgcagagattgaacatcttattcctggtctgaatctaccatacggcctgcttcatctctcttgtatacaggaaaaatatatagatagcagcatcacatcccaagatcagtttccaagtgatgcaacaaagatttgggttccaacaaatccaagaggtgcagaaagattacctcctgggatagtaaatgcagaatcagacttatttttgggcagattatggggtcttcccagtgaggatttaacctttaagccaaagtaccttgtgactttcactgttgggtacgagcagaaaaagaatatcgatgcagctgtgaaaaaggtttgtgaacgcgtgtttaaactagatatgccacttgaacagttttcaaaggatttcacgatccttctgtttcattatgatggccgaacaacggaatgggatgaatttgagtggtcaaaacaggccattcatgtcagtgttcacaaacaaaccaaatggtggtatgccaagaggtttctacatccagacattgtggtaccatatgactatattttcatgtgggatgaagacctgggggttgagaatttcaatgctgaagaatacctaaaactggtgagaaagcatggcttggagatatcacaacctgccttggaacctagtaaaagtaccaaagcggtgtgttggaatatgacaaggagaagagagcatagtgaagttcacaaagaagcagtggaaccaggaaagtgtaagtaccctcttctgcctccttgtgcagcgtttgttgagataatggctccagtgttttcacgaaatgcatggcgctgtgtgtggcatatgattcagaatgaatttgtccatggatggggtcttgattttgcctttagaaaatgtgttgagcctgcccatgagaagattggagttgttgatgctcagtggattgtgcaccaaggtattccctcactagggaatcagggagaagcacaaacaactggaaaaccggcatggcgagcggtgaaggagaggtgtggcatggagtggaggatgttccagggtaggttgactaacgccgaaaagggatattacaagtccaagggaattgatttttctaatttgctcgttcataattag

SEQ ID NO: 84781 - DNA, 204 bp, Glycine max
  Peptide Sequence Number=SeqID_176466
atggaagcgggaatgacgacgtcctcgttagaggagattgtaaaagaaagcggcaaagcaccaggccaagaccaactgcctcaaccagtccaaagcctcctttccaagagcatgatttcggcgtgtgaagccctcaagcccttccacatcattgtcaacgccgttgaagaggttcacagtgggagtggtttgctacagacatag

SEQ ID NO: 84782 - DNA, 2592 bp, Glycine max
  Peptide Sequence Number=SeqID_176467
atggagactcaaaaaccgaggaagaggagaaagtctactcttggttatacaccttggcccagtcagacaaaaacttggttttcgagtacgttaggtccactgagagaggcaagcttaagtttcacagaagccgataggagactgagggaaaatgggccaaatgttccacttgagtattcctttccaagatggtggcatcttctatggaactctcttttccatcctttcattatcattctgattgttttgtcagttctgtcattcattacctgcgacagtccaaatggatttatcatgctcatattggttttcatcagtgtcacccttcgtttctatcaggaatacagcagctcaaaagcagcaatgaagctttcagaatttgtaaaatgtccaataaaagttcaaagatgcgctggtagagttgttcagaaagaacttgtagttcaagttgatcagagggatgtagttccaggtgacattgtgatttttgaacctggtgacctctttcctggagatatcaggttgttatcttctaaacaacttgttgtaagccaggcatcactaactggggaatcttggacaactgacaaaactgctgaaatcagagaagatcacagcactcctttattggatttaaagaacatctgctttatgggcacaaacgtggtatctggtactggaacaggcttagtgatttccacaggatccaatacttacatgagcaccatgttttcaaaagttgggaagaagaaaccaccagatgaatttgaaaagggtctcagacggatattttacttgcttatttctgtcattctagcagttgttaccatcatgtttgtgataaattacactacatctcttaatttgagccagagtgttctttttgccatctcagttgcatctgccctcaatcctcagatgcttcccctcatcattaacacatgtcttgcaaaaggagcacttgctatggctaaagacagatgtatagtaaaaagtttaacatctatacgccacatgggatcaatggatattctttgtattgataagacaggctcccttacaatgaatcatgcaatcatggttaatcatcttgactgcaggggtttaccccaagaaaaaattttacgctatgccttcctcaactcttactttaagagtgaccagaagtatcctctggatgatgctatcctagcatttgtatattcaaatggattcaggtttcagccatctaagtggaggaagatagatgagattccttttgacttcataagaagaagagtatctgtcatcttagaaacagaaggcggacactcacaattctttggcaggttcctgttaacaaaaggagcactgttagaagtattgagagtttgttctttcattgagaatttcgataaagatgaaatttctcccttctcttcaaatgattatcagcggattttaaatctctcagaagatttgagcaatgaggggttaagggtaatagcagtagctataaggaagctggaaatgccccaaatatgcgaaacaagtaatggaagcaagagagaagaggaggatattgaaagagacatggtgttcatcggcctcataacgtttttcgacccaccaaaggactcagcaaagcaagcactgtggcgtttgtccgagaagggagtgaaggctaaggttttaactggtgactccctctccttgacaacaagggtatgcagggaagttggcataagtaccactcatgtaataacaggtcctgaactagaacaacttgaccaaaacactttccatgagacagttcaaagagccacagtactcgctcgtctcaccccaattcagaaacaacgagtggtgcaatccttgcaaacaattggaaaccatgtcgttgggttcttaggagatggagtgaatgattcactagctttagatgctgccaatgtaagcatttctgtggactcaggtgtagccattgccaaagacatggctgatattatcttacttgagaaagacctcaacgtgcttgttgcaggagtggagcatggtagacttagttttggcaacacaatgaagtatcttaagatgtcagtgatagctaacttgggaagtgtcatttcactcctcatagcaacactgttattcaagtatgagcccttaacttctagacagcttcttactcagaatttcatctacagtgtgggacagattgcccttgcttgggacaagatggatgaagagtatgttaagacacctcacaagtcctcagagagaggcttgtccatgttcatgttgtggaatgcaccagtgtgcaccctttgtgatgtggcaacacttttgtttctttggttttattacaaggcttacactgatgtgactcagaagtttttccattcagcttggttcattgaaggtctcctattgcagaccctcatcatccacttgataaggacagagaaaatccctttcatacaggatgttgcatcttggcctgtgattttctccactgttgtgacatctgcaattggaattgcacttccattcacacccattgggaaggtcgttaagagactttacatattggtttataagaaatggctttga

SEQ ID NO: 84783 - DNA, 177 bp, Glycine max
  Peptide Sequence Number=SeqID_176468
atggatcatcggatttccgagctcctttcccaagagaggctaaccaagagccccgttaaacatggactgaccgagagggtcgaatggatacaaatagtgggggtgggagcaaaaacgtcaccaaggctttcatctagtaatgttggtgaaggtgacggaatattcttcgcttcataa

SEQ ID NO: 84784 - DNA, 1636 bp, Glycine max
  Peptide Sequence Number=SeqID_176469
atggcggcggggtgcatcagcttcactgccacgcgcgaccgctgctttcgcttctccttctccaacgcgggcctcaaatccgtgacgacggacctcggcgatggcaccatcatgcactgctgggcccccaaggcccacaaggactccaagcccaacctcctcctcatccacggcttcggggccaacgcaatgtggcagtggaacgacttcctctcgcccctcacgcgccgcttcaacgtctacgtcccggacctcctcttcttcggagactcccacacgacccgccccgaccgctctgaagccttccaggcccagtgcgtcgcggccctcctccaggcccacggactccagagaaccagcgttgtgggtataagctacggcggcttcgtggcgtacagtctcgcggcgcagttcccggagcgcgtggagaaggtggtgctatgctgcgccggggtgtgcttggaagataaagacttggacgaagggatgttccaggtgaagactgtggatgaggctgcggatattttgctgccgcagacgccggaaaagttgaggcagctcgtgcagctcgcgtttgccaagcctgtcaaaaccatgcccacttgctttctcaatgattacattaacgtgatgtgtactgataaccgccaagagaggaaagaactaatcgaaacattacataaggatagaaaattatctaatcttcctaagataacccagcctacgttaataatctggggagaaaaggacctggtcttccctatggaattagctcataggctacaaagcatctctaatgccttcagcaagcttatgccttcaagttttgggaaagataccgaatggaataatggcaattcagatatcaagaacgctcaactagtggtcattaagaatgcagggcatgctctcaatgtagagaagcccaaggagatgtacaagaatttaaaatccttcctcattgatcccgctactccaactccaactgcgcaaaaaaaccacagtaacgtcccaaacgtagtcctggttctggttgaaagtagtggagcaatccaagctggtgttatagcctcctttacaaacacacacaaacccattcccaggcggcgcaaagccgcacacaccgccgctactctcacacccactgcacttggtagtgccatagttattatccaaagccccaccaaaagagtacttcaaggccactccatagacccagtgagtggggtccgtagggttatccccgagcgatacaacagaagcataggcaccacacttcatggctttcaagtcgagctcccctttgccgtcgaggttggcgggggagtagacgcagcaggagaggaggaggaaggtggaggaggcgatttggaagggggaggtggacatggaaggtggactgagggtgatggtggaggtggtgtaggagatcgaactcaccgggtaggagccggtgtggcttttcaggaacagttggtcgccggtgccgttggagccgcaggttacgtaggggctgaacagaggggagccgcaaccgtggccggtgccgaagggggtggtgaggaggagagtaggaagaggaggtggtggcgccatgctttgagccttgctctctttctctttcgggaatggaatg

SEQ ID NO: 84785 - DNA, 360 bp, Glycine max
  Peptide Sequence Number=SeqID_176470
atgtcgatttctttagaggctttggcgatggcaggcgcaagtaatgtccaatttgccatggatattgaagaatgggaacttagagattcggagcagaatccaccaccccatttgctgactgaagaatattacaacgaagaatactttgtcaccttcacaaatcatcaagaaaaggtagataggactggggaaacgaggaaacgaaaatgcatgaggtcaataaaaacagcactgcaagcacttgtaacatcatgcgtgatcatgagtgatatatgcgtaggtggttcacgtcctaggatggcaatggcacttagggtcaaggccaattatggggacccaaaaatttctggtactggttag

SEQ ID NO: 84786 - DNA, 108 bp, Glycine max
  Peptide Sequence Number=SeqID_176471
atgactgaaggaacagttgctggtactggaaccatgcacaaggagaaagaaagtaagaataactgcatggataatcctacagatatttgtaacattatcagaaactaa

SEQ ID NO: 84787 - DNA, 1488 bp, Glycine max
  Peptide Sequence Number=SeqID_176472
atggagtattctggcgctctcctcccaacaacaacaacaatgccaacaattttgaaaagtcatcaaacgcccctgacagaaaaaaaagatcaaggtggctgtgaagatgtaactttctcaggaacagcttcatctaataactcttcagctcgttctggctccaagcctctccacatgccaaaccctgttgttaaccgaacccaccaaaggaaccatcccaaagtgtcacctagggagggctatgtcaacagtggaagaagggtccctaaagaagcaattggtatttctggtgaacttgaaagcatgatcaccgatcgtcaaaagggaagcagctcccttgttcgtgcttcttctagcaacgtgatgatgtttggtaatttaggtaaccttaggcaaggagggaacacaaatacctattctcagaaccctgttgctagtggaagatacacaaaccaaacggtggagaatgtaagtaaaggaagcaaggaacaaccggacgcattggctctttacgatgctgcaattgcaattcaccctaataaagcttcctacaggagcaacagaagtgcagcattaacggctctagggaggcttctggaggctgtgtttgaatgcagagaagccattcaaatagagcctcgttataaaagagctcattaccgattgggaaacttgaacatgagtgacctcacacgagaaaaagatggagaaatggataaggctcattatcattataaacaagcaggaccagaggctgacacagaccagattgctaaagtcaaaaaaattcaggtccatttgaacaaatgcaccgaggcacgtaggctaggagattggaacaagttgattaaggagaccaactatgctgtttcatttggtgcagattctgccccacatatatttgcattgcaagccgaggcattttttatgctccgtaggcaccaacatgcagaagaagcaatgttgaagggatctaattttgatgtggatcattgcatccagttctttggacctatttgcaatgcaaatacattggtgactcaggcttgggttcatttggctgctggcagagctgtggccgctgctcgatcaaacagaaacgagcttttcaaggcatccaaattctccgaagcatgtgttgcctatggagaggggttagagaatgatccatataactcggttttgctatgcaaccgagctgcatgcagatccaaaacaggccaacttgagaaggccatggaagattgcaatgctgctcttagcttgcatccatcttacagcaaggctaggctgagaagagcagattgtaatgccaagttgaaaagatgggaaacttcaagacaagactatgaaatattgcttaaagagacaccggaggatgaggaattaagaaggactttgttggaggccaagagcattttatccaacagcgaggatgacagaaaaagcacacttgttgtcaatgatcaatactcaaatcctttgtag

SEQ ID NO: 84788 - DNA, 648 bp, Glycine max
  Peptide Sequence Number=SeqID_176473
atgatgagaggagagcggttcccaaaggcatgttttcttgagtctagtttacaccgaaagggcattcttacaggtcatcagggtggtggcctcagaaatgttgccaatggacccataattgggggtccatttacactaattaatacagagaaacaggcaattacagaacataattttcttgggaattgggtcctgctctactttggctatacctcatcccccgattgtgggccagagcaagtccaaattatggccaaggcaattgatatattagaatcaaaacagaatcttaagattctaccagtatttgtttccactgatcctcaacgtgatacgccctcacaacttcgtgcctaccttaaaggtgtgcttatgatagctgaggtagagggtgccaacacagttgagtttgactcaagaatcataggattaactggacctgttgcagctattaggcagatggctcaagaatattgtttttactttaaaaaggtagaagaggatggcagtgattatcttgttgactgttctcacaacatgtatttgctgaatcctaaaatggaggttacgagatgctttggtgtcgagtataatgcagaggagttgtcagaagtgatagggaaagagctgaacagaaacccctcttaa

SEQ ID NO: 84789 - DNA, 2010 bp, Glycine max
  Peptide Sequence Number=SeqID_176474
atggtgtattacaaaatatcacatgttgatggtcggataactaatccggaacaaagaattgccagtgatgtgccaaggttctgttcagagttgagtgagattgtacaggatgatctaactgcggcctacgtacttggagctggggctacaatccgaaacttctctcctgcttttggtaaacttatgtccagagagcaggaattggaaggagagtatcgacagcttcactcgcggttaaggactcattcggaaagtatagcattttatggtggagagaggagagaagaagctcatattcagcagaagtttaggaccttagttagacatattaatagagtgctacatgaccattggtggtttggcatgattcaggattttttattgaagtaccttggtgctactgttgctgttattttgatcattgaacctttcttttctggccatctaaggcctgacagttcaactttagggcgtgcagagatgctaagcaatctaagatatcatactagtgtcattatttccttatttcaatcgctaggaactctttctatcagtgcaagacggctcaaccgactcagtggttatgccgatcgcattcatgagttaatggccatatcaagagagctaagcctggataatgggaaatcttcactgcaaagacaaggaagtagaaattacataagtgaagctaactatgttgggttttatggtgtcaaggctagtccaaatggcagtggaaagagctcgttattccgggttttaggaggtctttggcccttggtatctggacatattgtgaaacctggagttggatctgatcttaataaggaaatcttttatgtgccacaaagaccatatactgctgtaggaacacttcgtgatcagttaatttaccctcttactgctgatcaagaggttgagccacttacagatagcaggatggtggagctattgaaaaatgtgaaactcacatctaatcctacttctatctcagttgatcttgagtatctattggatcggtacccgtctgaaacagaggtaaactggggtgatgaactttcgttgggcgagcaacaacgattgggcatggccagacttttttaccataagcctaaatttgccattcttgatgagtgcacaagtgctgtcactactgatatggaagaacgtttttgtgctaatgttctggctatgggaacatcatgtattaccatatcacatcgtccagcattagttgcattccatgatgtggttttgtctttagatggtgagggaggatggagtgttcatcatagaagggaggactcgtctactgaattggggaatgatacagtgaaggctttggagacaaaaagacagagtgatgccaaggcagttcaacgggcatttgctatgaataaaaagggttctgcattctcaaattcaaaggcacaatcggatatttcagaagtgataatagcatcatctccatctatgaagcgtaacatttcaccatctgctgttccccaacttcacggtaatacaagggcattgccgatgagagtagctgccatgtgcaaagtattggtgcccaccatatttgataaacaaggagcacgactacttgctgttgcttttcttgttgtttcaagaacatgggtctcagatcgtattgcatcactgaatggtactactgtgaagcttgttttggagcaggataaagcttcctttattcgattaattggtataagtgttattcaaagtgctgcatcttctttcattgcaccttctataagtggagttggttttgcttgtgaaaaaccaagctctgaaaggagaccgcgtagccaaataatctcagagcatgcggtagacatggtgcagtattttgcttcagtggatgatttggagactgagtcttgtttcttgcatttccaagaaattggagcttcctctaagaacatacaccagtcagtagtggatttccgtgtgtctggacatccagctcaatcagaatcagtgtatgcttga

SEQ ID NO: 84790 - DNA, 1713 bp, Glycine max
  Peptide Sequence Number=SeqID_176475
atggaaggaggagtacctgatgccgatgtctctgccttcagtgaatgcctctctctctcatggaagaatccctatgtccttcgcctcgctttttctgcaggaatcggtggccttctttttggctatgacaccggggtgatatctggagctcttttgtatataagggatgaattcaccgcggtagataggcagacttggcttcaggaagctatagtgagtacagcaattgcaggagcaatagtaggtgctgcagtgggtggatggatgaacgatcgatttggaagaagaacatcaatccttttagctgatatcctctttttaattgggtcagttataatggctgctgcacctagccctggtgttctcgtcctgggtcgagtttttgttggccttggtgttggaatggcttcaatggcatctcctttgtacatttctgaggcttcccccaccaaagttcgaggagcccttgtagctctcaacagtttcctcatcaccggtggacaatttctctcctacctcatcaacttggctttcactaaggcgccgggtacatggaggtggatgcttggagtggctgcggcacctgctataatacaagtggtgttaatgttcacgctcccagaatcaccacgttggctgttccgaaagggaaaggaggaggaagcaaaagcaatattgaggaaaatttatccacccaatgatgttgaagaagaaatccaagctttgcatgattcagttgctacggaactggagcaggcaggatcctcagaaaaaatcagcataatcaaactgttgaaaaccaaggcagtgaggagaggtttggtggcaggaatgggccttcaaatcttccagcaattcacgggcatcaacactgtcatgtactacagtcccacaattgttcagttagctggtgttgcatccaaccagacggcaatgctcctctccctgatcacttctgggcttaacgcgttcggttcgatcttgagcatatacttcattgacaagactgggagaaagaaacttgctttgcttagtttgtgtggctgtgttgtagccttggcccttttaacattcactttccgccaaaccgaaactcattctccaatgattagtgcggttgagaccgctcatttcaacaacacctgccctggtttcagccaagctgtgaatgctaatgaatgggattgcatgaagtgtctaaaggcagaatgtggcttttgtgcatccgacgtctctagcaaccgcttacctggcgcatgtttgatttctaatgatgctacaaagggtatgtgtcaaaaagaacatagagcatggtacacacaaggatgtcctagcaaaattgggtggcttgcaatagtgggacttgcactgtacatcatattcttctcaccagggatgggaactgttccatgggttgtcaattctgaaatctatcctctgaggtaccgtggagtatgtggaggaattgcttctacaacatgttgggtttcaaacctcattgtttcgcagtccttcttgactttgaccgtggctattgggacagcatggacattcatgttatttgggtttgttgctctcgttggcatcttattcgttctcatcttcgtgccagaaactaagggagttccaattgaagaagttgagcagatgctggaggaaagaggtctgcacttcaagttttgggagaagaggagtcctacccagaaggcttga

SEQ ID NO: 84791 - DNA, 633 bp, Glycine max
  Peptide Sequence Number=SeqID_176476
atgtggtgtatttccaaagagttactacttactcggaatctggattcaagaaagcagcagttgatctggccattggttatttggtcaccgatgctttttatagtggaccatgtgcattttcagtacaatggatttctcatcgggattttgttgatctcactttcatatttggaggaaggaagggatttgttaggtggttttgtttttgctgttctcttgtgctttaagcatttatttgcggtggcagcacccgtatattttgtttatttgttgagacactattgttggggtggaacagtaagaggcatcggtcgacttttgattatgggaggagtggttacagcagtgtttgcatctgcatttggaccatttttccaccttgggcagacacaacaaatcattcaacggttgtttccatttggcagggggctttgccatgcatactgggccccaaatttttgggtattctatatcatgtcagacaaagggcttgctttcatattcagaaaacttgggtttaatgtccagacaccaacaggttcattcaccgctggtctagtaggggattcctcaccattttctgtactacctcaggctagctatttcaacttccaacgtgctactgttcaatag

SEQ ID NO: 84792 - DNA, 393 bp, Glycine max
  Peptide Sequence Number=SeqID_176477
atgtggcaggaaacattccgacacaaactctttcaaaagatttttatacctcctaggctcctacctattgtaactcaatgcaacaccctagaagcagtgtctccatccttaaatcatatgaaacttgataattgtaatcaacatgacgaatcgcgcaattcttcgccctgcacagactcgtcggagagcggaatcgttggacacgccgcgctggatcgcaggatcgtgaagacgagcgtgtttcgctattttctcagccgtggcagagcggagtcaagttgcatgcataggatgaagaaaccaaaagaagtagaaaatggaataatccaaaagaagcatagacaagaagcaaagtgcaaggaaaattcatttccaaagctagagatagcatga

SEQ ID NO: 84793 - DNA, 321 bp, Glycine max
  Peptide Sequence Number=SeqID_176478
atggcagtcttggttgaacacaatttccttgatgcatatgctggagaatcaagagatggatctttaagtgtaaagttcagcactggtgacataatatccatgaactcatccctacaattttgttactcatggattctcaactcagaccatagaaagtggatgatgccatatcttgaacgattctccactgagatgaagtatgatatttttcgagtagtttatgttagtggtgacaatgtggtgaatcttccctatggttctcataatcggatgttagaagatgaacaagagagcacacaaggacaacttatgcaccaatga

SEQ ID NO: 84794 - DNA, 204 bp, Glycine max
  Peptide Sequence Number=SeqID_176479
caaaagaaaacaaaaccaaaatcaaaaagcttaattcacggaactcgccagtttgactggcggttcccaaaagctgcgtgtgtcgccattttaagtggcgatttggtcactggtatcgccattgacgttgacgatttgttcaaggacaccaaactcgctattggttctgacgatttgggtcctacatacatgcttttcacgtaa

SEQ ID NO: 84795 - DNA, 834 bp, Glycine max
  Peptide Sequence Number=SeqID_176480
atgaaacttctggcattattacagaagctcttcttctccacagcggccccatacatgactttgctctcatccctcctccagactatccctatcaaattggaatgcctcactaagttgattctatttttgtcgaggaaaggggttacatatattggatttgctaggaaaggggttactcatattttctcttgtagggacttgacttgccttttccttctgaattttagattctcagttgcacctactttccatggctttcaaaaaagtgatgaggttatcaagtcaattcgtttgaaggaagcacaagatttgattcttatccaactctttgctgatggtcctggggataacattgataggacttgggtatctgatctgtttgaagactcgccgaatattgagaggttatgtttgggaacaagttacattaagattttgtctgcaggcatctatccgcaagtgcagcttaaagctataaaatatctgaaattggatggtgtggatttcaatgaagcaagagaacttttgtttattatttctttattacttggaagttcttctaacctagagacacttattataaagtgcaatagcatggcagtggagctacaacagatttcgaaggtgtttgactacagtaactgttactttaatcagcttcaagatgtgaaaatcacagttacaacttcctataagcctgcacttgatttgatacggtttgtgtttgcaagatcaccgacattgaagatccttactttcaggatggatcgagcatcacctagagcagaagttagattcctttatgatgaccttcaacgccccaacttgttttaa

SEQ ID NO: 84796 - DNA, 372 bp, Glycine max
  Peptide Sequence Number=SeqID_176481
atggttaagaaagagagggcccccagctccgccgcagtagcaagaataaccagcacttctggccttcctcgatgccccccggccccctcaacgtcgccgaccgcaccttcaggaccggtggaactgagcttccctacgagatccgcatcagtgcgtcatagtgcgacgggaaggtcacacaagagctggccgacgtcgacgcccttgctggttatggtcgtcaacattaatggtgtttgtggtggttgggggtggtatggtgctgttatggtgacgtcggagttggtggtgtggatgggttcagaaggggcacggtggcaatggtggatggggttctacgtttgtggtgtcgaagaagatgaagaagggtag

SEQ ID NO: 84797 - DNA, 600 bp, Glycine max
  Peptide Sequence Number=SeqID_176482
atggccaaacatccaaaatatcaaatctcaagaaatccttatcccaagtcttgtcccgtggaagcctatgaagaacacaacttcaactatagtagccattcaaataaactgttttgcatgcggaggaatagcaataagcgtgtgcatgtgtcagtctttcaaacttcatcaatgactgggccactcaaccgcgaaaaagaacaagaagaaacagaaacattgactaagtcattattagccttcccagttcccggggcttcactcttcccgcaagaaaacttacctgttttctcagaagttttgttcgtggaaaacgacgccgtttgcagaaggtttgtcttcgaggcctccgagatcgactccctcaaagccatagtgtcctcccacaacgttccaaaccccacgcgcgtggaagttgtcagcgcgttgatctacaagcgcgcggtttccgctctagggttgagtttcaagacgacgtcgttccgcaccgccgtgaacctccgcaatagaacggttccgccgctcccggagaagagcctggggaacttggtttggttcctgttagtgcttaacccttcggaagcggagctgcatgagtag

SEQ ID NO: 84798 - DNA, 1437 bp, Glycine max
  Peptide Sequence Number=SeqID_176483
atggcgttgaatttctcgcatcgaccgattttttctgaggataatttggtttcgccgatgaggatgggaattccagagaagagtgttgttgacaattgctttgattatgggagagagaggggtggtggtggtgcgaaccacgatgacattctcgatcttttgccttcggatcccttcggcatggacatcagcaccaccgtcacagccatcaccgggtggctcgaggatttggagattgttgattatggtgggtaccgaagggatgagcttggggcgagtgatggcaattaccagctttttgctgggttgaatttcatttggaacaatgctatgaggttccatgcttcttgtgttgaggagaagagagggtttggcgagagttgttctgtgagaaatgatggggctgctgctgcatcgagcaattttgggtttggatctgttaataattatgatgaagtgtcgggtttgcctgctattagcaggtctggtgatgttgtgagacgggttggaggagcaggcaggggtgatgttgcgagaccggatggaggaggaagtgggggtgaggagcttgctcctcacccggccttgagtttttctcttggttacctgggtttgtctgatctgcttgttgttgaaagggtgtgtaaatctttgcattccacggtttgtggggatccgcttttatggaggagtattcatgtggatccgcctttgaatgagaggattaccgatgatgttcttttccaattgaccaacagggctcaaggtcatcttcagtgcttgagcctggtcgagtgtaccaggataacagatgatggtttgaagcgggttcttcaaagcaatcccaagttaaccaagcagatgcttaaaagtgtctttaggacattggttaaggaatcaaacttgagtgttccaggatgcacaagactcagtattgagggtattgtggggattttaaaagcttacaactctatgggtacccaagggttgaagcacttacacataggtggtctttatggtgttacgcaaaagcattttgaagagctgagtttcttgttgggggctgatggtccgctgctccagcactctcacaaaccacactattattgcaggggcaacttgtatctttcctgtgatgatgatcgagtcatagacattgaagtttgtccactatgccagaatttgaggcttgtgtatgattgcccggcggagagttgtcaaggggtggaacacactactcagatttgcagggcatgcactctatgcatacccaggtgtagccagtgtggttgctgcatcaatgatagtgaatatgaggaaacattttgtctggaattgctttgttcttcttgctctaagcagctagtcaaatgttcagaaagagaagataggaagattgggtcagataaatcagctgttattcatgagcaaagctag

SEQ ID NO: 84799 - DNA, 1185 bp, Glycine max
  Peptide Sequence Number=SeqID_176484
aaccgacctgcagagttgattgccaagtttttggatgagaagcttcgtgcaggtaataagggtacttctgaagaggaactggaggctacacttgataaagtcctggtgttattcaggttcattcagggcaaggatgtatttgaagcattctataagaaagatcttgctaaaagactgcttttaggaaagagtgcttctattgacgctgagaaatctatgatctccaagttgaagactgagtgtggcagccagttcacaaacaaactggaaggaatgtttaagaatatgttccctagcagtaatgtgcagcaagatcatggtggcatttttgtttgtttggttgatatggagcactggccaacatatccgcccatggatgttagacttcctcatgaattgaatgtttaccaggttctgcacgtgctagtgactgatttctcttttaactgtggtcttggtattttgagtgattcccttgacatggatattttcaaagagttctatctaagcaaatacagtggaagacgtctgatgtggcaaaattcactaggtcattgtgtcttgaaggcagagtttcccaaaggaagaaaggagttggctgtgtccctatttcagtttatcttagcatcttttattgcacaaatttccatttttttttatattaattctgcacgcctggctgtcctccagactgttgttctaatgttattcaatgatgctgagaagctaagtcttcaagatatcaaagatgctactggtattgaggacaaggaactcagaaggactctgcaatcactagcttgtggtaaagttcgtgtcctacaaaagatgcccaaaggaagagatgtggaggacgatgacttatttgtttttaatgatgggtttacagctcctctttaccgtataaaggtgaatgcaattcaattgaaggagacagtcgaggagaacacaagcaccaccgaaagagttttccatgaccgtcaatatcagattgatgctgctattgtgaggataatgaagactagaaaagtgcttagtcacacccttcttattactgaactcttccaacagctgaaattcccaataaaaccagctgatttgaaaaaaaggattgaaagcctcattgacagggagtatctagagagggacaagagcaatcctcaaatatacaattacctcgcataa

SEQ ID NO: 84800 - DNA, 945 bp, Glycine max
  Peptide Sequence Number=SeqID_176485
atgagatacgtggaggacaaagggtgctacaacaacaatggaccaacacaagagactccaaatagcagtgccatgtactcagagtttcacaaaggaaaagatgctactcgtgtctccaaccaccatcatcgagcaaccatgggaaaaccaaccccttccaagtgggatgatgcacaaaaatggctcgtggggttgtcaaaaggtggagagaaaagccactccaaaagcaagccaagaaactcaaacgcagatgatttgagactcatagctcctgtgccacagaaggagcatgattactcaagtagtgagaaggaagaggaggaaaatgatgcttgccatgatttcatgactaatattattagtgctaatgctattgctgctcaatatgaagctgaagccaaaagggtagaatgtgatgagtcaaattggggaagcaataataataataatgacaacaggttttcaggaaacacgatccaagtgcaaccaatatgtttcagagacatggggactgagatgacaccgattactagccaagagccttcaagaactgggacaccaattagagccacaactcctgctactagaagcccaattcattcagggacttcaactccaatgaggggtcaaaatgggttgcaacaagttgctgagggtggccatggcactactaggaagtgtggagatcaaggatcaacaagcccttgcaagaagactcatgaagatcatcaagctagaaaattgagtcctctagaaagccgtgcaatggcttgggatgaggcagaacgtgccaaatttatggccaggttcaagcgtgaagaggtgaagattcaagcctgggaaaatcaccagataagaaaagctgaaatggaaatgaagaaaatggaggctgaagatgatggctcatcttttcatgccctgttagcaacgggaaaaagctcatga

SEQ ID NO: 84801 - DNA, 1764 bp, Glycine max
  Peptide Sequence Number=SeqID_176486
atgaggagaggtggtttggcgggtggtgtgggttgccgtggttggagctgggcctccgtgaggaagaagaagaagaagagtaaaggaagtgtttctatatttctcattgctcttgctttatttataaggtacgaaggtttcgtaattcttcttttgggcttgtttacttcttgcacctctgtttgcacccttgcttctggcttcgtgaatatgttctctgttgttgcctttggttccttatcacttcctaacagtgttaatgggtgttcgattatgtgtttaagaccaaagggttgggagttgggacaatatgctcccttcaacccggctcacgggtgcgtcttcgaagggaggaaggtgcatggagtcgccaccaacgtttattggggaaaaatgtcagaaaaattgaaaagcgtgtgtggtctacgaactttgagtgtgaaagatttgggagttgtatttacgcacggggaaggcaccctcgacattcgaccttatttcttcccgcgcctaaagttaccctctggtgcacctgctccctgtgcacccgacccgcctcttcgggttttcatgtacgatctccctcgccgattcaacgtcggcatgattgaccgccggagcgcggcggagatgcccgtcaccgtcgaggactggccggcgtggccggtgaactgggggctgaagaagcagcacagcgtggagtactggatgatggggtcgctcctcaacgtcggcgggggcagagaagtggttagggtttcggatccggaactcgcccaagcgttcttcgtgccgttcttctcgtcgctcagcttcaacacgcatggtcacaccatgaaggatcccgccacgcagattgatcgccaattgcagaagattcttgatgttaggccttatgtgtcagctattgtgcttgattatggtgttgtacagtgtgtggttgtacctgttgatttaatggaattattaaagaaatccaattactggcagaggtctggaggtagagaccatgtatttcccatgacgcaccccaatgccttcaggttcctacgagatcagttgaatgaatcgattcaggttgttgtggatttcggtcgctatcctaggggcatgtctaatttgaacaaagatgtggtgtccccgtatgtgcatgttgtggactcttttacagatgatgagcctcaagatccgtacgagtctcgctccacattgcttttcttccgagggaggacttacaggaaagatgaagggattgtccgtgttaaactagcaaagatattggctggttatgatgatgttcactatgagcgaagtgttgctacagaagagaacataaaagcgtcatctaaagggatgcgttcttcaaagttctgtttgcatccagcaggagacacaccatcatcttgtcggctttttgatgccattgtgagtcattgcattcctgtcattgtgagtgatcaaattgaactcccatttgaggatgagattgactactcccagttctcggttttcttctctttcaaagaggcattacagcctggctacatgatcgatcaacttcgtaaatttccaaaggagaaatggactgaaatgtggaggcaactaaaaagcatctcccatcattatgaattccgatatcctccaaaaagagaagatgctgttgatatgctgtggagacaggtcaagcacaaacttccaggggtgaaactttctgttcatagaaaccggaggttaaaaatcccagattggtggcaggggagatga

SEQ ID NO: 84802 - DNA, 867 bp, Glycine max
  Peptide Sequence Number=SeqID_176487
atgtcgggtgatttagcatacaagagcattctccagagttcagcacttatgaaggaggttgttggatacaacaggaactctgattctctaacgaaatcatctgcaagacattgtaatgcaattctccctcatcccttcaacaagaacttggacgtccatctaaatgagaaattctttattcctctcttcactttgattcttgaatgtctgtacatctttgaaacgagtgcctatccaaaagagcatgaacaattaaagctactcagagagaccacggtacagaagtgccaggaaaattcggaatatatcatgaatgtgccagtggatgaagcgcagttcgtatctattctgcttaaaatcatgaatgcgaagaaaacactggaaattggagtattcactggctattctcttcttgccacagctcttgctctgcctcatgatggcaagataacagcaattgatgtaaatagaaaaacatacgagattggattgccattcattcaaaaggcaggaatggagcacaaaattgactttatccttggtgatgcattatcagttctcaacgatcttattaatgataagcatgaagactcatttgactatgtatttgtggatgcggataaagcagaatacataaaatatcacgagttggtgttaaaattggtgaaaaagggtggaataattgcatatgacaacactttatattttggtacagttgctatgcctgaggaagacgtaaagtgggatattctgaggcagaatagaaagcctttgattgaattcaacaactttatagcaaacgattctcgcttggaatcagcaattgtttctattggggatggcgtaaccctgtgtagacgtctgtga

SEQ ID NO: 84803 - DNA, 258 bp, Glycine max
  Peptide Sequence Number=SeqID_176488
atggtgacggcggaggtcagaccagttgttaagggaaggggaagactgtgtggcgctaacgcggtggtgaggggaggaggaactcgagaaggagaggcttatgtagtaatctttcagatgagtaggagctcccttgatgcacgctggtctcgggttgggtgtgtgacggtcgtcggtactgcagtcaccggagatgttgcaatcgtcatcggagatgctaacacccaaccaaaccatgtgcatgttgcaagaaaatga

SEQ ID NO: 84804 - DNA, 207 bp, Glycine max
  Peptide Sequence Number=SeqID_176489
atgggaaccgacaactctgccgtccctcgcgttgacctcaatctgactactgtagctgtatattactattatttagatggtgtatcacgtgcacatgctcacaccagtcaccaaagggacccttacgaacaagtggtagtatctggcaaatgcgttaagcaacatcctctgcatttgtctccaaactcctcacacttacttcagtga

SEQ ID NO: 84805 - DNA, 258 bp, Glycine max
  Peptide Sequence Number=SeqID_176490
atggcagatagccacagatcacccaattttgagccaacaagacagttcaagtttgaccgggtttactacagagcaatggtgacgttggtagaattattaaatgctcagaaaacaaactctaatgacaagatgacaggtgaacgtgataccaatacatggataattgacacaggggcttccaaccacgtgactgtaaatctaaatcgtatacgtgaactacaagatattcaaagttgtccaattggatttcctaattga

SEQ ID NO: 84806 - DNA, 1260 bp, Glycine max
  Peptide Sequence Number=SeqID_176491
atgactcgcggcataaaacaccgtcagaaagccaagagcaagaagaaggtctcgaagaaagagagtgggtcttcttcatctttggcgccagaaattcccgcgaaggtgtggcaaccgggtgtggataagttggaggaaggtgaagagcttcagtgtgatccttctgcttacaattctcttcatgcctttcacattggatggccatgtttgagctttgatattttacgtgactctttgggcttggttcgaaaagaatttccccacactgtatatttcatggcagggactcaggatgtttcattaatcaaatcggaggtggcagagaaaccttcttggaattctattggaatttttaaagtatcaaatattactggaaagagacgtgagccggtgcctaaacttggaactgatgacactgaaatggatggtgaggatagtgacagtgacgatgatagtgaggatgaagaaggtggtgctcagggtcccagtttgcaggcaacttcctcttcatttgagtttttattgtttcatttcttgactgcttcaaatccgatgttgcggaaggttgctcaccaaggatgtgtcaaccgtatacgctctatgccacaaaatccccatatatgtgcagcttgggccgataccggtcatgtacaggtctgggacctcaactctcacctcaatgctctagctgagagtgaaacagaaggtgtccaaggagttgctgcagtttttaatcaggacccattgtataaatttaaacacaaagatgaaggttatgctatagactggagtcctcttgttcctggaaggcttgcatctggggattgcaataattgcatttatctgtgggagcctacatctgctggaacatggaacgttgataatgctccatttactggacatactgctagtgttgaagatctgcaatggagccctacagaacctgacgtttttgcttcttgttccgtggatggaaacattgcaatatgggatacccgtttggggaagtcaccagctgcatcttttaaggcacataatgctgatgtgaatgtaatgtcatggaacaggttggctagttgtatgttggcctctgggagtgatgatgggactatttctattcgtgatctcagactgctcaaggaaggagattctgtggtagcacatttcgaatatcacaagcacccaatcacatccattgagtggagtccacatgaagcctcttcattagcagtttcttcatctgataatcagcttacgtaa

SEQ ID NO: 84807 - DNA, 2691 bp, Glycine max
  Peptide Sequence Number=SeqID_176492
atgactgaattgaataatcccaagaaaaatgaactatccgaggtagaagtggatcctaacagccagcaagaagacacatatgagagcaaagtagaggagggagtgaatgagtatggcagcaccacttgttacgaatacgatattaatgatctgcatcaagaggctcaagcaagatggttgaagcctgcagaagtgatgtacattttacagaatcatgaaaagttccagttcacccaagagcccccacaacagccaaccagtggatctctgtttctgtttaacaaaagagtcctgcgtttcttccgtaaagatggtcataactggcgtaagaaaagagatggaagaactgtgggagaagcacacgaaaggctgaagggaaagctcagttctggagctggggcacaattgtcaccaagttcctcttctgtgtatactcagagtcctagcccatattctactcagaatccagggtcaacatccatacttggcgattcatatgaacctaatcagagtttctccagtccagggtctacagaagttacgtctgatatgttcgtactgaacaataaaatgggtcacatggatgggacagatacagaatcaggaacctcgcctgaactcgaggttactcaagctttgcgccgattggaggtgcagttaagtttgaatgaggacaactttgaagatattgtttccttcggaagtaagcacgaaactacacatgattcaaaccctcagcacgaccaaagggtgatcagcaatcaagagcaatctgctgctttctctggacctgatgatcaagggctattttatgatggatataatggaaggcaaggtgatggtggtgaattttatcatgaattaatagaccatggttaccctgatggaaatgaaaaggctttatggacagaggtgctggaatcatctgttttctcacaacctcaaggtgttgatgaagtcaaatttcctgtctattcttctatggtggaaacacaagtaattaattctgactactatgaaacattgtttgaccaaagccaaattggagcacctccagatgcaaattcaagcttgactgttgcacaaaaacagaaatttacaattaagacaatctccccagaatggggttatgccactgagactaccaaggtcattgttgttgggtctcttctctgtcatccctcggattctgcatgggcttgtatgtttggtgatgttgaagttcctgttgagataattcaggatggtgtaatctcttgtgaagctccatctcaccttcctggaaaggttactctgtgcattacttctggaaaccgggagtcctgcagtgaggtcagagagtttgaatatcgtgataagaccaatagttgcactcaatgtactcaatcagaaacagaagccactagaagtccagaagagctgttattacttgttagattagagcaaatgcttctttctgcatcaacaataaagaatgacaacatagaatctggaattcctctcataaaacagaaagctgatgatgactcgtggagccatattatagaggctcttctagttggcagtggaacgtcgactggtactgttgattggcttcttgaagagcttctaaaggataagcttcaacagtggctttcttgcagatctcaggaaaaagatgaagagacaggctgctctttgtccaagaaagagcaagggattattcacatggttgctgggttaggttttgagtgggccttgaaccctattctcacttgtggagtcaatataaatttccgtgacatcaatgggtggactgcccttcattgggctgcacgttttggaagggaaaaaatggttgcttcacttatagcttctggagcatctgctggagctgtgacagatccaaatgcacaagatccaaccggtaaaactgctgcatctattgcagccggcaatgggcacaagggactggcagggtatctttcagagatagctgtaacaagccatctgtcatctcttacactggaagagagtgaattatctaaaagttctgctgagcttcaggcagatatgactgttaacagtgtctccaaggaaaatcttactgccagtgaggatcaggcatcactcaaagataccttggctgctatcagaaatgtaactcaggcagctgcgcggatacaatctgcttttcgttcacattcttttagaaaacgaagagcaagagaagtagctgctagtgcaggtggcattggtaccatttcagagatttctgctatgtcaaaacttgcctttcggaactcacgtgaatataattcagctgcttcagctgctttatcgattcagaagaaatatcgaggttggaaaggtcgcaaagatttcttagcgttgcgcaaaaaagtagtgaagatacaggctcatgtgaggggctaccaggttaggaagcattacaaggtaatatgggcagttggaatcttggacaaggttgtcttacgatggaggagaaaaggagctggtttacgaggtttccgacaagagatggacatcaacgaaaatgaaaatgaagatgaagatattctcaaggtgttccgaaaacagaaagttgatgtagaaattgaagaggctgtttcaagggtgctgtccatggtcgactcaccagatgctcgtgagcaatatcatcgcatgcttgagaaatatcgtcaagctaag

SEQ ID NO: 84808 - DNA, 1306 bp, Glycine max
  Peptide Sequence Number=SeqID_176493
atgagaaaaaggaaattgctttggcaaatttgcttgcgtctaatagcacaacatttgcagatcatggttaagactagaggattaggcagtgcgttaggtagggttggtgtcagaggtatagggagaggaggggatggtgatgatactgacggtgctccccagcgccaatggccgactgcatcggcacgcaggcgacgggtaccagtcattcttgacgattatgtgcctgtggtacctacggactcgcctacggtaccagaggcaaaggctgttgtaactggggatgagcccatggtagatgctgccgcacaagacaccggtgtagagactgacgcacagaatatcggtgcagagactaacggggacgagcctgtgggatttcttggtggacccagggacccatcagtgcttacagagtatgctgaccatgttgcgggcagcgtatggtctggacaggaacatcttgagttgaagttatgctcccatgggaggaaggtgcataacttgggtagacctgttcctgcaattgaagacatgattgttgggacaggattaagtcctttgatcacgtgttcaataaacaccggtgatcggggacttatatccttctttgtggagaggtggcaccgggagacttctagtttccatcttcctatggaggagatgtcgatcacactggacaatgccgcgtctcttttccatttgtctatcgttagcgcattccatgacttccagcctctgcgcaccgacgaggcggtgatgctattggttaagttactgatggtctcagcagaggtagtcatggccgagacaggccaatgtggtggaccatatgtacgcctgtactggacagctgccactcgcgcttatcttctacatcttttgggttacactttttttgctaataagagtgtaacccatgttcatgtctcacacttactggccctgcgtgaccttactcttgctgggcgcaccagccgacagcttgctggttacatcaccttgttacagtgttggatatacaagcactttccgtcagttgcggagtgcaatactgatctggactacgacgaggtatcatcacgtgtgtgtcggtggattgcgacgaagaagactgtgaagaagctccgtcggggggttgttgttgtcagatacagaccggagagggttatgctccagttcgactacgtccagtgcattcctacacatcctgtccattcatgggtgtcatatgatgacgtggacgatacttggacgcactactcagaccatctggcagcagtaggtgatctatgtgttgtgccag

SEQ ID NO: 84809 - DNA, 159 bp, Glycine max
  Peptide Sequence Number=SeqID_176494
atgtggataaaacggagtggtgggaagacgaagaggtctatctatgacactagtaacctaagtgccagttaccacccaactagagtctcacacttcttccaactccaagggcgtgatagagtccatggagcagggaacaactcgtgggccatactatag

SEQ ID NO: 84810 - DNA, 210 bp, Glycine max
  Peptide Sequence Number=SeqID_176495
atgaagagagcacgtaatattgtcaagggactccgctttgaaattgcagatatctggtctgatgaagcgttttctcaattggtccaaagccactttggtgtttctgaacttgagcatctgagtgtgactgaccttatggaactagagaaactggttcattctgctctttcgcgaatcagatcagcaaaggttttacactctgttcagtga

SEQ ID NO: 84811 - DNA, 516 bp, Glycine max
  Peptide Sequence Number=SeqID_176496
atgggttccaaggtgttgtctgtgttggttgatgttgagtttattctctttatggggcgtaatgttgtgatggagcaaagttttggtgccactaaagtaaccaaagacggagtaaatactgcaaagagcattgaattcaagggtaaagttaagaatgttagtttcagacttgtagtgcatgttgctaatgctactaatgatgtttcacaataccagattgcatggtgttgtaaccgtgacagaatattgagggagcacttcaattgttttgcaggaaccacatgcgctatagtccttacgcgagcaatatttactgaaggctgcaaatcagttatggctgtaggtgctgcggtgacaaacttgaaaagcagagcaaggatgattagcacatcagaagaaataacacagtgtttaatgcctgttttacttgtggaggaaagtgtggttagagattccatcttggttatggtcatccaggatggagtcatttctttttcctgccattcattttgctaa

SEQ ID NO: 84812 - DNA, 576 bp, Glycine max
  Peptide Sequence Number=SeqID_176497
atgatgaactttgacggcttccagaaggctctggcggagtttcagggccgctgctccacgctgctgggcagcctgacccgtctccagcccaaccgcgcgaggccaccatgggctcggatagcccagccctggggaggcaggcccatggccatgacggtggaggcaatcgaggagcgcttagagggaattcccgtttacgccctcagcaacgcttccgaggagtttctcttggtctcgggctcttcctccgggaaaaaccttggcctcttctgcttcaacaaggacgacgccgaggctctcctcaaccaggttacgcttatcgacccccacgctcgccagggctccaaagttgtccccgttgctttgaacaaggtgtttcagctcaaggagagggaaaaatctggctttgcttccagtggcttttctggtgttccagttttccagggtgagcccatgtttgaggctcccacccagtggggtctctggaagttcaaacctgtgacggaagcattggcgaaggcagagtgggccgacgatggagatgacagtgagggggagcaaacggaatttttctga

SEQ ID NO: 84813 - DNA, 576 bp, Glycine max
  Peptide Sequence Number=SeqID_176498
atggcttttgaaaatggttccaaaaaggagcttgagaaagttggtctaaaaatctcgaagagctttcctcttactaggactactctggcatctatggagtctttgtccctgccagtgcatcaagaagacctaggtggcgccaccacgctcctcctcctcccacccccaggatccttcacttccctcgctaggaagaacagaaattttgacaagcaaggttcctttcgatgtcgttgcttacggcagcaacgacgtagttggccaaccattcaacggcggtcgttgccggtgcaacgacatagtagaccttacctttcaagcattgattgtcatacactacgtcggtgccgccatagcccgaccttaaaagcttacctttcaacgttgttcctcgtgccggcaatgtcttcgaaggtgaacttgcaactacgggcctcccgtcatccccgtcgcaggaatcgtgtgtttctaaaacggtggaaggagaccgtcgtagactggccggaggcctacgacgacatctcattcaaagacggccgtgcaccgtcgttgaactccgagaagcaccgacgttga

SEQ ID NO: 84814 - DNA, 1182 bp, Glycine max
  Peptide Sequence Number=SeqID_176499
atggcgacaattcctatcacctacaaccatgcttggaccttctctcatcctcatcatgcactttcccgcttcctttcaccctgcaatttctctaggatcacattttctcgcagaaaatatggtgttggtggccctgccccgtcttctccactctctcattttcgcgtattttgccaatccaagacagagatattggagataagaaagtgctccccttttcttgaaagttcattacttcttggtaatggtggtgtggcctcagatgagtggaaagcagttcctgatatttggagatcttctgcggagaagtatggtaataatgtagccttagtagatccatatcatgatcctcctacaactatgacgtatacacaggcaattctggattttgcagaaggtttgagagttattggggtaagacctgatgagaagcttgcactttttgcagataattcatgtcgttggcttgtagcagatcaaggggctcaaggtcatcagttgaagagctattgcaaatatacaaccactctgaaagaaaaagcagagctggttggtcaagaaaacaagcatgtgccagtgtttactttcatggaagtcatagatttgggacgacagagtcgcagggcattatctaatgctcatgatgctggacaacgttatatttatgaagcaataaacactgatagcattgctactctagtatacactagtggaactactggaaatccgaaaggtgttatgcttacccacaggaatcttctgcatcagataaaaaacttgtgggacattgtaccagctgaagctggggatagatttctaagcatgctgccaccttggcatgcatatgaaagagcttgtgagtatttcattttcacatgcggtattgagcaagtatacacaaccgtgaggaatctcaaggcttcctacgcgtattcaatgttggactggctgtgggcaagaactattgccacaatattacttccacttcatattctggcaaagaaacttgtctacagtaaaatccattcagctattggaatatcaaaggctggaataagtggtggtggtagtttgccttgggaagtggataaattttttgaggcaattggtgtgaaagtacagaatggatatggtttaacagaaacttcaccagttattgctgctcgacgacctagatgtaac

SEQ ID NO: 84815 - DNA, 2202 bp, Glycine max
  Peptide Sequence Number=SeqID_176500
atgaggccaccaagttcttccatccactttctccttcaaattcttcttgtctttctactgcacagacccagctttgcattgaaaaagtcatatgtggtgtacttgggagcccactcacacaagccagaattatcctcagttgacttcaatcaagttacacagtcccaccatgagtttctgggatctttcttaggaagttctaatacaaccaaggactccatcttttactcatacacaaggcacatcaatggttttgctgcaattttggaagaagaagtagctgctgagatatcaaagcaccccaaagtgttgtcagtgttcgagaaccgtgggagaaagctacacaccactcgatcatgggatttcatggggctagagcataatggggtgatccaatccaactcaatctggaagaaagccagatttggtgagggtgtcatcattggaaacctggatacaggggcaaggtacttcaacaagggctacgcctcagtggcgggcccccttaactcctcctttgactcgccacgtgacaacgagggccacgggacccacaccctatccacagctggcgggaacatggtcgcacgtgtcagcgtcttcggccagggccacggcacagccaagggtggctcaccaatggcacgtgtggcagcctacaaggtctgctggccccccgtcgccggcgacgagtgcttcgacgccgatatcttggcagccttcgacctcgccatccacgacggcgtcgatgtcctctccctctcgctcggtggctcggcctccacgtttttcaaggatagtgttgccatcggatccttccatgccgccaaacatggcattgtggtggtttgctccgctggcaacagtgggcctgcggatgccactgcggaaaatcttgcaccctggcatgttacggttgctgccagcaccatggatcgacagttccccacttacgttttccttggtaacaatatcaccttcaagggcgaaagcctatcagctacgatattggcacccaagttctacccaattattaaagctacagatgctaaattggcgagtgcaagagctgaagatgcggtgctgtgccagaatgggaccctggatcccaacaaggtgaagggaaagatcgtggtgtgtctccgaggaataaatgcaagagtggacaagggagagcaagcttttcttgctggtgctgtgggaatggtccttgctaatgacaagactactgggaatgaaattatagctgatcctcatgtccttcctgcttctcatatcaattttactgatggcagtgctgtctttacttacatcaactcaaccaagttcccagtggcatatattacacatccaaagactcagttggatactaagccagccccgtttatggcagccttttcatcaaaaggaccaaatactatcgtgcccgagatcctaaagcctgatatcactgcaccaggggtgtcagttatagcggcctatactgaagcccaaggaccaaccaatcaagtgttcgacaaacgcaggattccatttaactcagtttcaggcacatcaatgtcatgccctcacgtttcaggcattgtgggactgttgagagccttatatcctacgtggagtcctgctgctattaaatcagcaatcatgaccacggctacaacactagacaatgaggtggagccactactgaatgctactgatggcaaggcaacaccattcagttacggggcaggacatgttcaaccaaacagagcaatggatcccgggctagtttatgacacaacaattgatgattacctcaacttcttatgtgctttaggttacaatgcgacacagatctcagtgttcacagaaggtccatatcaatgccgcaagaaatttagtctcctcaacctgaactatccctcaatcacagtcccaaaactctctgggtcagtgacagttacaaggagattgaaaaatgttggctctccagggacgtacattgctcatgttcaaaacccgcatggaatcaccatttctgtgaagccaagcatcttgaagttcaaaaatgttggtgaagagaagagctttaaagtaaccttcaaggccatgcaaggaaaggccacaaataactacgtatttggaaaactgatatggtcagatggcaagcattacgtcacgagtccaatagttgtgaaggccctcttaactagaaattga

SEQ ID NO: 84816 - DNA, 402 bp, Glycine max
  Peptide Sequence Number=SeqID_176501
atgttgggtaagatatgtttgcgtacgccttgtttatgcatcacgttgtctgttgaaaaagtgtatgctacgcatttaatcagcattgaaatttacacagtaatacaaccaggagaagtggtgtcccatggtgaggatttcagacaacagaaagctaaaagcacaaagaaagtaattctaagaaaccctccattggcaactaaaactagaatcggtattcaatcagtccccacttgcacaacccttgcacccacagtgaacacactctatgaccttctcctccctaagttgcttgggaactctgcaaacacaagtggtggcaaaattgtgatcacgtggctgcatgcacctcaggcagcaaagacgttcataaccaggctgcaattcagaccaaaaacatga

SEQ ID NO: 84817 - DNA, 672 bp, Glycine max
  Peptide Sequence Number=SeqID_176502
atggagcaaatgctagtgctattgggaggtttctcaattgctgatttctacccttcaatcaaagtgcttcctttgctcacgaacaagcatggagtgacgcacgaggattttattgatattcttctcaaaactcaaaagagagatgacttggaaattcccatgacccacaacaacatcaaagcactcatctgggacatgtttgctggtgggacagctgcaccaacagcagttacagtatgggcaatgtcagaacatatgaaaaatcctaaggttatggaaaaggcacatactgagataagaaaggtcttcaatgtgaaagtctcaagagaaaacagtgaggcatgtgtaatcaatggatatgaaatccctgcaaagagcaaagtcattatcaatgcttgggccattgggagagaatcaaactcttatgatttcagtggcacaaactttgaatacatcccctttggggctggaaggagaatttgtcctggagctgcattttccatgccttacatgttgctgtcagtggccaatttgctttaccattttgtttgggagctgccaaatggagcaatacaccaagaattggacatgactcatgagtcttttggcctaactgtcaaaagagcaaatgatctttgcttaattcccattccttatcacccaacatcctaa

SEQ ID NO: 84818 - DNA, 714 bp, Glycine max
  Peptide Sequence Number=SeqID_176503
atgcgggtgcacaccacaaacgcaggaagtatatccttttcaattcaattatgcatcattctatcattctatgtctatatatacatccatcaggaacaacgtgcagaattaaatgaagagatcctgaaggagaatccgagtgtctgtgcatatatgacaccttcattggatacaaggcaagacatggtgattgtggaggtaccaaagttgggaaaagaggctgcaactaagacaatcaaggaatggggtcaacccaagtccaagattacccatctcatcttttgcaccatcagcggtgtccacatgcctggtgctgatgtaccaacaagactgctttgccggtggctccgtctcgtcgaaaacaacaaaggtgctcgcgtgctattggtttggtctgagatcactgcagtcgcagccttgttcggagatggtgcagctgctggcattgttggatcagaccccttaccagttgaaaagcctttgtttcagcttgtctggactgagtatgttaatatgtcaagtggcatgtgtgttatttatcatgcatcagattgggaagaagtctataaaatggacttgacggtgaaggcctggggtgttatctttggcttcggccccgtcgactggactgtactaatatgtcactgtctattcagaccatccttttttttctcctttttttatctgttgacccagccttcctcagtcccataa

SEQ ID NO: 84819 - DNA, 1356 bp, Glycine max
  Peptide Sequence Number=SeqID_176504
atgattcctcccaggcggaagaaatggaccgaggcggaggagaaaaccctaatcgacaagtacggggagatggtagcggacggttcgctggcgaagatgcggactcgggagaagaagttcaagccgattgcttgtcacgtgaattcggtgcaccacgtgcgcgatcccgttgcgtacccttggcagtggagttggaaggacgtttcgacgaaggtgcagaacatgcggcaccagtatttgcttgtgaagcagaagatcaagaggcctgagttttcggggtccggaggaggaggggattgtgatgatgggagtgagtttgattgggtggaggggcttactcattggtctaacttccttaggtataaggatgtgtttggggatgttgcacttgctgttggcggtcatggtgggaatgagttgatggggattgaggatggggatcacggggatcgtgatggggataatggggatgggtttcttgctggtggtggggggatggatatggttgagtttgggcagatgggtcattctggggatggggattttggggctgctttggatggggtggacaatgaggtgatggggttgggatttgagattgagggggaggaaggggaggtgaattacaatgggagtggtggtcgggagagggaggatgctgcggagaatggttttgtgtttgaggaggaaggggaggtgacagggtcaagtttgaagaagaagaggaaggtggcgaaggggatggagaagaaggcgtggcggattcttgctaaccagctggggcagttgagagagatggagacgcggtttgagcagcgtgaggtggagagggagcgcgagaggcagaggagggagaatttgcgagtggagcttgataagcagtgggaaaggaagcttgaggagagggaaaaggagagagaggagagggagaaggagagggacaagcttaggaggcagaggatggcagagtgggaagccatggaaaaggaaaacgaagagatggaaaggaaaaggagagaggaagagttgatccatgagagggaatgggaggagagaatgaactgcaggaggctggaatggaagaagagggttgacgagatgctgagccagcaccgagcagaaatgggccagatgcagactcgttttcttcacgagcaacaaaatcttactaaccaattgcttggtatattctcgcagtggcctgcccaaccttctggcctatctgatcatactagtgctagcaaccattatctttcacaaatgatgcaaaatttgcatcatgtgaatggaattgttcatggtgacgctagggttgagggagataatcaagaagatcaattcattgttgatggatga

SEQ ID NO: 84820 - DNA, 2082 bp, Glycine max
  Peptide Sequence Number=SeqID_176505
atgggttcgaaggggaagaagaaaggttcaccggaagacattctggaaaccctaggagacttcacgagcaaagagaactgggacaagttcttcacccttcgcggtgattccttcgagtggtacgccgaatggcccaacctcagggacccactcctctccctcctcaaaaccgttcctctcccgcttcagctcctcgtccccggctgcggcaactcccgcctctccgagcacctctacgacgccggccacaccgccatcaccaacatcgacttctccaaggtcgtcatctccgacatgctccgccgcaacgtccgcgaccgtcccctcatgcgatggcgcatcatggacatgaccgccatgcagttcgaggatgagagcttcggtgcggttattgacaaaggtggactggatgctttgatggagcccgaacttggccccaaattggggaaccagtacttatcagaggtgaagagagttttaaagcctgggggaaagtttgtgtgccttaccttggctgaatctcacacgttttattttcctttactcttactgaaagattcatggtacaaggtttctggacttcatgaggctcttcaaaatgagaatcaaattcgtgaaaaatactccagcggctccaatttattatattctgtggaagatctgcaagaggagttgacaaagctatctcaaggtcggcgattgcagctaactctgggtggacaagggtactccactttttcttacagagctgtaattcttgatgccgaggaacaggccagcccatttacctatcactgtggggttttcattgtgcctaagactcgtgcacgtgaatggcttttctattctgaagaaggacagtggatggtggtcagaagctctgaagcagctcgtctcataatggtttacttggatgccagccattcggataccagcatggaggagattcagaaggatttgtctccattggttacgcagttggcacctgcagaaaatgagaatggagctaaaataccgtctgtcacatcttcattaactggatcaattattgttgaagatgtaatttatgaaaatgttgatagtgaagtcagttgtatttttccttctagagagttggtgtttcgacgccttgtatttgagagagctgcaaatttggtgcagtctgaagctctgctaaaagatgaacagtcacctactaaattggttagtgagacaggcaggaagaaaaacaatgcatcttccaaatctagaaaaagtggatctcagagacacagtattggagcaagcagccagttgaccgtctatcatggctatgtagctagttcttatcatacagggattatttcagggttcacgctaatatcttcttacatggaaaatgtggcatcaagtgggaaaatggcaagtcttggagctggtttactttccatgtttcttcacgggtgtatcccctttttggaaattgagactgtggagttagaccccatgattgttgatattgcaagggactacttcagttttgttgaggataaacgcctaaaggtgcatgtagctgatgggatccaatttgtccgagagattgacagttctggagcacctcagattcatggaaaaagtaatgatcctagtaatactgagtctgctctaaatgcaagttcaactgtgtctcatgctggtgtaaaagtgacaaaagttgatataattattgttgatgttgactcttcagacccaagctcgggattgacatgccctgctccggattttttggatgagtcttttcttgagaccgtaaaggataaactttcagaggatggtctctttgttgtcaatttggtgtcacggtcccaagccattaaggatatggctctctcaaaaatgaaaaaggttttcagccacctcttctgcctccagcttgacgaggacgtcaatgaagttcattttgccctcaaatctgagtcctgtattgaggatagctgtttctctgaagcttctcttaaacttcataaattgttggagtttaaacacccggagataggtcaaaacattatcaatgcgaccaaaaagataagacatttgaagtga

SEQ ID NO: 84821 - DNA, 654 bp, Glycine max
  Peptide Sequence Number=SeqID_176506
atggctatggcggccgccatggcgccgccatctttaacccgtcacgccaccgctattcggtggcgttttttcagaaaaccgctacgcaactccgccatggcgccgccatggccgccatttaacaacactggaccatggtggaattgggtggtatcgccgtgctggattgtggaatctgttggagcagatgaccccactgttgaatctgaaatattttgtcttcatggtgggttgtcaccatctattgaaaccctggataacatacgtaattttgatcgcgtacaagaagttcctcacgagggacccatgtgtgatcttctatggtctgatccagatgatcgttgtggttggggcatctctcctagaggtgctggatatacctttggccaggacatatctgagcaatttaaccataccaataacttgaagctgattgctagagctcaccagctggttatggaaggatataactggggacatgatcaaaaggtggttactatatttagtgctcctaactattgttatcgttgtgggaacatggcatcaattcttgaggttgacgactgcaaaggacacacattcattcagtttgagccagctccaaggaggggagagccagatgtaaccaggagaacacctgattacttcctatga

SEQ ID NO: 84822 - DNA, 780 bp, Glycine max
  Peptide Sequence Number=SeqID_176507
atggcacttggccgcaacagaaagagacaggtcacaatgcctacttatagctgccctctttgtgatcatgaagaagaatcgattaatcatcttattttcaattgtacaatgacaagaagactttggtgggagcctttgagatgggttaatagagtgggtcctttttccacagacccaaagaaccactttttgcaattcactcaatggaacaacaaagctagtataaacaacaaatggaaatttctgtggttagctctatccttctccatctggcatcatagaaatgccatgatcttcaagaaccagccgtttgaccctggaaaggtaagggtcttgtgtgataaggcaaaagaaattttgatggaagagagcaatgtccagcctgtgaaaagtcctgttacaatttgtggtgatattcatgggcaattccatgatcttgcagagctttttcgcattggagggaagtgtccagatacaaattacttgtttatgggagattatgttgatcgtggctattattctgttgaaactgttacgcttttggttgcccttaaagtgcgttatcgtcagcgtatcactattctgaggggaaatcatgaaagtcgccagattactcaagtttatgggttttatgatgagtgcctgcggaagtatggtagtgctaatgtttggaagatctttactgatttgtttgactactttccgttgacagcattggtccaaggtagtttgtttgattcaatgatcctgggcacccttagtatgttggcttgcatttaa

SEQ ID NO: 84823 - DNA, 333 bp, Glycine max
  Peptide Sequence Number=SeqID_176508
atggaaccaagccagattctatcattgcggaccaccacaactgatcctgatcatgtgaaggtcattcagtgggacgacttccagcacgatcttgcaaggttggccagtctctcttccgcgctccacgaagccaacgagaagaagcggaatcttcagtacaagctcgagcccctaattcagtggctggagggaaagcgcgtttggtctcgtggagaatgcgagcttgagtggggaatggaatcgcgttctgtgtttgattacgaaaattcttggcggaaggaaatagaattggggaagggagacgaatgtaattgcatttatttatcaagataa

SEQ ID NO: 84824 - DNA, 1038 bp, Glycine max
  Peptide Sequence Number=SeqID_176509
atggggagcgtgtacaagctacttttgggagattccatagacgagaatcaagatggagttttcaatgagtgtggaataaacaatgaagaggatgcagctcatttatttttcaactgcagcaaaattcttccggtttggtgggaatcggtgtcttggtcaaacatatcgggtgtttttccgcaaactccgaggcatcatttcctccaacatggttttgggaggccttctggagtcaggtctcagagatggcagatctggtggatagctttatcctggagtatatggcagcataggaatgggataattttctcaaatgatagcttcaatggcagtaaattgatggaggatgccattttcctttgtttgtcatggtttaaaaacttggaaaggagagaattcgcattggcaaggagttgctggaagcaaagcggattgaagaagagaatgagaggaaacggtctggctcagctagtaaatttgttgcctcccatctttttgttggccttgaaaaaagtagagaaagaggaagagaaaagggctagggagaaaatcaagaaaaagttggaagaagacaaggcagaaagaaggcggagacttggattgcctccagaggaaccctcagcagccaaaccttcacctgcgcctattgtggaggagaaaaagagttttgtgcctgttaggcctgccacaaaagctgagcaaatgagggagtgcctccgttctctcaagcagaaccacaaggaggatgacgctagagtgaagagagcattccaaactcttctaacttatgtagggaatgttgccagaaatcccgatgaagaaaagttcaggaagatacgtcttagtaaccaatcttttcaggacagagttggttccttgaaagggggcattgaatttctagaaatttgtgggtttgagaagatcgatggtggtgagtttttgtttttgcctagggacaaagttgaaatggcggtcctgaattcagctggatctgaactagactctgcaataaagaatccattttttggagttctttag

SEQ ID NO: 84825 - DNA, 1722 bp, Glycine max
  Peptide Sequence Number=SeqID_176510
atgagcagcaacagtagcagaaccgaacccatagcccaaaacatcatcaaactcatcagcaatctctgcttctccgtctttgtcttctctgtcttaatcttcaccgtcatagccataacctaccatcccccagacccatggctcgagtccacccctgccctaaccaacctcttcacccaatcacaaaatgccactttccgaatcgactcctccgtcctcaaaaccggcgaagacctcgctccctcgccgcaagaccctcccctcccgtcgccgccaccctccgcctccgccgtcaccgaagccgtcatcgagaaatccgaacagcaaattgccaactccaccgctaactccaccgctgattccaccgactccaccgacgcggcgcttccttctccccccgcctgcgacggaaccataaactgctccaaccctcgcgttcgtattgctattcagagattcaacctccgcgcgttcaagtccattgccttcttcgactaccaaccgccggtgaacggctccgtcgccggcgagtgcgacgtcgcttggcgcttccggaacaagcgcgaacgctcctggcgcaagtaccgcgactttcgccgcttcaagatcgcagtcaccgacgactgcaggtacaaggtggtgcacgccggcggctggcactccggcgccaatgctcgccggaatatgacgcgctccggtgccgccaggggtggtaagaccctgccgccgcgggcttcagcccgcgatgatgagatcaatgacacgattccgactttgggatcggagactaattttaggaatgggaagtatttgtattactcgagaggtggggattactgcaagggaatgaatcattatttgtggagtttcttgtgtggattgggggaagctatgtttttgaacaggacttttgttatggatttgagtgtttgtttggcttcaacttataaccctagtaacaaggatgaggaggggaaggattttaggtactacttcgatttcgagcatttgaaggagacggcttcgattgtggaggaaggtgagtttttgagggattggaagaattgggataaaacgcatttgaagaagaagattcctgttaggaaggttgtcaatcacaaggtgactcctatgcagcttaagaaggataagagtacgattatatggaggcagtttgatgcgccggagcctgaaaattattggtatagggtttgtgaaggtgaggccgctaagaatattcagaggccttggcatgctgtgtggaaatccaagaggttgatgaatattgttactgagattagtggaaggttggactgggattttgacgccgttcatgtggttcggggagagaaagctcagaacaaggagttgtggcctcatttggattatgatacgtcgccggatgttcttgtcgagaagcttaaatggatggttcagccttggagacatttgtacattgccaccaatgagccttattataattactttgataagttgaggtcaaattacaaggtgcatctgcttgatgactataaggagctgtggggaaatacaagtgagtggtataacgagaccacacttctcaacaatggaaagcctgttgagtttgatgggtacatgagagttgcagtggatactgaggtcttttaccgtggaaagacacgcgtggaaacgttctacaatttgactaaagattgcaaggatggagttaatacatgctga

SEQ ID NO: 84826 - DNA, 249 bp, Glycine max
  Peptide Sequence Number=SeqID_176511
atggggttgattttagcatggaggtggtgggagaggagggtgagcattgagtcgaaggagcaaaagaagttgacggaggagctcgtggaagatagagggatgggtcgagtagttgccgatcgaggtccattagaagaggcaaagggcagaggaggaatcgggttaacgacaaaggaggtcgaggagttaggagggagagatgtccagggggagggggagggggtggtgggtgacgaaagtgaaagatga

SEQ ID NO: 84827 - DNA, 2007 bp, Glycine max
  Peptide Sequence Number=SeqID_176512
atggattccgaggtgcagcaatcgcaagtcgccgccatcctcggcgcggatccctcccccttcgagacgttgatctcgcacctcatgtcctcctccaacgagcaacgctcccacgcggaggccctgtttaacctctgcaagcaaaccgatcccgatagcctctccttgaagctcgcgcacctcctccactcctcgccgcacgaggaggcgcgtgccatgtccgccatcctcctccggaaacagctcacgcgcgacgactcctacctctggccgcgcctctcccctcacacgcagtcttccctcaaatcgctccttctctcctcgattcaaaaggagaacatcaaatccatctccaagaagctctgcgacaccatctccgaactcgcctccggtattttacccgacaacgcctggccggagcttcttcctttcatgttccagtgtgtttcctccgattcccctaagcttcaggaatccgcgtttttaatcttcgcgcagttgtcgcagtacatcggcgattccctcactcctcacatcaagcacctccacgatattttcctgcagtgtcttacgaacgcttccgttaaccctgacgtccgaattgcggcgcttaacgccgttatcaatttcatccagtgtttgtccggttccgccgatcgcgaccggttccaggacctgctgcccgcaatgatgcggacgttgaccgaggcgcttaattccggccaggaggccaccgcccaggaggcgctcgagcttctcatcgagctcgccgggactgagcctcgttttctccggcgccagcttgtggatgtcgttggcgccatgttgcagattgccgaggctgaatcccttgaggaagggactcggcatttggcgattgagtttgtgattactctcgcggaggcgagggagcgcgcccccgggatgatgaggaagttgccgcagtttattagtaggttgtttgcgatactcatgaagatgcttcttgatattgaggatgatcctgcgtggcacagtgctgagacagaggatgaggatgctggtgaaaccagtaattatagcgtgggacaagagtgcttggatagactctctatatctttgggtggaaacaccattgttcctgttgcgtccgaacagttgcctgcttacttggctgctccagaatggcagaaacggcatgctgcacttattgcacttgctcagattgctgagggctgttcaaaggtcatgataaagaatttggagcaagtggtggctatggtcctgaactccttccctgaccaacacccccgtgtaagatgggcagctattaatgcaattggccagctgtctactgatttgggtcctgatttgcaagttaaatatcatcaaggagtgttgccagcactagctggtgccatggatgattttcagaaccctcgtgtgcaggcacatgctgcttcagcagttctcaacttcagcgagaactgcacacctgatatcttaacgccatacttggatgggatagttagcaaactacttgtacttcttcagaatggtaagcagatggtgcaagaaggtgccttaactgctttggcatcagttgctgattcttctcaggaacacttccaaaaatattatgatgctgtaatgccatacctgaaggctatattggttaatgcaactgacaaatctaaccgtatgcttcgtgctaagtccatggagtgtataagtttagttggaatggctgttgggaaggagaagtttagggctgatgcgaagcaggttatggaagttcttatgtcccttcaagtatctcaaatggagacagatgatccaacaacaagttacatgctacaggcatgggctagactttgcaaatgtctgggacaagattttcttccttacatggagtttgtcatgcctccactgcttcaatctgcttcacttaagcctgatgtaaccattacatcagcagattcagacaatgagattgaagattctgatgacgaaaggtctcaactttaa

SEQ ID NO: 84828 - DNA, 1854 bp, Glycine max
  Peptide Sequence Number=SeqID_176513
atggttgtgcgaagggttttggagtgggaagtggtgagaatcctggagagatgcagcagcctgaatcaggcgaaagaagtccacgcccaaatctacataaagaacctccagcaatcttcctacgtactcaccaagctcctccgcctcgtcaccgccctcccccacgtccccctccactcctaccctcgccttctcttctcacagctccacaccccaaaccccttcgcctggaccgctctcattcgcgcctacgctctccgaggacccctctcccaagccctgagcttctactcctccatgcggaaacgacgcgtcagtcccatctcgtttaccttctccgctctcttttccgcttgcgccgccgttcgccactccgctttgggggcgcagcttcacgctcagacactcttgcttggtggcttctcctctgatttgtacgtcaacaatgccgttatcgacatgtacgtcaaatgcgggtctttgcgttgtgcgcgcatggtgttcgatgaaatgcctgaacgggatgtcatttcttggaccgggctgattgttgcttacacgaggatcggtgatatgagggccgcacgggacttatttgacgggttgccggttaaggatatggtgacttggactgccatggttaccggttatgcgcagaacgccatgccgatggatgcattggaggttttccggcggttgcgagatgagggtgtggagattgatgaggttaccttggttggtgtcatatctgcttgtgctcaattgggtgcgtctaagtatgctaactggataagggacattgctgagagttctggatttggggtaggagataatgtccttgtggggtcggctttgatagacatgtactcaaaatgtggtaatgtggaggaggcatatgatgtctttaaaggaatgagggaaagaaatgtgttttcttacagttccatgattgtggggtttgctatacatggccgagctcgtgcggctattaagttgttttatgacatgttggagaccggggtaaaaccaaaccatgttacttttgtaggggtgcttacggcatgtagtcatgcaggcttggtagaccaagggcagcagctctttgcctccatggaaaagtgttatggtgttgctccaactgcagagctttatgcttgcatgacggatcttcttagccgcgctggatacttggaaaaggcacttcagcttgttgagacaatgcctatggagtccgatggagctgtgtggggagcacttcttggagcatcacacgtccatgggaaccctgacgttgctgaaattgcttctaagcgtttatttgagcttgaacctgataacatagggaattatttgttgctttctaacacttatgcatcagctggaagatgggatgatgtgtctaaggtcaggaaattgctgagagagaaaaatttgaaaaaaaatccagggtggagctgggttgaagcaaaaaatggtatgattcacaagttcgttgctggtgatgtgagtcatccaaaaattaatgagataaagaaggagttaaatgatcttttagaacggctgaaaggtattggataccagccaaacctaagttcgctgccatacggtattaatgatagagagaagaggcttttactaatggctcatagtgaaaaactagctttggcatttggattgctgagtactgatgttggttccactataaagattatgaagaaccttaggatatgtgaggattgtcatattgtaatgtgtggagcgtcaaaagttacaggaagaaaaattgttgtgagggataacacgagattccaccactttcttaatggtgcttgttcttgcagtaatttttggtga

SEQ ID NO: 84829 - DNA, 519 bp, Glycine max
  Peptide Sequence Number=SeqID_176514
atgaggatgcaaaaggtaactgtgatgggttgggcagaccaaaagaaggtattgaaaacagtgaggaagactggtaggagggcagaactgtggccatatccatacaacccagaataccatgccttggctcgccattacggcaatggtaattactttgcttctgccaagccctcctcttcttacaattattacaagcatggctatagttatggtgaagactttggctactaccacaagccaattggtgcagcaattattgatgagaaggccatgtccatgttcagtgatgacaaccctcatgcttgctctataatatacttgtcgtggaaattgagtagggaaaaatacctaaccacggttcattcttgccacaccacttcgacagtgacatgcacgtcagtagctacagcaagagggaggtcaacaccacacacgcatgacggacgacgggatgtgagacacaaaccgataggcaagacgctcaacaaaaaagaagcttttcgggcacgcgcgttttag

SEQ ID NO: 84830 - DNA, 1029 bp, Glycine max
  Peptide Sequence Number=SeqID_176515
atgctggaaaaagtctatttgtatcatttggaaagaataagttcatcaaatacgtacactaagacattttctgggattgatggagctggaaagcgattagctgatgaagtcttgcaagttgttaaaaagacaaagaacctgaaaagaatctcctttctagcccattctctgggaggcttgttcgctagatatgcaattgctgttctttattcacttgatacctatagtagggaccaaccaggtaatctagcaaacagcgtgacaggaaattcccagggaacaagcctttcaagaggagggatgattgctgggttagagccaatcaattttataactttagctacaccacatcttggtgtgagaggaaagaagcagcttccatttctgttgggtgtcccaatcctagaaaagcttgctgcacctatagctcctttttttgttggtcagacaggtagtcagttgttccttactgatggtaaacctgacaaaccacctctcctattgagaatggcttctgattctgatgatggaaagtttttgataaccggatatcttctacagagtcacagcctgtctgcaaaagatgaaagcctgtatccagaaatggatgtggcagtgcctcctcgaaaatctttagatggatacaagcacgtggttgatgtggaatattgtcccccagttccttctgatgggcctaaatttcctccaaaagcagtaaaagcaaagaaggcagcacaaaatgcgccaaatacacagaatactgtagaatatcatgaaattgtagaagtcactgatgttcctctaaagccactaatctttttaacagatgagatgattcagggattacagcagttgggatggaaaaaagttgatgtcagctttcactcagcattctggcctttctttgctcataacaacattcatgtgaaaaatgaatggcttcacaatgctggtgtaggagtaattgctcatgtggccgacagcttaagacagcaagaagcatcatcaattttgcctgctaacttgtaa

SEQ ID NO: 84831 - DNA, 3813 bp, Glycine max
  Peptide Sequence Number=SeqID_176516
atgacaacagcttccaggagtcatagattgatggttcaggttcaaaacattgaagcttcactacctgccttggagaaggctgtattggcacaaacaagtcacatacatttagcttacacagctggttgtgaatggcatccacgcatgaaagctgctcgaaatcatttcatttacaatgacttgcctcactttattatggattcatatgaagaatgccgtgatcctccacgggtacacttgcttgataaatttgatactggtggcccaggatcttgtttcaggagatattcagatccgaccttctttaaaagagtatctgcagattcagatgaatcttactctgggaaaactgaaaaagcaaggaaatctcataaaagcaagaagaaaagatcacgaaggaatggagacattttaaggagtgaacagaggcacagcactagtggaagaatgcaatctatttcttctgctatcagtgggcaaacctcttcctcacaaacagcctccaccatagatatggcaatgaaatcagatctggaaaattattcaaattcttttgattcaaaatctggtgctggctacattgaatgtgttttccatccaagtaattctatgcaatctgatgagccagattataaagaaccatcctctacaagattgaaacagaaagctgatactctgtcatcagtatctcatcatattgatgatagtatttcacatgattcgttggaaaagcaagttgcatctagttcatttggtgttacttgggatgaaaaggaagagatagtggaatctaagagtcaaacatgtgatagaaataaaactccggagaggcttgtggaaaagcatgactcaaatatgcatgtgaaagaggctgttaccataaccaacattgactacaatcatatcctatttactgaagaaaacaacctgaaaccagtccgcaatagggctcaaactgatgatattgatagtgaacctgataattatgtggatgctctcaacaccattgaatcagaatctgaaaatgatattgattatataacaaaacgagaggtgcagcagttatcttcacgtgtcacttgtggaatgattgaaaatggagttagtgaagctcctcctaatttaatggacaataatttatctgatgtcgttttccagactgattatactgttctcttaaatgaagaacaagggcatttagctgactcactgcaagaaaatcatgttcttgatcttttatcaaagccaaatgcatctaatttgggatatgtaagtccatctgatgatcttgatagagaaaatatgaccagagacactgcttccttaaacaaagaaccattcagggatttgcctgactctctgcaagatattcctcctctcacatcagagccacatgtatctaatttgggacctgtaagtccatcagatgttctttatagtgaagaaatgaccagagacaccatttgcttcaataaagaaatgttcgggaatttgcctgactcattgcaagaaatttctcctctcacatcagagccacatgcatctaatttgggacttgggaatccatcagatgttccttatggtgaagaaatgaccagagacactgttttcttcaacaaagaaacatttgggaatttgcccaacttgcaagaaattcctcctcccacagtagagccacatacatcaaatttgggacctgtgaacccatcaaattctcctcacagtgaagaaatgaccacagataccgtttccttaaacaaagaaatgcttgcgaatttgcctaactcattgcaagaaactcctgctctaacattagagccgcttgcatctaatttggcatttgtgagtccatcagatatttctgttagcaaagaaatagccaagaatatagctgattctcatccctccaagactcctgcctgtgagcaggttcctcgcccaagtgaaaattctgttttggataactcagtatgcactgactcctacattggttcttctactgttaatgatacagtgtcagcaccaattgagactgatatatcattttctggttccaaaaactctaatttaccagatgaggaagcaggtaagatcaacaacaatatctgcaaatctgaagagactcatagagagtctttggctgatcattcagttaggttctggactaatggtggattattaggactcgagccatcaaaacctcctgactttaacaagtcaacttctctaggtcaagggtctttgagcactaaaagtgaaacagatggtggttcacatcataattcaatgcaaaagagcaatggttataaagaggaatgggaatcatcagaagaggttgctgagcagattctaaaggaaccaaattctagattcttaacgtcaggccataatgatgaccaagcttgtgtctctgaaaaggccactggcaattctcagcagagtaatggatttggtcagactgagagggacaatttaggggaaatcagggtaattgcacctggaagtattctcccatcgacccctgacacaaaggacagtactgaacccaaccagggaaatggtgaaaactcatcgcgtgtgtttggacttagtcgtagattactaataaatagctttcagcggaaagtttcttttgatgaaaaatctgaacattataattctctgaaatctgttatattggaccagagtggacaaaatggcattgtaggaccatcacttcctgagacaacatcctccaaagagaaagttggttctggatatcctataaagtcacttcctccttcacctccacttgaacatatgaaaatatccttccatcctgtcagtggactagagacctccaaattaaaactgagatttccggatggcagtaatcatcatgaaagcgtaaatgatatgtttccttctttccagttggttcctgaagcttctcttcctctggatggttcagtttctcactctgatgatgatgacactttctgtagatcatctccatacatatcagatgatggtcaaagccctcgctctgactataattctgatcagtgggaatctgatgagactccggaaagcagtgaccaaggggtgcatgattctccttgcagaaggtcatcaactgaatctgtgtccaatgatgataccaatgcaaaaagtggacatggtacatgtactatgaatggtgtggaacattctctgtccaggcctttacttgattttccaagttacgataatgttaatcctgcacttgagaaagaaagtaaaaaacattccaaatgcaataatgctgttatgtcacatagtcatgcagagcctgcacaaccaccacctcctcctcctcttcctccaacgcaatggcgagtctcaaaaccacagttggatatgacaagtgggacacagtattgtatgtctgaagatgctgaacatattggtgatcacagtcttccagattctactatcctccagcagcctagggtcacccaggttgagcaaatacaaattaatcacgatgatcatgaatcttatgacaacattatatataaattgaaggacaagctggatcagcagaagttgaagggtcagaaggaagcaaaccagttgagaatgggaaaggagatagatgaaagagaagatttcctatatcaaatcagaacaaaagcattcaacctaaggcccacagtatcaggaaagtcaaatgataccactggttccacagcaaacgtcaaagttacagcaattttggagaaggcaaatgcaatccgtcaggttgttgcgagtgatgatggtgaagatgatgataactggagtgatacatga

SEQ ID NO: 84832 - DNA, 408 bp, Glycine max
  Peptide Sequence Number=SeqID_176517
atgcagcgtctccccgaaaggcgcgttcgtcgtaaaggcgacacgtggcagcacctgggacgcgccctgcgtacaggcgcgacgggtagcgctgctgcagcaggcgcgtcgggtcgtgttgggtacccaggcgcgacgggtcgcgctggggacccaggcgcgacgggtcgcgctggggacccaggcgcgacccagttgggtctacgacccaactgggtcgcgcctgggtacccaacacgacccgacgcgcctgctgcaacagcgctacccgtcgcgcctgtacgcagggcgcgtcccaagtgctgtcacgtgtcgcctttacggcgaacgcgcctttcggagaggcgctttgtagtacaaaaacagacccatgaagtaaataatttcaaaacagacccatttaggtaa

SEQ ID NO: 84833 - DNA, 3519 bp, Glycine max
  Peptide Sequence Number=SeqID_176518
atggatcaggcaaaaagcaaaggcagtggtgagattttggatcatgtcgatgaaagggtggatgaggattttaaccaattggttgaaggaaatgcaattgatgcaggaggtggacatagcttgggtgaaggagttaatgtaagtggggaagatgggacttcagaagagatgtgcaatgatcttcgattgaatagggagctaaaggaggggtctcaagaagttaatgatcagaacatgggtgacccacaagaaattaatgatacattgcatggggttgatcaaggaactagttatagttcaagaaatttggttagttgggaagtacccgagacttgtgttgtagtagatccttctactcagattgagtgtgtcaatggagataataggaaattggaagcaaaacctaatgaatcagggttgaacaaggtgtccatgaaagtcacaaatggggtgtctgagacagataaaaattcatgtgtgattgatataaactgtcacagctgtgatgggtttagtgagaatttggaaggtgaaatgatttgtaggatttgccatctggcctctgggcaaccattggaagcagcagatgttggcactgcaagtagtgctactactaatacagatttgattcagctcggttgtgcatgtaaagatgagctagggattgtgcatagtcattgtgcagaggcatggttcaagcttaaaggaaacagacaccttgttggttttccttctgaggtattagcaaatggcctggtttctagtggttgtgaactgaggacccttaagaatttgaaagctgttggatgggggttgtgtgaaatatgtggtgagactgcaaaaaatgtttcggatgttacggataatggatttattgaagagtggaatgatactagattcatggacagtgataatacctcatccagaagacaatctaggacaacatgtctgtcaccttcgaatttggacctttcttgcggtagcagtgttggtgtctctgcgactttgtccgagaccacccacaataacgtaatcgcggacaaaaatacagagatttgcaagttctgcgaaatgggtgatctaagaaacgccatggaattgctctcatggtgcttacattgctattggtacttaacaaactataacaattctgttgtaacagaattgagggagcactatggctgtcccctaacagaatgttgctatgtctcctgtggtgcagctattgctatcacaaggtcacaaaagtctgaacttgagttgaatacttactgttttgtgttgcagctctgtactcagcgtaagtctttggaagatggaaagagggttcattccattatcacttccgatggcatggcaattgatgaggttttgggggcaaaactagtctttatgtatgtgaattgtggtgatttgattaaagggagacgaatatttgatgggatcctcaatgataaggttttcctctggaatcttttgatgtctgaatatgcaaagattggtaattacagggaaactgtgggtctttttgagaaattgcagaagttgggagttagaggggattcttatacatttacttgtatcttgaagtgttttgctgcattggcaaaggtgatggagtgtaaaagggttcatgggtatgttttaaaactgggttttggttcttataatgctgttgttaactctctaattgcagcttattttaaatgtggtgaagctgagagtgcacgcattttgtttgatgaattgagtgacagagatatgctaaatttgggggtcgatgtggattcggtcaccgtggttaacgttcttgtgacttgtgcaaatgttggcaaccttacattgggtagaattcttcatgcttatggagtgaaagttggttttagtggggatgccatgtttaacaacaccttactagacatgtattctaaatgtggtaaattaaatggtgcaaatgaagtttttgtgaagatgggtgaaacaactatagtttcttggacttcaatcatagctgctcatgttcgagaaggtctacatgatgaggctcttagattatttgacaaaatgcaaagcaaaggtcttagcccagatatttatgctgtcacaagcgttgttcatgcttgtgcttgtagcaactccttggataaaggaagggagagcattgtctcatggaatacgatgattggaggttattcacaaaactcacttcccaatgaaactctagagctgtttctggacatgcaaaaacaatcgaagcctgatgacattacaatggcttgtgtccttccagcttgtgcaggcttagcagctctggagaaaggcagagagatacatgggcacatattgagaaaagggtacttttcagatttacatgtagcctgtgcacttgttgatatgtacgtgaaatgtgggtttcttgcacagcaactgtttgatatgattcctaataaggatatgattttgtggactgttatgatagctggatatggcatgcatgggtttggaaaggaagcaatttccacatttgataagattaggattgcaggtattgagcctgaagagtcctccttcacttccatcctttatgcttgcactcattctgaatttctgagagagggatggaaattctttgattccacgagaagcgaatgcaacatcgagcccaagttagaacactatgcgtatatggtggatctccttatccgctctggaaatctatccaggacgtacaagttcattgaaacaatgccaattaaaccagatgctgcaatttggggtgccttgctttctgggtgcaggatacatcatgatgtggagctagcagaaaaagtgccagagcatatttttgagcttgagccagagaagacaaggtattatgttcttctagcgaatgtctatgcaaaggccaaaaagtgggaagaagtgaaaaagttacaaagaaggataagtaagtgtggattgaaaaaggatcaaggctgtagttggatagaggtccaaggaaagtttaataactttgttgctggggatacttcacacccccaggccaaaaggatagactcattgctgagaaaattgagaatgaaaatgaatagggaaggttactctaataagatgaggactgttagagtaaccaagaatctaagagtatgtggggattgtcatgagatggggaagttcatgtccaagacaaccgggagggaaattttgttgcgagattcaaaccggtttcaccatttcaaggatggtttatgttcttgcagaggtttctggacgcattatagattaggatacaaagtcatggccaaaaaagtgtatgtagaagtgatagccatagtgtctgtagaatcagtgattgaggctaccgtttttgtagttacgtcagaggcaactttatgtcctaacttcgtctgtgaagtgatgttattcatggatgacttatctaaacatctatatttggattggaaaaacattgcagcagagatctgtaaatggggttcagatgtaacattttttctctga

SEQ ID NO: 84834 - DNA, 696 bp, Glycine max
  Peptide Sequence Number=SeqID_176519
atggaagatttagatcttgaaacacagcataagcacacaggcatcatatttaattgggctagctcattttcgatgattatctgttttgatatggaaagtgaagatgctgttatatacaatggttcattgaacatgttaagttcacatgttacatggtcttggtcctgttcactgttcacatttctggtcatagaatcattcatggatgggtcacgggttgcacaaagcctagactctctctggttctacaccaacatcttgacctgcagagatgagcctgaagcctctttggttgaatctgcacctttaatccaagccaaagagtgtcccaagagggatttgcagaaacccattaccccgttgcaacatgagtctcagaatgtggagaatttgagtccaaggtgtcacaaatttgaagaagtgatgaagaccatggtaccaagtagggaaacaaagaagagagagacgagaaaaagaaggaagtggcacaaattggggctatatgaaaccaatgtggttcatggagggcttgatttgaggtttgattttgatgtgtttgatgtggagtcatgggaatatcagattcagatgcttaacattcagcggcaaactaagatgcctccgtttgataatgatgtggcaatgaaacaacatctcaagtcatgggcttatgcagttgcctgcactgtcagataa

SEQ ID NO: 84835 - DNA, 984 bp, Glycine max
  Peptide Sequence Number=SeqID_176520
atggctgtagacaatgatgaaggtattgctgcgattgtagtggacggaggtgacgatcatggagtgggcattgaatacgtggtcttgttgaaggggccagagccccagaaacaaaatagcattgctgaaatgaagaattgtgatgaatggaaacctttcctagtaatgatagcaatagatttttctttaaccatggtgaacattctgcttaagaaagtccttcaagaaggaatgaaccatttggtttttatcacatatcgtctgtcagttgctactatatttttggcccccatcggctactttaaggagagggcatccgtcacacaatacttcttccttctggggatccaatacacctcagctacctttgcttgtgcctttgttaatatggtcccggtgatcacattcattatggcattaccatttggattagaaactgtgaacattaaatgcaaaggtgggaaagcgaagattcttggtacatttgtgtgcataggaggggcattgttgttgacactttacaaaggaaaggccttgtttgatggctctcaccatcaatctgcagtagccatgagatctgcaatggaccaagcttcttctactactagaacaacacagaaatggaccattggttcaaagatagggaagagatatccttgccagtattctagcacagccatcatgaccttctttggagccatgcaagcagctattcttggtttctccactggcagcagcaacttgtcctcgggtccggtctttaccgctgcattcagccctcttgttcagataatgtccggcatgattgatatccccttcttgcacgagcagcttcatcttggaagtgtggtgggatccatgttggtgatgatcgggttgtacattcttctctggggcaaaagcaaagatatgatgcagaataatggcgctactaagttcgctcaagaagttgaagaaaccaaagaacaagagccacaagtataa

SEQ ID NO: 84836 - DNA, 264 bp, Glycine max
  Peptide Sequence Number=SeqID_176521
atggcaaagaatccgagacacatcactccattcaccatctataaataccctgccagagttaagtactcacaagccaagagaacctcccttgtcaagagtaccgttctacgcttatacaaactaaagctcgcactggaaactgtcaaaagacagtatgaaaacctgttagccaccagaagagagttcattagcctatcgaaccatgtcaaagagaacaaggatgtgaaaatagagaaggtaggggcaggaaacttttatgggtga

SEQ ID NO: 84837 - DNA, 1932 bp, Glycine max
  Peptide Sequence Number=SeqID_176522
atggaagcgttttacacaactctctcctcccctgcttccacgtctgttctcaattttcagggctctgaattgcctagaagaaagctttgtaagaaatcttcacacactattttggcatcacctacgctgcctaaaccatttcttcagatttatggtagacctcagacattgctttataggtcaaccagactctcttctggagcacatagagtaacaatatcagctgaagctggcagacaaaattgggattttggaagatttgtaaaaacactgttcttcttcaatgggttcccatctcctgctaagttctttgattttctagttgagaaactatctgatccttccccaagtgaagtggttaacacaatgggaacttctgatattgtcctggtagctggagccactggtggcgttggtcgaagggtggttgacatattacggaagaaaggaattccagtccgagtattggttagaaatgaagagaaagcaagaaggatgttaggctcagatgttgatttggtcattggagacattacaaaagatagcactttgatccctgaatactttaaaggcgtgaagaaagtgattaatgctgcttctgtcattgttggccccaaggaaggagacactccagacagagcaaaatacagccaaataaaaggtgactcaccagaaaaggtagagtacataggaatgagaaatttgatcaaggccgtgaaggacaatcttggacttcgaagagaaaagctattatttggatttgaaggcaataattacaggcagcttccttggggtgctttagatgatgtggtgatgggtggagttagtgaaagtacatttcaaattgacccaagtgggggtgaaaatggtggaccaactgggatttttaaagttcaggtgttgtttctacagcaaacaatggtggctttacaagtatcagaactaagggcgagccctggtgcagcgttaaagttgtgccttggtgacttgttggtcatgggttcgaatctggaaacagcctctttgcatatgcaagggagagttttcacaattggttttcagaatttctcagaacctgaaaatctttctgcatatgatggtttggagttccgcctaaaaggtgatgggcgtagatataaaattattgttcgcacaagcagtgattgggatgctcttggttacactgcaggttttgacactgagaaaggaaaatggcaatcagtagtgccattttcttccttgaggcctgtatttcgagcaagaactgtgtctgatgctccaccatttgatccaagcattgttcaaaactctctgcagctcatgttcagcaagtttgagtatgatggtaaattaaatgaaacttttgtggaaggtccatttgagcttccagtgtctagcatacatgcatatataataaaggatccaataacccccaggtttgtacatgtgagctcagcaggagttacaagacccgaaaggcctggactagatctaagtaaacagcctcctgccgttcgattaaacaaggaactggattatatcctcacatttaaactaaagggcgaggatttacttagagaaagtggcattccctatgtaatcgtgaggccttgtgcattaactgaggagcctgctggtgccgatcttatttttgatcaaggagataatattacgggtaaaatatcaagggaagagattgctcttatgtgtgtagctgcgcttgatagcccttatgcatgtgacaaaacatttgaggtcaaaagtgtcattccatttagtgagccattcactgtggatccagcaaaccctcctccagaaaaggactatgacggtgggagtgatgtagcatttgaaatggagacaaatcttatgagggatgatgcagaagttgggaactgtgacaaggacgtgtatggctctatgcaatcatag

SEQ ID NO: 84838 - DNA, 1383 bp, Glycine max
  Peptide Sequence Number=SeqID_176523
atggaaaccatgaagcccaaatcagcactcaacaataggagcaagaaactggcaaagacgttccagaaggtgataagcctccgaagtgcaacgaaactcgcatcaaacaatggcatttgcatgctcaattcccacctcaaagtcaaggaggacctcttcaccgatcagaacaacaaaccccaccaaggaaacaacaagaatagagcagttatggaggctctaatcgcgagactcttcgctggcgtcacaaccatcaaagcagcatatgcagaactccaaatggctcagcacccttacaacaacgactccattcaagccgcggatcaagccgtggtggatgaacttcgagccatctcggagttgaaacgcaggttcttgaagaaggagcttgatctttcacctcatgttactattatgctcgcggagattcaggaacaacaaagtctcatgaaaacctacgaaatcaccatcaagaggctcgaagccgaggttgattttaaggacaataacatctcatcgctcaagaaacacctcgacgactgtgtcaacttcaacaaatccattgaaaagaaactcaactcgagtggctcattgtcgttgtttgataacctcacactttcatcgttgagtccaacacattttgttcattttcttcaccacactttgagatcagtcagaagcttctccaaggttatgatggcggaaatggaatctgctcattgggatctcgaagcagcggttaagttcatccattctaacgcggttttcaccaaaccaactcaccaaaccttcgcgtttgaatcgtttgtttgcataacaatgtttgaaggcttcaactacccaaacttcaacgtcgcagaagacaaaatcctacacaaacaaggagcacaaagcctctactttgacaaattcaaaaaagtcaaatctttgaatccaaaacagtacttaacccacaacccaaactcttccttctccaagttcctaaaatccaagtaccttcaagtggtgcacgccaaaatggagtgttccttcttcggcaacttgaaccagaggaaggtggtgaactctggagggtacccagaatcttctttcttcgtcgcgtttgcagagatggcaaagcgcgtttggaccctgcattgtttggcgttgtcgtttcaggatgatgatgtcactgtctttcaaatcaagaagaacacgaggttctctgaggtgtacatggagagtgtcaccgaagaacccgtttcgcattcaggggaatcctccgattccagctccggcgagcttagggtgggtttcacggtggtgccgggtttcaaaatcggtaagacagtgatacagagtcaggtttacctctctctggtgggttctccggctacttcctaa

SEQ ID NO: 84839 - DNA, 399 bp, Glycine max
  Peptide Sequence Number=SeqID_176524
atggcgcgctcagcgcacgatctgaacgcgctaagcgcgaggactgcatctggagacgtggtccctatcaacttggaaatcgaagccacttgttggcgtaacaacactgcaagaagaagaagggaacaggacaccgaaggaagcagtcacacatcacctcctctctctccacatcacgctgaaatggacggggaacaggcacgaagagtcaaattagaagacttctccaacacagccactcctcagttcttcacaagtattgcaagaccggaggtgcaagcagcaaatatctcttacccgcattcccttatccagcttattcaagggaatctcttccatggtcttccaagcgaagatccatatgctcaccttgcctcatacattgaaatatgcaacacc

SEQ ID NO: 84840 - DNA, 1767 bp, Glycine max
  Peptide Sequence Number=SeqID_176525
atggcagcactcaattcgagcacttgggccaaacctcaattccatcaccctctctcttcttcttcctcattattaacagacatgggcttccccactaggtttcccaagaagcccattggagaggtggtgaattgtgctctacactcccccccagtgacccattttccaaaccaacccttcacaaaaacactccaaattaccaaagaacctacctacccccccgcggaaaggcctcagtggaacccattccaaaaagccgccgccaaggccctcgacatgttcgagagcgcgttgctctcacgcgagctcagccaacccctccccaaaaccactgacccacgcgtccaaattgccggtaacttcgcccccgttccggaacaccccgtccaacattccctccccgttattggcacaatcccagacgcagttaacggcgtttatctccgtaacggcgccaacccattgttccatcccaaagccggtcaccacctcttcgacggcgacggaatggtccacgccgttaaaatcaatcacggcaccgccagctacgcctgccgcttcaccgaaacgcagcgtctcatgcaggagcacgcattgggaaaaccggtgtttccgaaagcaatcggcgagctccacggccattccggcatcgcgaggctgatgctgttctacgcgagaggcttgtgcggcatcgtcgaccaccgcagcggcgccggctccgccaacgccggcctggtcttcttcaacggaaaactcctcgccatgtcggaggacgacctcccctacgagctccgaatcaccgcctccggcgacctcgaaacaatcggtcgctacagcttccacgaccagctcaattcctccatgatcgcgcatccgaaggtggatcctatctccggcgagcttttcactctaagctacgacgtcacgagcaagtacctcaaatacttccgtttctcgccggaggaggagaagaagtcgccggacgtggaaatccccctcggcgccgcgacgatgacgcacgacttcgcgatcacggagaatttcgtcgtgatcccagaccagaaggtggtgttcaagctcggcgaaatgataaaaggaggatcgccggtgatctacgacgacgagaagaaatcgcggttcggaattcttccgaagtacgcctccgacgcgtcgagcatcgtgtgggtggagtcaccagacacgttcttcttccacttctggaacgcgtgggaggaacgcgagacggacgaagttgtagtaataggttcctgcatgacgccaccggattcaatattcaaagacaccgaagagagtctgaaaagtgtcttaacagaaataaggcttaacataagaagcgggaagtcgacgcggcgtgtggtggtagaggaaatgaacctggaggcggggatggtgaaccggaacaggctggggagaaaaacccggttcgcgtacttgtgcatagcggaaccgtggccgaaggtgtcgggattcgcgaaggtggacctggagagtggggaagtgaagaggcacgagtacggagagagaaggttcgggggagagccattctttttgccaacacgtggagagaatgggaatgaggatgaagggtacgtgatggcttttgtgcatgacgaggtgacgtggcagtccgagttgcagattctgaatgcacttgatttgaagttggaggccaccatcatgctgccttccagagtgccctatggctttcatggcacgtttgtggaggctatggatttgccccagtga

SEQ ID NO: 84841 - DNA, 1410 bp, Glycine max
  Peptide Sequence Number=SeqID_176526
atggcgacccttttccagggattgggagttgtgaacccgtcattgtcttcttccaactccaacaacttcctgcttccttctcgtacatccctctctgagagaaaagatggcatatttgtagtcagatctgatgcaagggtaagcagcaaggttctgaaggccggagctcgcaagcatgaattgttggttactaatgcagtcgcaacaaaggaaggcagttctgcggcttctacatcaaaatctggatattgttacatgtttatgtccaaccattcatgcgcttcacccagcaacgcaacaactcattgtcccatgataccggcaatacatcttattcttgctaagattagtaacaatatccatacaatgtttatctttgttctcaagagtcaagactcttaccgtttttctttcactataccaaatgtccataaaaggcatgaacttctcctttttgaggccctacgtgaaggtttggaagaagaaatggagagggatccttgtgtatgtgtcatgggcgaagatgtaggtcactatggaggatcctacaaggtgactaaaggccttgccacaaagtttggggaccttagagttttggacacacctattgctgagaactccttcacgggcatgggcattggggctgccatgactggtctgaggccagttgttgagggcatgaacatgggatttctacttctggcatttaaccagatttctaacaattgtggcatgctccattacacttctggaggccagtttaagatacccattgtcattcgtggacctggtggagttgggcggcaacttggagcagagcactcgcagcgattggagtcatattttcagtcaatccctggaatccagatggtggcttgctcaaccccttacaatgccaagggcttgatgaaagctgcaatccggagtgagaaccctgtgattcttttcgagcatgttttgctttataacctcaaggagagaattccagatgaagagtatgtattgtcacttgaagaagctgagatggttaggcctggggagcatgttacaatattaacgtactccaggatgaggtatcatgtcatgcaagctgctaagacactggtgaacaaggggtatgaccctgaagtaattgatatcaggtctttgaaaccattcgatcttcacacaattgggaactcggtgaagaagacacatcgtgtgctaattgtggaagagtgtatgaggacgggtggaattggggctagtttgaccgctgctattactgaaaatttccatgactatttggatgcccctatagtatgtttatcctctcaggatgtgccaactccttatgctggcacattggaggaatggacagtggttcaacctgctcaaattgtgactgcagttgagcaactctgcaagtga

SEQ ID NO: 84842 - DNA, 630 bp, Glycine max
  Peptide Sequence Number=SeqID_176527
atggctgattattcagcacgaactgaatcctgcgaggtagttgtaaatgtaaccaaggacacctccaaaacaatggaaccctcagactcctttgtctctgttcctttcttgcagaagttggtagctgaggtggtgggaacatatttcttgatatttgcagggtgtgcttcagtggtggtgaataagaacaacgacaacgtggtaacacttcctgggatagcaattgcttgggggctggttgtaacagtgttggtttacactgttggtcacatttctggtgcccatttcaatcctgctgtcaccattgcttttgcttctaccagaaggttccccttgatgcaggtaccagcttatgtagcagctcaactcctaggaagcacacttgccagtggaactctgaaactattatttatggggaagcatgaccagttttcaggaacactcccaaatgggactaacctgcaagcttttgtgtttgaattcataatcacatttctccttatgtttgtcatatccggggttgccaccgataacagagcggactcaatgaaaaatgttacatgggttagatcatctgttatcaagctgataaatgaggtggagagtgtgcacaggggcattcttgagtga

SEQ ID NO: 84843 - DNA, 297 bp, Glycine max
  Peptide Sequence Number=SeqID_176528
atggtgttgaagtccaaggcagagttccttatcctcttggtccttgttgtgtgccaaccctcttgtgggttgggggaggattggtctactaggagactcagtaggcataataataaggtgattcctccaagctgtggagagttggtgttgaagtcacagtgctcagagaactcaaagtgcaggtggtgcaccagtgaggaccttgatgacatgtgcttctctaaatctgaggcattgagattgcctcaccaggaaactgctgtccgctctgttaataatactgatggtgcttggtag

SEQ ID NO: 84844 - DNA, 315 bp, Glycine max
  Peptide Sequence Number=SeqID_176529
atgacacgaagaaatggagagaggcatgacaacactgaggttggtgagttggctgggattgcaattgggtctacaatactgcttaatgtgattattggagggccagtgacaggagcatcaatgaacccagttagaagcctaggacctgctattgtacacggcgaatacagaggaatatggatatatttgttggcaccggttgtgggggccatagctggagcattggtatacaacaccattaggtacacggacaagccattgcgagaaatcaccaagagtgcctctttcctcaaaggccgtggtggctccacataa

SEQ ID NO: 84845 - DNA, 813 bp, Glycine max
  Peptide Sequence Number=SeqID_176530
atggatgagaattcagcaacaaatggaacccatgaggtggttttagatgtaaacagggacgtctctagaacaactcaagcttcacgctcttgtgtcaatgtttctttcttgcagaagttggtagctgaggtggtaggcacgtatttcttgatatttgcagggagtgcttctgtggtggtgaacaagaacaacaacaacgttgtaacacttcctgggatatcaattgtttggggactggttgtgatggtgctggtttactctgttggtcacatctctggtgcccatttcaatcctgctgtcaccattgcttttgcctccaccaaaaggtttcccttgaagcaggttccagtttatgtggtggctcaggttgttggatccacacttgcaagtgggactctcagactattatttagtggcaaagaagcccagttttcaggaacacttccatctgggtccaacctgcaagcttttgtgattgaattcttaatcacttttttccttatgtttgtcgtatccggggttgccactgataacagagcgatcggtgagttggccgggattgccgttgggtctactgtgctgttgaatgtgatgtttgcagggccaatcacaggagcatcaatgaacccagcaagaagcatagggccagcgattgtacacaaggaataccgaggaatatggatatatttagtgtctccaactcttggggctgtggccggcgcatgggtctacaatagtattcgttacacggacaagccactgcgtgagatcaccaagagtgcctctttccttaaaggagtagcctctaggtga

SEQ ID NO: 84846 - DNA, 1338 bp, Glycine max
  Peptide Sequence Number=SeqID_176531
atggagtcatctttttcaggcccaaacaaccaaaacgacgacgttttcctcgacgcgcttcctcactgccccttccaccattgctccggcgccgccgataaatcgccggaatcttcctcctcttcttcaattctctccgaccccaacccaccctccccacctccggcaaccacaatccgccgccgttcaacccgccgtaactcaccggttagggagaccacgaataccggttccagccacaattcgaccaccggaaacgtcacgaaccttcggagcgatcgaaatctcggaacttcaaacggaaatgagaatttccccgagaaatgcgattcaaatcgagagaaagttcgtccctttcaatctccaagcgttggcaccgaagaggggaacgaggaatcgacgttaaccaccgccgagaacgaagacggcgtcaccgattccgctgactcggcggtggaattcactcaagggtggttcaaagagcacaaatccttgtggaatgttgcatttaggtgtgggtggggattcttgaggtcaatgtatatttgttgcattttgtttggtcttttggtttcttcacttgtggtgagtgggtttttggtgaggtggttggtggaggagccgtttcagatgaggcaggttttgaattttgattacaccaagcagagtcctgttgcatttgtacctgtgatgtcttgtgatggtgttgggggtgcgcatgattctgagaagggcattgctgttagagagtggatgggtagaagggttatacctgctaaccaaaaggtgcaggtcactgtttcattggttgtgccagagtcagaatacaacacaaatcttggcatctttcagatcagggtagacttcttgtcttctgatggcaaaacaatttggagttcaaaccaaccttgcatgttgaaattcacaagtgagcctatccgcctaatcacgacattcctcaagattgtacctcttgtcactggctatatatcagaaacccagacactgaatgtcaagatgagaggttttgttgaaggggatgtacctacttcatgcttaaaagtaacccttgagcagcgagcagaatattcacctggtgccggcattcctcaaatgtatgattcatcagtggttattgaatcagaacttcccttattcaagaggattatatggcatgggaagatttgcatatttttatggatcacaatgatggctttcatgatggagttactactcgttctagtgtgttgtttgcctataattattccaagaaccaggcaaagcagtggtgctgctcgtgttaccggtacccaaaataatcttcaggcaccaaattaa

SEQ ID NO: 84847 - DNA, 318 bp, Glycine max
  Peptide Sequence Number=SeqID_176532
atggacgtcaaagcttcaattgagaggtacaagaaagcaagttcagatttatctactggtggacaatctgcttctgaggctaatgctcaggacaagaaaaatttaactacaatattgaaaaaaaaagcatatgaagagatctcaagtattattccaatatttggtaaaaatgttttgaatcgcagtcaaatgatgggtgagggtttgagcaccatgaatggcaaggatctcaaaaacctagagactaaattagaaaaaggaatcagcagaattcgttccaagaaggtatttctagtaacaagaagtttctttctatga

SEQ ID NO: 84848 - DNA, 1503 bp, Glycine max
  Peptide Sequence Number=SeqID_176533
atgggtctagtaatctcatacccgtacccatacccgacttttggttatcaggaaaaacccgaacccgaacctatacccggagatagtggagaaaggaaactcacagatggctacggaagtgtcgtagttggcagcgaagtgagcggttcggacatcgtcgctgtcggcactaatggtgaagaggtcgaagttgtagtgtgcggagaaaggagggacgatatagaggaaccgctttggggacaatggaggagacgcaacaatggagacaccttccatggtggcaacaatgagggaaggcataaacacaagccaagtgagggaaaccacgatgacgcaacaccgtttcttgctccaatggcagctttgtatctcccaataagcatgttggcactcattgttgttgtttctcttggtttgtggagtggtgttcaaggtgcaccacaagtgccatgctacttcatttttggtgattctttggttgataatgggaacaacaaccagctccagtctttggctagggctgattacttgccttatgggattgacttccctggtggaccttctggaaggttttccaatgggaaaaccactgttgatgcaattgctgaacttttgggattcgatgattacatacctccatatgctgatgctagtggcgatgctatactcaaaggagtcaattatgcatctgctgctgctggaattagagaggaaactgggcagcaactgggagggcgtattagttttagtgggcaggtgcaaaattaccaaagcacagtgtctcaagtggtaaatttactgggaaatgaggactcagctgcaaattacttgagcaagtgcatatactcaattgggttgggtagcaatgattacctcaacaactatttcatgcctcaattctattccagcagcaggcagtactcaccagatgagtatgctgatgttcttattcaagcatatactgaacaactaaaaactttgtacaattatggagcaaggaaaatggtgctgtttggaataggccaaataggttgcagcccaaatgaattggcccaaaacagcccagatggtaaaacatgtgtggaaaagatcaattctgcaaaccaaatattcaacaacaaactgaaaggtctcactgaccaattcaacaaccagctgcctgatgcaagagtcatctatgttaactcttatggcatctttcaagatattataagcaacccttcagcctatgcaaataatatgaactcacaaagttctgttgacatgaatcaatcttcaggtttcagtgttacaaatgctgggtgctgtggggtaggaaggaacaatggtcaaattacatgtcttccaatgcaaacaccatgccaaaacaggagagagtacttgttttgggatgcttttcatcctactgaagctggcaatgttgttgtggctcagagagcttacagtgctcaatctgcatcagatgcttaccctgttgatatccaacgcttagctcagatatga

SEQ ID NO: 84849 - DNA, 1119 bp, Glycine max
  Peptide Sequence Number=SeqID_176534
atgcagatacaggcactgccccctgctctccaacgcccgtttcagcctccactatctcttggattccctttcaaaccttattttttaactccaaccaaacacgccccttggcactctactaataattcattcgtcctatattcacgttttctgcatgcagttaagtttcgtcgctcttttgcaacggttacagcgaccaccgacgaggctgttattgacgacagctacaccaccaacaacgaacggggcttcgttaacattggctacatatcgagtgttcatggtattcagggcgagattcgcgtcaagcccgccaccgattttcctcgactgcgcttttccactcctgggagaagatggttgaagagcaaggttttggggggagaaagcgttcaagaagttgagctggaggaaggtagagagcaccctgcactcaagagttggatactcaaattcagaggaattgacaccgtggagcaggctaagatgcttattggtgctaccttgcttgtgacggatgaagacaggccggaattagaggagggtgaattttacacacatgatctgattgggatgagagtttttatgaaggaaaatggaaaacttgtgggaactgttgtgaatgttttcaatagtggagccaatgacctactacaaattgtactcgattcatcttttgatatgcttgacaaaagtggcaagtcaagatcagcagaagatgcatctgatcagcttgttttggtacctttcgttgaagccattgttccagatgttgatatgaaaaaaagagaaatgcatattacaccgcccaagggactcctagaattaaatttacgatttgatgagaggtctaaaaaagaaaggcgccaacttgaatggaaagaaaggaaaaagtttcaaaagcatctcatagcagccaaaaagaaactcattgaaatggagcaaaaacatgtatttcatggatttcaatatggagagaaagatcaatggagcttgcttagtgatcagattgttggcgtaaactccaaattgctccaggaggctttacaaagtctagagcggccagcaaagaggcaagttaatataacaacaacaaaaatgaaagcctgttcccactaa

SEQ ID NO: 84850 - DNA, 1410 bp, Glycine max
  Peptide Sequence Number=SeqID_176535
atggctatgcatgtactatcacaaaggtgggatgtgaaatgggttgctggaaaggttctcatcattgctttgcttcttcctgttacagtctccgctaagaacacaacctcagaatccaatgagatcacaggggttggcaccggttatcatgctaaagtattttaccaacacacttggccgagcatgaaatatggctggaaaataatagtgggcaccatagttggattcctaggatcagcatttgggaatgtgggaggtgttggtgggggtggcatctttgtgcctatgctcaccctcattattggatttgatgcaaaatctgcaatagcaatatcaaaatgcatgattacgggtggagcaacagcaactgttttctacaatttgaggcagagacaccccacccttgatttgcctgtgattgactatgacttagcacttcttttccaaccaatgttgatgcttggaatcagtattggtgtttctttcaatgtgatttttcctgactggatgttaacaactttgttaataatatctttcaccggcatttcggtcaaatccttctttaagggtgttgacacatggaaacaagaaacccttatgatgaaggaagctagcaagaattcactgactgatggcaggggtggatccacatgtatagcaacaaggcaattatccttacaaaatattgggaatcctgaagatgatgcacattatattaaaacaatagacccggtcaaggacaataccaatcaatcaaggaaaaaaaattacacaacaacttgctctggagtatattgggtaatcaatctactgcaggtccccatagctgtaggaatgagttcataccaggctatgcgtctatacaaagggcagagaatcatagcatcaaagggagatcaacaaacacattggcgagtgttgcagttaattgtattttgtgcttgtggcatacttgccggcacgattgcaggcttgttaggccttggtggaggattcatcttggcacccctcttccttggactaggaatccctcctcagattttgcatggaaaccactctaattggggatttttttccacaaaggtggctagtgcaacatccattttggcaatggcattttctgcatctatcgcagtggtggaatattaccttctcaaacgtttcccaatttcttatgctctttactttgtagctgtagccactgctgctgcacttgttgggcagcatttggtgagaaaggttattgccatgttggggagagcatctgtgatcattttcatcctaaccctcacactttgtgttagtgcagttttactaggtggagtaggcgttgcaaacatgatcaaaaggattgaaaataaggagtacatggggtttggaaacctttgcacgtacaaggttaaagaataa

SEQ ID NO: 84851 - DNA, 56 bp, Glycine max
  Peptide Sequence Number=SeqID_176536
actgtagaagccggtggttatgctggaaaaggctattctcgtcacgttcaacgcgg

SEQ ID NO: 84852 - DNA, 1056 bp, Glycine max
  Peptide Sequence Number=SeqID_176537
atggcaaggtatgacatgactggtgttggaataaaccttaaggaagttcctgatgaaaatggagacctcagactggaggttctgggaattatattggatggtcctgctcattctgctggtgttagacagggggatgaaatattggctgtcaataacatggaggtaaagggaaaatcagcatttgaagtatcatccctgttgcaaggccctaatggaacatctgtgactattcaggtcaagcatggcaactgtggacccgttgaatcaatagaagtccagcggcaacttgttgctcgtaccccagtcttttatcggctggaacaattggacaatggtgttacttctgttgggtatatacgcctcaaagagttcaatgcattggccagaaaagacttggtcattgcaatgaaacgacttcaagacatgggtgcctcatatttcatattggatctcagagacaatcttggtgggctagtacaggccggaattgaaattgcaaagcttttcctaaatgaaggagacacggtgactaaggggggtcacccctatttattgaatgagattgggcgaaaggctagaatacccaatcattctacattggatgatccattcactgacagtccacaaccccctcaagcgttgagcttgaagggctttattgcttctaacagtcagcctttcctgggccgaatggtcgaagttgatagttgcttacatgttgatgtgatctacactgttggaagagatcctcagttacagaaagctattgttacagatacttcaccattgattcaagctcctattgttgttgcttctgcacttcatgataattgtagagctgttcttgttggaaaacgcacatatggcaagggtctaatccaatctgtatttgagcttgatgatggatctggtgtggttatcactgttgggaagtatgtaacaccaaatcacaaggacataaacggcaatggaatagagcctgacttccagaaacttccagcatgggatgatatcagccgacatcttaaaaaatgcagtatgtcacaacagggataa

SEQ ID NO: 84853 - DNA, 630 bp, Glycine max
  Peptide Sequence Number=SeqID_176538
atgagtggctacgtctgtctgaaactctcgccacctccaacttgcctctccaaacatcctcgtcttcccattcccttggttcgcaacactctcctcggcgctgctctctccttcgggcttgtcttctccttcccctctgtctctgcttcccaaatatgtcgtgatgtggaacccatacaagagacgctccaaacagctcccgaggttgtcaccaacgaaggcctcgtcgaggaagcatggcagattgtcaacgacacctttctcgacactggtcgccacagatggtcccaggacacttggcagctgaagagggaagctattttgagcaattccattcagacaagatcaaaggcgcaccacatcatcaaacgaatgctctccagcttggccgatccttatactcgctttctctcccctgatgaggtcatttttcatgtgtcctttttactgtgtttgttaatcactagtattagtgttggaaagtcccacatatctgcttcaattcctgtggtgcagcttatatgcctacttgttatatcctctctctgtgtatcgccatcacctgttttagctagcagacatctatggaaggggtctaaacttaggattgagcctaactcaatcctttaa

SEQ ID NO: 84854 - DNA, 264 bp, Glycine max
  Peptide Sequence Number=SeqID_176539
atggcaacttatcccgatgcgtttcctgaagactcaacgagcgaagtgattgataggagaccggatcttgaaatgcccaagggtactcagcaaaaaagccttgatttgattggtaacaaggctattggtgggcaacaggttggagtgtcatcgttaggaacttatggcaacaaatcataccacagattttggtgcttcattccagcaatgacagtgcaatccctcggcgtgcttgttgtgaggggtgatggactttctctgtga

SEQ ID NO: 84855 - DNA, 129 bp, Glycine max
  Peptide Sequence Number=SeqID_176540
atgactgaaaaaggctttaaatacactctcagtataatgtcttttgagagtcaatggctatcatttactactgctaattggcattgctgtggaagcgctttgattatatctttgaagcctcaaagtcag

SEQ ID NO: 84856 - DNA, 609 bp, Glycine max
  Peptide Sequence Number=SeqID_176541
atgggacccacgaggttgcagccagagaggaaaagcgtttcgaggttccggagtgaggttgcgaagggaagagggtattgcttcggtgaggaggttgctgacgaggttgagcgttttgaggcgggagagggcggcgaggctcggcggaatgttgccggagaggtcgaggtgttggagcgtggcggaatggggcccacgaggttgttctgggagagatcgaggacgacgaggttgcggcacaccgcagcaacgacggcggagagggtggagctgatgaggttggtggtgaggttgagggtggttagggagacgatgcggcagaggatggcgggaaaggggccggagagggaggcggaggggaggctcacggcagtaatggtggcggtgagagggtcacaggtgacgccgcgccaccggcatgggttggcggcagaggagtcccaggaggagagggcgttttccgggtcggaaagctaccgtcttgcttcgaagagaaagagactgtcttgggttagagagagagagagtgcgggagaggagagagaaagcagaggaacagcaaaacaaacacgaaaatcctgccagagatctgaaagatattttggttag

SEQ ID NO: 84857 - DNA, 2295 bp, Glycine max
  Peptide Sequence Number=SeqID_176542
atggcaacacccccaaggtccccacctaattcagataatcctcccgaggtaacttcaaagaggactagacagtccaccaaacttagatacttgacgacgagaagcttatatcatccacgaccgattgttaacgtcaatcccactactagtagaggatcggggccccacaaagacaaatttctcagttacctaggggttgtgcgcaaatttgacatccctgaaggtgacgatgcgaaaaaaaaggtgatgtcaatagtcgctactagatggaggcaatttaagtcttcgttgacgtctaaatttgtctatgctgataacgaagggcaacaaaagagtgatcctatagtgaagtatggggttcatcctgcaacatgggcggaatttgcaaaaagccgccaaacccctagttggcaggagaagaggaagcaacgacaacatgaagctgagttgactgaaaatccttcattgaccgaagaccctccgtccccaatatccagacaattgaagtggaagatggcgcgcacaaagtgttttgggcaaatgacctttgcagcggcacaacaaatatcagaaaaaattgattccttagaggaacaggcaacacaggggagctttgtaccgcatggccgtgatgacattttgaacacggctataggccgagctgagcatccaggccgtgttcgtgtcgcaggggcaggtgtcacaatcagccaatactttggcaagtcgtcacgtgcctcgagcacttcccccccatcaatcacgcaacaacaattggctaacatcatcggtgggctgaaggatgagatacaaaaagaggtagaagaagaacacaagcttcaacaggaggcttggaggagggcacttgaagagcaacacaaacccagtttggacttgatgaagcaagagttaatgggagcagttaaagttgagttatctcatattgcatcacatcaatcagcccccattgagccccctgaaggtagttgcattgcaccagagccaaaagaagtacctcaagagtcgtcagatgttggtgacaatttgatggggttgtatgtggttgatgaagatcaaaatactcttctagtggccttaggaaaggtgtacccctcaacatgtaccatacacactgttccttatgcagatgaggtcactagagtgagtattatctctgtgtacctggctgatgctaaggtcctgcttcctacgtcagagcctccccccaagtccgttggaaacgttgaaaggggcactataagtggtgttgatgatcccctaggagaattggtgaagaatctttttgtcgtttatcaaaagttgatcgagttggcatgggaggaggccaagtttgggatacctaattcaaaaaatggatttttcatgacacatgctgatgtaactgaaatcattgttggtgacaaatgcttaaacatatctatactacaactgtggattgcaatgcagaaaatagccactactgttgaaggcaaagctgatagagctgcacctcgatggactgaagttgggagtcatgtacaacccggagcatatgagtgtggatattacgtcatgcattggatgtggtgcatagtcagtggtggtttgaagaatgaatggaccaggtggttttgtgatcgaacacccttagacaaggacaccatcaccacactacgcaagaaatgggcaacctatttcctacaaaagcaatggaagacacatttgttctgttttgtgaaatcagtatatgatcttcaagggagattgatgtgttacaagcaagactggattggtggtctcacggcaggcttcagagaacatgaatatgaggactcagcagctaaggttgctgggaaagaccaattggctgaagcagaaaaaagtgacattgctactgaatttggggatgatgagcaaaaattgtgtttcattgatgaagatgagaaagagaagcatgatgaacttgttgcccttccaccttatggttctgaagtatttattggtggacttcctcgtgatgtatgggaagatgatttaagggaattgtgcgagcctatgggtgatattcttctggtgcgattagtgaaagatagggacactggagaacacaaaaggctattcaggagatacataacagggaatttaagattattcattggtaatgttccaaaaagttggactcaacatgattttaggaatgtcgatgaaggtgttggtcccggggttgaaaccattgagctcataaaggcgtgtcctaaatcttctgacgatcaagattgtcacgacacaacctaa

SEQ ID NO: 84858 - DNA, 243 bp, Glycine max
  Peptide Sequence Number=SeqID_176543
atgtcggccttgctggtagcaagatcaacatggaccactggtctctcagcaccaggtggtctggtagacaaggatcatagacgtgaggctttgcgtgtccgcttcacggcaaacggcgaagctgatgcatcagaaggaggaggaggagaagaaggaggaggaggaggaggaggagaagaaggagaagggggaggaggggaggcaggtggaaatgccatgatcctgtttgataagctttgctaa

SEQ ID NO: 84859 - DNA, 237 bp, Glycine max
  Peptide Sequence Number=SeqID_176544
aaagatgcactccctccacaagatgagcgtactccttctcctcctcctcagcgagatgattcagcccttatgactgaagttctttcagagttacggggtcttcacacttatgttggtgaacgatttgattctttggataatcgttttgaattaaattgtcatcatcaaaaagggggagattgtagaagcaaagactttgagattgtaaaagcaaagactttgcctttgatgttttga

SEQ ID NO: 84860 - DNA, 582 bp, Glycine max
  Peptide Sequence Number=SeqID_176545
atgtctacatatcaggagtatgagcccgagtgtcgcacgggcaaacgactagtttcaagaatcaaatggggattagtcaaaacactgaatttcccaagtctaaaaagcactgaatttcctccaatatatcaaaacactaaattagccaaagcattgaatcatatcaatggcttcttcttgaactttcgctggggtgtcaatttccccaggaactttggctccaaaatgctgagtttgaccatgaataagatagggttagagagggttggggaaaggaaagagaataataataagaagaagaagaggaaggatggttctgaaattgatttgcagttgttgaagggaatgtgtttttggatgggaaaagatttggagattatggaaaaggaaaatagagagatgaagcgtttgttggatgagatgaaattgggaaggaataatcgccttgaggagagcaaaggtggtggaaggaagctgagtgaaagcaatggggaggttcagcgttggagaagttacaagagtgaaagacaagaggaagagaaaaaagttcaacaaccaaacaaagttttttgtattcactaa

SEQ ID NO: 84861 - DNA, 522 bp, Glycine max
  Peptide Sequence Number=SeqID_176546
atgtcacgatctcgtgcatcgtcatcacgttggactagcgttaatgaggaactgggacagcttcttgcgaatgtgcctgaattaacaattgaagagcatgaggaatggagggaattggcaaacatgatgcagaatgtcgcggctccaccagaggcttttttccaaacctttcacgccacggaccaggatgtactggatggtgtatggcatttggttgacaaagatggaaattatcataacgttgtgtataacaaagatttggaccaaccagtcattgtagcagggtggacagcactacgagatttttaccagctgaccggagatcatctagtatccttgcatcattatgttgtctgcccagatcattcccaagatgacactctttatatcatcaagtgtcaggacgttccaagcagcatgtattatttttttaaagacaaaggatggactcatttgcacttggagaacgttgctgaatgttggcttgtgttcaatcattggaggaagacacttaaaatttga

SEQ ID NO: 84862 - DNA, 900 bp, Glycine max
  Peptide Sequence Number=SeqID_176547
atggcggaccttgcaggaggtagtgcgcatgcaatgattcctctatcggctgaggagtacaatgcctgcttggaccgtctcaaagctctcattgccaacctcgctgccgctcaactccattccattgtgactctcgatttcatagtctccaaactcgatctcattcttctgaaacaacatatctcgatcccatcttcttcatcgataaacaatcaccacgctgaaaaggaagttcccagcgacacgatggaggaacttgtctctgtgggctctctggagttgtcgtcagaggtgccccctctgcccataacacacggtgcggcgcaagcgaggtgttttgcattgaccaccaacactaccgccacgaccactgcaacacggtcccctacgacaacgtcatctagcacagcggtgccactaacagccactgcctccaccacgaccacggtcggcgcggtttgcaccttgtggagagtgatgttcggccgtcaaggtcttggccgtgcaaaccactattcatatctctcactccctcttgttgctttttcttctgaccatgcaacaacagtatctcttcaatttggtgagttcccttcgtggcttgcacccattggagcagcagttagagctgttggtgtttccatgagccacaaccaagcaaagaaaaggcacagggataggattgatgctctgtggcgcaggactttgtcagcaagtagtggagtgagtatggctgacctggcaggaggtagtgcgcacgcaacgattcccctgtcggctgaggagtacaatgccaactcaaaggacgctggcatcagcgtgttcgcttctaagtttataccagaaacttctgatgagcttttagcctctggagttgaagatgttggagtaatcctatga

SEQ ID NO: 84863 - DNA, 438 bp, Glycine max
  Peptide Sequence Number=SeqID_176548
atgtctcttgccactttctttgggaaacttcaagaacatgagatggaacttatgagactccatcaacatgaagagaatgacaaaaagaagaaaggaattgcactcaaagccttatcttctattcatgaggaaagtgacaaagaagatctgaatgaacaaaataacttagaagaagatgatgattttagtctctttaagaaaggagaagattcctctttagttccaaaaagctatgaatgcgatcaacttgggcacctgagagttgatcgtcctatttgtaaaagaagaatggaaaaaccagacaagaaaactttcaaagataagaaaggaaagaaagtgcacatcacttgggtagataatgatatggattcatcaagtgatttagaaaatgaaattgtaaatctgggcctcatggccaaagactatgaaagcgaataa

SEQ ID NO: 84864 - DNA, 1344 bp, Glycine max
  Peptide Sequence Number=SeqID_176549
atggatgaaggagaaatcatgacaaatattgctttccctcagaacttaactgcttccgctgcatccaatcctgaagcacaagtcatagccttatcaccaaagaccctgatggctacaaacaggttcttgtgtgaaacttgtgggaagggtttccagagggatcaaaatctccaacttcatagacgtggacacaaccttccatggaagcttaagcagaggacgggaaaggaagcaagaaaaagggtttatgtgtgccctgagaagagttgtgtccaccatgacccttcaagggctcttggagacttaactgggataaagaaacacttttgcagaaagcacggtgagaagaagtggaagtgcgagaagtgctcgaagcgttatgctgtgcagtcagattggaaggcacattccaagacctgtggcaccagagaatacaaatgtgactgtggaactatcttttcaaggagagatagcttcatcacacacagggccttctgtgatgcattggcagaagaaacagctagggtaaatgcagcatcagacataaacacctccttagggggcaacattggttacaacataatgggaacatccctaggccctaacatggcaacccatttcccctcaattttcaagccaatttcaagcactgatgaaacaagtaaccaaacatctaggggactacccctttggatgggtcaaacatcttctcaggctcaagaaacaatggtcaacacaaattttcgtgagattcatcaacttggttctgccacaagctcatcaggaacaatgtatggtggcaactcaattctccaatactcaaatcttccaccttccaataactatcaactaagttgggtgtttggaactaaaatttccaatagcagtaacaaccaagagttaacaactaacactactactactacttcacttcctattggaaactcaagtgttccttccttgtattgttcccaacaccaacctcaacaaacatgttcatcagcaaacatgtcagccacagctttgttgcaaaaagctgctcaaattggagcaacctcaagtgacccttcatggcttgggagcttaggtttgaaatgtggcaacagccaaggtcaagatgggaacaataacaagtatagtgacatgtacggatcaagcttggtgctaaccactcttgggagtgaagcagataactctgcatgtgaattgtcccaaatgcaccctcacaaacgaagacacgtgctcaatgaagaaagtggaggggggcagactagagatttccttggtgttggtgtgcagaaccatttgccacacttcatcaatcaaggggtggacttgatttga

SEQ ID NO: 84865 - DNA, 1020 bp, Glycine max
  Peptide Sequence Number=SeqID_176550
atgggtgcacgtatgggcacagaggggagtaatgctaaagctggtgtcaatccatcaggggaagaagatggtgttgatgttttacccactgtgggattgtatgtgcaacaggatcattctacacacttggtggccttaggaaaaatatatgaggaggggtctaccatacatagtgtggcttatgcagatgacatggcccttgacacattcattgcatggccaacacagcttgtcaaacttgtatcacatgagataatgtcaaatgatgtggaggcagatgatcccttgcgtgggttgatcataagcctttgcgatatttacgacaagcctattgaattgttgtttgatgggactaaatttgggattctagatgtagatgcatccgtcttcctaacatattttgatataaatgaaataatatcaggtttggataagtggagctcaagcttgggtcatggtttcgtgtatcgattccttgagcctaagtccatacacaatgcaaagaatagacatggtgaatgccaacgatacattgaaacatgggttaaggaatcccaacgaggggtctacctaggagcttacttgaatcatagtgcaataaacacattaaagactactttgcatggtcatagtggtcaagttgcacctaagtggattgaagtaaagattcatgttcaaactagaggctatgagtgtggctattatgtcatgcattggatgtggaacatagtaagcggggagttgaagactgattggaccatggatcagtgttttatgagcgaccaacctgctcattttgcaggtcagtatgaacctgaggatatagatagtgctgatgatagcccaattgacatcaacacaaatgagaatgaagccatgtctaacttcaccaagtgcgttattattggaaagaggggtttgcatatgttgttgaataccggtaacccttacagtggattgttcgttgaaaattatgaggcacttacttcttattgcccctccttgactgccactctttga

SEQ ID NO: 84866 - DNA, 288 bp, Glycine max
  Peptide Sequence Number=SeqID_176551
atgtcgtttgccaagcgaaatctgggatgggaaatactgctgtttttgttttgtcaacacttcagcaagctgatcctgttccggatcaagttgcggctcttgttctttgccacacaagagaactggcttatcagtattcattcttatgtgatcaatgggaatgaaaaacaagacctcgaaatatgggcaaatggaagtttaactactaaggaagcgctttatgaaccctcctggtatttgatttatttatatgcccagagtgctatcataatcagcttacgtgattaa

SEQ ID NO: 84867 - DNA, 675 bp, Glycine max
  Peptide Sequence Number=SeqID_176552
cctatccctcttaagattattgaggccacaaggtccaacacaagatccatgtgcagcactgatgtctgcgacatagtcatcgtcggctctggtcctgtcggcatcatcattacccacgccagaggtgtcatcccctatagaagaggtgctagccatggtggaggctctgcatcatttggaatagatgctcctactaggaagaagaggaagaagaagggctggcagaagaggattgatcagagcggggaagtcgagcttggatgtactggactgagctatctaggtatgggaggtaggagcgaggttgaagtacgaaagcatgctccatgtctgggccatggtagtgaggtctttccgcagaatcttccatggatccttgttggcgttcaacatgaatcaccctcctggggtgcacagcttggccgcaatggcctcatggtttgggtaagtatggagggcaacatcaatttgcttctcagcaagcctggtgagtcttctgtgccagtgtcacctctagagctcgccataaaattcattaatgttctagagatgaacgttatcttggtacggagcaatcctttctcaaaagcaaagcgggaggaatccgaagtggaatccccccttgtggttgactggctccagtacaacgcttacttgaggccatctgcaaaataa

SEQ ID NO: 84868 - DNA, 96 bp, Glycine max
  Peptide Sequence Number=SeqID_176553
atgtctgaagaagttgatatgaatgaagaaaatgaagacgaaactggggtgaatgaagaacatgttgattgttctgatgcgtttaatacttctgag

SEQ ID NO: 84869 - DNA, 366 bp, Glycine max
  Peptide Sequence Number=SeqID_176554
atgcatttctctgactaccttgcatcagtggttcagatttatgttgtgcttggacaatgtgcaccggactacatggactggttctacatgatttcgtatccattcataaggtcgacacaacccgaggatccccccaaacatccacttgtcatgcaagatgagacatacgtggaactagatatgcctgagtacccggtggtagcagcagctatggaggaagcacctgtacatgtaccttctgatgtggagcagcctagacatgcagtggaggcttgccaaacaattgtagaaaggttggagtggttactcaacctaaggatagtgaccaaaggcacagaaacatacatgtcatgcaagactatctaa

SEQ ID NO: 84870 - DNA, 624 bp, Glycine max
  Peptide Sequence Number=SeqID_176555
atggaagaaaagtattgggccccaaccatcttttatcttctcccttctttgctgtgttcgtctgtggctgccaccaccacagtcgccccaatagctgtcgcgtccatcgccgccaccaccaccgcaatcgttgtgagtggttttctttccttcctacgttatttgtgggggcaacgggaagctgccgttgttgctgaggatgctcttaacgtggatgatgcaactaaagaggtcttccaacatcctgaagaagttggtgttgatgcccagggttttccaggcaggtcacgtgacacatcagttctgactgtctatgttgatcatgttgcaatcattgtttggaatgaagaggaacgtcctgaattgaagttatcctcccatggaaggaaggttcagaaattcaggaggtctgttgctaagattgaagggttagtcgctgccacaggattaagtcctttgatcgcattaggagaggtcaccatcaccctcgacgatgtggcctctttgcttcatctgcccatcataggcacattccacagcttcgacactcttcatgtcgacaaagcggtgttgatgttagtggagttacttgaagttagtggagatgaagctagagctgagata

SEQ ID NO: 84871 - DNA, 462 bp, Glycine max
  Peptide Sequence Number=SeqID_176556
atggggaatactttcctgaaccttcaaccaatagtctctgtagccagattaagagacatcttaagagtgtcctctattgagacgacattaaggaaggtcatacctgatggtgaaaactatcttgtccgtgaaagaaataccaactgtgtgaatggtgaggtggtgcagaatgtttggttaaggcttcgaggagttaagtatggggaactagaattgaccatcaagtttcaggccgatggccgagaagtgtatttgggattgatatatctgtgctttctaggctcaagaatgctaggaagtactgcatttccatgtctcactagtgggtcatcatggcttagaactgaggactgcctagttattgcatacattataccggatcttctcaaaggaacctacttgggaaagatcttgcctaaacgaatacaaatgagcttgagaatcaactggaggcatcactga

SEQ ID NO: 84872 - DNA, 315 bp, Glycine max
  Peptide Sequence Number=SeqID_176557
atggttgcgctcatcgttggtaacgaagaagctgagagagaggtggcggtggtgatggagagaggggacgatggagtagactgtagtttggattttttccgaggaacctgtggcagaggcggtggtggtggaagagggaggagggaggtggcagtggaacctgtggcggaggcggtggtggtggaggagggaggtggcagtggtgatggagagagagggggcgatggagtagatttttggtttggagaggagggaggtggcggtggtgatggagggagaggggacgatggagtagactgtagtttggatttttag

SEQ ID NO: 84873 - DNA, 459 bp, Glycine max
  Peptide Sequence Number=SeqID_176558
atgggcttggagttcggtaactcaaaaagtgaggatgaagcgatggaaagagtgctagatggagaagatagaagaaacaatgaggtaaaaaaggaacagagcaaagacaatgatgatggaaacatggcaccaaaaagaagagaaaagccacaagtagaaagtagaaacaaagggaaagatggggcaaacttaatggacccacaaatagaaaaatggggagacaatattcggcctatcttggagcctagagacaagggagaaaatgaatcaaagcaatggtgggaaaaagaaagagacacaaggtggaaatcacttaacaacatatccttgtggcacggtagtaggagatgcaattatgagtacacaattaccattggaaaaataggggagggtgcccgagttcctcaactaggtctcaaagctatacgagtaatgggaaaacaagaaggaagcaactga

SEQ ID NO: 84874 - DNA, 135 bp, Glycine max
  Peptide Sequence Number=SeqID_176559
atggttcaacgagctccgccgcaggagcgcgttgaggatggcgttgtaggagaggacggtgggggagaagcaaaggcacttggcgaagtggggaacagtgaggataggtttttcgtgaagcacaaccgtggttga

SEQ ID NO: 84875 - DNA, 273 bp, Glycine max
  Peptide Sequence Number=SeqID_176560
atgcaacaacgaacaaacaaaccaagtcaaaaccagatgaaattgaaaagctttagacaacgagggagggagctcaaggattcttaccttcacagaggaaaaaaagggagaaggcagcagtgcgaggaagaagggagaaggcaacaacgtggcggtagacagcgacaacgtgagacgaggggcgtgaacaaaaaggggcttttttttcctatgtgccaaacgagacttcaagagagaagagaaacctggcaaatgcgagaaatgacactctga

SEQ ID NO: 84876 - DNA, 678 bp, Glycine max
  Peptide Sequence Number=SeqID_176561
atgtcacaaatcattgaagaaatggaggttacttgtgcgaagtggccaattttttctttggttgacaagtttcttttggggtttgcttttcctccattgctgggtttgactgttgttttgcagtttagttttgctgaggttgattgggagaagctaagggtttctgattataaagttatgccacgtgttgctgataaaataaaattgatagatggatcaagggaagctcttaagctttctgtaaggatcactgatctttggttcattgggattcccggaaagactgaacaagtcgaaatggtggttgttgattctgatggagatgaaatccatgttgtttgcaagcaggatcagctgaagtctcgcaaggctgatttgaaagagaattttacttatgtgatgcataattttaaagttatcaagaatgatgggaaattcaaagtttgtgatcatgaatataaattatgttttactggagttactgttgttaggcaatgtgatatggaacagttaccttttaggaaattcagatttgtttctttttccagtgtcattgctggtgattttaaaattggactcttggttgatgttattggcatggttgatgaagtggtattccgatatgtgtcatccaaaaatacgagggttgttttgaatttaaaggatttaagtggccag

SEQ ID NO: 84877 - DNA, 183 bp, Glycine max
  Peptide Sequence Number=SeqID_176562
atgacaaagcttactaatgcagctggaagcactgatgatgaagaggaagaagcaatcgataggagtagagcaaaaaggaaaatggctttatcttcaaagaaacttgagaagaatggccttgattctaaatcaaagaagacaagggtacttgttgaggtcatacccattattgttttcaactaa

SEQ ID NO: 84878 - DNA, 435 bp, Glycine max
  Peptide Sequence Number=SeqID_176563
atggcagaatcgtcaaagaagagaaaggggtcatcctcctccgccgctgctgctggccatcgccgccacagaccatccgaagcacccacaacacctatccatccttccttgtcatctccaagatcatccactctgttttcttccgatgatcaacgtctacgtcaaggtgcaccttttgagggcaccattgttgatgactggaaatttgattattctagtcatgatgctcaccgtatggtttgcaatgaccaggctgaaatgaccagtagattgttggccggatcattaacttttgataatcgcatcatgcactacattattgttagaattttgcttcctcggtcttcaaatttggctcaagcctctgaggaggatttgattttgatgtgggctttccttaccggttgtcagatcggctgggctcacttggtttag

SEQ ID NO: 84879 - DNA, 759 bp, Glycine max
  Peptide Sequence Number=SeqID_176564
atgacagtcaggctcagggataacagtaactgtgacattctaataactgtttgggaggactatgctattcagctacatgatgctattgacaaaaaccttctgcttcaggaaccattagttgttatgttgaccttaggtaaaatcaaggatgctacagacaagtatcccctaagcgtgcagaatatcaaatttggatctaaattgtatgtcaacgctaatattacaaagatacacgaatttcgtcaaagccagagtaatatggtggaaaaatttctgcagaatgctcaagtggtcagtataggtgaaatcaacaatctcagacaggattgttactgcttaactgttggaacagttgacgaaatcattattgatgctccatggagttatgacagttgtcctaactgtacaaccacatttgatccatcaaaaggtggctcagctttccgttcttgccataccagtgtgatcgatacagttccacggatggagcataatggggacaaaggaaacttccttctctgggatgcaacatgtatcaagctgtttggtaagactgctggagaatgtcgagatgagttgatagcggatggggatgatattaaggtatttccaacgtgtgttgatgaaatcctatcgaaaacttgggctgtcagatttaagttccgttcacaattacgccaatcatctgtattggatatgagtgaagaactccatcatattcaatcattgataccaccctgggttgaaggtaataactaa

SEQ ID NO: 84880 - DNA, 1386 bp, Glycine max
  Peptide Sequence Number=SeqID_176565
atggaatcacgtcctttgcacatagcaatgtatccatggttagccatgggtcaccaaaccgcattcctccacctatgcaacaagttagcgataaggggccacaaaatctccttcatcaccccaccaaaagcacaagccaagttagaagcattcaacctgcacccaaattcaatcacctttgtcaccatcacggttccacacgttgaaggccttcccccagatgcacaaaccaccgcagatgtcacttaccctttgcagccgcagatcatgacagccatggatctgactaaagatgacatagaaacccttctcagtggcctcaaacctgatcttgtcttctacgacttcacacattggatgccagcattggcaaagagtttaggcatcaaggctgtgcattattgcactgctagttctgtgatggttggttacactctcccaccggctagatatcaccaaggaacaaacctaatagaaagtgacctcatggaacccccagaagggtaccctgactcatcaatcaagctccatgctcatgaggctcgtgcctttgctgcgaaaagaaaggacacgtttgggagcaatgttcttttctacgatcgccaattcattgcattgaatgaagccgatgtgttggcatacagaacatgcagagaaatcgaagggccatatcttgattacattgaaaagcagttcaacaagcctgtgctagcaaccgggccagttattctagacccaccaacttcagatttggaggagaaattttccacatggcttggagggtttgagcctggctcagtggtctattgttgctttggaagtgagtgcactttggggccaaaccagttccaagagctggtgcttggtcttgagctaactggcatgccattcttggcagcagtgaaggccccattagggtttgagacagtggaatcagcaatgcctgaggggtttgaagaaagggtgaaagggagagggtttgtgtatggtgggtgggttctgcagcagttgattctggcacacccttctgtggggtgcttcatcacacactgtgggtcagggtccttgtctgaggcattggtgaacaagtgtcagttggtgctgttgcctaatgttggtgaccagatccttaatgcaaggatgatggggaacaacttggaggttggtgtggaagtggagaagggtgatgaggatggaatgtacaccagagagagtgtgtgcaaagctgtgagcattgtgatggatggtgagaatgaaaccagcaaaagggtgaggggtaatcatgctaggatcagagagttgctgcttaacaaagatttggagtcctcttatgttgacagtttctgtatgaggcttcaagagattgttgagggaatagacttgtag

SEQ ID NO: 84881 - DNA, 354 bp, Glycine max
  Peptide Sequence Number=SeqID_176566
atggatgccatatccaaacagtttgaagagcttgatgtatgtggaaaagtgactctaaagagtaaacttcagaaaattgtctaccatgatcaaaattctatgtgtgctcttcctgaaaaggtcaaaacaaaaggtgctcaaaagaaacagatgatcaaacaacaaagatcaatgaagcctgattcatcttactgggattatgtggatgcattacattatgtgcaaaataacaattctttaatgaaatgttgtgcatcatcatctgaacaaccaaaaccaaagaggaatatgccaatgttggatcaatttcattcatgcattcatgatttcattgaaaacattgtcgatgtctaa

SEQ ID NO: 84882 - DNA, 537 bp, Glycine max
  Peptide Sequence Number=SeqID_176567
atgcatccggcatgtgcagcatgcaagcatcaaaggaagaaatgcagtgaaaactgtatattggaaccttactttccatcgaatagaagtcgtgagttctatgctgtgcacaaggtttttggtgttagcaacataaccaagttggtaaagaatgctaaagaggaagatagaagaaaagttgtggactcattgatatgggaagcatgttgtaggcaaagggaccctatacaaggtccttatggagagtacacaaaagtttacaatgagtataagaaagtgttggatgaaattaagagattcagaagccaaaaccaacttttgcaaattccctctctagggtttaagtctgtacaagatttgattgcttgcaatggaaccaaaggggaacacaaagcgtcagttaataatgcatcaaattatcttcatgggaaaaagaatgagtttcagaatataaggccagaagttgtcataccgtttcagcaacactctcaaccatactacattacagttttactaaaaggtatgtttggaggttaa

SEQ ID NO: 84883 - DNA, 651 bp, Glycine max
  Peptide Sequence Number=SeqID_176568
atggatgttgttacaacttacttgttcgactatcttgatattgacatttgcatgaaactctctgaaggatataatttgtccaataatgcatattctcgaaaagaatactctctatggactaaagcaatcatgtcgcatgtggcttctaattttaataacctcatcgctggattcgttgttaaaaatgaggaattgaacgaaacctacaagtatagtgagtgtatgagaaatagttatgaagttgctcaaggggtctgtcctgattccatttatgaaggccttgatgggccttctgattctattaactcttactatcttcctcataatcatggggttctgaattatgatcatttggttttgaaggtattggagcatgtgaatgaatgtacaggtcccttggatgatgaagacaaagaagatcaaggtctgcagatgcaaatgttccatgggaatcaagaacaattcaagactcaagaggaaaagttgaagaacacttcaagattcaagaagaaggatgaattcaagaatcaagattcaaggatcaagcttcaagaatcaagatcaagattcaagattcaagactcaagaatcaagagaagacataatcaagaagatcaagattcaagactcaagaataaagagaagacttaa

SEQ ID NO: 84884 - DNA, 438 bp, Glycine max
  Peptide Sequence Number=SeqID_176569
atggcggaaccatcgaagaagcggaaaggcacttcgagtcgaagtcaacgacacttcaaggcacatgaaaccccaattccttccaccattccctctggatcattgttctcatcagaggaacaacgactaagatggtcattgactagtccctattctgatttaacccaattgccaagcgaaggtgtaccatttgaaggtgcattgattgacgattggaagtttgatttctctgtacatgatgcccgccgattggtttgtaccaatcaaacggatatgaccggaaggcttcttgccggttcattggcttttgaaagccgcatcctccattatcttattgttcgcatcttgcttcctagatcttcaaaccttgcccaggtttcttcttcttcttctttgtgccaaaagctttccaaagttttctggttttctaaaccttga

SEQ ID NO: 84885 - DNA, 237 bp, Glycine max
  Peptide Sequence Number=SeqID_176570
ggttatcatggcatggatggcaattttgagggtttaagctatgatgaacctgaagaggatgcagatgcagaactaatgagaagatcaaatgaggctgaggagagggttattcttctctcaaagaaactggaacgagatagcttttttcttgatggtggttatgatgtgatgaggacatggcaaggactaagggaaggaacctttaaaaggacttggaggacttatgacaagggctag

SEQ ID NO: 84886 - DNA, 192 bp, Glycine max
  Peptide Sequence Number=SeqID_176571
atgaagcttaaggaatgtttggataaccatgttactaggcttgtggtgttgttgctgtatatggctaaaatcaaagaacctagagcaacatcaaggagattgtgttcaatgtatggttcccagatttttgtgaatagtgacatcaaggagattgtggacttcaaggatcggttatctacttcatgcgaatga

SEQ ID NO: 84887 - DNA, 189 bp, Glycine max
  Peptide Sequence Number=SeqID_176572
atggcgctcactggcaaacaactactttttttaattgaaagagctggtggtgaaggaagacaacttgaaaatgttagtaactatcatgatggatatgtggaggacccgagatctcaaggttttggtggaagcagaaatcatgcagaccagggtgctgttgctgattctcatgaatcaacatgtagttaa

SEQ ID NO: 84888 - DNA, 858 bp, Glycine max
  Peptide Sequence Number=SeqID_176573
atgaggaccggtgtaggagatattgttcaagtagaaggagggcacattgttaggtccacaggtagaaaagatcgccacagcaaggtctacacttcgaaagggccacgcgatcgccgcgttagactctcagcacacacagccattgagttctatgatgttcaagacaggcttggctatgacaggccaagcaaggctgtggactggctcatcaagaaggcaaagacttccattgacaggcttgctgagcttcctccatggcatccacctactcatgaggaagaaaagcagaatgatgctgcaggatcaagtggaatcatagccattgcgcaacaacaacaacaacatgaacagcaatcagagtcttgtgaagatcttggcctatccctccattgcttccaagaccaccctggcctcattcattggcaatcacaacagacaggtgcacatcaaacacctccttcaaatgaacaccaaatccgaaccctttttgctggctcaaccccaggtggctttgagaaccattatcaaagaagtgtgacttggaacaatgaagcaactaccactgatcatgtgaacaggttggggttcatactcaactcacagccatttataggccaaggttctacttcagcttatgctcaaagtggggggacccttcagtccagtttttcatttccaatgacttctccctctgagcttcacaggccccagccagtgaaccaaccttccatctttgacagcaggtttgtgtctgatggattagctgatttctgcattccagatagaattcaaggtgtggaagagaaccatggagttgcttccaataggccatcttcttcccctagttctatccactga

SEQ ID NO: 84889 - DNA, 573 bp, Glycine max
  Peptide Sequence Number=SeqID_176574
atgccaatgatagtgataatgacaaagtgtggtagtggtgttggtgatagggataaaggcattgatgacaatggtggtggtagtgtgacgatggtgggtggtgatgatagtgatgttgtgattagacatggcaatgaggtcgggatgggtatgggtattgtctccccaattccttatcccgactctccaacatatcctcgtactcatacccgatacccgacgggtttaagtttattgtctcatcccggtacccgttgggatggattcgggcgaatacccacgagtacgggttttcttatcatgtctagcggtgatgatgacaaatatagtatcgttaatagtaatggtgttggtgacgatgacggtgacaacgacattgatgaaaatggtggtgatgggaatatccgggacaacggtggtgacaaaatgatggtgatagtgatattggtggtgttagatttgtacgaggctgctaattggggtcactctagtgtaagtacctttcctaacttagatcttgaagacaagagttctttcaaggggaaggatatgatactcagatattgggtgtga

SEQ ID NO: 84890 - DNA, 957 bp, Glycine max
  Peptide Sequence Number=SeqID_176575
atggcagcgtttggtattcaaatcatgctattgctggcagctttcttgcttccactatctgtggaagctatggtggtgcaaaagaataccacaagattgggttcaaccaagcccattgttaccataaatggaaagttcccaggtcccaccatctatgcaagggaagatgacactgttctggttaaggtagtcaaccaggtcaagtacaatgtcagcatccattggcatggggtgagacaattgagaacaggttgggctgatgggccagcatacataacccagtgtccaattctaccgagccaggcctatgtctacaactttactcttacaggccagagaggcacactttggtggcatgcacatatcctctggcttagggccactgtccatggtgccttggtcatcttgcccaagcttggagttccttacccttttcccaaaccaaatatggaacaagttatcatattgagtgaatggtggaaatcagatactgaggctgtaataaatgaagctttgaaatctggtttggctccaaatgcctctgatgctcacacaatcaacggccatccaggacctatccaaggctatgcttcacaaggaggatataagttggatgttcaaccaggaaagacctacttgctaagaatcatcaatgctgcactcaatgaagagctcttctttaaaattgctgggcatgaactcactgttgttgaggttgatgcagtttacacaaaacctttgaaaactgataccattgtcatagcacctggccaaaccacaaatgtgcttctaacaaccaaacatgcaactggcaaatacttggttgcagcctctcctttcatggatgctcctattgcagttgacaacaagactgccactgccactttacactatctaggcacccttggttccaccatcaccaccctcacttccatgcctcctaaaaatgcaacacca

SEQ ID NO: 84891 - DNA, 295 bp, Glycine max
  Peptide Sequence Number=SeqID_176576
ctctgttggtgttgcccgcgtaggtgttcctctccacgtcgtaactccgagtgttgtgcctccacatcggtgttcctctccacatcacgactcttctttctcactcccactcgcagctagtcttgttgccactatcattgttggtgttgagcttgccccagaatatatcaacggaggtagggctagcaaggaatcaaacatttatagttttggggttgtggctcttgaaattgcatgtgggaaaaggatttatcaagacagggagtttaatgtacctctcgtgaattgggtgtga

SEQ ID NO: 84892 - DNA, 309 bp, Glycine max
  Peptide Sequence Number=SeqID_176577
atggaggcagagaagttatggaggaggctggagaaactctctttagaggaaatggataaggatggtttcacatttgatgtggaggatgacgacactttaacgacaattatcgtctttgtcttatgtcagggtgccattgaagaaaggaaagaaggtcaggaagccaggagtagattggagaggaggtcacaagtcaaaaggaggggggcacaaatgagagcctgcaaggagagaagaaaaggaaatgtgatgggccaattgctagtattgatgctacggatttgggtcaaacagacgaagcctgaataa

SEQ ID NO: 84893 - DNA, 1370 bp, Glycine max
  Peptide Sequence Number=SeqID_176578
atgtctactatttctgattctacgttgggcataggaggaagtgactctgggggttccattcagcaacccatggtagagcgggaagtggttctcataggagattctttgtcggaggagaggttgatgaacttcaaaaatgtgggtgagggtagcttcgagccacgcgctgggataaaatctcccctggcttctatggaggatcaatcttcccttgttacgacaatcatgtgcctgcccccttgggagaatccagtgactgacgaggctgtaggaaaagatgattgtggtgaagttagggtttctagttctcctcacggcaaagtgaaaggtggtggggcgagaaagggcaatgatggaggccttgaagagacgtcgaggagttggcatcgtcgtggtggtgatatgccttccccttttccatgtgttaccggttttgaagaagatgagtaccccattatgtgtcctgcccctgatggtacctactatttttatgtttaccaatgtatgtttgaagtgttgcatttgactcttcctttaaatgacttccaatgcgctttactaagtttttacaagaagatgtttgagtttgactcgaacgcatttcgtagattcaaggatcacttttttaaggtcaacgtaactagtttcatttctaatgggttgccattaatgtatgaggagagtggggagcctcattttcccttttactggcaatcaaaccctacaaagtttaagtcttttgaagagcacctaatgtctttagaggaaagggttggacttgttgatggtgacgtgccccctcccctagtcagtgtcaatgaaccctctaaagggggaggagattcgattgaggctaggttgacccatccaggactgctaatgctgtcgaggttacacttggtgtgccttttcctacaactaccaagaggaaacgcagtaaagcggttggagcaaccagactatgcaagaagtcaaaggcttcctttattctttgagcccttagcaagccacaggactattgctgctatagctaacgtctctaatcctattgctcctccacctttatccacccaagtggtttctgtatctcttccatctgcaccagccatttttgctccttcctctgtcatgttttctcctgtttcttttgttgcaccatcgctacttagtgcagggctaacaatgataggtgttgttacaagcatgcctcatcttccctctgttgtgccacctttagctcccattgtcctaaattcagagatgccttcttcctcttctcagaatggaagcaagcataaagaggctatgaacagaattgcttccttggaggaggaagttgccaagtggagggtcactgcgaggatagtatg

SEQ ID NO: 84894 - DNA, 132 bp, Glycine max
  Peptide Sequence Number=SeqID_176579
atggtgttgaggagctggaatagtcctctaaggcgttgttcttcctactggttgcctcaatttccgattttagtggaacaaagttcacctcagaaggcttacctcgtatacaagaaggaaaaatcaacttaa

SEQ ID NO: 84895 - DNA, 354 bp, Glycine max
  Peptide Sequence Number=SeqID_176580
atggtggtaagcccacaatatgctggggagttcttccttccacaagcctttggatttgtcaagtttaatgtgcaaggctttaagggtgaccttgttcactacttcagcttggccgtttgtctgagaatgctcgatagaggtttaggctttgaattgaatgtctttgttagttacaatgggacagtggagtccatacctgcatatgagtctatggcaactagcaagaacttgacttgtcctggagcttttggaaatggccctagcatgtccatcccctacatggcaaaaggccaaggagagctcatgttgtggaggttgtcagggggtacacgtgggacatctgggaactcctaa

SEQ ID NO: 84896 - DNA, 594 bp, Glycine max
  Peptide Sequence Number=SeqID_176581
atggaggactatccaattagtcccgaaagcgtcatctccaccccatcaaagatctcgatgtcaactgtcgatgtcaagccgctgagaagtcttccttctataaccttaattgatagagatttaaaaggcatcaaccccatcaaccaggacgaccatatggttgtctctatcgtcattgccaacttcatggtggccaaagtccttattgaccaagaaagttccacaaacatactctattggaagatatttcaaagattttgctggagaaagagtggaaacaagaggttatgtgaatatgatgacccacttcagttagggcaagctctcgaggagtttcatagtaaggtggcactttatcctcctgtaagagagccgagcaaacctcattccctctttggtggcagcaacaatcaagtcatgagcattgtcgaagaattcctaataaggaccttgaccgtctatgagacaaccatgggaaatcccaatgacacattcaatgttgaccctcgagatgacaccattgacaaaggccttaaaccaatagaagagtttgtcaagctacaacttggacctaagcctgagcaatacatttag

SEQ ID NO: 84897 - DNA, 387 bp, Glycine max
  Peptide Sequence Number=SeqID_176582
atgaaaaccgggagggagcggggctcgaaagcgagggaggcggggcaaaactggaaggtgcagtactcgtgcatgtggatgtgggagtggtggtggtcgaaaaggggagacgaggaggaggaagatgcaaggaggaaaaaaaagggtttggtggaaattaagggtggaggagggagtggagagccaattgaggagaggggaggaggtggggagagaggaggggaggatagtgttgatggagtcgtggaaggaaggggaggtgaggaagctaatgacggtggcgaggagggtggcagaggaggaggaggaggaggaggtgatgtggcaaatgacgcgacattgagcagtcctggtcaaccttccaccctagtcagcactggaccttga

SEQ ID NO: 84898 - DNA, 192 bp, Glycine max
  Peptide Sequence Number=SeqID_176583
atgtggcggagctttccatttttcattcctatgacgaggtgtattataaattgtggcaggttgaggggtgggggtcacaacccactctttgaggatttacctagtgagtctggtagtggggccgccactgtgagatatgggctaatctccaatgacactcacgaaacaagatgcaagtgcaaggccgtgtaa

SEQ ID NO: 84899 - DNA, 453 bp, Glycine max
  Peptide Sequence Number=SeqID_176584
atgacatctgaggcggcacgccaaattattaataggactgattccctagaagaggagtccgcacaaggtagctttgtagctcatagacgtcaggatgtattgactactgccattaggcgaccagagcaccctggatgtcaggttctaaggagaggtgcatttcttcttcggattcaggataaggggcacacatctaagctgaaacttgagtgcgagatcttcaatcttctttgcgaactcttcgtcagagaaaggctccaacctagcactgcaagcccttctccaactccacctgcacatgaggataatgaagaagaagctatagtgggaagagattgcagaagtaaggatttgagaagaagaaggggaatgaggaagaacgtgttatggaccattgcaacaagttctctggggagattctggcgagcctcgggtttgagcggcgctacctag

SEQ ID NO: 84900 - DNA, 492 bp, Glycine max
  Peptide Sequence Number=SeqID_176585
atgatgaattctgaagagcatactagtacatacacatttctttcaaagacaactcaagatttccctacatgtgagcaatcaaataaagagcgtgaattacatattagagatccaataatagcacatactaaaggaagacaaaatggttctatcaaattgtctcaacctaaaagaattaaaagtagtctagagttgtcaatgagtcaattaccagctaaaaaaaaagagcacgccaacaatgtgaagaacatggtcacaatcgaggaagttgcaagccaaaagtacttgatgaagaagctaattaagctagttgaattgaaagtaagagattttacatgttttgaaccacttaaactgcttgcaccatttgatgcaatcctccctaggaagggaccaatcactagaaccatgagcatgaggctccaagaagattgggctagagttgctgaagaaggccctagggttctcatgaaccttagggtagatttctga

SEQ ID NO: 84901 - DNA, 2697 bp, Glycine max
  Peptide Sequence Number=SeqID_176586
atggcttcggagcctatggttggaggagatgacgaagccagagagaaacagagattcggggagagaaaggtttacacgaggaggaaagtaaagaaagaccctaacgccgttgcttccaccactgaaaataacggcaccgccacttccaccgttaccaatgacaacagtgtcagtaatagcaccgttcagaagagcaacactggtgaggccgctgaggccaagagcaaaggtgataatgtttcgacacaggctctggcacagcctgttgtactgccggaggatggaaatttggctcagcctcaagtggtttcgggattagaggatgggaatttggggcagccacaactggaggatcagaatatggttcagactgaagtgggttcaggattagaggatgggaataaggctcagccgcgaggggaggatcagaatatggcacagacgcaagagggatcaagattggagaatgagaatagggctcagccgcaaggggaggatcagaatttggcacagacgcaagtgaattcaagattggaggatggggatacggctcaactacaattggaggatcagaatatggttcaatctcagtcagaggatcagaatatggttcaacctcaatcagaggatcagaatatggttcatcctcaatctgaggatcagaatatggctcaacctcaatctgaggatcagaatacggctcagccacgattgggggatcagaatacggctcagctgcaaggaaattcaaaattggaagatgagaatatggctcagccgcaagtgagttcaagatcagaggacgcgaatacagctcagccgcaagtgagttcaaaattggggggtagaaagtcccctcagccagaagtgaattcgagattggaggatggcaatttgcctcggccacgggtgaattcaagtttggatgggaatacagttcagccactggtagtgctggtttctgatgactcgtgcagccggcagccagatgaaccttctaacctcaatgttcagctgcaggatgatgggccttctagccccatccatcagcaggaggcagttcctagctcccgagaccttactttgggaaatggggttgtggagccgcagtggagggaccgaatcaagataaacttggcctcaaaatcaaagcagcagatgcgggagcttcggtggaagcttgaaagggaacttggtattgtgagatgtttggttaataggattgaagtgaagcagaggccagttggtggatatggcaactcaaatgtgctaatcgacagtgggattaataatgttggtggagccaagcgtgctcactcagaggtggcatctgctggtgttccacgggaacctgccagtaccaggcctttgcatcagttaagtttgtcaatgttggagaatagtcaagggatctgtgaaactgttgagaaggagaagagaacacctaaagcaaaccaattttatcgtaactcagagttcttgcttgcgaaagacaaatttccacccgcagagagtaacaagaagtcgaaattgaattggaagaagcaaggtgggggagaaatgggacatggttttgggatgggatctaagtttttcaaaagctgtagttcactgcttgaaaaattgatgaaacacaagcatggttgggtgtttaatgctcctgttgatgttgaggctcttggtttgcatgattattttactattatcactcatccaatggacttgggaactgtgaagtctaggctgaacaagaattggtacaaatcaccaaaggaatttgcagaggatgtgagactcacttttcgtaatgccatgacatataatcctccgggacaagatgttcatataatggccgagcagttatcaaagatatttgaggacagatgggctataattgagtcggattacaatcgggagatgagatatggctttgattatggggctgttgcccctgcactatcacctttgtctagaagggtttctgcatttacaccaccacctcttgatatgagaaggattttgaatagatcagaatcaatgacacagactccaagactcatgagcattactccatcaagtagaaccccagctccaaaaaagccaaaggcaaaagatcctcataaaagagacatgacatttgaggaaaagcaaaaactaagcactaaccttcagagcttgccttcagagaagcttgatgctattgtacaaatcattaagaagagaaattcagcacttaatcaacatgacgatgaaattgaagtggacattgatagtgtggatgctgagactctctgggagcttgatagatttgttaccaactataagaaaagtttgagcaaaaacaaaaggaaggctgaacttgctcaagctagagcagaagctttgcagcagaatgccatccagaagagtcaggcaccagctatggcagagattccaaaagaaacactaacaggtgaacttctaagaatcaggatgaaaggaatcttccccaacccttgcctgcgcaaaggggaaatcaagcagataatgggagtaggtcaagcagttcaagcagctccagcagtgattctggatcttcttcaagtgattctgatagtgacagttcctcagcatctggatctgaggcagggtcgcaagggacctgaatgtgctccgtcagcacttctccctttccattctgaagaggaatgtttgtag

SEQ ID NO: 84902 - DNA, 581 bp, Glycine max
  Peptide Sequence Number=SeqID_176587
atggctcaacctccatctcgtgagaggactcttagggagatggctacacctgatttcacttatgaaagcttgtgcattcaatatcctgataaggttagtgtcatgcctctgtccattttcaattctttatcccttggacctttgcaatctacagatgtggtgattcatttggcagatagaagtgttgcttaccccgcaggtttcatagaggatgtgctggttcgggttgcccgaaccaagatagatgtttatgctagcacattgtctatagaatttggtgatattgttgttcattttaacattcttgatgccatgaaacatccatctgaggatcattctatttttcgtgctgagataattgatcagattgttgatgattatatgtttgattttgattctgttcttcatggtaggaaacatccatttttatctgatttgcatacttgccattccttatgcattgaatctgaatctgagtttgaatttgatcctgtatttgatttttatgctgagaatgaatctgaatttgagtctggttctgattttctgggtgttgtacctcttgatgttgattttttaga

SEQ ID NO: 84903 - DNA, 492 bp, Glycine max
  Peptide Sequence Number=SeqID_176588
atgcctcggaagatcaaggttcttattgatgcaatcctccctaggaagggaccaatcactagaaccatgagcaagaggctccaagaagattgggctagagctgctgaagaaggccctagggttctcatgaaccttaggatttcagagctccttttgagcacaaaatttcgtgctcttctctccctctcccttcattcatctccttcttcctccaagctcttatccatggcctcctatggtgaagcaaaggaatccattgatgaagaagatcctaggcctacaagctccaatggagcttgcatcacttattctggagttgtagctgcttccaagttctgcaaaaattttctgattcactctgcgttacacctcctacaagtggcgttaatctccaaatcaatggggatcaaatcacctacagtagatcttctttgcatacaagaaagtagagcagcaattatccagttcaaaagaacaatgaatgcacagtaa

SEQ ID NO: 84904 - DNA, 97 bp, Glycine max
  Peptide Sequence Number=SeqID_176589
atggagaatggacaagcaccgggtctgtttgcaaagtttcttcacgaacatgggatagttgcccagtacactatgcctggttctccggatcagaatg

SEQ ID NO: 84905 - DNA, 1668 bp, Glycine max
  Peptide Sequence Number=SeqID_176590
atggcttctgagcaaatgcatcgcagagggaacagcaatagggtgatagagagagaggttcacgttgagacacacagaaaggagtccattgctgatccattgctgataaggggagggtctgggaatatagttaaagacaaagaggttgaagaaagaagaagagggagagaaagtggtggtggtgttcagcatgtgaggaagtttgaaacaaaaggtgaagagaagaagcgtttaggggaagaggctgaactcgagggaataacaagagtggtggtggaaagagagtgcaacaaagaggagaaacaaagaagcatgccaagagggaatgtagaggcacagaaagcaagatcaatggagagaactagagaggaagctaaaggaagagaacaaactgaaaccaaaggccaaatcatgaagggtggtggtgaggaacaaggaagaagaagagaagaaaataaacaatccaacctagaagagatctctaagtacagtgaagctcaacagaaaacaatgaaagcaattgaaggtgctaaggagagatacgagagagcacaacaagaagcaagtgaagcatccaaagagagaaatggtcaggcaaatgagggggctgaagaaggcagaagagaaagtggtggtgatgttcatggtgtggctaagtttgaaacaaaaggtgaagagaagaaggattcggtgggaaaagcagaactcgagggaagaacaagagtggtggtgagaagagactggaacaaagaggagaaacaaagatgcaaaccaagatgggaagtagaagtagagaaagcaagaccaatggaaaaaactgaagaggaagctagaacagaacaagctggaaccaaaggtcaaatcaagaagatgactggatcagtctggctacaagaccttgaaaaaggaataagccctgatacttcttttttagttagagctttcaattttttgtgcagagctgaagctcaagagaaggttaaggagagaaatgagagagcaaaaaaagcagcaaatgaagttgccaaagagagaaacaagcagacaacaaagggaaaagatgtcacaagagagaagggtcaacaaggcaaacttaaaacagaaaatgggacacaagacaatgcagcaaatgaagttgccaaagagagaaacaagcagacaacaaagggaaaagatgacaccattcgtagtgtggaccacattactacaccacttgctggaaagaccaaagttactgctagcaccactgctcagtatgttgaagagaaatcagcacaagccaaaaatgctacagtaggatcaatggagaaaactacagaggatgctaaaggaagagaaaaagctggaaccaaaggtcaaatcaagaagggttgtgatgaggaacaaggaagaacaagagaaaaaacaggagaagaaaacaaacaatccaacctagaagagatttctaagcacaaagctgaagctcaacaaaaagcaatgaatgcaattgaaggtgctaaggagagatacgagagagcaaaaacaaaaacaacaagtaaagcttccaaagagagaaacgtgaaggcaaatgagggggctgaaggaggaagaagagaagcagaaagtggtgggggtgttcatcatgtggctaagtttgaagagaagaaaacttcagtggggaaagcataa

SEQ ID NO: 84906 - DNA, 1062 bp, Glycine max
  Peptide Sequence Number=SeqID_176591
atgggtttgccattagtacatgctctgttcttgactctgtttctgctctgcctccaaacaaaagcagaggattttggtgcaaccaggaagctcgcaggaacatgcaatttgttcagtggaaaatgggtctatgatgcttcaaatcctctctatgacccttctacttgccccttcatagatccacagttcaattgccaaaagcatggtcgctcagataaactgtaccaaaaatataggtggatgccattttcttgtcccttgccaaggttcaatggattgaactttttgcagagatatagtgggaagaagattatgtttgtcggcgactccttgagcttgaaccagttcaattcattggcatgtatgcttcatgcttgggtgccaaaatctaggagcactttcagccagagggatgctctctccaaagtggcatttgaggactatgggcttgagttgtatttgtaccgcacagcatatttagtggaccttgatcgtgagaaagttggaagagttttgaagcttgactctatcaagaacggtgactcttggatggggatggacgtgttggtcttcaacacgtggcactggtggacccacaccggaagttctcaaccgtgggactatgttcaggtgaataataagttgttcaaagacatgaaccgttttcttgcgtactataaagggctaacaacttgggctaagtgggttcagagaaacgtcaatccagcaaaaaccaaggtcttcttcttaggaatttctcctgtgcattaccaggggaaagattggaatcgaccaacaaagtcatgtatgggcgagacacaaccattctttggactgaagtaccctgcagggacaccaatggcttggagggtggtgagcaaggtgttgaacaagataactaagccagtgtatttcttggatgtgaccacactctcacagtacagaaaagatgcacaccctgaagggtatagtggtgttatggcagtagattgcagccactggtgtcttccagggcttcctgacacttggaatgagcttttgagtgcagttctttctggttga

SEQ ID NO: 84907 - DNA, 228 bp, Glycine max
  Peptide Sequence Number=SeqID_176592
atggcttcatgcgctagctattttgtaggcttaacgggaattcaaagtgtggtaaatgattctgccaagcagaagcatattgatatagtcaaagctataaggcgaggtgcctcgctaggatgcttcaccggcacttgggggtttgttgggacaaaatctttggtaaagagcgccacgattgatggtggtagtgaagatggactcaaggagaaagccagactgaactag

SEQ ID NO: 84908 - DNA, 321 bp, Glycine max
  Peptide Sequence Number=SeqID_176593
atgaggtctttcagcaaactcatttatgaaaggatacaggaagaatttgaggctagactatctcaagctaggtctgatgttgcatcaagtgttggtgaatcccaactcactcccttagaccctactgaagaacaaagacttaggagtcggaattgggttgcagctgcaggaccaaagcataagggacgcctttatggtactggagaccttgctcatacttacaaatgcataaatgacagctttatgcagcatacgcaaggatcttccagtcgcattgaagatgttgcagagattaaccgcttgagggaggagttgcgttaa

SEQ ID NO: 84909 - DNA, 237 bp, Glycine max
  Peptide Sequence Number=SeqID_176594
atgggaggcctattaattgaattgccttcggggaacagtaaaggatacatctacttgggttgttatactgagaacaagatagggcacatctcttgtggatcagttcaagtggagggtacatccacttggttgttcaaagagaacaagggaggatacatcccttgtggatctttggcttgtaaaggattctacaaggttgaaagaaatctccagaaccgttggttgcttgtggactag

SEQ ID NO: 84910 - DNA, 363 bp, Glycine max
  Peptide Sequence Number=SeqID_176595
atgttgttgtatcttcacactgtcaccgagaccaagcttgtcatcgacacttccagagccaaaacgatgtgtattaattttgatgttaggtttaatgcgcttctgtgttccatactcaaccttgatgccatggacatgaacgaagaacaacatctagatgttgcttggggactggatgtaggcatgggtcgttgtcgaaccaatcatgatgaagaccaagccaacttatgtctcatgacaaaatcctatgagtacaacgaggaaaaatctgtaaggaagaagtggtacatcgacagtggatgttccaagcatatgacgggagatgtgtccaaatttacaaccatttctcccaagaaaaattga

SEQ ID NO: 84911 - DNA, 525 bp, Glycine max
  Peptide Sequence Number=SeqID_176596
atgtttgatcaacaggaagctgtgtctccagcaaaacctccagaaagcccggatgaagaggtcgaggatcccctgtacctgatgacattgaccatcccacaactgtttttgaagcctctccaggttatgtgggatgctaccatattcggggtgtttaatcaaaacttcccgttatatataaagcacgaagatctctctgaaattgcacacggtgatcaatgtctcagcatatctgttatacagttgtggattctcggacactggcaaatggtcgtcattctgcctaaggaaaacctagttgtctggttttgttctttacataataggccagacaactaccttaagggaataattaacagtgctttgaaaggacttgatgatactccacaacctaaatccaaggctgttgttaggtggattgttgttaagtattttaatgaagttagaccattggaagcagagagattcaaggcgctttgcatccagtgggcacagtattatctaaaagttagaaatcaaacatag

SEQ ID NO: 84912 - DNA, 957 bp, Glycine max
  misc_feature (105)..(105): n is a, c, g, or t
  Peptide Sequence Number=SeqID_176597
atgaggcccttcgggttgcttatgttgatgagaaaaccactggaagggatgagaaggagtattactctgttcttgttaagtatgaccaacagttgcagaaggagngtggaaatttaccgcgtaaagttgcctgggcccttgaagcttggggaaggaaagccggaaaatcaaaatcatgccattatcttcactcgcggtgatgcagttcagactattgatatgaatcaggacaactactttgaggaggcacttaaaatgcgaaatctcttggaagaatacaggagttactatggtatccggaaacccactattttgggagttagggaacacatttttactggttctgtttcctctcttgcttggttcatgtcagctcaggaaacaagttttgtcaccttaggacagagggttttggcaaatcctttgaaggttagaatgcattatggtcacccagacgtgtttgacaggttttggttcttgactcgaggtggtatcagtaaagcttccagagttatcaatataagtgaggacatctttgctggatttaattgtactcttcgtggaggtaatgtcactcaccatgaatacattcaggttggaaagggaagggatgttgggttgaatcaagtatcaatgttcgaagcaaaggttgccagtggaaatggggagcaagtcctaagtagagatgtgtacagattgggtcacaggctggattttttccggatgctctcattcttctacactactgtggggttcttcttcaacactatggtggtggttctgactgtgtatgcatttttatggggtcggctatatcttgctcttagtggtgttgagaagtcaatggaaagtaacagcaatgacaataaagcacttggtaccatcttgaatcaacagttcatcatccaacttgggcttttcactgccctttccaatgattgtagagaattcccttga

SEQ ID NO: 84913 - DNA, 1142 bp, Glycine max
  Peptide Sequence Number=SeqID_176598
gttccataagagtgtcatcctcatctgccaccaacaagaacaagctagaagcacacttatggccacatggtatggatggagacagtggtttggagggggtggagagtagaggtgcgggagagatggttgggggtggtcgtgggcctagtggtcctagagctagagagactgccttaatcaacgataatggttacaaggcttgtacctcgcagcagatctccgggctgagtccagagatgaagcagctaagcagaaatggcgccggaagtccgagaatccgatttgcaagggattcaaactcatataagtactcattaacagaagcacattgcaagcaaaccgagtttcaagggcatggagaaaggcagactaggaagtcaattgagcattgcggtgcatccactggaaccatgataagacgatgtgaagattttgacgtaaaagtagagggactggcgacggatgaagctaagatgggaagaggtgagtttcacaatggcatcttcaagatgatccatcttggacttggagcgagtggattcagccattgttcaatgaaagcaccaatgttaagccttggaattcgaggactaagacaaccctccaaaagtttcatcaacgtcaaccaacactctaatttggttattgaaagaatggttcatgccttggagcttcctgcccattggaaagtaccatggtttgaggtcaaatggcacgtcaagcaatacaaaaaggagaaacacatggacccaaatttacttgaattggctaaattaaatttcaacttgattcatgctaaacttcaaatggaggtcaaggaattatccagaagcttcttgtgtgcagcaggagttgcatttgagcctaagtataaatctgagaggaaatggctcactaaagtgattactttcgtgccagtcatcgatgatgtttatgatatatacacctcatttgaagagttgaagccattcacaatggcttttgaaaggctgccggtaaaaccagaggaaggtgaggacggcgtcaagtcatcatgctccttatgcatgctgggccctctatccatcaagtcaagtaatttgctattggaaatattgccaccgtgtatctcatgcttcttgtttcttcgaatcagttcctag

SEQ ID NO: 84914 - DNA, 1071 bp, Glycine max
  Peptide Sequence Number=SeqID_176599
atgccggcggcggaggcggtggaactgagagcgattggacgacggcgaattgaggtcgatccggtggccgtcgacgagttcaatgggtcacaatggtgtgacgtgaaggtgcgatgttgttcatggagtgcatcggttgtgttgggtgaggtcaggtgcggtggtcatggaggtttgggggagaggcattgcttaggagaaaaaggatattttagaaaatatgggatgccgcaaacaaaaatagggagccgtcatagttcgactcctcaagttcctttcttttcctcattttccaattccgcaatgcaaagggtgtctccaacctccacaatttggaggaccatagtctccaaggccagaaaaaacgtgtttttcatcaacgacccttttgctgcgcgctccttctctgcggttcccgtcgtggcagccgccaagaaattgcatcaaccagagattccaagcgatttccagaaatggggttcggttggattctgcagaacgtcgaaatttgcctctgggttcaatccacttcaaccgaagccgttggattctattgtagatgtccacagattgaaagatcggtatcctgaagacattgcttctgtttgggatgattatcacataggaagaggtcatattggagcaactatgaaagcaaaactttatcacttgctggagcatagagcttcagaatgccgatattttgtcattcctttatggaggggaagtggatacacgacaatgtttgttcaagtccagacgccacacatgatttttacaggtcttgaagattacaaggccagaggaacacaagcagccccttactttactttgaccttttacacagaatttgcagagagcaaggacttggtactgatccgtggggatgttgtatttaccagcaagcttactgacccagaagcaaaatggcttttggaaactgctcagtctttttatttgaatgatgcgaggtacaaactggttgagaggttcaacaggcaaacacatgattttgagttcaaagatgtcttgcaaaatgaagttgcaaatgaaggaaaggaagaagagtaa

SEQ ID NO: 84915 - DNA, 834 bp, Glycine max
  Peptide Sequence Number=SeqID_176600
atggaccaattctatgatgaggttcaagagcccgtgagtcctcatggacattatttcaacagttcggtgatttgctcctatgtttttggctttcttgaaatggcagttccaattgatgactcacagactatacctttgctggaagatgtcttcctccccatcaacccacgtttctcctctattatggtcagagaccaagctggtaaaatgagatggaaaagggtacaagtgaatcctgaagagcatgtaaaagtccctagatttcctgaatgcaattcagcagaattgtatgagcaatattttgatgattatgtgacaaggattctaaatgaacggacacctcagaacaagccactatgggaaatccatcttattaagtatccaacaagcagtgctgcaggcacaataattttcaaatttcatcattcacttggagatggttattccctcatgggtgcccttctttcttgtcttcaaagaactgatgacccttctcttccactaacttttccttcaaattcacagcatgcaaagaaaaacatgtttaagttacattcagtgatatcctccctctttagctccatgttagattttggatctagcataataaagactagaatgattgaagatgacaaaacacccataaggtctggatatgaaggaactaagcctaagtatttcaccttgtcaaacatatcattatctcttgatcatattaaagcaatcaagtccaatcttggagtgatttgcttagatgggaaagaaactgtaagagtttcttcacttaagaaattcttaaaaaccctcgttagagatgctcttagatcaatctag

SEQ ID NO: 84916 - DNA, 312 bp, Glycine max
  Peptide Sequence Number=SeqID_176601
atgcagaaagatgaggccaatgaaataaagttcaaagggcttgaagattatgaacttaggagatgcccaacctactgttggtataaagaaggttcattgtttgaggatgatgatgcttttgatccacatcttgagcgcataaagaatgaagctggtggagatgaaagtggtgaggaggatttcgattttgttgttgacaaggatgatgaaggttctcctaccaatgactctggggtagacgattttgatgacagtgatagtggtgatgagaaagaggcaagcgatttttgtttgcctttgttatctttgtga

SEQ ID NO: 84917 - DNA, 273 bp, Glycine max
  Peptide Sequence Number=SeqID_176602
atggccgcaaggaaactcttcttaaaatttgaatgtgagcttcaggacacactcaaagtcgagcttggaagtgacaatccctttggacttgaaggacagcattgcatagcaccacttatcttggggagttgctacgtgcacccagcattattgctggggcacccagcaaacagtgaagtggcgaaactgcccttcagcaattattcttccggaaactttccggaaaaattatttccggaacttttccggaagaaccttcttccggaagaataa

SEQ ID NO: 84918 - DNA, 651 bp, Glycine max
  Peptide Sequence Number=SeqID_176603
atgccaaaacattctcttccaccgcaagccaccgtgagcccagctgctgcttctttcgcctggacgccattgtcgttcgagatgagagcaggaggtgccgaaaaaaatggggaaagggggctgacggcgaggcttccggaagacccgttatgggttcttccggaacttccggaagaacattttccggaaactttccggaagaagtgttctttcggaagaaaccaaacattttccggaagaactcttcttccggaaactttccggaagaaggtttcttccggaaacatcatggccagaacacgaggtttaggtcgtgcgataggtagagttgtaggcagagatagacctgctgatgaggatgctgctgatgttcctgagaggcgtaggcctactgcctcagcccgtaggctacgcgttcatcagatgactgcggagggacgtgatatggctgaggacgtcgctgacatgactgatgatgtccctgagcagcctacggaggcacctgagatgcgtgtggacgcacagggtgctgatagtggtgaggggtcagatggtgatgatgctgcagagggattccctggtggtccacgtgacccgtcagtgctcacatcatttgccgagcatgttgcacatgccgtgtggagtggacag

SEQ ID NO: 84919 - DNA, 186 bp, Glycine max
  Peptide Sequence Number=SeqID_176604
atgaaagtagatcaggaaaattgtattaagcctaagctatttcatggaaaccttacctcaacaaagccgtggaacggtggaagggaagaggcggagaggccgagaggggcaacggcggcggcagcgcacgacgcaatggaagaagaggcacaattcaccgtgaacgagagagagaaggaaccctag

SEQ ID NO: 84920 - DNA, 707 bp, Glycine max
  Peptide Sequence Number=SeqID_176605
ctttgtccttgagagctctcagtcgtgccttgcttcttctcaatcagcttccgctcatcgctaaaagaaaaaggagggaggatcagccaccggttatacagaacagccggtgggctagccttcctctggagcttcttggtgatgttattaatagattggaagcaagcgagagtacatggcctggtcgtaagcatgtggttgcatgtgttgccatgtgcaagtcctggagagaaatgtgcaaagaaattgtcagcagtcctgaattttgtgggaagattactttccctgtttccttgaagcaggataaatggcttcctctccacactcttgctgcatgtggagaattttaccttttagattctctgttgaagcacaatgttgatatcaatgttctgaaaaatgaagattcagggccattgaaggaatccacatccttgattgagcaccgtaagtgggatggattatattgtcttccttcggagaagagtgagattgtttcagatgagtatcttcctacaaatgatccaaagtctaacaataatataaatgatgaagctgcagaactagtcaagctgacagagcaatcacttcttctcaagaaaaggacaaaccaaacaaagcccaggcctatagtagtgagattggatgatggagatgtggcaccaatttcagtcaaaagaccagagccaatggatgatattgtgtaa

SEQ ID NO: 84921 - DNA, 105 bp, Glycine max
  Peptide Sequence Number=SeqID_176606
ggtggtgctgacaaggactacaaggagtgtttgaatgtggctgatttagaggttcagctcctccagagcaagaaaggaagaccaagagaagaagatctaagataa

SEQ ID NO: 84922 - DNA, 225 bp, Glycine max
  Peptide Sequence Number=SeqID_176607
atggatgtcagaattaaatggtgggatttaatattggatgtggcgggagttgtctatcaatcaatctctttcaatgaatgtcataggccagggatattttctggaggcggaaggcaaaggagaagaggagaggggaggcaccatccactagggaataagccaaggaagaaggagcttcaccaccaagaattgtcttggataagaagcttgaagaggatgctttaa

SEQ ID NO: 84923 - DNA, 522 bp, Glycine max
  Peptide Sequence Number=SeqID_176608
atggacatgttggccttctctggctgcgatcatgattgtgatagcagagaggaggaggaactcacaagaatgagaacagtttctaccagtattagtggtgcaagctactacactggaactttcaatactgtcaatcgctctccggatggaagccattctagctgccacataataaagcagttgccagaagaatccagaacatgcgatggagagttgatggtggaaatgatcctggaagaaaatttttgcttgatggagaggtcactattgacacaatggcagatgatgtggaattcacagattatcaggaagaatggaagaataaagtttttggttgatatcttgcttgggcttaagttctccatgagtggaaattttgtacaaatagtggagaacctttggataattaaggggatagatctagaatatgtgaacaaagagttaggggggtcttcgaccttagacaaggatattaaagcccaagggcacgcgtttgtcacctccagagagtacatgtgctaa

SEQ ID NO: 84924 - DNA, 480 bp, Glycine max
  Peptide Sequence Number=SeqID_176609
atgggttgggtagccatgctttatctcgccgtcgttcctgcactcaaccgaaagcatgttcttccttctccaaaaccaaacttcaaaagagagaactacatcaaggaagaggatgaaatattcaatgtcgaccgcgacgccgtcagatacatcacctaccggaccaaggactccgcggacgctgccatcgtcgccggcctcgaccccaccttcggaatcaccgttaactctaaaacggtccaggtgttgtgggcaacataccctctagccatgtggagggaaggagttggtaatagcaggaacaaaggttctatgtcaaagcttgtgcgtgctgaggtacctttgagcaagcatggaagaggtaacagacttgcttcacccatagggaataccaaacgtagcaaggatagctcaggtagctcagttttagaagtgtctttcaagggcagagaaattgttgcttatgatgatatcctctga

SEQ ID NO: 84925 - DNA, 366 bp, Glycine max
  Peptide Sequence Number=SeqID_176610
atgcagtttgctagcctggcagtagaatctagggtcaaagagagggaaaattttgtagaatacattgatcctagtgaaaagattcctgctcgttctaaagaaaggtcagttcaagcaactacggcatcaaaaactgagcataacactgctctcaaggactcaagactgcaatctaattggaggatacttgttcgacaccaaacttcacaaccatcatttgacagtcgcaaggcttttacaggctctattatagagcatgctgagaatataaaaccaactacaagacaacaaagttcagcttcttcacaggattctggttctcaatcttcaaaaccagtctccagattcaaaatgcagagaagatag

SEQ ID NO: 84926 - DNA, 357 bp, Glycine max
  Peptide Sequence Number=SeqID_176611
atgatttacaacaaaagcaacaaccaactaggaggacaacacaagaacaccaatgaaagaagaaaacgaaaaatgatagaagaaggagaaaaaaaagacgaacgaaaaaaaaaatacctttgtcggaggaagctcgcggactggcggtgccagaagaagaaaaaggtcacactagggggagagggaggaggaggtgaagggtcgtgggccgaagggaggcgaagggtcgcgggtgccaaaagggagagggatggtcgccggtgccggaaaggagggggaaggtcgtcggtgctgggagggaggggggagaagggaggtcttgtgagggggagagggaaggggaaaagtgagaaataa

SEQ ID NO: 84927 - DNA, 1269 bp, Glycine max
  Peptide Sequence Number=SeqID_176612
atgcctgctcagaagcgttccttccctgatgctcctaacgatcaccaccgtcacgccaaatatcaccaccaagaagaagaagaagaagaagaagataattacaaatcagatgattctccccccgaagacaaatccgatgatgatttagaatgtcatggtgctgtggttgatgacgtatatgagaagcaggataattttgtgaaactaaaattaggttttagtagtattcataaattctttgttgcaatgaggaacaatgaatgccctgcttgtcgcacacactgtgccagccgtcgttctttgagagatgatccaaactacgatgccttaattgcagctttatatcctaatattgagaagtatgaaatagaggagcttcaattttgtgaagaggacaagaaccgcaataagcaggcttcaattgcaaaagttgctcaacgacaatctgaagcactggttaagagacgtagagatacaccaggttcatttgtgacaagatcacagcgcaatcaacaaaatgttctctctaggagacaaaaccaagtgatagataatcaaggatctgaagataatgaggatgaaaatgacaataatgaaaaggactcatcttccacagatgagcgatgtacagaactcaggcagagaaggcgaaagaggcagaccagaggtcgtccttctcagccctcatcatcaacagctagtcctgatggtggatgcatagaaagtgacatggatataagaatttcttctagaccggtgtcaaaacctcaaaaattaacttggggagggggtggttttaggagtcacacacggcatggcagtggcaatggtagcaatagcaaaagttcccgtagtagtcgcatggctaagttagttgattatctccgtagcttgaatgaaaacactgatgagttagatgtccatctcattcttttgtctttggacaaacaaagtacaccaagcttgcagcagccacacctttgctgtcggccaacattgtctgtgaagcacctttgtgaatatgttgctcatcagacacctttgccggttgaagaagttgagatattggcagttaaaggatgctgcagtacagtttgtgacaagtcatttgatgaaacttcatcctctgatgagctaactacgctagttatagatcctagcaaagatgaactggaaactctgcaagggcatgaatctttggcagggattaaatccaaatgcatatctaaaagggagcatttgattctggcatacaggaggaaggaatga

SEQ ID NO: 84928 - DNA, 552 bp, Glycine max
  Peptide Sequence Number=SeqID_176613
atggcaaaccaaacaacaattgttggtgttgttgttgttgttatgagggctcatattggtgcactttttcttgttgctattttcattggaatgcaaaaccctgagttggcgaggggtgtgagcaaagaagcaaacttttcgcttgcaattcctaccatccttgcaagcctcggttctatacctagaagggtagtaatgaaaccggcgagggtcccgacggcgggccttctcgccgggatgtacaaatggacagtctgtccagtcatggctccggctgcgagtacagcgccggaccttgaactcaaacatgcggaattgatcggaggcgtaggggtcgccggagtcatcgtcggaggagtcggtggagccattgtggggaaggtacttgtgccggagggtgtcatcggaaaacatgtcgccggagacgtcgtggacggcggcggagcggcgggtgaggagcttccttggtgggactgggatgtctatgtccctcagggatttcttgagggagagaagttggtgagagggttgaagttggaatttgtgttctga

SEQ ID NO: 84929 - DNA, 315 bp, Glycine max
  Peptide Sequence Number=SeqID_176614
atgtcaaaaatacggtttcgaaatgaaatagaatctgtccgtgggaggtgcagtggtggtgtgggttggatggaggtggtgacaccgtggtggcaacagcgtctgattttggcgcaccgcgtcacgtggcgctttagcatgcaaagcttgtctgggtcccacaccgcgcttaacgtgttacgcgtggccagctctggcggccaaacagaaacttccctcacttcttctcactctgcgccgtatatgcttcagctcctcactcacactcaccaccacccactctccgcgcgtcacttatcttcttctaaccactaa

SEQ ID NO: 84930 - DNA, 899 bp, Glycine max
  Peptide Sequence Number=SeqID_176615
acactggcgatctaggagttatatccgcttttgttgagaggtggcacaaggagactagcagcttccatcttccagtagaagagttggccatcacactggatgatgtggcctcattgcttcatcttccgatcataagcgccttccacagcttcgagcctctgcatgtggatgaggcggtcattatgttgatggagttggaagaggtctcgaatgaaaaggccagagctgagactacacaatgtcatggggcatacagtgggagctatgcatggggagctgccgccttagtccatatgtatgatcagttaaatgatgcttctaagagcactggccgacagcttgctggttacattactttgttacagtgttggatatataagcattttcccaatgttcatgagagcatgactgatgaaaggtatgatgagacgtcacaacgtgcctatcgatggcttactatgaaggcttatatgaaggaattaacagcatcgtcgtaccggacacgtatagatgcactggtgatccctgacgtatgttggatgccttatggtgaccaccgaagagttagggcgtttgacctcatttcatgctttcaggcaaattacatggactggttctttgggatatctcatccgttcatcacacccacacgggcagttgatcagcccagacatccacttgtcccacagcatgaggcatatgtggagccagatatcccggaggatgcttgtgaagcgatcgcagaaaggttggagcgtgtgctcaacctaaggatggtcaccgcaggcacagagttacatgacatcatggaagactgccttaggatcgcaaggggtgtcacctcagatggaaatgattatgttagggcgcaacgaagacggcgcacaaatcattcatag

SEQ ID NO: 84931 - DNA, 279 bp, Glycine max
  Peptide Sequence Number=SeqID_176616
atgcaggtcgaaatggccatcggaacggaagaagaagatgcacgaggagagaggacaccaaccaacacaaagaagaagaagaagcggaagaagcgaaagaagcgaggtgccggaggccgccggagtgcggcgaaggtggagaagggaggaaaaggagggagtggcggtggaggaggttgtgaaacagaggaagaggaggcacagtgggagacacaggaaggagagactcagcttggtgccttttcaaccaccttcaacttcttctccaagtatgcatga

SEQ ID NO: 84932 - DNA, 574 bp, Glycine max
  Peptide Sequence Number=SeqID_176617
atggacagaaacattcttgactctctgttcttaaacatccactttcatggccttgacatgaaacaagaatcaatcccagtagctttgatctataggatgcagtacaaggtcatgaatacttgtgcatctagagtcctattgcaaccacaaaagggagaaacaaccttatttatcactgatatgacaaaagccaacgtttctttaaaaagaataataaaatgggatgaagtaactctccccgaaaaatgggtcatggagaaggccacgccgtctgatccccgacccgctccaattattgaaaaaattaaacaagataactccggaaaggtagagataaccttcaataggagaaattctttttcatcaaggatagaagcctctaggtctgaatatgagtcagccagaaggtctttttcggttagaaccaaaagtcgatccaatccccaacatactcttctatggaaccttatgatgttatctgacaactttagcattgataaggaaacccttaggaaagatttttattctccggagaatgagcctcaaaggagatggtttttccaacattacaagg

SEQ ID NO: 84933 - DNA, 1104 bp, Glycine max
  Peptide Sequence Number=SeqID_176618
atgtcaatagtccctccaactgaggcagttgatgtacaactcggagatcgtatagaagacatgatgcgcgatcttggccaagagggttttaggcaagctcatacacccttatatgataaattagaaactgattctaagaaacccttgtatttgggatgcacaaccttcacacggttattggggtttgtcgaaatgcgcaactgccctacatgtgaggtatcacgctacaaagtgaagtatgatgaatgcagtgatgatccagtcacaaacaacgattttccaacaaagaccaaagaggaagaagaagaagataaactcaaggaatattctaataacagattttgttatgcatgtctgcctatgagggagcaaacaccacaagtaggatttggtgttgattctactaattcgttcttccagttttgctccttagacgtaatcatcaagtccacgacccttggaaattcaccttgtcctcaaggtgatacacttcaaaccatggctaccaaagtaataccagggtcccaaggtctgttgcggcaaaacgcactcagctcagcacctgctcgtagtgcagagacaactggtatgcacgtgcatgagaccatgatactttcaaagaatcctggtcccagctcaaacaacgcgatgtctcgatatttgccatgcttggcttgctgggttggttacggccctgacagtgaaaaatcctcgagggttaccaacctcgtgaagcagctcgaactgttgctccaatgggtgcaagccatgaagggaactcaccacactgaagagatactgttgttggatggtcagaagaagcaacaagagggagcgagagttgtgaatagtggtttgcacgaccaagaccttgacggccgaacatcactatccatgaagcgcaaacccgcgctaaccgtggtcgaggaaggcaagagaggatccaatgggcacagggtggtgactgagcatgttaaggggaagacgggtaccacggtggatgttgttgccgctctcgagaggtgtggtgacagagttggcatggtcgtgggagcggtgagcgtaggtgacggacttggcttgagcgacggaggtagcggcatg

SEQ ID NO: 84934 - DNA, 459 bp, Glycine max
  Peptide Sequence Number=SeqID_176619
atgcattgtattttcaaagcattagtacaattgacgataccttcgggaatccaagcgctcgtgcgggtcgaaattgaaagcatagaattcatgagcgcagaagcagtggccgtgtggtacggcatcatcgattccacacacgaactcaattccacagggaaccttatcacacaaacgcaacacaacgcaacgcaattagttactgacagaagaacacgaaaaagaagcttccacgcaatgcgtgaatgtgtgcgttgcttatacctgagagtggattgggactgcgagagaggcttattggacgcgatgcggaacggagaacgaaccggtttggcttccgatgcgacgcgaaacgctgacctgggggcggagcatgatcggaatatagatctggcggcggcggatgccattttctggatcggaatcgttcgggatcggcgtagggttttgcgtagttaa

SEQ ID NO: 84935 - DNA, 477 bp, Glycine max
  Peptide Sequence Number=SeqID_176620
atggaaaatattagtttttcaccagaaggaatttaccctatttcttcaccaattaatgagtctccttctccttcaccttcaccaattgatcaaacttgttcacctattcaagttgatcttgcaccttctccttcacctattaatgttgatcatactccttcacctcatgaagatgaagttaataatgtggaggcgcaaggaggaatatgtaggctgaaaaataagatttggcagcatttcaaaaaaattaaagtcaatggtttggacaaggctgaatgcaagtattggatgaagggtcaaacatttcttatacctaaggtcattcaaggaaaacaagagttgggtgcgggaacttatgatgcagaacgtgcaagggaaaagctagcaaaagcaattattatgcatgagtatccactatcaattgtggatcaccttggctttaggagatactctactgccctccaacctgtgtttcag

SEQ ID NO: 84936 - DNA, 930 bp, Glycine max
  Peptide Sequence Number=SeqID_176621
atggcagaatcgtcaaagaaacgaaagggttcttccgccttcgcttcggcttcaagagctcatcgttccggagccactagcgcatccacaacaccaattcctccatcattgtcctcttccccagtgttttcttccgatgaacagcagaaacggtactccaatcttttctcatctcgttccattattgaccctaagtttattgatatggaattcttttctgctgaaacctttgattgcattcaagcctttcagaacttagtcccttttcatgacttaaccaaattacccagtgacggtgtaccatttgaagttggtttgaccggacgtcttcttgccgggtcattggcttttgaaagccgcatccttcactatttaattgtgcgtattttgcttccacgatcttccaaccttgcccaggtttctgaggaagatctaattatcatgtgggcctttcatacagggcgtcaacttgactgggcacacttagtcagatatcgcatgcataaggcattgcgattaaatgctccactaccatatccacagcttgtcactctctttttccaccattttcaaattcctcttgattctgaaccttacgttccaatcaagagatcctttttaattggtgctgctgtgattgcttcttttggttaccgcaaagaacttgatggctcttgggtcaaaaagggtgctccacccgctgatgatgaaggcaaccaaccagttgaagataattcctctcttcttcgaaagcttttagaaaagttcgatggtcttcaaacttttgttggtgacaagtttgataatatggaattgcaagtcgacatgcggtttgatgccatggaatcaaggatcaccaaagttgaagaagatgtctccttcatccgtacttgctttgatccaccaccaccgcctccatcatcctcttag

SEQ ID NO: 84937 - DNA, 537 bp, Glycine max
  Peptide Sequence Number=SeqID_176622
atgatcattgtgttgtatgaaacgaggcgtcctttagtattccatggatctaacgatcggaaaggttttgaggccgacaactctcgacattctgagggggtggacattgaggcttcttgtagcgacaatgtggagaccgtcatgaagccgaagcattgcatgttagaaaaaaggaaagagtattcattgattacccttctcggatattcatgggtcgacgacgaagtgggttcattctattctcggaatagtgataaggtgtttcttaagaagaagaagccaaacccaaacccggacccattagggccgagtgggaaacatctgccaaggccaaaagaagaaaaggttcttgccgctggtgtctcgctaagcgaggcatatgcgcttagcgaaggatcagccagagatgtgctcgcccagcgtgccacaagcttgctcagcgagtcatttgtctcttctcgcgctcagcgcgcccagcccgttaagccaaatttcactaactcagccaatctcgctaagcgacccttcagaatctga

SEQ ID NO: 84938 - DNA, 201 bp, Glycine max
  Peptide Sequence Number=SeqID_176623
atgacatttcaaacaagttgcccatctactcctcctactcctaccaaaatcgtcatgaccaacacgacctcttttgacgatggagaaagattattgaaaaaggtacttccttggccgagtatgtgtactcgtgagggaagccttgagtactcaggaggaaaacttagtaaagaagttgaagatgcatcctttgccgagtag

SEQ ID NO: 84939 - DNA, 93 bp, Glycine max
  Peptide Sequence Number=SeqID_176624
atgaaaataggaaaggatgagtgggatgttaaggttcgtgctgttctggagagagctacaggaggagttgagaaggctttgcttggcgtttga

SEQ ID NO: 84940 - DNA, 261 bp, Glycine max
  Peptide Sequence Number=SeqID_176625
atgggggtgcaaatagcacccaggcccacttgggccctccagaaggctgttgcttctggaggaagcaacctggctcgcctgggcgagctgggcggcaaccacctcccctattttgctataaataggggaggaagtgaagaagaaaaggccgaggcgcttccgaaacgtttccgtaacgttttccgtgaagaatttcgcgaaggtttcgactgttcttcgacgttcttcattcgttcttcatcgttctccgatcttcaacgg

SEQ ID NO: 84941 - DNA, 228 bp, Glycine max
  Peptide Sequence Number=SeqID_176626
atggcgagagaatatgaaaaaccgaaggagttgagcaacctctatctttacctttttctcttcgaatatgaaaactttggagaagatggtggcacggcaacgagagctttggctttgcgagcgaagggcgaggaaggagggctgttcttcgatgtctcctgcaacaagattttcttcctttatttaaggaacaacgacgtcgttcgttatttttacaaaaaaacgtag

SEQ ID NO: 84942 - DNA, 495 bp, Glycine max
  Peptide Sequence Number=SeqID_176627
atgagaagggaaagaggagaattcattaccattgaactaacctcaaaactcaaaaagagcaccgctacaaggtcccttgagtcaaggaaattgaaagtctcacactctctaatggtgggttgccttggagaggaaaaagagaatgcattgagagagcgttgtgttcccgtgtcctctagcatgaggttcttcatagtcatccacctattcatctgctccctcgaacacaagttcaagatcatcacaggatccaaacacaacaacacacagagaggagaccagtcagggtcacgatgttttgcaagaatactccaaccatatgggatcaacataggcttaaaggagtactcaaacccggtgacccccaaggcctacactccgaagactccgtcagggcctctccctcctgattcaggtccaacccctaaaacaattttgcatgcagacactgctcatgaattatacaatacccatgacctcacgctcgtgttttaa

SEQ ID NO: 84943 - DNA, 225 bp, Glycine max
  Peptide Sequence Number=SeqID_176628
atggttaagatggtctccagaaagaggaaatccactgcctcccggccccaggagccttacaacaccaccagattcatctttgaggctgcttgggagaagtattcccagaacgttcactcccggaacatccttccggagaggaacgttattctctacggcacaaagtatgacgagttccgcagggagctcgagaagcgatgctggcataaatccttgactaggtag

SEQ ID NO: 84944 - DNA, 549 bp, Glycine max
  Peptide Sequence Number=SeqID_176629
atgaagcaagatcttagagttgttggtaaccatgcattgcacaatgatggaggaggaagaagggtagtggagacacaatgggcaaagtttcagggtctgtcgcccactgggaaaagtgaaactgacgagctttcgttctccccggctattggcatccttcattggctttctttgttcgtttcttccgccatccagacgaaggttcttccgcgagaagaaccttcttccgcgcgtgtgaaagtggacattgtgtattgtagcggaagacggtgttcttccgggggatcttgcagaagaaaggtgaaaaggttcttccgcgggttccagcggaagaaggtgaagaatattctttcgcgggatgcagcggaagaacgttgtcttccgcgaatcccgcggaagaacctgtggaaccttcttccgcaggctacatgttctgctcgtggaagaacctgcggaaccttcttccgcaaggtacatgtccttctcgcagaagaacctgcggaaccttcttccgcaggctacctatccttctcgcggaagaaactgtga

SEQ ID NO: 84945 - DNA, 567 bp, Glycine max
  Peptide Sequence Number=SeqID_176630
atgtctcttgatgatgctacaagtactgtgatgaaggctattgcttatggagcttgtgattattggattaaaccattgcatcagaaccaattcaagattatgtggatgtggcagcataacagttctaattcccaagaatctgatcctgatgtttgttatgctccccctggaaagaagtctcgtttagtatggcaaggagaattgcatcatcaccaatttgtcaaggctgtgaatgtgatgcaagttgggcttgataaggcacagccaaagagaactcttgaagtgatgaatattcctggtttgacagaagagcatgtagctagtcgtttacagaaatatagacttaatttgaagaaatctaataaagaggttgtgcaacaggatgagatgtcattgccaaactgtatagaatccagaggcaggaattatccttcttcttacttggatgcttccattccctctctgttcccaaaattctctttctacattcccaattcgactggttgccgacgatggggaaaggaggcagctacgttccagcaagaagaagtcgccgccgatcattga

SEQ ID NO: 84946 - DNA, 183 bp, Glycine max
  Peptide Sequence Number=SeqID_176631
atgggaaatcgagcttccaaccaacttggacctatgatattggattttgcaaagggtgctaaatcttctatgaaagtggtgaagcttaagaagagtttaagggaagagaaagtgcaaactcaaatttatactggttcggtcacacccttgtgcctacgtccagtcctcaagcaacccgcttga

SEQ ID NO: 84947 - DNA, 372 bp, Glycine max
  Peptide Sequence Number=SeqID_176632
atggttgcagagttagggcatcaaacggtggagttatccacccttgtcacacgtgccgctaacgataagtcctccaatttaaaacatgccaaggtttatccaacggaagccagaaatggcattttagacaacaagattgactacttggaaaacaagataaagatggttgaaggagagttaagagaagccgctgctattgaggctgctttatattcagtagttgctgaccacatggccttgacaacaagactaattgcgttggagagcaaaacattttcatgtttcaccttggcagttgtacttctaacgatcaaggataagctattccaagataaggctattgctggaaacactcacttaaggtggacatga

SEQ ID NO: 84948 - DNA, 639 bp, Glycine max
  Peptide Sequence Number=SeqID_176633
atgaagaaggatgatacatgtttcttccttcaaaaacagagccctaattacaatgaaaaagttgaagttgagttgcatccattagccggaaaccaattgtcttctggcgtgtcccatgatgttctgagattcttgtcaaactcaacaagagtcttggcttccactaaggggttgattctttgtaagcacgcaactagccacacaccaattgaactcttcatttgtaacccatcaacaaaaacttggttacccattcctaccccacaggaagttcaaaacagatttaatgttgctgatcccacaatggtgttgctagaatcttcctatgacggttgtggcgatgattacatggtatttcaccttgaacttgaaatcacaacagattggtcctcaaattatccttgcaagattttgaagcctaaggaaggtttgtggaaaacaatggaaacaagtttctttgcaagtggcaggaacatgaagtttaacatgcctgtctgttgtaacagggcaatccacttcatttctaactgtggtccttatctgactaaaaggagctccttttttaacccctatctatgtcatttcttacaatctagagaatggcacctcaacaatgctaagggtgccaaaagatgctag

SEQ ID NO: 84949 - DNA, 279 bp, Glycine max
  Peptide Sequence Number=SeqID_176634
atgggtgggcatcatcaacaacattgtcaatggatggaggctgagagtgaaagcaaagaggggacgtggggtttggaagagaaggaggaaagttgggaatgggaagagagagaagaacttaggcaaattgacctacatgggatagttttacaaactatttcccaaactagccatgcagtggttttcgccactttgacaggcgatttatggtgcaaagggcgcgtcaggcaagggcagcagggtcacaggctagggcagcagtggtttttgccactttga

SEQ ID NO: 84950 - DNA, 378 bp, Glycine max
  Peptide Sequence Number=SeqID_176635
atggatacctcagagccctacactggggcaatgaggggcactgtgcatgagcctcgagcgaacctaggggcagatcaaaaggtggacccttgggtactagtacctattgcctttagaggactacacgtcctcgtcttcagagggctacacgccctcaccttcagaggactacacgtcctcgctttcagaggactgcatgtcctcgccttcagagggctacacgccctcacctttagaggactacacgtcctcaccttcagaggaccgcacgtcctcgcttcagagggctacacgccatcaccttcaaaggactacacgtcctcgccttcagaggactgcaagtcctcacctttagagggctacacgccctccccttaa

SEQ ID NO: 84951 - DNA, 618 bp, Glycine max
  Peptide Sequence Number=SeqID_176636
atggcggcggggtggaactctcagctcgtagtggagacatggtcgcaaggaggacgtattaccaccagcgtggggttagcagtggcgaggtctcacacgtgcggaagacacgtgtgcgtagtttccaatgagcgggtgagatcaaagtatgtagagaggataggcaaggtgggcgtgatgatggatattatgggccttccaggagcatatactgaggatgcagctttgaaagcatatccaaaatgtgagacagtgccatgtgaggactttgagacttcattcaaggctgttgaatcgtggttagtggataaagttgttctacccatcaaaagttctattggtgggagcatcaaccgtaattatgatttacttcttggacacaagctatacattgttggggaagtgcagttgctaattaaccactgcctcttaggattacctggtgtgagaaaagaggatctcaaagctgtaatgagccaccctcaggatgaagacgttaatattactcactttctgatactggcgagggatcctagaattccaagaaatgacatggcttataagatcgtccgcgacactcgggttgtcaaccacgacgatggaggtgaacaggtctaa

SEQ ID NO: 84952 - DNA, 297 bp, Glycine max
  Peptide Sequence Number=SeqID_176637
atgtaccaatcatgtctaaaccaaggacaagcttcagaccaaagcaacacaaaatctaggtatccaaaacccctcaatttaatggattttcaaggtttgataagtgaaattgagaatgagggggtcgtctttgacaccctgacatttgagtcactaagtcctatgattaacttggcttacattaagaagaactgctggaaccccgcagatccatccatcacattcccaggggcccattgtacccgtgccagagccgccgcgccagacaccccacctccttctcacccgccatcatag

SEQ ID NO: 84953 - DNA, 396 bp, Glycine max
  Peptide Sequence Number=SeqID_176638
atggctcatggccgtcaagcgcttaccttcaataaggattacggcgttgccccagtagaagttcgtaccgaagttcggtatccatggcgtggaattgagatgttggattttgaaatccgtgcacattttctgcatcatattgttattcagattggtgccattgtcagtaatgatcttcctagggagtccgtaccgacaaatcagctccctctttatgaatctgaccactacactcctcgtgacattggtgtaggaagccgcttcgacccatttggtgaaataatatattgccacgagaatgaagcgatgaccgttcgaagccttgggttcgatggcccctatgacgtctatcccccacatggaaaaaggccaaggggaggacatgtcattcagtag

SEQ ID NO: 84954 - DNA, 144 bp, Glycine max
  Peptide Sequence Number=SeqID_176639
atgtctagagtatatgattgtggagatgacaaggaaaggggaattggtgctgcgggtgcttcagatggttcgtggcggcgatggccagcagtagcggtggtggaggacattccctttcacttcttcaatgattctgccatttga

SEQ ID NO: 84955 - DNA, 318 bp, Glycine max
  Peptide Sequence Number=SeqID_176640
atgataccggattttttaaccgttggatcatcttcaaattttgtctggatatccctaagtgagaatggtgcgctaagcgcaattccaaccgaggggaattgcgctgagtggcccaaagctgtgctaagcccaattataattgaggggaattccgctgagcagcccaaagagacttgtgtttggacaaacgagcgtgaacaagagagacctctgagtaatgcaaagaggaatcgacggagagctcacgataggtgcatgttgtgtatgttcgtggggggtgcattggccttgtcagatgtcccttgtgtgggaaaatag

SEQ ID NO: 84956 - DNA, 621 bp, Glycine max
  Peptide Sequence Number=SeqID_176641
atgtcgtcccacctccacatagttaacagaaaagctatacaactaaggattgtggaagagatgggtgttcagaactataaatgcaatttaaagcaaaaaggtagaggagaggtaaaggacaaaaaggtcaacaaatgttcatcgattaatcattgcccgactgggactaatggactgcgagtaggtttaggagatgtggacaagggagtggtagtgatcccagaaacaaaggctagttggtgtgatgatgataggaaagggagatggtggctagatgggacacgtgtggtggagccactaaaagatgttgggcttaacaatgggtccatattgggttttaaaaaatccccattttcgaatggactagggctggaattactccttaataatcatgaggatagcataggcaaaggattggtaggccgtgaccattcctttaacgtgtgggaagttgctaccaatcatacaagtggaccactagtagttagtgctcaacaaattggacccccaacttctaatgcgagcgatttcaatgattcaactttcattgatggagagactgtcagaatgttcaggaggttgaattatgttggtcaatatataaaaggtagggagaagtaa

SEQ ID NO: 84957 - DNA, 384 bp, Glycine max
  Peptide Sequence Number=SeqID_176642
atggagccactaaaagatgttgggcttaacaatgggtccatattgggttttaacaaatccccattttcgaatggacttgggttggaattactccttaataatcatgaggagagcataggcaaaggattggtaggccgtgaccattcctttaacgtgtgggaagttgctaccaatcatacgagtgctcaacaaattggacccccaacttctaatgcgggcgatttcaatgattcaactttcattgatggggagactgccagaatgttcaggaggttgaattctgttggtcaatatataaaagggaaggtgaagataactgatgtagctccattggagcttgtaggccttggatcttcttcatcaatgaagtcctttgtttcttga

SEQ ID NO: 84958 - DNA, 261 bp, Glycine max
  Peptide Sequence Number=SeqID_176643
atgattgaagaccgaagaaagaacgaagaacgggcgaagaacggcgaaaaatcttcacggatttgctcacggaaacgccttggaagcgttacgaaagcacctcggcttggattttctttagggaaacatgttttttcacccaaaacagccgaaatgcatagcctaagagtcaaggatcaatttacacagctcccttcccctatttattgccaaaatggggaggttcttgccacccagaggcttcttgaggaagatttctga

SEQ ID NO: 84959 - DNA, 454 bp, Glycine max
  Peptide Sequence Number=SeqID_176644
aatgttgcggatctttacggattgcacaacaatgcttgttttgatttccagaatgttgcgagactttatggattatacaacgatggaattgagggagcactatggttgtcccctaatagaatggtgagcacaaatattgtccccttttatgcagtcattcatgtaagtgggcttaatgtggttccttattggtctggtagatggtatgtttcttgtggtgctactattgctatcaatacccaccgttggaaaaccaacctgttcctcaagttggtgaaggttgctacaattggaaactactgctatgttttacgtacttcttcactgagtggcaaccctatgattaaaatggcagtggctttggtggtggtggtggatatagtggcggacgttgacaccgatgatggacagagcaagagattgaggggcgacgatgcgaacaacgatgataatg

SEQ ID NO: 84960 - DNA, 276 bp, Glycine max
  Peptide Sequence Number=SeqID_176645
atgaaagaaaggattaagggatttttctccatcgaatccttgaggtggaatatgaggattccgcttagattaaaatgttcatcttggtgtggagattcggtgacaagcaatggcggctcatggtgcccactagtggtcgtgggtggtggagaagaaggtgttagggtttggatttcgcttagtgaacttgtctcactaagcaggagtccacttttagcgctaagcgcgataattctcgctcagcacaattctctctcgggttggaatttgcgctga

SEQ ID NO: 84961 - DNA, 219 bp, Glycine max
  Peptide Sequence Number=SeqID_176646
atgacttcatcatcagtcaatgcgattgtgtattacaacggcaccatcacatcaactaaacatggttcaacttttgaaagaggttcaccaaagattgttcaacttgacaatagaatgtcccttgatgccttgaaacaagctattgtaaacaagattagtctaccaaatgcgattgttagcaatacaatggatgcatattgtacgatgatgagaatgtaa

SEQ ID NO: 84962 - DNA, 192 bp, Glycine max
  Peptide Sequence Number=SeqID_176647
atgttcctcttggtgtgggggttcgacggcaagcaacgacagttcatggtggccactggtggtcatgggtggtggagaagaaggtatagggtttggatctcgcttagcgagacaaacttgctaagtgagagtctacttttcgtgcttagcgcgataattcgcgctaagtgcaactccctctatgctaattga

SEQ ID NO: 84963 - DNA, 717 bp, Glycine max
  Peptide Sequence Number=SeqID_176648
atggctgccaagcgaataggtccacattctgatgtagggtatcagcgatgcatctgtgctcatggcttgagctatgtacattgcccgggtttgagtcccaactgcagcttgacgagctcttcaatgggctttgggcctttgttagaagtgttgttgcatggatctatatcgaattcatcatctaagatggcttggtatatggttagggctcagattagaggtctttccttcatgctcatgacttggagtaccttcaaccattgtggggtgaggcttagcaagctccctggtgggaggataagggtggggaatttcatctttggatgcaccgtggagacaatagctccaagctcattaagtgtcttcctgccaatcaaagaaaaatacgatgtatatgcgtcaacaacctcttgtctctactcttttgcatatgaagccaaggagtggaccggcatgagggaccttgaacaccatgaagcttgcgatgatgatggagataaccatggggtcgtcctggttcatggggttgatacccttgaagttgtcacttgtgcctttgttgttggtatcgctatctacctcaacctttcactctatcttttcttttgtccgcatcatgattcctatgctaattctcttggtgtcctccagggcccgacagtcttttgtattgtgattgataccatgatggtatctacagtatttggtcgcatctaa

SEQ ID NO: 84964 - DNA, 306 bp, Glycine max
  Peptide Sequence Number=SeqID_176649
atggaaatagtgttactcaagtactatcacattgctaaaattgtcattgacaattttgaatgcttcaaaatgtactacataccaagagagagcaataacagagtatacctgctctccaagctggccaacactaagaaggttgggcacctcaagactatcatccaggagacgctccaaactctcatcatagatgctaaggaagttatggggacgctctcttgccaccaaattggtgcaagatgccaagagtttgcggatgtgccacacacttctcctgataatctccacagtataagctccccttag

SEQ ID NO: 84965 - DNA, 129 bp, Glycine max
  Peptide Sequence Number=SeqID_176650
atgtatttccgtgaagaaaattcaagccgaggtgcttccgtaacgcttccgagatgtttccgtgagcgaatccgtgaaggttttccatcgttcttcaccgttcttcgttcgtttttcattcttcaacgg

SEQ ID NO: 84966 - DNA, 147 bp, Glycine max
  Peptide Sequence Number=SeqID_176651
atgcaaggatcacacatgagcaatcatgaaaacaaaaggaacgatatgttcatttatgatgccatgaagagatgcttatgcatgctagagataaaatgcgggagtgatttgattcgcactgatctttggagtaaaaacgcaggataa

SEQ ID NO: 84967 - DNA, 135 bp, Glycine max
  Peptide Sequence Number=SeqID_176652
atgggtttgccaggcttaaaagagcactcaaacccgatgacccccaaggcctacactccgaagagtctgtcaaggcttctccctcctgattcaggtccaatccctaaaatcattttagcacacagacactgctag

SEQ ID NO: 84968 - DNA, 686 bp, Glycine max
  Peptide Sequence Number=SeqID_176653
tgcaattccccattctcaaccctttttgggagcccatgaattgcgttttcgttcatgcgtcctccacctacgagtttggagccatgcgtagtgattgcttagtgcaattctccattctcaatctttttcggaaccccatgaattgcattttcgttcatgcgtcctccacccacgagtttggagccatgcgtagtgattgcttagtgcaattctccattctcaatctttttcggaaccccatgaattgcattttcgttcatgcgtcctccacccacgagtttggagccatgcgtagtgattgcttagtgcaattctccattctcaatctttttcggagacccataaattgcgttttcgttcatgcgtcctccacccacgagtttggagccatgcgcaccacgcgtagtgattgcttagtgcaattctccattcttaaccctttttcggagcccatgaattgcattttcgttcatgtgtcctccacccacgagtttggagccatgcgtagtgattgcttagtgcaattctccattctcaatctttttcggaaccccatgaattgcattttcgttcatgcgtcctccacccacgagtttggagccatgcgtagtgattgcttagtgcaattctccattctcaatctttttcggagccccatgaattgcattttcggtgggatcctctag

SEQ ID NO: 84969 - DNA, 135 bp, Glycine max
  Peptide Sequence Number=SeqID_176654
atggctaaatggatgaatattaccgatatgggttatgtgattgcatcaagaaacctataccccaatgtcacatcctatcagagcattgtgtcccaacgtctttcagcagaaggttccttaaagcaattcacctag

SEQ ID NO: 84970 - DNA, 459 bp, Glycine max
  Peptide Sequence Number=SeqID_176655
atggcgcctaccaggcaccctctggacccgaataagtccaacagggccctgggatttcccgccttgatcacaggactctgccagtcattcggagtccctgtcgcacctagcaagagacaggtccaaggggatgctccgcaggccgcagacgcgccgccacctcatcaggccggtccagccgaatcgtttgatacggagcagtatttgcggcatttggttcgccagcaggcggccaaccaccgggcacatgtacagacccatgattgtctttatcagatgagtctcagcctgcagagccagggctttacttcttttccgtgccctactccggaccagttcagggcagaggtcgcatggcctggagattggcctgaggctcccgacgaggcagatgaggcccgcgaggacgaggagatgaccggtttacttgatttcttaggaggaagcggggccacatga

SEQ ID NO: 84971 - DNA, 555 bp, Glycine max
  Peptide Sequence Number=SeqID_176656
atggcatccttcagccagatacagtcccaactccaaccacagatgcaatcacagggacttgcactgcctccggagcctgaggttggtcccttaggtgctcgtgtcagcacaaaggagagttgtgttgatccctcagggaatgatccagagacgagtaacttagacaaatgcgggttgtacattgaagaaaatctttcccgcttggttgccttaggaagactttatgagggatccatagcggttcacaacatttctttgttgcatggacaagtcaaggttggtgtggagatgattaaagatgcagaggctcccatttcggtacccactgacgaggttatgttggatgctaccatgttgggggtgtttaatcaagacttcccattgtacatcaagcacgaagacctctctgaaattgcacacagtggtcaatgtctcagcatatctgttatacaattgtggattctgcatctgactgagacaagtatacgagcggggaattccgatgtgtatggattccttgagccacagtccattcagagatctgggcaaccgtag

SEQ ID NO: 84972 - DNA, 963 bp, Glycine max
  Peptide Sequence Number=SeqID_176657
atggcggaactcgaagacgccgcggggcgtcaccatcatcaacggccgcagcgccacttctccgtattcgaagaaggtctgctgacgcttgacgatggcctcggcgacacgctgtatggtggtgtagcgctgctccacattgcgcaccagccagcgggcctcctgcagttcctgcgccatggggctgcggtcgtccagtcgggcccgccggaacaggtcggcatagacctggtgcaggcgggcctgcggcatcgcgctgcggttgggcacgacgcgccagcgcgagcgccatttgtcgacgaacacgtccggcaccacatagaccggtgcctgcccgtcatagcggcgacccggcttggggtccagattgcggatgagcgcgcaggcctcgcgcaacgcgtcgtcggagcagttcagcgcccgccgcaagccggcgacgtcgttcttggcgagccggtcgatctgcccgcgcacgatatccagcgccagtctgcgcagcgacgcgtcgatgccgggcgcgtccagttgcagcgccaggcactccggcagatcgcgcgcggccaggcccggcacatccagttgctgcaccaggcgcagcgccgccagccattcgctgtcatccggcgggggggtgaaatcggcgctcagggcattgcacaggttcgcggtcggcgtgcgcagatagccatcctcgtcgagcgcatcgatgatgaattcggccagcaaccggtcgcgcggcccgagccggtagttgcccagctccagcgacagcttttcgcgcatcgacacgggcgcgctggcccactggctgaggtcgtggtcttcgccgtcgccacgggaaggaacgggatagtcgcccgagtattcgggcgtggtggcgggaggttccagggtgacctgcgtgttctcgcccgctggtgtttcgggttcggacggatcaccgacggtgggcgcggtggttca

SEQ ID NO: 84973 - DNA, 582 bp, Glycine max
  misc_feature (44)..(44): n is a, c, g, or t
  Peptide Sequence Number=SeqID_176658
atggtgaaagttggaacctcttacgtgccgatcaacgtctcatnttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttggtgcaacatccatctcagtcaaacatctctctgtcagctgcctgtgatacgagaaagaaagcttcatcgagtagtctgtgtgggatattcttcgctaggtctggtatggctcgttctcttcatctgttgggtggcggtagagaagatagggcatctgaagaagcagaggctgacggtgggtggggtagggccaaacaagcggcagcgcgaggagcagagctaagtaagcaatag

SEQ ID NO: 84974 - DNA, 318 bp, Glycine max
  Peptide Sequence Number=SeqID_176659
atgggtgaagtagaggaggtgcaagagcaaatgaaggccgacacagaggccttgaaagagcaaatggccacaatgattgaggccatgatgaacataaaggagataatagagggccctcagtatcacccacaaccacacctcttgcattccataatgggtaaaaaccctcatgctatggcagaaatgggaaatttcgatcatctagaggaaaggctcagggccattgaagaagggagagattatgcctttactgacatagaagagttgttcctagtgcccaaaagtggtcattcccaagttcaaggtgctgaactttga

SEQ ID NO: 84975 - DNA, 678 bp, Glycine max
  Peptide Sequence Number=SeqID_176660
atgatcgcgtccggacgcgcggcgcgcgccagttccggcatgatttccggggtcgggttggccagcgcgaagatcaccggatccggcgccatggcccaggaagatgtccgcgccgtcgacgatctctgcaagggtgcgcttgtcggtgtcgcgcgcatagcgctgcttttccgggtccaggtcggtacggccggtatggatcacgccctcgcggtcgaaggccaggatgttctccggcttcaggcccagctgcaccagcatgttcacgcaggaaatgccggctgcgcccatgcccgtggtcgccagcttcacttcctcgatcttcttgccggtgatcgccatggcgttgagcacggccgcgccgacgatgatcgccgtgccgtgctggtcgtcatggaacaccggaatcttcatgcgctcgcggagcttgcgctcgaccacgaagcattccggcgccttgatgtcttccaggttgatgccaccgaaggtcggctccagcgaggcgatgatgtcgaccagcttgtccgggtcggtttcatccacttcgatgtcgaacacatcgatgccggcgaacttctggaacagcacgcccttgccttccatcaccggcttgccggccagcgcgccgatgttgcccaggcccagcaccgcggtgccgttggagatcaccgccaccag

SEQ ID NO: 84976 - DNA, 295 bp, Glycine max
  Peptide Sequence Number=SeqID_176661
atggtcactggtaatcgattagtgccaactgcttgcttctacaagagtgaggctaacttagaaaagaagaaaaaggctactcctactgaatgcaaggaggtacctcatccattggtaccttcccggaaagataaagagcgacatttggtcagatttcttgatatcttcaagaaactggagattactttgccatttggaaaagcacttcagcaaatgcccctctatgccaaatttttgaaggatatgttaaccaagaagaaccggtacatccatagtgacagaattattgtggaag

SEQ ID NO: 84977 - DNA, 246 bp, Glycine max
  Peptide Sequence Number=SeqID_176662
atgagaacagactcaaccgaattgcatcaccaggtaagcataaggtgtggaagcaatgccttccaagattattttgatgatgccaaagaatcaagagttaagcaaattccaaagattcgagaatcaagtttcaagaatcaagagttaagaaaattccaaagattcaagaatcaagaatcaagaacaatcaagatcaagattcaagactcaagattcaagaatcaagagaagactcaatcaagataa

SEQ ID NO: 84978 - DNA, 282 bp, Glycine max
  Peptide Sequence Number=SeqID_176663
atgggtgatactgagggccctccaaagtgttttgcaggggtataccaccaactgcttgcccttcaatggcatatccgaggcaaggctcgaagtcggctagatggtgatgatgacaaaagtgatgaacaaaaagctcaagtgaatcaaagaacatccatctcaagtgaatcaaagaacatccatctcaagagaatcaagaacaagtcaagagttcaagaatcaagaagaaagcctacacacaagaatcaagatcaagattcaagactcaagattcaagaatga

SEQ ID NO: 84979 - DNA, 1080 bp, Glycine max
  Peptide Sequence Number=SeqID_176664
atggtgccgccgcccaccaccaccgcatgcgccgcgcccagattgggcagagaccttcgcgtccgtctgcatggtttgctccttgttctgaacccgctgttgcatctctcgtctgtgcccgcgcttgtgtcggcgcgcatgactgtattgggcgccgagtgtagagaagcttgcgcaggacggcatgcagatcaatctttcgatgcgcgacatcgacaccaccctggtgctgggccgcaccctcaacttccgccaggcggcggcgcagttgcacctgtcgcagtcggccctgtcgacgcagatccagcgcatcgaggaggcgctgggcgtgcggctgttcgaccgcaccacccgcaccgtgcggctgacggcggcgggcgaggtcttcatgcagcaggccgccgccctgcaggtggccttccgcgacgccattgccgcggtcagcggcatcgccagcgccgagcacggccaggtgtcggtggcggcgctgccgtcgctggccgcgcgcctgttgccgcgggtgttgatggcctaccgccaggcgcatccgcaggtggcgctgaaggtgcgcgacacgctgtcggggccggccttcgacctggtgcgcgccggcgacgtggacttcgcgctgaccgccgccgatccgcagcacgccgacctgcattaccagccgctgatgtccgacagcttcctgctgctgatccccgaggcgcatccgctggcgcgatccaaggggccgctgcgctgggccgacacggccggcgcggcgcacgtgtcgatggtgcatccgagcagcgtgcgccagtacaccgaatgggccttcctgcagaaccgcatccgcttcacgccggccttcgaggccgaacacctgaccaccatcgtggcgatggtggagtgcggtttcggggtggcggcattgccggaaatcgcggccggcgcggtggcgcagaacggcatcgtgcagcggccgctgaccggccccgtggccgaacgctcgatcgggctggtgacggcgcgcaaccgcagcctgccgccggcggccgcggcgctggtggcgatgctgcggcagtatctggctga

SEQ ID NO: 84980 - DNA, 264 bp, Glycine max
  Peptide Sequence Number=SeqID_176665
atggagactaaacccggggcgaaagagtcaccagcgcaaaagattttggttggtaatcaagaaggggaccgcttcatgtgttatattgtttggtctgaaaacctttatcacgattgcagcttaacagtgaatggatcttctttcttgggagacccttcagttccttcttccgagggtaaggataaaaatttctatcctaggttgaggtttatggccaatgagttgaggttttggctcgaaaggcttgtagaaggctggacatga

SEQ ID NO: 84981 - DNA, 363 bp, Glycine max
  Peptide Sequence Number=SeqID_176666
atggatcatgaggatccattcacacatttgtctaccttcatggagctgtgcaataccatgggagcttctgatgaaaatgttgaagttgtttacctcagagatttcttattctccttggcagaatgcaattctggctcgaaacaagctcttgactcagcattaagaggtcttgaccaagtagataggtcaacttcctcaacaatatcaacaaggtggatcatagaaaacacaccaagctcatcaagttcaacaagttccaagatgcatattctagtcccactaacatttcttttggatgtccttctaaaaactattatgtggatcattcaaatgaggatccacaacaagaaaaagctcaactag

SEQ ID NO: 84982 - DNA, 294 bp, Glycine max
  Peptide Sequence Number=SeqID_176667
atggtgggttacacaccttcaagctttgtggatttggaaagaggcaaatctgatcatcctgctttgatgaatacgaaaactggggcaaatgaagaggaattaggtaatcgattaccagtgtgtcgcaacgtgcccttttatgggcgagcgaaggcgaggctcacgggtgcgctttccaaaggaggaaagatgcgcggagtcgccaacaacgtttatttgtggaaaacgtcgggaaaaccgaaggaaaccggtcaaaatgaaaattctaagttcgggagttgtatttacggttga

SEQ ID NO: 84983 - DNA, 352 bp, Glycine max
  Peptide Sequence Number=SeqID_176668
atgactagaggcaatccatctgacttacaaccctttgatcctgagatagataggacatttcatagattagttaggtatcattttgtaccttttgatcatcctgagcattccattactgatgagtttgtgcattctgttattggtgattttgaacatcctgattttgagcattataattttgaacattctgagaacatggcacaacctccaccccgtgagaggactctaagggaaatgactgcacctgatttcacctacgaaagcttgtgcatccaataccctgatgaggatgtcccatatgttcttaaaactggactgatccatttgcttccaaagtttcatggccttgcag

SEQ ID NO: 84984 - DNA, 534 bp, Glycine max
  Peptide Sequence Number=SeqID_176669
gacactggggcagccactcctgcagacacaggcacacaggctattgaggatgagcttgagggatttctgggtggtccaagggacccatctgtgcttaccgagtatgcggatcacgttgtaggcagcgtatggacgggagatgagcatcctgagctgaagttatcctctcacgggaggaaggtgcatagtttaggcaggcatgtccctgccattgagggactagttgctggaacaggactaagtcctctgatcgcatgttcgatagacactggcgaatggggacttttgtcgtcatttgtcgagcggtggcaccgggagacttctagtttccatctccctatgggagaggtaacgatcacgctggacgacgtcgcgtctcttctgcatctgcccgtggttggcgacttgcatgcctttcagcccgtgcatgtggatgatgttgtacagatgctggtggagttattgatggtcactgcagaggctgccagggctgagacagcgcagtgtcgtggaccgtacgtacacctgcaatag

SEQ ID NO: 84985 - DNA, 762 bp, Glycine max
  Peptide Sequence Number=SeqID_176670
cgtgcgggccgccgagtcgcggcacgtcacgcatcccgcgttcggacgccgcatccgcgccctggaagcctgggccggcgcgccgctggtggatcgccagcgcgtgccggtgacgctgacagccgagggcgaggcgctgctcaagaccgccacccaggtggtcgagcagatggggctggtgcgccatcgtatccgcagttcgggcgcgggcggcgaggcggtgctgcgcatcgccaccggccgcagcctggcgcgcacgctggtggccgactggatcgcgcgcctgcgccaccgcgcgccgaaggtgctgaccgaaggcacccagctggagatttcgaccggcaagatggaagacatggcggtgcggctggagcagggcaaggtggacctgctgtgctgttacgagcatccggcgctgtcgatgcagctcaatccggtgcgttaccgctacatgacgctgggcaccgacaagctggtgccggtcagccaggccgacggccgcggccgcgcgcgctatgtgctggccgagggcgggcagccggcgccgctgatcacctacgcaggcggcctgtcgatggagcgcatcctgggcgaccggctcgaatccacgccctatgcgctggcgccgttcgtgcgcagcgattcgctcgacgccgcgcacggcgccgcggccaagggcctgggggtggcctggctgccctggtccatggtggcggcggattgccgtcgcgggacgttggtgtcgctgggcgggcgcagtga

SEQ ID NO: 84986 - DNA, 213 bp, Glycine max
  Peptide Sequence Number=SeqID_176671
atggagaattgcattaagcaatcacctgcatggctccaaactcgtgggtggaggacacatgaaccaaaacgcaatgcatggggctccgaaaaaagattgcgaatggagaattgcactaagcaatcactacgcatggctccaaactcgaaggtgggaggacacatgaacgaaaaagcaattcatgtggctcccaaaaaggtcgagaatggataa

SEQ ID NO: 84987 - DNA, 918 bp, Glycine max
  Peptide Sequence Number=SeqID_176672
atgtttataaaagtcctcggttccgccgctggcggaggttttccgcagtggaattgtaactgcgccaactgtcaggggctgcgcaatggcacaattcaggccaccgcccgcacccagtcttccattatcgttagcgataacggcaaagagtgggtgctgtgtaacgcctctccggatatcagccagcaaattgcccacacgccagagttaaacaaacaaggcgtactgcgcggcacgcatattggcggcattatccttaccgatagccagattgaccatactaccgggctgctgagcctacgcgaagggtgtccccatcaggtctggtgcacgccggaggtacatgaggatctcagcacgggttttcccatttttactatgttacggcactggaacggcggcctgattcaccatcctgtcaccccgctgaatagttttaccgttgacgcctgtcccgatctgcagtttaccgccgtccccatcgccagtaatgcgccgccctactcgccgtttcgcgatcgcccgctgccgggccataacgtggcgctgtttatcgaaaaccgccgtaacggccagacgctgttctatgcgccggggcttggcgaaccggatgaagcgctcctgccgtggctgaaaaaagcggactgcctgctgattgacggtaccgtctggcaggatgatgaactacaggcggccggcgtcgggcgcaataccggtcgtgatatgggccacctggcgcttggcgatgaacacggcatgatggcgttgctggcctcactcccggcaaagcgcaaaattctgattcatatcaataacacgaatcctatccttaacgagcaatcgccgcagcgcaaggccctgacgcaacagggaattgaagtgagctgggacgggatgcctatcacgcttcaggactaa

SEQ ID NO: 84988 - DNA, 117 bp, Glycine max
  Peptide Sequence Number=SeqID_176673
atgtggaccaccacgggggagaagcttgccgcccagctcgcccaggcgagcaaggttgcttcctccagaagcaacagccttctggaggaatcttctggagggcccaagttggcctag

SEQ ID NO: 84989 - DNA, 1146 bp, Glycine max
  Peptide Sequence Number=SeqID_176674
atgagtcatcattcatctagtgttaatggtgagggtactagtcataaggaccctttatctagaatcttagatgagttgagttccctcaagttatggaaagaaaaaatagaaagaaaagaaaaaggaaaagagactgtagaaataaatcaagatgagagagaaaaaataagggaagaagaaagaaggaaaatacttaaagagttaagaaaagaaaaacatgccacctatagtagtcatgaatcttgtaagagtctaagtaaagaacttcgtgactattatgaaggaagacataggttacatcttagacctcactcccataggagaaaaaaggaaagaaagcctcaagaggctaacattaacctcccatacttctatgggaaggacaatgtagaggcttacttaaattgggaaataagggtagagcaacaatttaaaagaaagtctactttaaaatcttatggctcttactcttatccaaagaaagaccaaggtctaggcatattaggggcaacaccttctaagcccaaagatgataaggggaagacaatagaaaagcaaccccctaaggctagtatgcaagaaaagactagctctataaagtgctttaaatgtcttggaagaggatacattacttctcaatgccccaccaagaaaaccatgactatgaggggccaagacatttatagttgccaagatgaggctactacttcaccttcctttagtgaaagtgaagaagcaaaaagggaagaatctagtgaagaaatctacccccaagaagaaggacaaccattaatggttaaggaggagtgtaaggagacacttgttagcattgccacacctcttgggcttgaggttattcctcaattaaaggagttgttgggtaagggtttggttcgtacgagcttaattccttatgctttgttggtgcccaaaagaggggttcctacgaatcctaaaagaataaaggtcattcctgagtggtccactccatcaagtgttgaggaaagaaccctagagtttcaagaacctctggatttgaggtcaaatcctttccaagggggagggaatgatgcaatcctaccctccaagggcattagatataagacttcaagaagattggaccagagatgcaagagaagaccctag

SEQ ID NO: 84990 - DNA, 1440 bp, Glycine max
  Peptide Sequence Number=SeqID_176675
atggcattggaagtgcttgaagcgctggattcagcgcgcacgcaatggtaccacgtgaccgccattgtaatagcgggcatgggcttcttcactgacgcctacgaccttttctgtatctccacggtttcgaaacttttgggacgattgtactacttcgacccgagcaccccgaatctccccgggaagctcccgctgagcgtcaacaacatggttaccggcgtcgcgattgtcggaaccctcacaggccagctcatcttcggctggctcggagacaagcttggccggaaaaaagtgtatggtatcaccctcatcctgatggtgatctgcgccatttgctctggactatcgttcggggcaacgccgaagtccgtcatggggacgctctgcttcttccgcttctggctgggcttcggcatcggcggagactacccgctctccgccaccatcatgtcggagtacgccaacaagaggacacgtggcgcgttcatagcggccgtgttcgccatgcagggcgtgggaatcattttcgcagcgatgatgacttactactggcgaatgaagatgccggagacggggcgttacactgccatcatcgaagggaacgccaagcaagccgcggcggacatggcaaaagtcttggacatagagatccaggcggagcaggacaagttggctgagttcaatgctagcaataactacccactgtggtcgaacgagttcttccagcggcacgggcgccacttgataggaaccatgagttcatggtttttgttagatattgcgttctacagccagaacctgacgcagaaggatattttccctgcgattgggctcatagacaaagactatcaaatggacgctattaaggaagtgttcgagacatcacgtgcgatgttcgtgatcgcgttgctgggaacgttcccggggtactggttcaccgttttcttcatcgagaagatcggaagatacaagatccaactcatcgggttcttcatgatgtcgttcttcatgtttgtcattggggtgaagtacgattacctcaagaacgagggcaaaggctacttcgctcttttgtatgggttgacgttcttctttgctaactttggccccaacagcaccacgtttgtgctgcccgccgagcttttcccgacgcgcgtgaggagcacgtgccacgcactcagtgctgccgcgggaaaagccggggcccttgtgggagtgtttgggatacaatgtttaactgtgggcggcgaatcgtacaagattaagaaggtaatgattattctggcggtgacgaacttgttagggttcttctcttcgttcttggttactgagacgaagggacggtcgttggaagagatttctggggaggatgggagagagagtgaactcacaccgacgcccaataatagggttcagggatcaaggactgagacgatgtga

SEQ ID NO: 84991 - DNA, 732 bp, Glycine max
  Peptide Sequence Number=SeqID_176676
atgtatcaatcatgtctaaaccaaagtcaagcttcaaaacacagcaacacaaaatctaggtgtccaaaacccctcaatttaatggattttctaggtttgagaagtgaaattgagactaagcacataaacatcacaagcatcatcataaaaaccctaaaactgaatggaaacttagcaaaactacccatcatatctcccaaaaccccatacccacgaaaatcaagagagaaagaagtccacccaaacctgaaatttcgaagtcccacacgtagagatgcgcttcacgactccgaaaatgccctcctttcgcgatttggagcagaaatgatggccaaaggttggagctttgttggagcttcaatggtggaggaagaagaaggagaaaagcaacccacagaaagtgagaaaaatctgacctttgaaacgctaaaatccttcctcggtttgcgtgccatttctctgacacctgatgagataaaggagcatagggagaagaaattgaacagtccttggagagacatgccaatttcagagtcattgaagctctttgaggatatgaaaaatggcagtatagaagaaggaaaagccacacttagaatgaagcaagacatgcagagtgataactacaatattttaccccacaccctcatgctggagacaaatggtgtatctatccaagttatgattatgcacattgcattgtggattctcaagagaatatcacacatttag

SEQ ID NO: 84992 - DNA, 153 bp, Glycine max
  Peptide Sequence Number=SeqID_176677
atggctggtgttggttcttcttcttacaaaggcaatgacaacattctcttctgctttcactgcaagtccaagacaacaaccttcattaacggatggcagcttcgaagtggcggtttagctctgctctgtcaaaactgcggttttttcaactaa

SEQ ID NO: 84993 - DNA, 276 bp, Glycine max
  Peptide Sequence Number=SeqID_176678
atggaagttatagcaattgttgttggacaaaatttaaagttggagcctctgaagcctgagaagaaggctatgtggagaagagaaatgaattgtcttctatctgtgtgtgattacatactagaattttcctcaactgcacaatatttagaagatggcacaattgtggaggaaatattggatagtttccaagatactgaattttggtacgcggagcaagggaccatatcagggaattcaactcaatcacggggaggctcatttcgaaggattgtttag

SEQ ID NO: 84994 - DNA, 227 bp, Glycine max
  Peptide Sequence Number=SeqID_176679
atgttggccgtgggtgctcgtctttgtaggcagccgcagccaccgtcgttaacattgaggtatataatgttgttcgcgctaattcataaacactcacgctcgagctcccgcttccctgtttctctaaaaccacgtgtctaccgtgacctcgccgtgaattgtggcgtttgcccgcacccccgtgacctcgtccggcgtctcgtcttgtggcggcatcgtgcaagcca

SEQ ID NO: 84995 - DNA, 734 bp, Glycine max
  Peptide Sequence Number=SeqID_176680
gacttggagttgtctggaacactgcaaaattggagtcagggtcaattgttgctatttttggccttggaactgttgggcttgctgttgcagagggagcaaaaactgttggtgcatcccaggttattggcatagatattgacaacaagaagtttgatataggatttgttggaggagcaggcgtcatagggttcctttgtcccccatggacgtcaggatgtcctgactgttgccattgggcgactagaacaccctggtcgtgtgcatatctgaatggtgcacactggcaaatggtagtcattttgcctaaggaaaaccttgtctgtgctttgaaaggacatgacgatactccacaacctaaatccaaggctggtgctaggtggattgttgttaaatgtagacatggcaagaaaatccgtacccgtgggtatccgtccaaatccatctcgactttgacgggtaatacccgagttgaccgggtatgggttcgggttttccctaataaccaaaagtcgggtacgggtacgggacagggttggggatactcgatacccaatgagtacggggataagataataaattttaacccgtcgaatatcgggtacgggtatgggaacatgttagagagtcgggatcgggaattggggagacaatacccgtctccgccccgtcctattgtcatgtctactcgagtacgcaaaatgagctttggacgaataatacttgcgctggagtag

SEQ ID NO: 84996 - DNA, 1275 bp, Glycine max
  Peptide Sequence Number=SeqID_176681
atgccagcctctccttcagagaaccgaaccagatggaggaagcgcaagagagattcacaaatcagccgacgccaccagaagcacgaggaggaggaggacgacaacaacaaaaaccccaatgcagaggaagacatcgccgaacgcgactacgatttggaggaccaaacgcaccacaaccaccctaattcgcaaccttacatggagacgaaagtcctctccgaccacggcgttcagatttcgcagttcccaacagtgataaagcgctccgtgaaccaccctcactcctccgtcaccgcaattgttgctctggagcatgccctcgagttcggacagaacaaggctccaagcaccctcgttgctccgattctcgagaatgtgtctcacgaccatcttcaagcgttgtcgtctgttcccttcgatagctttgcttttgacggtgattcctcttttgtcatcacttcccctcccattttggaaggtcgtggcgttgttagcgctacgaaactaaggctcttagtgtcttaccaggcattcttcaaggggacaaaggctgccaaacgccttcatttgaaggaacacttagtccttgatggatctggaaatcttttcaaattagctgcaccaatggaatgcaagggcattgttggtggtgatgaccaggtaattcctcgtgatgccaactatactggacctagttctcgattttgtatcttgagaccaaaattaattactgcctattgtcgggcccaagcatcagagatattgaaatctaaggagaagaatcctcaagaggcagacaatttggtcactgattcccaaaatgttgctgaagcttataacctggtaaatgattcccaaaattttggtgatgctgaccagttggtaaatgattcccaaaatcttgttgatgctgacaaggtggattcaacaaaggaagaaaaaattgaggatgttaaagtgttttcttctgtgactaccaaagcctctgagggttgcgaggatattgtttttaatcccattgttttcactgaattcaaacttgctgggagtccaaagtttatacaagaattgtgtacacttgaagtttcaccaatggatggccagacattaactgaagcattgcatgctcatggaattaatgtgttctatattggcaaagacttattgagaaagacagaggaccatgattttgcaccagcactatctcatttcctaaattgcctatttggaagctgtcaagctcctggtggaaaagtccttgctaatagcacatag

SEQ ID NO: 84997 - DNA, 243 bp, Glycine max
  Peptide Sequence Number=SeqID_176682
atggccaaggagagaaaagacagtactgtcaaaatggttaatggtaaagagagtgtaacaactaacttcaagggattactcgcgagtaaggcttctcaaagatcacctcagaatggattgttcataaattcatgttttgctcattgccaatctgagaggcaggatacatggtttgctgacaattctcctgtcattgggaacaagaatattcaccttgagaaaaattctaagacatttacgtaa

SEQ ID NO: 84998 - DNA, 48 bp, Glycine max
  Peptide Sequence Number=SeqID_176683
atgacctctccagcaataggtgaatcttcaactggtaattctgagtaa

SEQ ID NO: 84999 - DNA, 278 bp, Glycine max
  Peptide Sequence Number=SeqID_176684
ggatcacgcccgcaagacacccagtggacctgaagaagttcaacagggtcttggagttgccagctctaattatgggcctctgtcagttctacggagtgcctgtcgcccccagcaaggtcatcaggccccctactaatcgagctttcatcaagaagtactacgcccccaggcaggcgcagggcgagacaccacagcagcctagggatggccgacagcgggcaacaaacgcactgccaccacctgtagagttcaccacaactcatccacaaaaaggttag

SEQ ID NO: 85000 - DNA, 126 bp, Glycine max
  Peptide Sequence Number=SeqID_176685
aatccggttatcgactcggcagctatggaatctaagccaattgaatcagcaaccgctggtacagtaagcggtgttcaaatagccgttgttgggatcttctccgctgctagctcttcttcttactag

SEQ ID NO: 85001 - DNA, 105 bp, Glycine max
  Peptide Sequence Number=SeqID_176686
atggttaagaaagagtataaggaggatcaaggagttcccacggaccctaagagaataaaggttattcctaagtggcctactccaccaagtataaaggaaatttag

SEQ ID NO: 85002 - DNA, 222 bp, Glycine max
  Peptide Sequence Number=SeqID_176687
atgacaaccactactcatcagcagctactactaatggatggagaaagtttcaccggttcagtgcagttcacagtgcagttcacattcgtccttgttgttcttcctcaacctctcggactcaagatgcacacccgcgatgaaactacaccaagtactacctcgtgggtggaatggatgagctacaggtctagccaacaacacccttggctcaagactagatga

SEQ ID NO: 85003 - DNA, 331 bp, Glycine max
  Peptide Sequence Number=SeqID_176688
atggctccgaaaaagctttccgtgaagagatctaggagagacgccgcgactgaagggaccaatgctgcccccgagtttgatagctaccatttctggagcgccgtgcaccagcagcgcttcgaggccatcaaaggatggtcgttccacagagaaaggcgcgtccagctcagggaggatgagtacacagattttcaggaggagatagctcaccgacattggacgtccctggtgactcccatggctaagtttgaccctaaggtagtcctggagttttatgctaatgcttggcccacagaggagggagtgcgagacatgtgttcatgggtgaggg

SEQ ID NO: 85004 - DNA, 312 bp, Glycine max
  Peptide Sequence Number=SeqID_176689
atggatagtcttggtcctattgaaaataccagtctaagggaagaccctaaaattttaaccgatatagaaaaaaaaattcacagggatttggattatttagaaatggaaggttttttttctagcgatctgaatactgtttctaagaatgatgatgatcattacatttcagatagaatcgaactttcgattgattcgggtacttggaatcctatggatgaagacatggtttctctggatcctattgaatttcattccgaagaggaaccttataaagatcgtattgattcttatcaagaaaacgggattaactga

SEQ ID NO: 85005 - DNA, 282 bp, Glycine max
  Peptide Sequence Number=SeqID_176690
gtgtgcgatatatatccacgcattgaatatgctaacagccaaaccaaatacgccaaatacagtgattcaaaaagcattcaaatgcctaagctgcgccgcatttcaataatgagagtgatgagcaaaatgacggcgacaacgacgaagtctatttcgttgaagcctttgggaagagacggcaccgtgaggcgccatttggtggagaagattccgattgtggtgcctaggtacaccgtcaagcctctggcgatggtgacattggaaagcacggaccaaaggtga

SEQ ID NO: 85006 - DNA, 225 bp, Glycine max
  Peptide Sequence Number=SeqID_176691
atggctcaacctccacctcgtgagaggactcttagggagatggatgcacctgatttcacttatgaaagcttgtgcattcaatatcctaatgagggtgaagatcctcataagcatcttaaggagttccatattgtttgttccaccatgaagccccctgatgtccaagaagatcttatctttctaaaggcttttcctcattctctggagggagtggcaaaagattag

SEQ ID NO: 85007 - DNA, 270 bp, Glycine max
  Peptide Sequence Number=SeqID_176692
atgatacgcggagataccttacggttatccgcacccttttgtcatccagaggcggcgggcccgatgacaagcagagaccaagtttggtcattctgcacccatgatacgcggagataccttatggttattcgcacccttttgtcatccagaggcggcgggcccgatgacaagcagagaccaagtttgggtcattctgcacccatgatacgcggagataccttatggttattcgcacccattcttttgctatctgtaagacagaacgcttga

SEQ ID NO: 85008 - DNA, 167 bp, Glycine max
  Peptide Sequence Number=SeqID_176693
catcctcttcaagcttcttatccaaggcaattcttggtggtgaagctccttattccttggcttattccctagtggatgctcaaagatccagcctccatagaagctccacaagcaagcttccatcaagtggtatcagagcacaagagcttcaagtaggtgctccttaa

SEQ ID NO: 85009 - DNA, 825 bp, Glycine max
  Peptide Sequence Number=SeqID_176694
ttctatgcaaacctatacaactctgatggtccttcaccaaagcaagccagggttagaggccatctagtgaagatcgacgctgacaacctcaacgtattcctagagacacctgtggtgttggcagagggtgagactttgcccacatactccagatactgcaggctgcctttagatcctagggagattgaggctgccctatgtataccaggccgagggttcatcttgaatgctgagggccattctgggaggatcctgaggaaggacctgacgactttagcccaggtgtggagtgttctctcatactccaacctgacccccacatctcacacatctgacctgatagtggaaagagctaggctgaactttggcctagtctctcgcatggacatgaacataggagctctcatttatggccaaatgacttctatagcccaatctaactcttctagacttgggtttcctgctctgattactgccctatgtagagctagaggggttgtctctgacaacctcacttttgagtgcctgagcccgatcattaacttagcctacattaggaagaactgttggaatcctgatgatctaacagtttctatccgaggggctaggaggacgaaggcgaggccaactgagcttctttccacatttgcagctcctactccagcatccacttcagcaactccttcagtcccagctcagagtgattctcagcgctttgaagccatgcttcagagcattcatcagggacagattattttacttcaaagtttacaggtgggggcatctccaggattcattccttctgttgagcagtttctagagtga

SEQ ID NO: 85010 - DNA, 396 bp, Glycine max
  Peptide Sequence Number=SeqID_176695
atgggttcaagggccttgctactccaacgagggcaccctttatttaggcttcttcagtccatcggcgagaacaaaacaagccctttaagcagaacgtcatgccattgggttgatcgagtgagactccctagctgtagctcgaattgctattgcttgattgagcattcaaatccattctcttcaattggagaggaagccagcataagggagcccattcaacctaaagctaacaaagacttatggcaaggaaatctattccattcattcaggcttttctatatcttgaaaggttcattcctactacttcatttaagactttcaggcctctctcctgtcactagctgccgagtgtgccttgtgtgtgtctcagtggaatcaaagcccttccacctttga

SEQ ID NO: 85011 - DNA, 183 bp, Glycine max
  Peptide Sequence Number=SeqID_176696
atggcttctaggaaaagaaaggaaccatctacacccacccaattcgatgagttcaaggaggaacttgaaagacgccactgggacgaggagttgactgactttggggatggcaacattgatgttgccattgtgaaggaattctacgtcaacctccttgaccccgaggataaatcacctaagcag

SEQ ID NO: 85012 - DNA, 457 bp, Glycine max
  Peptide Sequence Number=SeqID_176697
tgccgctattggtgcgagttgtaaggagtctggtctcgagtcgagctgggcgtcatttcattctcgtaacgggagtgagtgcacgcaagatcagacaagttactccctcgcagcgccattccccgaaaaagggagagacgagggaatcgtccgctcccgttcatgtgacgaatcgaacatcgttaggtcccgaattctgcgaaccaccggacctagaccaagatctccattacgtcgtacgatatatcgatccgaagaactttcagttctaaatgtcgagcgcttaagcggagcttgtggtcactcgttcctcgcttgttccaatcctaagcatgcccgagggggctactacgctcaccgcgcacttgcatcaccacctgagcttcgctaccgcttcgcccagctcctacgcctaccacgaatcttgaatcatcacgtggctgctaaagcaagctaa

SEQ ID NO: 85013 - DNA, 387 bp, Glycine max
  Peptide Sequence Number=SeqID_176698
atgcggagacaaaatttggtcattccgcacccctttgccattcagacacagtcgtgtccgatggcacgcagagacaaattatggtcattctgcacccttttgtcatccagaggcggcgggcccgatgacatgcggagacaaattatggtcagtctgcacccctttgccattcagacacagtcgtgtccgatggtacgcagagacaaattatggtcattctgcacccttttgtcatccagaggcggcggacccgatgacatgcggagacaaattatggtcattctgcacccttcgtcaatcgcggccgacaagcccgtcgacacgcggagatttacatcatcttccgcacttacaagatttgtcatactgacttttgagtcatgctga

SEQ ID NO: 85014 - DNA, 324 bp, Glycine max
  Peptide Sequence Number=SeqID_176699
acttatcaaggtaatccttgtggcgtctaccctgacttatcttcgttcaccggaagtggcgtctaccctgacttatcttccttcattggaagtggcgtctaccctgacttatcttccttcaccggaagtggcgtcatccaaaccttcgtagcctgtatcaaacgatccgccccacttatcaaggtaatccttgtggcgtctaccttgacttatcttctttcactggaagtggcgtctacccggacttatcttccttcaccggaagtggcgtctaccctgacttatcttccttcaccggaagtggcgtcatccaaatatccgtag

SEQ ID NO: 85015 - DNA, 261 bp, Glycine max
  Peptide Sequence Number=SeqID_176700
atgatgaaacagcagccatcgaatagcggtgttttgatgaccccacgaaagaagcccgcaagaggatccttattttacactgttggcggttggggttatggtcaagggtcgggagcagtgcaacaacagcggaaggcgaggtgggcacaaaacgctatcatcggtcgtctgggcagtatggagagtagtgtcgggcatggaccacgtgactgtactcgcagttcggagtggacgatgcaacagatggggtttggctcatga

SEQ ID NO: 85016 - DNA, 567 bp, Glycine max
  Peptide Sequence Number=SeqID_176701
gacggaccactcttacgagagttcaacacggaagaagaactcgaaaagatcgcaagtgaactcgagcgggtcgatgatgcgacgcgggctcgtatgtcagaagtgatcttatcaaaacgaaaagatgagccgacgcgatacgagatttttatgaacgatggcaacacgttactcacaccgacattgaagttaagcgagaccgtatcaaagtatatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacgggggcggagatttcctggaagatgccaggaagatacttaacagggaa

SEQ ID NO: 85017 - DNA, 367 bp, Glycine max
  Peptide Sequence Number=SeqID_176702
atggcaattgtatcaaagccgagtgaagaacgccttcgccaggaagcgttcgctaagcgcaacactcctgggataagcacgaggaagactctggaagaagatgagctgtatagtttggactgggattcagagctttgcatgtctagggtttctagagagataaaggttcaagttccaaagagttttgagagattttgctgtgttaagatctgcagagaccagagcttgaagcaggagccggcttcctggaatggaaagctaaatcctctgttggatcttccctataagtacttgattggaaactggtctgactctaaagtccttgatagtacagggctgagttgtcgtgctttcacgaggaatcggg

SEQ ID NO: 85018 - DNA, 309 bp, Glycine max
  Peptide Sequence Number=SeqID_176703
atggctaagtttgacccagagatagtcctggaattttatgccaatgcttggcccacagaagagggagtgcgggaaatgcgatcatgggtgaggggtcagtggattccctttgatgcagatgccctcagccagttcctaggtgacctgctggtgttagaggaaggccaggagtgcgagttaagtcagagaaggaacagggccgacgggtttgacaaagaggccattgcccaactattatgtatatcaggtcaggattttgcccggaccgctacagggaggcaggtatgccacccaccaggcaccctctag

SEQ ID NO: 85019 - DNA, 1338 bp, Glycine max
  Peptide Sequence Number=SeqID_176704
atgggtgacaagcttgctagcttagcttttctgttcaaggatatgtactgggtggaagagagtggagcttcttcccttgttgctgttgttgttgttgttggtgaccgagcaatgttggaaatggagaaggattttgattccaagctgaagattcaggggaattcctcatcttccaatggtgctgggaatgtacagagatccaaaagctttgcttttagggcaccccaggagaattacactatccaggactttgaattgggcaagatctatggtgttggctcttattctaaggttgtgagggcaaagaagaaggacactggaattgtgtacgcattgaagatcatggacaaaaaatttattaccaaagagaacaaaacagcttatgtgaagttggaacgcattgtgctagatcaattggatcatccaggcattgtgcggttatatttcacatttcagactcattttctctataaaggtcgtctatcagagaatgaggcacgattctatgcagctgaagttatcgatgctcttgaatacatacataatttgggagtcatacatcgtgatattaagccagagaacttattacttaccgctgaaggacatattaaaatagccgattttgggagtgtgaagcctatgcaggatagccaaataactgtccttccaaatgcagcatcagatgacaaagcctgcacttttgtgggaacagctgcttatgttcctccagaggatttggaccccagcaggagaccaggtgctggacctgatggttatgctattttaaaaagtcacccatttttcaagggggttgactgggataacttgagggcacaaattcctccaaaacttgctccagaacctgggactcagtcgcctgcgtctgatgatgttcatgactcatcgtggagtccttctcacattggggatggttctgcagcttcggttagacaacctgacggtgctacatcttctgaggggactggtcacataactaggctagcttcaattgattccttcgattcaaaatggcagcaatttttggaacctggggaatctgttcttatgatctctatggtgaagaaattacaaaaactaacaagcaagaaggtgcaactcatccttaccaacaaaccaaagctgatctatgtagacccatcaaagctaattgtgaagggaaatataatatggtctgataatccaaatgatttaagcatccaagtggctagtccatcaaatttcaagatttgcacacctaaaaaggtaatgtcgtttgaggacgcaaagcaaagagcatggcagtggaaaaaggctattgaaggacttcaaaaccggtga

SEQ ID NO: 85020 - DNA, 1239 bp, Glycine max
  Peptide Sequence Number=SeqID_176705
atgggtgagattaaagagaacgttcctcttccgaagaccaagccttccactgaacaggacgttacggatgagctagacctgagaatgaagaagtatcttagaggagaaggtgctaatttggagggtttgaaggataaaaagctgaagggtcaactagctgctaaggaagacttatatggaaaatctgctaaagctgctgctaaggctgagaaggaacatggtccagtgttaaggcttcagtttctggaaaaccattttctcttggcttcaatcaacaagtttggacaacttcgttatcaggacgttacaatgggttccatggtcggtaattttcgaactggcttaggacgtacaaatgtaatgcaagtgaaccccttcaatggggttgtttccttaggtcactcaggtggtactgttaccatgtggaagccaaccagtgcttctcctcttgtcaagatgctatgtcatcatgggcctgtctcagcactggcatttcattcaaatggcctcttgatggccactgccgggaaagataaaaaaattaagctttgggacttgaggaaatttgaggttcttcaaaccttaccaggtcatgcaaatactctggattttagtcaaaaaggcttgcttgcttgcggtaatggttcattgatacagattctgcgtgatgtttctggtacacaaaattattccaagtatatgactcattccatggtgaaaggttaccagataggaaaattggtatttcggccatatgaagatgttctaggcatagggcattccatgggctggtctagtattcttactccaggagcaggagaacccaactttgactcatgggttgcaaacccgtttgaaacttctaagcagaggagagaaaaggaaatacggtctcttcttgataagcttccacctgagactatcatgctggatcccagcaagattggtacggtgaaaccaagaagagagaggccaacaaagcaagagagggaggctgaaatagaagctggcgttgaagcggctaagggcatgaaactgaaaaagaagacaaaaggaagaaacaagccaggtaaaagggtacagaaaaagcaagaggcagtttctagagtgaagaggccctacttggagcagaaaattcaagaagaggaaagcatatcaagaaagaagcagaaaactagtgaggatgttgaactaccaaaatcactacagcgctttgctcgtaaaaaagcatcatcatga

SEQ ID NO: 85021 - DNA, 1047 bp, Glycine max
  Peptide Sequence Number=SeqID_176706
atgtccgacaaagaacttttcaacagcatatgtggaatagcaatatttctagtttgtggtcctgaactcgaccttgtagcccttgggccaaaaaggttgaccccagagatattagggcacatgacgatagatccccagtcattgatgttggttactgtgattcggaatctacagaagttgggttatgtctttaagatatttgcagtaggacatgggaaggcccgctcaatatgggaaaacataggtggcggaatctctcctttgagtgcaaagcatcaaggcctgatcgattggtcaatttttgaaggtatcattgttgactccctagaagcaaaagtagccatttcaagcgttatgcaggatcctttttgttctgtaccattaatatggattattcaagaagatagcctttcaagtcgccttccagtttatgagcaaatgggttgggagcatattgtttctcattggagaagtgcttttagcagagctggtgttgttgtgtttccagattttacttatccgatgttatatagtgagcttgacactggaaacttctttgtgattcctggatcaccagtggatgtgtgggctgcagaaagctatagtaagacccatgcaaaggatcagctaagagaacttagtggatttggtaaaaatgatatgttggttctagttgttgggagctctgtcttctatgataacctatcttgggactatgctgttgcaatgcattccgtagggcctctgctgacaaaatatgcaaggaggaatggtgcaactgactcatttaaatttgttttcttatgtggcaattccactgatggttatgatgatgctttacagggagttgctttacgtatgggacttcctcatggttccataaggcattatggcttgaatggtgatgtgaatagtgtgttactaatggctgatatcatcctatatggttctgctcaagaggtgcagggttttcctccattattaatcagagcaatgacttttgaaattccagtcgttgtacctgattttccagtgttaaaaaaatat

SEQ ID NO: 85022 - DNA, 447 bp, Glycine max
  Peptide Sequence Number=SeqID_176707
atggaacggggacaactctggtctagaaatgaagctcaagtctggggaacttttgaagcatatcccttggaagaaagttatcgtcatcagctagcaaggcatctctgtgagatcaataattactcatacaaaactgtagatccaaatctgccaagttcatctcaaaggccaaaagaaagttatcctactgataggataatacccgagaataccgatgatggacaaatcagaacagagttttatgttccagaaccagtgttccaaaaggcagaagatttagctgatgattattcttcattaaacagagattgggaagactataatgctcaattaatggaggacttattgcacaagaagaaataccgttatcatcacccgactagtgatggatggaaaacagctgtacagaggtgtgttggagaacagctgtacagaggtgtgttgtag

SEQ ID NO: 85023 - DNA, 1132 bp, Glycine max
  Peptide Sequence Number=SeqID_176708
gcaagccttcgaatctctgcaaccatccctgagaccccctttctccttatccattctcacccccgaccaatacgccctcctcaaccgcgcaatcctccacggcgttttaacggagcctcatttggccaatacccacatcaaacacttgcatgcaatcgtcgccgacgcccacgccaccttcctcagcttactcctcaacgccgtcctacaactctaccccaaactcctccactccgtcaaaacgcagttactcaggctcaccgaggaaatgcttcgcgttttgggtatcggatacgacgccgttttgctcttccttttgcgccaaatcgccgccgccgattgcaccgatgccaacttatcgctctgctccgagttgctgacccttttcttaaaacaatttgaacccttattggaaggcgcgcctcatgttttgtcgtctgcgttgtacacgtttcttagggttttatctgataaatttagggttagcatcgaaaagttggagattttgaagcggagggagattcatctgtgcgtgaagatagtgagggaagagtttcgcttgtgtttgaaaattgggagggattttattcgcttgttgcaggatttggctcatgttcccgaattcaaggccatattacaagacattgtgttcaatccatctgtgtttaatgtttttggttttaaggatcgtgataaagagtttgttatagtcgatattgtgaggtttatatgctgtgcacaccaccctccaaatgagatcattcaatcagatatttttcctaggtgggtgcttattggttggcttttgacttgtaggagtaaacaagttgaggagagtgtgaaactggctttgttttatgactggctcttctatgatgaaaggatggatggtatcatgaacatcaagccggcggttctgctcatggtgcattctgttcccaagttcatcaacgtgacttgtgctcttcttgagttcttgtcgcatcttgtggatcgttatgacgtgggacggaagggtgtcattgttaaagggtctgaaaaggttgttatcagatgggaaggttggaagctcttaagggatttctgccagaaggatagttgctacttgctaatccacaatggccacctttga

SEQ ID NO: 85024 - DNA, 303 bp, Glycine max
  Peptide Sequence Number=SeqID_176709
atgggcccgaaatctaccctaaggctcatgagaaccctagggccttttcttgtatctctgacccaatcttcttggagtattctatccaatgcccttgcggggtttgtcatcatcaaaaagggagagattatagaagcaagcttcatgatgatgaaccaagcaattttgatgatgccaaaagaccaagtgattgattcaagattgattcaagacttcaagatcaagcatcaagaatccaatccaagattcaagattcaagagaagaaatcaagaagcaacaagtcaagacttcatataggataa

SEQ ID NO: 85025 - DNA, 219 bp, Glycine max
  Peptide Sequence Number=SeqID_176710
atgagaggactacacgtcctcaccatcagagggctgcacgccctcacctccagaggactacacgtcctcgccttgagagggctacccgccctcgccttgggtactagttaccctcaccttcagaggactccatgtcctcactttcagagggctacacgccctcgccatcagaggactgcatgtcctcaccttcgtagggctacacgtcctcacctttag

SEQ ID NO: 85026 - DNA, 190 bp, Glycine max
  Peptide Sequence Number=SeqID_176711
tgattctcctcaaatttcagccagcccgcatcaattagaccttgcaccttatgcttcagggccctacaatgctcaatggaatgccccgaggctcctccatgataagcacacgttgtgctcgagtcgtatcctcagagaaatgaaggtggtgttcgtcattggaagtgcggtagacaggctttgtggttga

SEQ ID NO: 85027 - DNA, 390 bp, Glycine max
  Peptide Sequence Number=SeqID_176712
atggcgcctaccaggcatcctttggatctagataagtccaacagggccctgggatttccctcgctgatcacaggactctgccagtcattcggagtccccgttgcacctaccaaggtaattcggccgcccatcacccgggcttttattgagaagtactgtacccagagacaggctcaggatgagcctcagcatgcagagccagggcttcgcttctttttcatgccctactccagaccagttcagggtagaggtcgcatggttcccggagattggcccgaggcccaagcaggagaggcacccccagaagctcccggcgacggagaagaggcccacgaggatgaggagatggccgatttgcttgacttcttgggagggagtggagatacgtga

SEQ ID NO: 85028 - DNA, 931 bp, Glycine max
  Peptide Sequence Number=SeqID_176713
atgtccgctcctgagccatcgcctcgtgtacgtgaaaaagaggagaatagattgggaccagctcttggccgggataggaggggttgtattaattacaatcccacgctagctataagacaactagggtaccccatgaggggagcaccgacggaagaaagcatgtctcctttcctggtgagggatctcagcgcgggaaattccaagactatacaaagaggggggaaagatcaagagcttagaggcattcgtaatggcatcattggtgggtaccacgaatggctgaaagttcgcatacgaggtttagattggctcgccaagttaaaagtcgtcagcgaagagaattttgaagcaccggaagaggacgaggaagtccaagctctcaaaagcgagttaggaaaggcaaaactcgccaaggagaagttcaagttggctgctacacacgttcggaagaagtgtgccgggttacgggaagagaatgcaattaccgcaagagcccttgaacgagagaccaagagggctcgcaaggaagatgaactcaagttgcgaagggaagaaagggaccagtcgcgagcacatagcatggttctgaaagagggagttgattgcttgttcaaggtccaaaagaagcttgtctcagcgtttatgcgagacagagaccaacatgttagctatcatcgccaagtacgaagaagagttaggtctggcacggcccacgagcatagaatcgcggatgagtatgctcaagtatatgcggaaaaagaggctagaggaagggtgatcgactctttacaccaagaggcaaccatgtggatggatcggtttgctcttaccttgaacgggagtcaagaacttccccgactgttagccaaggccaaggcgatggcagacacctactccgcccccgaagagattcatgggcttctcggctatt

SEQ ID NO: 85029 - DNA, 402 bp, Glycine max
  Peptide Sequence Number=SeqID_176714
atgcagagccttcagagcatgggccctccatccatcatgagcatggatgagtttgacacgcaggtagcatggccaggagcccagccttctccttctggagagggtggggcctccacagcccaggagcctgagccagaggagccaacagcagcagtagagggggaggatgagctgactcctcctaagaccttttattttgatgcaggtgtacacatggctcaggaggaggagacttccacagaccagattccaaagccatcttcaatacccatacctgatgattccatgccagctacaccaacatctgagctagagcagcctatccctcaggattcaccaattgctcaggtgttggatctctatgagcatgcacaggagcaatcacaggagcaggacatttaa

SEQ ID NO: 85030 - DNA, 315 bp, Glycine max
  Peptide Sequence Number=SeqID_176715
atgcagagactaacatcgtcttctacacctttgtcattcagagacggcgagtctgatgacatgcggagatacccaagtggttatccgtacaaaatgatttcagttaatcctgaccggagaagtcaggtggcaggcggaaataccccaagtggttatccgtacacacacagttctactaccccgacctgtgagaagtcaattagcatgcggagacgttctatatggaatttcaatatcttcatgccttcacgggttttactgcttggatttgcgctagtggccggtcgggtaaagattcaggtcgaacgaaattag

SEQ ID NO: 85031 - DNA, 147 bp, Glycine max
  Peptide Sequence Number=SeqID_176716
atgcatacgcatacgcatgcatattgtgtggtaaacaggggcaggatcatcttgagctacttctgggtgggggcaaaacatgaacaacaaaaccaaccaaggtacttaggaacggatgcaattggggatggggtcacgaccgactga

SEQ ID NO: 85032 - DNA, 123 bp, Glycine max
  Peptide Sequence Number=SeqID_176717
atgtcacggaacttcacgaattgcctaacgatgagtgccaagtacctcgaagtggtcaaacgagggtcgcatcccaacaatggatggtccccggacgaaattagggaattaatgaaacattga

SEQ ID NO: 85033 - DNA, 78 bp, Glycine max
  Peptide Sequence Number=SeqID_176718
atggctaagcgtaccctatgcgctaagcctaagtgtcattctgatgaggctgagctaagcgcgccatgctgcggctaa

SEQ ID NO: 85034 - DNA, 330 bp, Glycine max
  Peptide Sequence Number=SeqID_176719
atggcaccttcgaccgaagatgtgaagaaagcaatgcaaggattgtttgctgtactccagctctctatgtggggctggtttcacacctttttctccaagaaggtaggcccatctatccgctacaaggttaccgctcgatgtccaaatgttccctggatgggaacatggggttgtattaattataatcctgtcctcgccataagacagcttggctaccccatgagaggagcgccattagacgaaagcatcacgcctttcattacacggggtttcagtgaccccaatgcaagggtactccaaggagttcgcaaggcatgggatgcggcgtga

SEQ ID NO: 85035 - DNA, 138 bp, Glycine max
  Peptide Sequence Number=SeqID_176720
atgtatttggccactggtaatcgattacatcctctgtattgtcttgaatttttaatcttgaaaagcccatttgcatcagttgcaacacatcatcatgatcatcatcaaaacatcaaagccaattgcatctacaggtag

SEQ ID NO: 85036 - DNA, 149 bp, Glycine max
  Peptide Sequence Number=SeqID_176721
atggtgacaatcaacaaaggtagaattcttggagtgggtaaaataggtacaaattcttcaaactccattgaaaaagttctacttgttgaagccttaagcatagcctgcttagcgttagtcaactatgtgaaagagcatactcatcatgg

SEQ ID NO: 85037 - DNA, 291 bp, Glycine max
  Peptide Sequence Number=SeqID_176722
atgggtgccaagtacctcgaagcggtcaagcaaaaggttgcatgccatcaaacaatgtccccggacgaaattaggataccttgtttagattctaggagagcatatggttcaaggaaaatttaccccttaccccaaatttgggggagtggaactaattgggagcaaagaaagagattcaaagcatcgccaccaacacagagttgcttcctccagaagcaaccgccttctggaggaacatcttcgaaggcccaagtgggcctggttgctatttgcaccccctttttttactaa

SEQ ID NO: 85038 - DNA, 238 bp, Glycine max
  Peptide Sequence Number=SeqID_176723
gcgagctaggttgcttccaccttaagcaagaaattgcccagaaacctttagaagggcccagatttgataattactatttgcaccctgtcgcaacctacccttcggcgggagggcgacgcgagactcgcgggatgcgtgttccacgaaaggaatacgcacggagtcgccaccaacgtttttttgaggaaaacgtcagaaaaaccggaaaagacgcgatctacgaacttttaagtgaaag

SEQ ID NO: 85039 - DNA, 217 bp, Glycine max
  Peptide Sequence Number=SeqID_176724
atgcatgagaacaaatggcacggagcgtgtttgctctttgcccctatttgggaacctataggaaaatatctaggggcgaggctcacaggtgcgctttccaaaggaggaaagatgcgtggagtcgccaccaacgaaggtattagcacctctcacgtcgacaaaagcggggctcttgctcctacgtaccctccatcgaagaggaaatcagacctacgta

SEQ ID NO: 85040 - DNA, 402 bp, Glycine max
  Peptide Sequence Number=SeqID_176725
cttggagggattgatgggaacccgatgttgagaggaacgaggataagggctatgtgggagtacgtgagctcagttgaaggtgggcaactggggatggtggatttatgtgtgatttgtggatgtggagagtcgacttgcaccatcgcccgatcgccacctagtaccacatatgacggagtggtacctggagatatgtcgcgggggtcaggagaccttggggacgtcaggcgagctcctggcaatcaaccgataaaagaacaaagaccacaaagcaaggaggcttgtgtggtggctggccagctatggatcttgagtgatatttggaatatggcctctggtaatcgattaccaagggcttctggtaatcgattaccaatgggtgtaatcgattaccaggcttag

SEQ ID NO: 85041 - DNA, 156 bp, Glycine max
  Peptide Sequence Number=SeqID_176726
atgacatgcgggggtaccttatggttatctgtacctttgtcaaccagagacggcgagttcgatgacatggaggggttttactttcgtcatccagagacattcaagtccgacgacgtgcaagattcttctctgctaggcagggacgatcgagtttga

SEQ ID NO: 85042 - DNA, 528 bp, Glycine max
  Peptide Sequence Number=SeqID_176727
gccccatcaaattcgatggcaagaacacgatttacagcagcatttcgtgttcacaagaacatcattgaagttctattgacttaccatagacaatggaggccatattacccaacttatgttttatttgactacaatggaaccaagcattttgttaaggtgtgcaaatatggcacacgatgcttttttgctgatgggctgaaagagtttagaagaacccacggcattaatgacagtgtcattatccggttttttgcagcctcaaaagatacttcttttgaagttgacatcatgggacctatccttagacagacatgtcgaaggccggttgttacaaccagaaggcacatctttaccgctgatgtcacgcaagacatgatcgaacataccaaccctttggttcttccagcaacagctttaaattttttgtttggatcaaaaaaatatgttcctgttcagcgtccaagtggcagacgtaaccaatggcagagcaccgtgcacaacggtctgccatctgttgcagatccatga

SEQ ID NO: 85043 - DNA, 489 bp, Glycine max
  Peptide Sequence Number=SeqID_176728
atgcgattagggaattccgacgtgtatggattccttgagccacagtgcatccaaaaatctttgcaatcgcagtttgaatcagaaagttacatcaagaactggatgcagagttcaaaatgggatgtctacctaggagcctacctgaatggtgcacactggcaaatggtcatcattttgcctaaggaaaatcttgttgtccggttttgttccttgcataataggccagacaactatctgaaaggaataattaacagtgctttgaaagaacttaacgatactccacaacctaaatccaaagctgcaggtgctaagtggattgttgttaaatgtaataaacaaaaaggaagcactgagtgtggctattacgtgatgcactggatgtcaactataatcttaggaagtttcaggaataattgggaaatgaccactggaattagacacattgaaggcgcttcgcatccagtgggcaaactattatctcaaagttag

SEQ ID NO: 85044 - DNA, 390 bp, Glycine max
  Peptide Sequence Number=SeqID_176729
atgacgacactcgctcagacatggagtgtcctctcttactatgatcttgcgcccacttctcacacatctgatgttaatcttgacagggcccgcttgatttacggcttgcatatcagtcagattgcccagtccagcacctcgaggctcgggttcccagcattgattacatcgctgtgtgacattcagggggtggtttctgataccctgatttttgagtcactcagccctgcgatcaacttggcttatgtgaagaagaactgctggaaccccgccgatccatcgatcacctttccaaggactcgccgcacacgcaccagagcctcggcgtcggcatcagaggcccctcttcctacccagcctctgtctcagccttcttctcagagaccgtga

SEQ ID NO: 85045 - DNA, 110 bp, Glycine max
  Peptide Sequence Number=SeqID_176730
atgggaagatggtgtgtcaacaacttccaactcttcagtgatgaagaaattgcaaatatatacttaatggcgaagttcatgaatgatccatcaacaaatgagaaactaag

SEQ ID NO: 85046 - DNA, 605 bp, Glycine max
  Peptide Sequence Number=SeqID_176731
gtgggcaactggggatggtgtgcttatgcctgggcttgtggaaatggaatatttgctttgcgccatcgcccgaccgccacctagtaccatatatgatggagtggtacctgaggatatgtcgcgggggtcaggagaccttggggacgtcaagcgagctcctggcattcaaccaataaaggagcaaaagtgcacgaggcaaggaggcttgcgtggcagctggccagctaactatcttggagataattatatgaaaaaaatgcccactggtaatcgattaccagagagtaaatctcttgaaaaagacattttgactatcgcgatggcagcgcagttgatccatgatcgcgtcgtgatggagtgcctagagggtgtttgggagaccctcgagggaaatgagaggtgccaattccgcggcatagttcgactcactgctacatcgcttgtgtcatcctccgaagaggatcctgaaggggacccagaggagttatctcctgaacctgctatggatgcccctgacttaccagaggatgatgaggacccacttcctgatgttgattctccagaggatattatgccagcacctgaggcaaactctacagaggaga

SEQ ID NO: 85047 - DNA, 510 bp, Glycine max
  Peptide Sequence Number=SeqID_176732
atgaagcaaatagcctcaaggaaaaccatctccatcaatattccacttgcaaccattgctagaagccatatggatccttcaatggacgtggattcccccttcaaagctcattctaatcaatccagccaatcccatctcgcatatgttgagtactcaacgataggtggcatttttgctcaaatgtatgctttaaatcaggctataacatacccacctagtcttcataccagtagaaccattgacattttgatggcttcgtcatccgattacaatggccaagacactgtagaccatagtgacaacattcaagtgttgcatcaacaacaacaagcaagactagagcaacaagcaatgtacgacactgccaagattaatgaggttctcatttacctcactatatctagtgttgtgcatgaagatgaagtacctgaagtgtcctatattgcgtccaatgctgcaaaggctaatgaggtcattccaactggtccatctgaacctgtgtccaagtag

SEQ ID NO: 85048 - DNA, 237 bp, Glycine max
  Peptide Sequence Number=SeqID_176733
atggcagaaaactctcccaacttcccttttgctctaagacacacgctctcaaaagatcctccaacaactgaatggtccattcagtttggccatcagtctaaggatgaagaatctggcaaggcatcaatattaaggccgcacgcaaagcgcgagatcagtgcgctaagtgcagtaggtgcgttcagccaggctaagcgcgagactggcgctaagcccaatttcacttactcgcgctaa

SEQ ID NO: 85049 - DNA, 729 bp, Glycine max
  Peptide Sequence Number=SeqID_176734
atgcacaagatatacaaactatgtggttcaccttccgatgagtattggaagaagtcaaagttgcctaatgctaccttgtttaaaccacgcgagccatacaagagacgcataagagagacatttaaagattttttgccttctgctctacctctgatcgatacacttcttgcaattgatcctgtagaacggaaaactgcctcagatgctttaagaagtgaggaaccttccgtggcttttgcaattcaaattttggatggaacgcctctttgccctggtggcaagattcctatgtctgtcagccaggctaaatttgagcagcaagataactgttattggattcctatgacaagagacaagtttgtatccaagcatgtagacgataaaaaggaaaagaaattgaaaaaggtggaagacaaaatgcttggatgggcaatagttgacttaaaagttgacatgagatgggagaagctacaaaaaggaattggattagagatagttaaacagttagcttcagttggaatcaagatggtgctcacaacaagaaatgaagagaggggtctccaagcacgggaaacactcaaagccttaggttcttctcaccttggactgtttcatcagggagaaagtatcatttttttctacttgacaatctccttgtattctaaatcatctaccgatgccgaggatgcgggatttgatgatgtcattgttgaggatcaaattgataag

SEQ ID NO: 85050 - DNA, 315 bp, Glycine max
  Peptide Sequence Number=SeqID_176735
atgttttggggagaaaccggccaaaaacacaaaaacaagagtataattagcaaagtggggcttaacactcatcgcagtggaattcgtaaagttccaggacgtttcggaaagaaaacaaccaaaaacacaaaagtgggggtgaacttatcaaacacagggggtgcgctcaggaaacttcatctagaacattatagaaggggggtgaacttatcaattaccgggtgcattcaggaatcttcctcaagaagcctctgggtggcaatcacctccattttattaaaaaaggcattcgaggcttctgtaatgcttccgtaa

SEQ ID NO: 85051 - DNA, 900 bp, Glycine max
  Peptide Sequence Number=SeqID_176736
atggtagaagagtttgaagagatcctgggatgcccgctgggaggaaggaaaccgtatcttttctcagggttttatccctccttggctagaatttccaaaatagtcaaaatcttggcacaagaattggaccaggggaagcaagtcgaaaatggggtggttggagtaccaaggaaatgttcggaagcaaaggcaagagccttggcaagtcaagaggaatgggcttcgttcattgatgtcttggcactattgatctttggggtagtcctctttccaaacgtggatgggttggttgacctagcagcgattagcgcttttctcgcctttcacgatcgcaaggaaagctcggtcgtcgctatattagccaacctgtatgacgcattcgaccgaagatgtgagaagaacagtgtaaggattgtttgctgtatgccgaccgtctacgaaggaagaatcgagattcttgtctcatgtggaggatttccaaatgttctcttgacggggatgaggggtttcaatagccccaatgcgggggtgcttcaaggggtccacaaggcatgggaaatggtgcaaaagaaggataaagaacttaggggaagtagcaacggggccgtcggtggctaccataggtggttgaaagcctatgtacaaggtctggattggctcccgaggttgagagccactaaagaggtggaggttgaagccccagaagaaagtgaagaggtacaagccctcaaaatggagcttgagaaagcccaagcggtcaaggaaaagttcaagtcaacagccgttaggatccaaaacgagaacgccgaactgagagatgtcaacatagccaccgccaaggccttggagcaagagaccaaaagggcccgcaaggaagagcatggtcggaacaagttctga

SEQ ID NO: 85052 - DNA, 723 bp, Glycine max
  Peptide Sequence Number=SeqID_176737
atgacccaagagctggtagcccgcggagacaccttacggttatccgcacctcgtcattcagtgaccccaagtgtgattggtgagcagaggccaatgtggtcatctgcgccctttccggagatgtcagcaccttccggtggagactttttcaagtctcacaagttatctagacaaattatggtcattctgcacccctttgccattcagacacagtcgtgtctgatggcacgcagagacaaattatggtcattctgcacccttttttcatccagaggcggcgggcccgatgacatgcggagacaaattattatcattctgcacccctttgccattcagacacaatcgtgtccgatggcacgcagagacaaattatggtcattctgcacccttttgtcatccagaggcggcaggcccgatgacatgcggagacaaattacggtcattccgcacccctttgccattcagacacagtcgtgtcggatggcacacagagacaaattatggtcattctgcacccttttgtcatctagaggtggcgggcccgatgacatgcggagacaaattatggtcattccgcacccctttgccattcagacacagtcgtgtccgatggcacgcagagacaaattatggtcattctgcacccttttgtcatcaagaggtggcgggcccgatgacatgcagagacaaattatggtcattccgcacccctttgccatttag

SEQ ID NO: 85053 - DNA, 267 bp, Glycine max
  Peptide Sequence Number=SeqID_176738
atggataacccttgggtgtctccgcatgttatcgaacttgatcgtctctggttagcaaagacgagtcttgcgcgtctctggatgacaaagctgaagacaggtgcggataaccataaggtgtgtctgcgtgctaccggacccttgggtcacgatagtgaaattgaggctttttcacggtctcggtcggaagacgctgacatctctgggaagggtgtagatgaccacattggtctctgtgtgtcaacatgctcgcttggctctagctga

SEQ ID NO: 85054 - DNA, 432 bp, Glycine max
  Peptide Sequence Number=SeqID_176739
atggggttgaaccaagcatatgtttttaaggaaaggttcatcgagtcaaggtcaagtatggaagtaaccggcttccaaaaattggggcagaagatgaatcgagttacatcacttctttgtctactacctgtggaagcaatcacttccaagattattttgatgatgccaaagaatcaagagttaagcaagtttcaaagaatcaggagtcaaaaagcttcaagaatcaagtttcaaataatcaagattcaagaacaatcaagtttcaagattcaagattcaagaacaatcaagatcaagattcaagactcaagattcaagaatcaagagaagactcaattctctggtaatcgattatctgaaggtagtaatcgattaccagtagccagcattattttcaaaactaatttacaaagttgtaatcgattaccatga

SEQ ID NO: 85055 - DNA, 414 bp, Glycine max
  Peptide Sequence Number=SeqID_176740
atgaggaaggcgtggaagagttcttgcaatttgcttctaaaagaagtcaaccagaattatacaacatggatatggcatggtgaattgaaagacatgcagagtgggtcccaatccaaactatttgatgtagaaataggagatcgtgatgaggacacaactaaggacaaggaccatgaagcacttgaagggcccatgaccagaggcaaacttaaacaggcccaacacgtcatagagacatggggacagatgtcgtacaggatgtcacgacatcacgcttcagaacatgcagattatatgtgtccgtatgaacagattaaacaagtaaataacacaagagaattgtttacccagttcggtgctacctcacctacatctgggggctaccaagccagggaggaaatccactctcaatag

SEQ ID NO: 85056 - DNA, 219 bp, Glycine max
  Peptide Sequence Number=SeqID_176741
atgtatgatccatctaagtgtggaagcaatgccttccaaggttattttgatgatgccaaagaatcaagagttaagcaaagtttcaggcaaagattcaagaatcaagtttcaagtttcatgattcaagattcaagaatcaagaataaccaagatcaagattcaagactcaagactcaagactcaagattcaagaatcaagagaagactcaatcaagataa

SEQ ID NO: 85057 - DNA, 150 bp, Glycine max
  Peptide Sequence Number=SeqID_176742
atgtgttttcgtgaagaaaatcccagccgaggtgcttccgtaccgcttccgagacatttccgtaagcgattctgtggagattcttcatcgtttttcgttcgttcttcgtcgttcttcggtcttcaaccgttttcttttcttctgctttaa

SEQ ID NO: 85058 - DNA, 213 bp, Glycine max
  Peptide Sequence Number=SeqID_176743
atggatccaaataatgacttcgaaagagtttcgaagcaaactgtttatgaaacaccaaatgacaataatgatgaacaaatcataagctacttgatgcaatcctaccccgtaagggcattggctagaagactccaagtagattgggctagagatccaaggaaaggccctagggttctcatgagccttagggtagatttcgagcccatgggctaa

SEQ ID NO: 85059 - DNA, 480 bp, Glycine max
  Peptide Sequence Number=SeqID_176744
atgagagcttctggtaatcgattaccaagggggtgtaatcgattaccaggcttaaaaaggggactggaacattgtggaggcctctggttgtgtaattcgagtttagcctctggtaatcgattaccaagtctatgtaatcgattaccagagatgaaaagccttaagataccattttacttgcatatagtgatcgtgatggcggcgcagctaatccgtgatcgagtagagatggagtgcctagagggagcttgggagaccctcgaaggcaacacgaggtgccgatttcggggcaccattcgattcacggctacttctttggtgcatccagatgaacctgcacggacacttcagcgcacggtggagtggatactacccacgcctacaccatatcgtctagtggagcccgtccaagtgatcgaggtaacgtcatccgaggaagaccttgaggaggatctggaggagctacctcctgagcctgct

SEQ ID NO: 85060 - DNA, 309 bp, Glycine max
  Peptide Sequence Number=SeqID_176745
cttaggtggagggcaaagaagcctccttctggggggccagagccatcagtgagataccactctggaagagctagaattctaaccttgtgccaggacctacgggccgagggacagtctcaggtaacggaggcgtgcaaaggtttcctcgggccagacggagattggccctcgagtgcaaaggcagaagggagcttgactgcaagacccacccgtcgagcagggacgaaagtcggccttagtgatccgacggtgccgagtggaagggccgtcgctcaacggataaaagttactctagggataacaggctga

SEQ ID NO: 85061 - DNA, 471 bp, Glycine max
  Peptide Sequence Number=SeqID_176746
atgagatccttcccattagatacagtcaaaaaggtagtaaaaaaaagggaatccgagaagggatggagaggattgaatgagccaccccctccactacttctctttcacgcctattcttgtccaagcagtatccccttcgtccgggaaagcgagtcaattcccgccttcctcggcaccagccaacacggtctcgatgttgagagtcacatccctgcctcggttgtgtcttcattcccccgcgttcgcgcaaccaaacctcttctccctcgctttagtgctttgactccagcaagctacggctcgaaagccgttttcttcgctggctcgaaagcaagaagcataagcagcataagcagaagcagcttgggtaagcagcataagcagcgtaagcagcaaagagagagcgcgctagcgctattatttcttcgctccttaatagcagcggctaactattctttttccggccggtaa

SEQ ID NO: 85062 - DNA, 411 bp, Glycine max
  Peptide Sequence Number=SeqID_176747
atggcaaataatgtctcagaggtaaatgaggagggtcctataggagaagctggagcaggaactggagctggtaagggagtgagagctgaagctggtaactgtggaagatgtggagtcgaagtggatggtgctgaaggatctggtaaagtagatgaagaaggagaagaagcacctggtgctactgaagtagggggagcctcagatctcttacccttggccttccttggccctctgaatgtcactattggatcatctagattccaacagctcttctttatatatgccaagttaatggcagggctaaggctctccaaagatctagaatctgatgtgactcctctagctttacacaaagttgtgattaaggctggaaatccaagcctagaggagtcatgctgggaaatgatataa

SEQ ID NO: 85063 - DNA, 510 bp, Glycine max
  Peptide Sequence Number=SeqID_176748
atggttacctcagagccctacactggggcaatgaaaggcaccatgcataaacctcaaggctacacgccctcaccttgggtgcttgtacctatcaccttgaggggactacatgtcctcgccttcagaggactgacacatgtcctcctaactagagggctacacgccctcacctccagaggactacatgtcctcgccttgagagggctacacgccctcaccttgggtactagttaccctcaccatcagttgagaggactacacgtcctcgccttgagaggactacacgtcctcatcatcagagggctgcacgccctcacctccagaggactacatgtcctcgccttgagagggctacatgccctcaccttgggactacacgtcctcgccttgagaggactacacgtcctcaccatcagagggctgcacgccctcacctccagaggactacgtgtcctcgccttgagagggctacacgccctcaccttgggtactagttaccctcaccgttga

SEQ ID NO: 85064 - DNA, 261 bp, Glycine max
  Peptide Sequence Number=SeqID_176749
atgaccgggctcaggcgctcaaaggtgaggctatcagagacaacccctctggatttacataatgcggtgattagagcagggaacctaagtctagaagtgttagaatgggctatagagatcatctggcctgagatcatcgcccctatgttcatatccaagcgagaaactaggccaaagatcagcctagctctatccactgtcaagccagaagtgtgtgatgtgggggccaagttggagtatgagaggacactccacacctga

SEQ ID NO: 85065 - DNA, 351 bp, Glycine max
  Peptide Sequence Number=SeqID_176750
atggtgtttttgaaggtgctccagtggcgtctgtttctatcagctgtccctcctgttcagctactgacggggtggtgcgtaacggcaaaaagcaccgcccggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaa

SEQ ID NO: 85066 - DNA, 1167 bp, Glycine max
  Peptide Sequence Number=SeqID_176751
ctggccgggaatatcgcgatagtgttcgtcaccgtaggtcatatagcagtgatcgagcgtatccggatcgacctgcgcctcacggcaggcgcgttccatcccctgtcggcggcgtatcgtcgccagatgcctggccggaagatgcaaacagagcgggcggcgatagccggcggccagcagcgctttcaccgcgtcgtactggccttgctcatcatccggaatatagctggcaacgttctcgttcaggctttcgcagttggccagcacgcagggcagcgtcaacaatttcgccggtcaaggatggcatctggattgtcatccgagaacatgttaaccacaaagctgttccagccgtgggcccgcgccgtctcttcgatagagagcgttatctctactgagaatggagtggtcaccgtatccagtgccagcacgccgatggtgctcggtgttgcccgggcgccgcgaattttcttcgccgacagcgcgcgggataccgtcatcagtgagacgttggctagcttcgctacatctttcagggatgccatggtgattactccggaagtagggctgaaagccggggataccggcattatctacgcggtgctgtcggtctcggcgctattcgcccagatttgctacggctttatccaggataaactggggctgcgcaaaaatttactctggtatatcaccgtcttactgatcctttccggcccggcctatctgctgtttggctatctgctgaaaatcaacgtgctgctcggcagtatttttggcggcatctatatcggcctgacctttaacggcggcattggcgtgctggagtcctataccgagcgcgtggcgcggcaaagccagtttgaattcggcaaagcgcggatgtggggatcgctgggctgggcggtggcgacctttttcgccgggctgctgttcaacattaacccacaactgaacttcgccgtcgccagctgttctggtctggttttcttcatgctgctggcgcggcttaaggtctcttcagcgccgcacgccatgcaggaggcggtcagtggcggtaaagtcacgctggaagacgcgctgcgcctgctgacgctgccgcgcttttgggcgctggtgtttttcgtcgttggcacctgtatttacggcgtttacgaccagcagttcccg

SEQ ID NO: 85067 - DNA, 1155 bp, Glycine max
  Peptide Sequence Number=SeqID_176752
ttggcaccaaccatagaagagtttgaaggaatcttaggatgcccattagggggaaggcagccatacctccttgctagattctatgcttctatggaaagaatagcaaaagtggtcaagatcttagaacaagagctagaccgagtgaaggaagatagggatggggtgatagggataccaaggaagtgcttgaaggagaaggcagaagctttggcaaatcaaggggagtggacctcgttcattgacatattagcactattggtgtttgggactatactatttccaaatgtagatgggctagtggatctagccacgatcaacacctttcttgcttatcaccatagcaaggaaagcctcgttatcgctattttggcggatgcatatgatacatttgacttgaggtgcaaaaagagcagccagaaggcagttaggctaccctatgaggggtgcaccatcagaggaagtcatcacgcctttcatcatcaatggcatcatcagcagctatcacaagtgttgaagtctagaacacaagggataacatggctcccaaagttaagaagtctaagtgggaaagaggctgaaattcttgaggaaagtgaagaagtgcaagcattgaaaacaaagcttcaaaagacaagagtggtgaaagataagctaaaaacgacagtcgctaggatcaggaatgagtgtgatgagctgaaagatgtcaacctgaccacggaacaagttctgtggggcagtagtaacgagctcaagcttagaaggggcaagagtgacgaatcgaggatgaaaagcatggtgttagaagctaagttaaaggcttgtcagaggtcgaagagaagtttgatggaacaattgagcaaaacaaaagagaatatgttcataatcatctaccaatataaggagatgatgaacctggctgccacttatgggcagatgctggaagatgaatgggcaaaggtattggctctgcaaattgaaagggaagcgagagagaggatgatagagttgttgcacagggaagctatgaaatggatgaatagattcactctcactttgaatgagagtcaagagtttcgaaggttgttatccagagccaaggcagtgactgacatgtactcggctcccgacaaagttcacagtcttttcgattactag

SEQ ID NO: 85068 - DNA, 480 bp, Glycine max
  Peptide Sequence Number=SeqID_176753
atgattatgaggggccaagacatttatagtagccaagatgaggctactacttcaccttcctctagtgaaagtgaaaaagcaaaaggggaagaatctagtgaagaaatatacccccaagaagaaggacaaccattagtggttaaagagaagtgtaaggaggtaagtgtctcctccaagagtttagctaaaaaggaaactcattttacaataaagacaaacattaaagaaactttccctcttagacaacctccacattttctcttttgtaaaaaggaacttgctagcattgccacacctcttgggcttgagtttattcctcaagtaaagaagttgttggatgagggtttggtttgcaaaagcttaaatccttgtgctttgttggtgcccaaaataggaataatcgatatgaaaatacagaaaaagatgcccaagaaatgggctttcagaacttaccttacttcaacataccaagctacctag

SEQ ID NO: 85069 - DNA, 201 bp, Glycine max
  Peptide Sequence Number=SeqID_176754
atggtggggtacgcaccttcaagctttgcggatttggtcttcgcccgaaaaaagatcgaagtgggtctgaaaagaggaaaatttaatcatcctactttgatgaatgagaaaactggggcaaatgaagagggtcaggatgagggagaaacccatgctgtgactgccattcctatacggccaagtttcccaccaacccaataa

SEQ ID NO: 85070 - DNA, 744 bp, Glycine max
  Peptide Sequence Number=SeqID_176755
atgagtcatcattcatctagtgttaatggtgaggaaaaaatagaaagaaaagaaaaaggaaaagagagggtagaaataaatcaagatgagaggcaacaaataagggaagaagaaagaaggaaaatactaaaagagttaagaaaagaaaaacatgcctcctatagtagtcatgactcttgcaagatcctaagtgaagaacttcatgattattatgaaggaaggcataggtcacatcttatacctcactaccataggagagaaaaggaaagaaatcctcaagaggctaacattaatctcccatacatccatgggaaggacaatgtagaggcttacttagattgggaaataagggtagagcaacaacttaaaaggaattcttcttcaaaatcttatggctctcactcttatccaaagaaagaccaaggtattgttaggcaccaaatccctaaaataggtgacatgatgaatgtgttgagtggtgcgaccctcttttgtaaaatcactcatgcacccaacatcttcatgattcgtgtacatagggaattattaggtagtgatcaaggggttcccacggaccctatgagaataaaggtcattcctcagtggcccactccaccaagcataagaaaaatttggggcttccatgacttaacaaacttttacaaaaggtgtcgagagaagaagcccatagtatcaagaacctctggatttgaggtcaaatcctttccaagggtgaggggatga

SEQ ID NO: 85071 - DNA, 444 bp, Glycine max
  Peptide Sequence Number=SeqID_176756
atgcatagtttaggcatgcctgtccctgccattgaggggctagttgctgggacaggactaagtcctctgatcgtgtgcttgatagacactagcgatcggggacttttgtcgttgtttgtcgagcggtggtaccgggaggcttctagtttccatctccctgtgggagaggtgacaatcacactggacgatgtcgcgtctcttctacatctgcctgtggttggcgacttgcatgtctttcagcccgtgcacgtggatgatgttgtacagatgctggtggagttattgatggtcactgcagaggctgtcagggctgagacagcgcagtgtcatggacctgctggatatacgagcactttccctcagtcgtggagtccactgttgatccgaactatgatgaggattcaccgcgtgcctgtatgtggattgctacaaagaagatcgtga

SEQ ID NO: 85072 - DNA, 314 bp, Glycine max
  Peptide Sequence Number=SeqID_176757
gggaatcagagagatcaacagcttctccagataaggaattagaaagatcagtagcttctccaactggggaatcagagagagcaacagcttctccagatatggaatcagaaagatcagcagcttctccaactggggaatcaaggggagcaacaacttctctagacggggaatcgaagatgataataaaaggtggagatggggaactacttcaagctcaggagaaggtgtgggctcaggaggagcagccttgttgggtcttaccactgaaggtagagctccaggtcatgctacttgctcaaggaactgctccatag

SEQ ID NO: 85073 - DNA, 192 bp, Glycine max
  Peptide Sequence Number=SeqID_176758
atgtcagttaaaaacctcgtcggacgcctaggagtacatgacaagacaaaccacacactagtaagtcaagtcactctcactaggcttaacggagcactcaaaccaggtgtatttacccccaaggcctacactccgaagagtccgtcaggacctctccctcataattcaggtccaacccagaaaatattttag

SEQ ID NO: 85074 - DNA, 276 bp, Glycine max
  Peptide Sequence Number=SeqID_176759
gtgctccagtggcttctgtttctatcagctgtccctcctgttcagctactgacggggtggtgcgtaacggcaaaagcacccgcccggacatcagcgctggcaagtgtagcggtcacgcctgcgcgtaaccaccacaccccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaa

SEQ ID NO: 85075 - DNA, 663 bp, Glycine max
  Peptide Sequence Number=SeqID_176760
gcagacacagttgtgtccgatggcaagcagagaccaagtttggtcattctgcacccaagatacgcggagataccttacggttatctgcacccctttgctaggcagacacagttgtgtccgatggcaagcagagaccaaagaccaagtttggtcattctgcacccaagatacgcggagacaccttacggttatctgcacccctttgctaggcagacacagttgtgtccgatggcaagcagagaccaagtttggtcattctgcacccaagatacgcggagacaccttacggttatctgcacccctttgctaggcagacacagttgtgtccgatggcaagcagagaccaagtttggtcattctgcacccaagatacgcggagataccttacggttatccgcacccttttgtcatccagaggcggcgggcccgatgacaagcagagaccaaaggctgacacagtcttctgcaccttttgttcctccggggacaacaaagtcatttacatgtggaaatttcatggtcactcgcgactctcgtcagccgagaggagcgaaattagtgtcatacactgattttcggggacctttgcttgatgacatgcgaccattctttggtccttgtgaggtgcttggcaccatcatcaggcaatttgtgaaatcctag

SEQ ID NO: 85076 - DNA, 336 bp, Glycine max
  Peptide Sequence Number=SeqID_176761
atggcaaaaggtgtgcggaatggccataatttgtctccgcatgtcatcgggctctctgcctctggatgcaaaaggggcaggatgaccataatttgtctctgcatgccatcggactcgatcatatctggatggcaaaaggtgtgcggaatgaccataatttttcttcgcatgtcatcgagctcgccgcctctggatgacaaaaggcacagaatgaccataatttgtctctgcgtgccatcggacacgatcgtatctggatggcaaaagggtcagtatgacagagattgtggggcagccgacaaaagcgaggctcttcctcctacgtatcctcaatga

SEQ ID NO: 85077 - DNA, 867 bp, Glycine max
  Peptide Sequence Number=SeqID_176762
atggggacgaggggttgcatcaattacaatcccgtcctcgctataagacaacttggttaccctatgagaggggcgccatcaaaggaaggcctcataccttttattacacgaggtttcaatagcaccaacgtgggggtgcttcagagggtccacaaggcatgggaaatgtcgcaaaggaaggacaaggaacttaggaggagtagtaatgggcccatcggcggttaccataggtggttgaaagcctacgcacaaaatctggattggctcccgagtttgaggaccactaaggggatggagggtgaaacttcggaagaagacaaaggaagagtcaaagaaaagttcaagtcagcagctgttaggatccgaaaggagaacgctgaactgagagacgtcaatatagccaccaccaaggccttggagcaagagaccaagagggcccgggctttgtggggcagtaacagcgagcttaagcttcgaagagaggaaagggaccaatcgcgagtagacgactttattttgaaggatgaattgagggtttgcctaaggttcaagaagagtttgtctcagtggttatgcgagaccgaaacaaacatgttagccatcattggcaagtaccaagaagaattaaatctagccacggcccataagcacaaagtggcggacgaatatgcccgagtgtacgcggaaaaggaggctagaggaagggtgattgactcgttacatcaagaagcaacgatgtggatggatcggtttgctcttactttgaacgggagtcaagaacttccccaattgctggaaaaggccaaagctatggcagacacctactccgcccccgaggagatccacgggctcctccgctattgttag

SEQ ID NO: 85078 - DNA, 237 bp, Glycine max
  Peptide Sequence Number=SeqID_176763
atgatatgggttccaaaaggatcttttatcaaaactggcattcgaggacccaagaaagtttgggatactttgaagaagagttggtacattgatagcagatactctaaacacatgatgggagatgcatcaaagtttacttatatttctcccaagaatagtggacatgtgacttatggcgacaacaataaaggtagaatccttggagtcagaaaactaggtgtattccttgaacaataa

SEQ ID NO: 85079 - DNA, 321 bp, Glycine max
  Peptide Sequence Number=SeqID_176764
atgtataagacaaaaggagtagagcccaacccaaaaggtgcgagcaacgctctcgaggttcttactcaatgtaaccctgatgcaagctccattggagcttgtaggcctacgatcttcttcatcaatggattcctttgcttcttggaagatgaatggcagcggaatggagaaaggaagagagagaggagacgccacttcaaggagaagatgagtctagaagaagctcgccaccataggaggccatggataagagcttggaggaagaatgagatgaatgaagggagagggagagaagagcacgaaattttgtgctctaaatga

SEQ ID NO: 85080 - DNA, 878 bp, Glycine max
  Peptide Sequence Number=SeqID_176765
acatcctcgccttcagagggctgcacgcccccgccttcagaggactacacgtcctcaccatcagtgggctacacgccctcacctttagaggactacatgtcttcaccttcagaggactacacgtcctcgccttcagagggttgcatgccctcgccttcagaggactacacgttctcaccatcagagggctgcacgtcctcaccttcagaggactacacatcctcaccttcagaggactagacgtcctcgccttcagagggctgcacgcccttgccatcagaggactatacgtcctcaccttcagaggactacacgtcctcaacttcagagtgctgcatgtcctcgcctttagagggctatgcgtcctcactttcagtgggctccatatccatgccttaagagagggaggctatcacgcagctactatgcatatcggggcaagatttcactcatgccactgcaaagagacgagtgcggatcatgcgcaccgacttggcactcttacacagatatggatgacgttgctttgcaacattctgcccagcgactgtaatgccgatctccctctgcggaagtatcagttggtctgtgtcgtctcgacatatggattgcgaccacaaggcacccagtggacccggaggagcccaacagggccctggggtttccagctctggttacaggcctctgtcagccctacagggtgcccgtccaccccagaaaggtcatgccatcgtgaaataaggatcgcgcccgtaagacacccagtggactcggagaagtccaacagggtcttggggtttccagctctaattacgggcctcggtcagttctacgaagtgcctgccgcccccagcaaggtcatcaggcccccctactaa

SEQ ID NO: 85081 - DNA, 1182 bp, Glycine max
  Peptide Sequence Number=SeqID_176766
atgtccttgccagcagaggactacatgtcctcgtcttcagaggactacacgtcctcaccttcagagggccacacgccctcgcctttagaggactacacgtcttcacctcgccttgagagggctgcacaccctcgctttcagaggactacacgtcctcgccttcagaggacaacacgtcctcaccttcagagggctgcacgccttcgccttcagagggctgcacgccctcaccttcagacaactacacgtcctcacctcgccttgagagggctgcacgccctcgttttcagaggacaacatgtcctcgccttcagaaggttgcgtaccctcaccttcagaggactacgcgtcctcgccttcagagaactacatgtcctcaccttcagaggactacacgtcctcgccttcaaagggccacatgccctcaccttcagaggactgcatgtcgtcaccttcagaggactacacgtctttgccttcagaggactacacatcctcaccttcaaagggctacacgccctcaccttcaaaggactacacgtcctcgccttcagagggctacacgcccttgccatcagaggactacacatcctcgctttcagaggactacacatcctcgctctcagaggactacacgtcctcaccttcagaggaaaacacgtcttcaccttcagaaggctgcatgccctcgccttcagagggctacacaccctcaacttcagaggactacatgtcctcgccttcaaaggactacatgtccttgcctgcagaggactacacgtcctcgccttcagagggccacacgccctcaccttcagagcactacacgtcgtcaccttcagaggactacatgtcctagccttcagaggcctacacaccctcgccttcaaagggctacacgccatcaccttcagaggactacatgtcctcacctttagagggctacacgccctcgccatcagaggattgcacaccctcgctttcagaggactacacgtcctcgccttcagaggacaacacgtcctcgccttcagagggctacacgccctcaccttcagaggactacacgtcctcaccttcagaggacaacacgtcctcgccttcagaggactacacgtcctcgccttcagagggtcacactccttagccttcagaggactacatgtcctcacctcgccttga

SEQ ID NO: 85082 - DNA, 381 bp, Glycine max
  Peptide Sequence Number=SeqID_176767
atgggattgagtcaagctccttcgcttaaaaagaggttttatcaagtcaagcgacaagcgtttcgcaaaggcagtaataacgagcccatcggcggctactgtaggtggttgaaagcccacatgcaagatttggattggctcccaagtttgagaaccactaaaggggtggaagttgaggctccggaggaagacgaagaggtgcaggcccttagggaagaactcgagcaagcccaatcagtcaaagaaaggttcaaatcagcagctcttaagatccgaaaggagaatgctgaactgagagacgtcaataaagctaccaccaaggccttggaacgagagaccaaaagggctcgtagggtggaatatggccggaacaaattctga

SEQ ID NO: 85083 - DNA, 1227 bp, Glycine max
  Peptide Sequence Number=SeqID_176768
atggcttctaggaaaagaaaggcaccttctacacctacccaagccagatttgatagatctagattcatttctcaagaggcttgggagagatacactgacattgtggtgcctcgtaagcttttaccagagaggaatgtggtagtttactatactgagtttgatgagttcaaggaggaacttgagagacgccattgggatgaggagttgaatgattttgtggacggcgatattggtgttgccattgtaaaagaattctatgcaaacctctatgaccccgaggacaaatctcctaagcagggccaaactcatttatggcatcatcatgaagatggatatgaatgtgggtcagattcaaggtccttggagagtctgagtcctgccattaatttggcttatattaagaagaattgttggaatcttgatgatccaacagtaacttttagaggacataggaagactagaggtaagagatctaaggccccttccactttagcaccatcagatgcaccaacaccttcttcttctatagtacctccctcttcatccactcagattccagttattcctcaagcacctccacagataccacttccagctcctctctctacaggactatcagattttatttttacacccatggaggagtttgatactcagatggcctgtccaagagaccagccctcttcttctagagggggtggagcctctgtagcccaggagcctgtgactgatgagccaccagcaccagcagaggaggagaccactccagatcacactcctcagccatctccatcctctgcatctactcctgaggagactcagccatcagcactggatcataatgaagaccaccataggaggagcaggactatggactggatgcatgaatttgaggatgatgaaggccatgtgaaaaaaaggctaagtcatgaagtcccaaaagtgacagttgagcttagctcagcagatgggctaagcgtgcatccaccactaagcgcagcatcagcgtgcttacacgaaggagaatctggtagggcatcagcatcaaggtcgcacgctaagcacgagatcattgtgttaagcatagcagctctagcttctcatctcaaggaggtgagcttagctattagagaggaagttttctcaaagaagcttctcaaggaagttttctcaaagaagcttctcaaggaagttttctcaagaaatcttttcaaggaagctacctag

SEQ ID NO: 85084 - DNA, 297 bp, Glycine max
  Peptide Sequence Number=SeqID_176769
atgacaaggactcatccgatggttcggagaaggagatcaaccttctatccaaggactatgaaagtgatgagaccatctctcaagaattttattagagggtacatctactttggttgttatactgagaacaagagagggtacatctcttgtggatcagttcaagtggagggtacatccacttggttgttcaaagagaacaagggaaggtacatctcttgtggatctttggcttgtaaaggattttacaaggttgaaagaaatctcaagaaccgttggttgcttggggactggatgtag

SEQ ID NO: 85085 - DNA, 969 bp, Glycine max
  Peptide Sequence Number=SeqID_176770
atgatgcaatcctaccccccaagggtattggatagaagacttcaagaggattgggctagggctgctaaacaagaccctggggttctcatgaacctaaggcatcctttccaagcttcttatccaaggcttatcttggtggtgaatctccttcttccatggcttattcaagatgaggctactacttcaccttcctctagtgaaagtgaagaagcaaaaggggaagaatctagtgaagaaatctacccccaagaagaaggacaacctttaatgacaaatattaaagaagcttcccctcttagacaacctccacatcttctcctttgtaaaaagacacttgttagcactgccacacctcttgggtttgaggttattcctcaagtaaatgagttattggatgaaggtttagtttgtattaataggcaccaaatccctaaaataagtgatatgatgaatgtgttgaaagttacaaccctcttttgtaaaatcagtcatgcacccaacatcttcatgattcatgtacatagggactcattaggtagtgatcaaagggttcctacagaccctaagagaataaaggtcattcctgattggcctacttcactaagtataagggaaatctggggctgccatgacttaacaaacttttacaaaaggtttgtcccatatctttctatacttgtagcaccactcattgagttggtgaggaactatgttcccttacgggaagatgtccatgaaaggggtgtcgagggaaggatcccagagtatgaagaacctcaggatttaaggtcaaatcctttccaaggtggaggggatgatgcaatcctacccccaagggtattggatagaagactccaagaggattgggctagagctgctaaacaaggccctggggttctcatgaacctaagggtagatgttttgagcccatgggccaaggttgggtccactcttctttgtaaatattag

SEQ ID NO: 85086 - DNA, 240 bp, Glycine max
  Peptide Sequence Number=SeqID_176771
atgaagatgacagaaatagaggctgtatcaatgttgtgggttgtggaaactgaaggggataaagagaaggagcaaggacagaatcgaactgatgcaaaaatagaggagcagagacaaatacaacaggtgttggatgaatatgctcaagtattttctgagcccaagagtttacctccgaatagagcaaatcatttcaccgcggaagccaaaggccttgcgagtgtaccaaaagaggaataa

SEQ ID NO: 85087 - DNA, 387 bp, Glycine max
  Peptide Sequence Number=SeqID_176772
acgcatcttctccttgaagtggcgtctcctctctctcttcctttctccattccgctgccattcatcttccaagaagcaaaggaatccattgatgaagaagatcctaggcctacaagctcaaatggagcttacatcaatagcacacttttgttttcaaggtttggaaaaccagaaaactttagaaagatttttgcaaaggaagaagaagaagaagttcaagaagatgttcaaagagattcaaaggttgtaaaagaatatgtggaaaagttgtttgtaaagattgtaagtaagtctcttaaaaatgcaagtcaaggtcttgcttttatagactcttcaagtctagtcaagaaaaccattagaagagttataacttttagaaaaatatga

SEQ ID NO: 85088 - DNA, 165 bp, Glycine max
  Peptide Sequence Number=SeqID_176773
atggcatggaaaattgaaggaagaaagggagagaagttgaactttgaagtgtctctcacaagactctcattcatcaaagttgtgacaagtgttacacatgtttctatttatagcctaggaatattccaaggatatgtcaaaggcatcttagcatattccctttag

SEQ ID NO: 85089 - DNA, 591 bp, Glycine max
  Peptide Sequence Number=SeqID_176774
atgcaaatctttattcaatcaattgatcccagtgcatggaatgctattgttaaaggagcatttataccaactaaagaagtgaatagtgaattggtgcctaaagaatgggatgagatgaaagatgaaaggtgcaaaagtgcaaaggaaatacgaaaaatgcttgaagtcactcttgaaggcactatggataatggagaaaccatttcaaaacttcaaacaagattcacccatattgtgaatcaccttctaggtcatggaaaaacgtttaaagatgatgagctaaacatcaagatcctcaactatcttacaagaacttgggaaccaaagatcacaacgatcaaggaatccaacgacttggcatcaatgtcgatgaaagctctcttcgaaaaattgcttgcatatgaacatgagctaattcaacaatctcatgtagaagaaaccaaaaagaacagaaaaggaattgcagtcaaggttaattcttcaaaggaagattgccaagaaagctctagtgatgacaaagatgaagagaatttaagcttgatggtaaagaagttggaaaattctcaacgatccaagatagaaaatctctaa

SEQ ID NO: 85090 - DNA, 312 bp, Glycine max
  Peptide Sequence Number=SeqID_176775
atggaaaaatccgacaagaaaactttaaaatataagaaaggaaagaaagcatatattacttgggaagataatgatatggattcatcaagtgatttagaaaatgaaatcgtaaatctaagcctcatggccaaagactatgaaagtgaagaagatgactccttgaagaaaagttggtacattgatagtggttgctccaaacacatgacgagagatgcatcaaagtttactcatatttctctcaagaatagtggacatatgacctatgatgaaacaacaaagataaaaccccaaatcatgctcaatgctttttaa

SEQ ID NO: 85091 - DNA, 962 bp, Glycine max
  Peptide Sequence Number=SeqID_176776
atggcggataaaatctacgtcaacttctcgctgttccagtcgatgccggatgcctggggtatcgatcagctgttcccggtgatgccgctggaagggctgaacaagtcgccggaacgccgcgcggtgctgctggatattacctgcgactccgatggcgccatcgatcactatgttgacggcgacgggatcgcaaccaccatgccgatgccggaatacgacccggagaacccgccaatgctgggcttctttatggttggcgcttatcaggagatcctcggcaacatgcacaacctgttcggcgacaccgaagcggtagacgtcttcgtcttcccggacggtagcgttgaggttgagctctccgatgagggcgatacggtggcggatatgctgcagtatgttcaactggatccgaatacgttgctgacccagttccgcgatcaggtgaaaaataccggcctcgacgccgagctgcagcagcagttcctcgaagagttcgaagcggggctgtacggcggctgcgcaaaacagccggagtacaatacccgcacggcactctccactgaggttgccacccgctggggcagcgacgttcactcaacggttaaaggcgtgcctgcagagcgcgtagattcccatcctgatgagatcgtattaattaattattccggtcaatatcaaaccgggtttgaccagcgctatagcattcgtaatagcgatctggaatatgcggtacgcgatgctaattttaactctctccctattactcgccgctataataattccacgggaaaatggcaatacgccattgcggcccgcgttggtactcagtatcaattatatgtccgtaattatagccacagcgtggattatgaaattgtcgccacggtggatggtctcgatgtcctgagcggtaaggccggttcgcttaacaacaacggctacattgtgcctgctggtggctc

SEQ ID NO: 85092 - DNA, 702 bp, Glycine max
  Peptide Sequence Number=SeqID_176777
atgacgttgctacttagcaacattctgcccagtgaccgcaatgccgatatccccctacagaagtatcggttgggatcgtgcccacaagacacccagtggacccagaggagcccaatagggccctgggatttccagctctggttacgggcctctgtcagtcctacagggtgcccgttccccccagcaaggtcacaccatcatgacatagggatcgtacccacaagacacccagtggacccggaggagcccaacagggccctggggtttccagctttggttacgggcctctctgtcagtcctacagggtgcccgttccccccagcaaggggtagcgcccacaagacacccagtggacccggaggagcccaacagggccctgggatttccagctctggttatgggcctctgtcaatcctacagggtgctcattccccccagcaagggatcacgcgcgcaagacactcagtggacccggagaagtccaacagggtcttggagttgccagctctgattacgggcctctgtcagttctacggggtgcctgtcgcccccagcaaggtcatcaggccccctactaatcgagctttcatcaagaagtactgcgcccccaggcaggcgcagggcaaaacaccccagcagcgggcaacagacgcaccgccaccacctctagagttcacctcagctcatccacaaaaaggttag

SEQ ID NO: 85093 - DNA, 657 bp, Glycine max
  Peptide Sequence Number=SeqID_176778
aggactacaagtcctcaccttcagagggctacacgccctgcctttagaggacttcacgtcctcaccataagaggactacacgtcctcaccttcagagggctacatgtcctcaccttcagaggactacacatcctcaccttcagaggactacacgtcctcgccttcagagggctgcacgccctcgccatcagaggactgcacgtcctcaccttcagaggactacacgtcctcaccttcagagggctacatgccctcacctttagaggactacacatcctcgccttcaaagggctgcataccctcgccttcagaggactgcacgtcctcacttttagagggctgcacgtcctcaccttcagagggctgcacgcgctcacctttagaggactacacgtcctcaccttcagagggttgcacgccctcgcctttagaggactatacatcctcaccatcagagaactaaacgtcctcgcctttagagggctacaagccctcgccttcagaggactacacgtcctcaccttcagaggactacacgtcctcaccttcagagggcttcatgccctcacctttagaggactacacatcctcaccttcagaggactacacgtcctcgccttcagagggctgcacaccctcgccatcagaggacagcac

SEQ ID NO: 85094 - DNA, 786 bp, Glycine max
  Peptide Sequence Number=SeqID_176779
atgtgctgcctggcgctgctatgggtgagcccgtttatctggatgctggcgacctcgttcagcgccaccaccttcggcgaagatatggcctcattgctgccccgtctgccgctgactctcgataacttccgcgacgcctgggacagcgccgactggctgagcctgtacgccaacacccttatctttaccttcggcactttcttcgtgcagctacttaccatcaccaccgccggctacgtcttcgcctgccacgaatttcgcggcaagaaaatgctatttctgctgtttctcgtccagctgatgatcatgccggtggtgatgatggtgccgaacatgctgaccctgaaaaccttcggcctgctcaacactctgaccggcgtgatgatgccttactttacctcggcgttcggcgtgtttctgatgcgccaggcgttcctcgccatcccgaaagagctggaagaggcggcgctgatggagggatgccgctggtggcaggtgctattccgcgtactgctgccgatgtcctggccatcggtgctggccttcgccaccgtcagcattacctaccactggaacgagtacctgtggccgctgatgatgctcaacgatcccgataagcaggtgctgaccgtcgggctggtctctttcgccatgggcgctgaatccggcggccaatggggcaccatcggcgccgggacgctgatggtctgcctgccgctgatgctggcgttcatccttttccagaaacagttcctgcgaagcttcggcttctccgggatcaaataa

SEQ ID NO: 85095 - DNA, 313 bp, Glycine max
  Peptide Sequence Number=SeqID_176780
tttttcatgccctactccagaccagttcagggcagaggttgcatggcccggagattggcccaaggcccaagcaggagaggcacccccagaagctcccggcgatggagaagaagcccacgaggatgaggagatggctgattgcttgacttcttgggagggagtggagacacgtgactgggagatccccagattcatggtgaatgctgtgaaatttcccggacgcccgaaatggactcggatgaatgcacaaattgataaaagaacatattttggaaacattgggttgattaaaaatagaggaaatgaatcctga

SEQ ID NO: 85096 - DNA, 240 bp, Glycine max
  Peptide Sequence Number=SeqID_176781
atgaagcaaaatgccatcataacttgtcttttacaaggcatgctgtcgcaacgtgcccttcgcgggcgagcgagggcggggctcacgggtgcgctttccaaaggaggaaagatgcgcggagtcgccaccaacgaaggtattagcacctctcacgtcgacaaaagcggggcttttgctcctatgtaccctccatcgaagaggaaatcagacctacgtagttctttcttatgcgtgaatcaa

SEQ ID NO: 85097 - DNA, 291 bp, Glycine max
  Peptide Sequence Number=SeqID_176782
atgaggggcatcgtgcataagcctcagagggctacacgccctcgccttcagaggactacacaccctcaccttcaaaggactacacatcctcgccttgaggactacacgtcctcaccttcagagggctacacgccctcaccttcagaggactacacgccctcgccttcagagggctacacatcccttaccattagagggctacatgcgtcctcgccttcaaagggactacacgccctcgccatcagagggctaaacgtcctcatctttagagggctacaccctcgcctttag

SEQ ID NO: 85098 - DNA, 324 bp, Glycine max
  Peptide Sequence Number=SeqID_176783
atgtcatctattgttgcagggatcgccacctacaagacacccagtggacccgaagaagtccacagggccctggggtttccaactctgattacgggctctgtcagtcctacagggcgcccgtcccccagcaagggtcacgcccgcaagacactcagtggacccgaagaattccgacaggtcttggagttgccagctctgattacgggcctctgtcagttctacggagtgcctgtcgcccccagcaaggtcatcagcccctctactaatcgagctttcatcaagaagtactgcgcccccaggcaggcacagggcgaaacaccataa

SEQ ID NO: 85099 - DNA, 243 bp, Glycine max
  Peptide Sequence Number=SeqID_176784
atgtaccttctcttgttctcagttacaacagcccaagtagatgtaccctctacttgtaccacaaaggatgtaccctccaatgtgttaagacaaagttctcaggcggttagtcctttgaaacattgtgaaggggaaacaaaagatatctcagatgaacaaggtttggaaaccagaaaacttagaaagcttttggcaaaagaagaagaagaagaagttcaagaagatgttcaaaaagttgtgtaa

SEQ ID NO: 85100 - DNA, 537 bp, Glycine max
  Peptide Sequence Number=SeqID_176785
atgactaatgcaaattatccgcaagaatcattgcattcagtctcaaacgggaatctacggacatttaacgcagccctgttgggaaaatggcgatgggatctttttcacaagcacgaggagccttgggcaaaattgctagattccaagtatggtggctggagggctttggaggagggcaaaacagctaatcaagattccatttggtggaaggacctcatttcaattctgcaccagcagcagaattctgcaataagaaaagaaactggttggatagtggggggcggagacaagttcatattttgggaggacccgtggttagatactgccatgcctttatgggagaaatacccaagcactggatgggaatggaatctcacttggagaagggatctttttgaatcagagttactgttggcagatacttttattggggaagataaatggatatggaagcatggccacagtggacattactcatcaaaaagcgggtatgaccttatatggagagagctaaggagggtcaatccagaattctga

SEQ ID NO: 85101 - DNA, 344 bp, Glycine max
  Peptide Sequence Number=SeqID_176786
atgatgattctgacgatgatgattacaagatatctaattcatatgttgaggactcgtttgatgaggaggaagatatcgatgatatatctgacacagatgaagaaggtggaagtgggattgcattttgggaatctgcttctaattatagtaacattaattggagtcatccagatgaagaagacatctatggtttcgatatgggatcaaccttcaatattggccaagaattatttgttggcatggaatttgaaagcaaaaatgcactacaacagtatgttatgaaggtgcaccaaacttttaaagttgttgaatcaaaatcacaaaaatatgttgttgctgcgtaa

SEQ ID NO: 85102 - DNA, 324 bp, Glycine max
  Peptide Sequence Number=SeqID_176787
atggccccgaggaagcttgcctcaaagagatctaggaaggacgccacggccgaagggactagtgccgctcccgagttcgatagtcatcgtttcaggagcgctgagcaccagcagcgtttcaaagccatcaagggatggtccttccaccgagagagacacgtccagctcagggacgacgagtacacagatttccaggaggagatagctcgccggcgttggatgttgctggtcacgcccatggccaagtttgatccggatatagttctcgagttttacgcaaatgcttggcctacagaggagggcgcacgggacctccggtcatgg

SEQ ID NO: 85103 - DNA, 437 bp, Glycine max
  Peptide Sequence Number=SeqID_176788
gtcgaagaaatctaggaaaggaaagagtcccagaaagggtgggaatcgattttggaagtgcattgtggttcgccttaagactcctagggcgttcttcttctttcaccttctgcctaagttcgtctttgtcgcaaactgggctgcgcttccgtgactgcaaccacattgtggagttcgtctttgtggagttcgtgtctgccacttatcgattaagctcgaagaaaactaggaaaggaaagagtcccggaaagggtgggaagcgattttggaagtccattgtggttggctttaagactcccagggaagccatcgaaggtgatttgttcgtcttctttagtcgttgtcaagttcctttgggtatttgcattttgaaagtaatggatttgagtcatttgatgttgcgtgatgtattcttaaagtccaataagctggtttaa

SEQ ID NO: 85104 - DNA, 243 bp, Glycine max
  Peptide Sequence Number=SeqID_176789
gaactcgcactgcctcctaagcctgaggttggtccttctgctacttgtgtcaacacaaagaagagttgtgttgatccctcagggaacgacccaaacaagggtgagttagagaaatgtggattggacgtcgaagaaaatcctccccacctggttgcccttggaagactttatgatgagtcaaccaccgttcacaacatccctttgggcaatgatcaagtgaaggttggtgttggagaagtttga

SEQ ID NO: 85105 - DNA, 375 bp, Glycine max
  Peptide Sequence Number=SeqID_176790
atggcgtgcccattaacctatgtaccaaaagagccctcatggacctccctcaacaagtcttctgcttctttagcattcacgcagcgtagcagagccatgtcatggtttctcttgtatagtatgcttccgctcatgaagaagttggccgccaatctcctcaatatccttttgtcattgtcggaagcctccggtgggtgctatttgctttcaacgtattgcttgatatcaaaataccaaggcttaccgtcccgttcctcttccacccgacaacaatgtgcgggtctgccacgacaccaaaactcaatttacggtaggtccccgtgcggtgttagctggaacatggacgctaaagtggtaaacgcatctgccatttga

SEQ ID NO: 85106 - DNA, 87 bp, Glycine max
  Peptide Sequence Number=SeqID_176791
atggaattggaggaaggtatttgggaaagtgaaggtgtagaggctgaaacaggaggagataggtcaggattgaggctgaaacaggaa

SEQ ID NO: 85107 - DNA, 358 bp, Glycine max
  Peptide Sequence Number=SeqID_176792
tgcaatcctccattgtcgagagtttttcatcgtcaagggcggatcctcttgactgggaaataaaagaagaaggagtagagacgagagtcgtcatcacggaaagggcaggatggacgaaatcagtgtcttatctttgctttcctcttatctccgataaaagtcccgagacgattcagaaatcaaaaggaagcaggctagcgcaatccgtgaaatttcgtgatgtggcggaaattgaaaagagatccttcctccagaaggttgttgcttctggaggaagcaaccttgctcgcctgggcgagctgggtggcaagctcctcccctattttgctataaataggagagaagtgaagaagaaagg

SEQ ID NO: 85108 - DNA, 165 bp, Glycine max
  Peptide Sequence Number=SeqID_176793
atgccttgcacgaatcccaagcgagcatttgctaagcgcgacattcagtggctaagcgcgaggaagaatccagaagaagatgagttgtcaagttcgctaagcgcaccgctccaggtcatcaagcgcaccgcttcagctcatccgctaagcgaaacaagcgactaa

SEQ ID NO: 85109 - DNA, 837 bp, Glycine max
  Peptide Sequence Number=SeqID_176794
acttatcaaggtaatccttgtggcgtttaccctgacttatcttccttcactggaagtggcatcatccaaaactctgtaacctgtatcaagcgattcgttcctagtaaggatcacatcagtagtgaggaacatcagtggcgctttgaagagatcaaagattggtctttcctcaaggaaagaagggtccaattagctgagggtaagtatattgaattccaaacagagattgctaagaggcactggacacagcttgcagagcccatgcctaaatatgaccctgcaattgtcatggaattttatgcaaatgcttgtcctactgaggaaggtgttacggataagtgctccaaagtgcggggccaatggattccttataacacagatgccaccaaccaatttttagggaatccattgatcttagaggaggggcaacagtgtgaatacacggcaagaagaggtcagactataggttttgatgaagaggctatcgatcaactgctttgcttcccagaacatgattttgtatggagcatggcaaggaagtggttgcgaatcatgcaaaccaaaatgacaactctaactcaaatctggatgactttccttctcaataatatccttctgagtgatcacaactctaatcttaccctacctaaatgccagctggtctacaacattatggagcatattactgttcatgtggcccaactcattcagatgttatccataagtttgttggtacaacaacaagagcaggatcaacaacatcaaccagcagcagatgcactaccaccaccacctccacatcagccaccgtccttggagtctatctcagccccctag

SEQ ID NO: 85110 - DNA, 438 bp, Glycine max
  Peptide Sequence Number=SeqID_176795
atggccactgttcagcacctggtgatggacaacaagatgaggaggcccattatctacagaaccaagccatacctcaacaaaactttcaaggaagctaccaaggctataaaggtatccatcgcaaaccagaagaacactaatgcttctattaaaaatctagaagttcaagttggacaactggctaaacatttatctaaacatggaagtggatctttcttagtaaccacacaggataatgacaagaaaaataataaagaaggagttgaaaaagaaaacgagaaaaatgatgaagtggtgactagtgaaaaagtggaagaaaaagtgatggctccaaagaaactcacctctaagagagctaggaagaccactgtaggagaaggatctagcacaactccacctgtagaaaatgaatttgctggacaccgctttcgtagttga

SEQ ID NO: 85111 - DNA, 165 bp, Glycine max
  Peptide Sequence Number=SeqID_176796
atggaaatctttattcaatcaattgatcccggtgcatggaatgccatcattaaaggtcgtttcattcctaatgaagaattgaatgaagaagatgcaggctttcaggaaaaggattatgctcttgaagatgacataaaggcaaaagaacttgagcaaagcaaatag

SEQ ID NO: 85112 - DNA, 489 bp, Glycine max
  Peptide Sequence Number=SeqID_176797
atgaccaccttgacccagacgtggatgacattgctgctcagcaatgtcttgcctagcgatcataactccgatctccctctactgaagtgtcagttggtgtatgccatcctgacacggatgagcgtccacgtggcccaggtgattgctgacgccatctatttgtttgcagtgatccgaccgccgatcacccgggccttcgtcgagaagtattacacgcctaggctggcgcagggtgatgcacctcaagccacagactcaccgccaccacctcatcaggccgatcccgttggatcattaggcatagagcgttatctacagcacttggttcgccaacaggaggccaaccaccgggggcagcctcagtcagtaggggcagggtttcactccttttgcatgccctactctagagcagtttgggactcaggtcgcatggcccagagactagcccgaggcccaggcaggggaggtgcccacaggatcccccggtga

SEQ ID NO: 85113 - DNA, 282 bp, Glycine max
  Peptide Sequence Number=SeqID_176798
atgcccttttgcgggcgagcgaggcgaggctcacgggtgcgctttccaaaggaggaaagatgcgcggagtcgccaccaacgtttatttgtggaaaacgttggaaaaaccgaaggaaaccggtcataaagaatattcaaagtttgggagttgtatttacgtttgaggaaggtggtcattttaaggcgtttgaccttaaaaatgatcctttttacttggtgagaaaacggcttaaacgatcggttaaagctcgtcaaaaacgaaagaaaagaaaccgatattga

SEQ ID NO: 85114 - DNA, 1107 bp, Glycine max
  Peptide Sequence Number=SeqID_176799
gcactgttggtgtttaatgagatgtgcttgctgggtgttaagagtaatgagtttaccttccccagtgtgcttaaggcatgttcaatgaagagggatctaaacatgggtaggaaggttcatgggatggctgttgtcatagggtttgagtctgatgggtttgttgttaacattttggttgttatgtatgccaagtgttgtctgctagctgattctaggaggttgtttggtggaattgtggagcaaaatgttgtttcgtggaatgccatgttctcttgttatgtgcaaagtgagtcgtgtggtgaggctgtgggctcgtttaaggaaatggtgaggagtggaatagggcctaatgaattcagcatttccatcatattgaatgcctgtgcaaggttgcaggatggcagtctagaaaggacggacattgcacaccctgatgttgtttcttggaatgcagttattggcttattgctggttgtgttcttcacaatcgcctgtgctactatggggttcaaggagttgggtagacagttacattctagtttgataaagatggatgctgactcagatttgtttgctgctgttggagttcaagatgcagatatcaagccagatccatttatctgcagttttcttttaaatgtttgtggaaatttatttgcatatgctgatcgtgccttttctgagatacctaatagaggaatagtctcatggtctgcaatgattggaggatatgctcagcatggccatggtaaagaggctcttcaattgttcaatcaaatgcttagagatggtgtcacccaaccatattactttgggaaattaaatgaagcagtggagcttgtaaactccattccatttgaggctgatggctcagtttggggggcacttcttggagctgcaagaatccataaaaatatagaactcggtcagaaagctgcagagatgctttttgatcttgagccagagaaatctggtacgcatgttctccttgcaaacatctatgcctctgcagggatatgggaaaatgttgctaaggttagaaagcttatgaaagacaacaaggtgaagaaggagcctggaatgagttggaacgagatcaaagactag

SEQ ID NO: 85115 - DNA, 390 bp, Glycine max
  Peptide Sequence Number=SeqID_176800
atgtctccttcacctctgggatctcacaaccactcacaaactcatctcaagctctcagaacaacttcctcttcaagctctggtctctgcagatcttcacatagcaaaatctctcaaaactctctggaacttaaacctttctctctctagaatcactagacatgttttatacacaaaagttagtcatattcatcgactaacatcaacacgactacaattattgccgcaagtactgccactgaggtggaccagactcactcatgtccagagtaagcattccttcccaccatatggcctgcctcccaaatatacaccacccaatgttgcacacgctcctgatgacaatgtcgataactctgctcccgtacccattgagagccaacaaccctaa

SEQ ID NO: 85116 - DNA, 333 bp, Glycine max
  Peptide Sequence Number=SeqID_176801
atgtcttcagccttaagcaaccaactcgcttgggcaagtacagcttgcctggtttctacaaataaattgctatttgatccaaaaattaccaagactgaaaagaagaacaaagagaaaaagaatcaagcaaccactaagccacaaggtgaatcttcttctattgattctccttcaccaaaacagccactcacaattgatagtatggcaggaaaaggaggggtaggaaatagaccaccaaggaggactcttggtgactatgcttatcaacaaggaccaaagcattacaagagcatacttattcctcctttcagtaacaaggttgtggagttgtga

SEQ ID NO: 85117 - DNA, 366 bp, Glycine max
  Peptide Sequence Number=SeqID_176802
atggaggctggatctttgagcttcaatgaggaagaaggagtttcaccaccaagaattgccttggataagaagcttgaagaggatgctttaatggaggaaaagaaagagagaaggggggagcacgaaattgaaggaataaaagagggagagaaatggaactttgaagcttatgagaaccctagtaccttcccttggatctctggcccaatctacttagagtcttctatccaatgcccttgcggggtaggattgcatcattctctccaccttggaaaggatttgacctcaaatcctgaggtaaggtctgaaaacccatttcctgggcatcttctcatgaaggaacatggtttctcaccaactcaatga

SEQ ID NO: 85118 - DNA, 192 bp, Glycine max
  Peptide Sequence Number=SeqID_176803
atgttcttccatatgaaggatttttatgtgacgaaagaaccttcttctgtgagttcatacggaacaactttattccgtatgttcatacggaagaaggaactgagttacatgacatcatggaagattgtctgtggctcgctaagggagaggcctatgctggaagtcttagggcgtgacgtagactgcgcatag

SEQ ID NO: 85119 - DNA, 231 bp, Glycine max
  Peptide Sequence Number=SeqID_176804
atggtgaacaagccatttgaaacttctgaaggcactcagggaactattgttccgaaggacaatctgctagagtaccccaactgtccatcacataattccaggcccatttgggccctccagaagattcctccagagggcggttgcttctggaggaagcaaccctgctcgcctgggcgagctaagctcgcctgggcgagctgggcggcaagcatctcccctattttgctataa

SEQ ID NO: 85120 - DNA, 823 bp, Glycine max
  Peptide Sequence Number=SeqID_176805
atggtgccatcaatgtggaccatagaagtcaagaggatgtttatggaaggggtgttgttaggtgcacccagcagtattgctgatgcacccaacaacttcccattattccaatattgccctcccgtaaaatttgatggaagaacttcttccgtaacctttaacggaagaagtagggaggaagaagggggagagggagggggaggtcgtggtggcggtcgcggttccagcaaacttgttgtccaaaatcatctgagacaacttccgctccacgtgaccctcttactttccatcaaaagtgctgcaagccttgcccgaactcactgtcaagggatgctgcaagccttgcctgaactcgctgttaagggagtagaagggggagggggagggaggaacaaggggggcgattgcagcgaacttgttggagtagaaggggagggggagggaggaacaatggggggcggttgcagcgaacttgttgtccaaaatcatctgagacaacttccgctccacgaacaagggggagaggaaggggaaaggggagggaggaagaagggggaaggggagtggcaggaagggggagagggaggtcacacgatggcggttgctgcaagccttgtctcaacttgctgtctcagaaagcagatctatgccaccttgttgaactgggggcacaacgatgaaaggtggctgtggactattgggactattgggtcttcaaagaaattaagggaccgactagaatgtgcatcagcagcaactttggtagcatccaagtcaggccaagatattgtagccttcatttaccatgatcttacacaacaag

SEQ ID NO: 85121 - DNA, 115 bp, Glycine max
  Peptide Sequence Number=SeqID_176806
gaatgtccggaaacacatctacaaaacctgcgtacgaatctatggggtctcagaaatcgacctcacatgcaacgagcttcactccatcagaataataacagagttaaagaagagg

SEQ ID NO: 85122 - DNA, 177 bp, Glycine max
  Peptide Sequence Number=SeqID_176807
tatgcctgcgtgtttcgacgagaacaccaaagaaacctaattcagctttacgcaagatagccaaagtacgtttaaccaatcgaaaggagataattgcttacattcccggcgaaggccataatttgcaagagcattctgtggttatggttagagggggtagagcgaaagatttgccag

SEQ ID NO: 85123 - DNA, 438 bp, Glycine max
  misc_feature (8)..(8): n is a, c, g, or t
  Peptide Sequence Number=SeqID_176808
atgcaaanggcattacgatcaaaaacaccccttccttatcctcatctaattactctattcttgcgtcatttcgatgtccttcttgactctgagacatttgttcaagtcaagagatcattttctaacggggcaggagtagttacttccttcggataccgcaaagagcgtgatggctcttgggtgaagaaggacattcctgcacaagcagcaaaggaccgctctccatcaccacctcctcagagggatgactcttcatcccttatgaaaagcattctcgatagactagatggactacacacgtatgtcggtgagcgttttgacaccctggaaagtcgcattgatacacaatttgcagacatggatactcatattgatcggcttgaagaggatgtgagtttcatccgtcagtgcttcgaccttccaccaccgccttcatag

SEQ ID NO: 85124 - DNA, 171 bp, Glycine max
  Peptide Sequence Number=SeqID_176809
atggcaatctttgctgacatggtggagaaatgtatcgaagtgtttatggatgacttcttcttcttcggctcatcttttgattgctgtctagaaaatctagagtgctgtgttgggccagagaaaaggcagaatcttccatgctatttactatgctggcaaggttttgaatga

SEQ ID NO: 85125 - DNA, 222 bp, Glycine max
  Peptide Sequence Number=SeqID_176810
atggctggatttcgcccggaccgctgcggggaggcgggtgcggatcatgcgcaccagcatgactacctgacccaaatatggatgacactgctgctcagcaatgtcttgcctagcgaccataactctgacctccctctgcctaagtgccagttggtgtatgccatcctgacgcggatgagcgttcacgtggcccaggaatggcgcctactaggcaccctttag

SEQ ID NO: 85126 - DNA, 1040 bp, Glycine max
  Peptide Sequence Number=SeqID_176811
ggtccgggcacgacggggctctcaccctctctggcgcccccttccaggggacttgggcccggtccgccactgaggacgcttctccagactacaattcggacgccgagggcgaccgattttcatggtgggcttttcccggttcgctcgccgttactaagggaatccttcgggtagccccgcctgacctgaggtctcgttgggagcgtgcgtgcacgcaaagggtcgtcgatgggtccagaactgaccggctcgcacgtgattggtctcgagcgtggctcatccaccattttatcacggcgaagtcggccatgaacccagatttcaaccaaccacgaggcgggtgctcgcgggaggtcagcatacaccccgcgcagcaacattgttacatgtttgcgttggggaaacgatgtgtgacacccaggcaggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgtatcgccggggtttgtgttgtcgcgaggacgaggagcgggcgcacggggcgccgtggtcatcccctccctcccgacggcatcgacaatgatccttccgcaggttcacctacggaaaccttgttacgacttctccttcctctaaatgataaggttcagtggacttctcacaacgtcgcgggcagcgaaccgctcacgtcgccgcaatccgaacacttcaccggaccattcaattcggctaggagcgacgggcggctgaggtctcgttcgttaacggaattaaccagacaaatcgctccaccaactaagaacggccatgcaccaccacccatagaatcaagaaagagctctcagtctgtcaatccttactatgtctggacctgccttgcgaccatactccccccggaacccaaagactttgatttctcatacggtgccagcggagtcttaaagcaacatccgctgatcctg

SEQ ID NO: 85127 - DNA, 255 bp, Glycine max
  Peptide Sequence Number=SeqID_176812
atgaaagtggagaagagttggcacattgatagtggttgctccaaacacatggcgggagatgcatccaagattattcatatttctcccaaagatagtgaatatgtaatctatggagacaacaaacaaagtagattaccattgatgtgtaatcgattaccagcaacagaactcttgaaattcaatttgaaaagacatgacccttcaaaatataactgtgtaatcgattaccagaaacctgtaatcgattaccagtga

SEQ ID NO: 85128 - DNA, 353 bp, Glycine max
  Peptide Sequence Number=SeqID_176813
atggcttacgaacggggcggagatttcctggaagatgccaggaagatacttaacagggaagcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgtttcagtccgaccgctgcgccttatccggctaaactgaaaggacaagttttggtgactgcgctcctccaagccagttacctcggttcaagagttggtagctcagagaaccttcgaaaaccgccctgcaggcg

SEQ ID NO: 85129 - DNA, 315 bp, Glycine max
  Peptide Sequence Number=SeqID_176814
atggctacagccaggtgggcactcaagcatcctgtttatggcattgtgatactacggttgggaatttacacagacagacccaacgtttccaagacgacgttcctaaatgaaaaactctacacggttccggaatttcaacaaacactattgacaacaacaaaacatgaatctggggatcccacggtcatgtggctccgcatgccaccggactcttgtgtcacggtaacaaaaagtggggtggtcgacaaaagtagggcttttgctcctacgtatcctcaatttgtgatgaggaactcagacctacgtagttcttga

SEQ ID NO: 85130 - DNA, 240 bp, Glycine max
  Peptide Sequence Number=SeqID_176815
atggagcttgcatcaaaagaagtctacccaaacctgaaatttgaagtcccacaatgtagaggtgcgcttcacgactccgaaaatggcttcctttcgcgatttggggcagaaatgtttctctggttccagtccctcgcgtttctctgcacccatcggggccagttttcgaaggtaggcaatatatatatcaaaacgctcaaaatgaaaccccgagcgtggttcagaggttggttttgttaa

SEQ ID NO: 85131 - DNA, 348 bp, Glycine max
  Peptide Sequence Number=SeqID_176816
atgccaccccaccaggcaccctctagaccagataagtctaacagggccctgggatttttggcattgatcacgggcctctgccagtcgttcggggttcccgtcacccccaacaaagtgatccgaccaccgatcacccgagccttcattgagaagtactgcacgcctaggcaagcacagggtgacgcacctcagggcgcggacgcaccgccaccacctcggcaggctgatccggcggagccactgggcatggagcggtatctacaacatttggttcgccagcaagcggccaaccaccgcggacaggtgcagatacacaagtgtctctacagtttcagccacagtcagtag

SEQ ID NO: 85132 - DNA, 537 bp, Glycine max
  Peptide Sequence Number=SeqID_176817
atgagtcatcattcatctagtgttaatggcgaggaagcaaaaggggaagaatctagtgaaagtgaagaagcaaaaggggaagaatctagtgaagaaatctacccccaagaagatggacaaccattagtggttaaaaagaagtgtaaggaggtaagtgtctcctccaagaggttagctaagaaggaaactcattttacaataaagacaaacattaaagaaaatttccctcttagacaacctccacattttctcttttgtaaaaagacacttgttagcactgccacacctcttgggcttgaggttattcctcaagtaaaggagttgttggatgagggtttggttcgtaagagctttaatccttgtgctttgttggtgcccaaaataggtattatttggcaccaaatccctacaataagtgatatgatgaatgtattgagtgttgcaaccctcttttgtaaaatcagtcatgcacccaacatcttcatgattgatgtacatagggactcattaggtaggtgctcatatgggacaccttag

SEQ ID NO: 85133 - DNA, 243 bp, Glycine max
  Peptide Sequence Number=SeqID_176818
atgacgagtccctcgaagcaagaagcgggtcagacggagagtgaaaaggatgatgtcgcaacctacccttcggcgggagggcgacgcgagactcgcgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcgcggggaaggtattag

SEQ ID NO: 85134 - DNA, 336 bp, Glycine max
  Peptide Sequence Number=SeqID_176819
atgtgtaatgtcactggatgtcgaaagaaggcacaggccattcaaaaacaaaacactgcccctcatgtgttgtctcatggaggttatgattttctggaacaaaagttgatggaagagaagaaaaagaaacgattggaggaagcaacccaatctaggagcactgacataatcgttgaccctccatctcccattagacgacacatgaagtggaagatggcttcacagttaagctttgtcgtcgatggacgtcaggatgtactgactgctaccattgggcgactagagtaccctagtcgtgtccttgctgctggagttgttgtcacgattaaacaataa

SEQ ID NO: 85135 - DNA, 255 bp, Glycine max
  Peptide Sequence Number=SeqID_176820
atggtgaaagttggaacctcttacgtgccgatcaacgtctcattttcgccaaaagttggcccagggcttcccggtatcaacagggacaccaggatttatttattctgcgaagtgatcttccgtcacaggtgctccagtggcttctgtttctatcagctgtcccctcctgttcagctactgacggggtggtgcgtaccggcaaaagcaccgccggacatcagcgcccacaagagttgctgtcactatgcgagttaa

SEQ ID NO: 85136 - DNA, 574 bp, Glycine max
  Peptide Sequence Number=SeqID_176821
atggcttcctcaccaaaagaaacttccgcttctggttcaccagctgtaccatcatctccgcaccaggaacaaccagaattcaacatccaacccatacaaataattcctggtcaagcttcagtccctgagaaactgattcccagaagacaacagggagtgaagattgctgaaaaccctagccttgcaacaagttctagggaagtagacaaggagatggacaagaaaatccgcagtatcgtgagtagcattttaaaagacgcctctgttcctgaagctgatgaagatgttccaacatcttccaccccgaatgtttctgtgcctgatgttgagaaagatgttccaacatcttccggcccaaatgctgaaggactctcttcccccagcaaagagagatcaacagaggaagatgatcaagcgacaaaggagacccctgcaccaagggcaccagaacctgctccaggtgacctcattgacctggaagaagtagaatctgacgaggaacccattgccaacaggttggcacctggcgttgcagaacgattacaaagccgaaaagggaaactcccatcaagag

SEQ ID NO: 85137 - DNA, 477 bp, Glycine max
  Peptide Sequence Number=SeqID_176822
atggtgaaagttggaacctcttacgtgccgatcaacgtctcattttccgccaaaagttggcccagggcttccccggtatttattcggcgcaaaagtgcgtcgggtgctccagtggcttctgtttctatcagctgtccctcctgttcagctactgacggggtggtgcgtaacggcaaaagcacccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttggataggcaggcggagcaactactataaactggtgagtgttcattggccaaaggggacttgcgattcaacgatggctaggccggggaggagtaggtga

SEQ ID NO: 85138 - DNA, 279 bp, Glycine max
  Peptide Sequence Number=SeqID_176823
atggcggaaatcgaaaggaagtactgttacgcaatccgcccacttgggccttccaggatgttcctccagaaggcggttgcttctggaggaagcaacctagctcgcctgggtgagctgggtggcaagctcctcccctattttccaagccgaggcgcttccgtaacgtttccgtgtgtgattttgcgaagattttcaaccgttcttcgacgttcttcgtcgttcttcggtcttcaaccgtcatgccgtaaccacgttggaaaccaaaaagaggtaaaataa

SEQ ID NO: 85139 - DNA, 108 bp, Glycine max
  Peptide Sequence Number=SeqID_176824
atggccaaccagcaggcgaccaagaccaaagccaaaggtagcaagataccttggatatgcatgtatatagcaaaaatacctcacaaaaatatacagatgtttaggtag

SEQ ID NO: 85140 - DNA, 726 bp, Glycine max
  Peptide Sequence Number=SeqID_176825
atgaacgcttggctgccacaagccagttatccctgtggtaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggatcgaccggccgaagccgaccttgggtccaaaaagaggggcagtgccccgcttccgattcacggaataaaggccccgaagggcccgttcccaatcgtccccgacggcacgcgacgacccgctctcgcgcggaagcagctcgagcagtccaccgacagcgacgggttcgggactgggacccccgtgcccagccctcagagccaatccttttcccgaggttacggatccattttgccgacttcccttgcgtacattgttccatcgaccagaggctgttcaccttggagacgtgatgcggttatgagtacgaccgggcgtgggaggcactcggtcctccggattttcaagggccgccgggggcgcaccggacaccacgcgacgtgcggtgctcttccagccgctggaccctacctccggctgagccgtttccagggtgggcaggctgttaaacagaaaagataa

SEQ ID NO: 85141 - DNA, 243 bp, Glycine max
  Peptide Sequence Number=SeqID_176826
atgtgtcctaacatggccctttcttggagctacagccttgtccttaaggatcaaagaaggaaactggctacatcgcacaaattcatcctcccacatttaccagaggtacggatgaaagatgaacaaatacaagacacctatggtgccgccctccaaaaaagagaagaacccaaccaagaccccaccacagaagatacaggaaacccaacccaactcaaccaaaagactccgaaagattggtag

SEQ ID NO: 85142 - DNA, 1758 bp, Glycine max
  Peptide Sequence Number=SeqID_176827
atggcgactccatcaccgttgcagccactcaaaacaactatccaccaccaaccacccttgcacttatactaccctccacaggaccttttcccttcgttaccgtgcccacacccgtctccacaaccaattttaaaatcatcatcattatctcagaaattaactcatctttgcccttccacccaaaagctcaaatcccactataccaggatggaaccatttcggaaaaaccacattgacattcaattgttgtgcaatgatgaaactccccactcttatgtttgtgccctatggttcctcaagcaattggatgtctacttcctcttatttgatggttgggtagttgatgcatgccaactatttgatgatataggctgggtagcagatgcgacatctgcgcgcccctttatcaagtggttttgttctggtgctataaggagcaaatatttggcacatgcccaacccaatccacatgaaatgcttccacagcatcctacatttcatgattctgcatatccaaaaaggatgttggataagagagttgcaattctgttttgtgccacatggacctgtgtgctatttgggaaaggtggtatgatgtctatggttgttaagtctaagacaaaggattctgtgaaatatgaagttgttgatggaggaaagctcaagtcaagaggaaactgtgcaacactaccttcaatcactgagaaggattgggatgatatcacgtttggagtggataacaaagttgacttctatgttgtttcctttgttaaggatgctgaatttgttcatgaattgaagaattatttgaagagctgtggtgctgatatacatgtcatcgtaaaaattgaaagtgcagagtctataccaaattttcattcgattatcactgcatctaatggggctatggttgccagaggagatcttggcactgagctccctattgaagaggttccacttttgcagggagagataatcaacttgtgtcataccatgggaaaggctgttattgtggcaacaaatatgctagacagcatgattgttcacccaactccaaccagaacagaggtatcaaatatagcaattgttgttcgagaaggttctgatggaataatgttgtctggagaaacagctcatggaaagttcccactaaaagttgtgcaagtaatgcacacagtagcattgtggacagaagccactataccaagtggtaaaatgccacctaacatcggtcaagtgttgaagaaccacatgagtgagatgtttgcctaccatgcaaccatgatgtctaacacccttggaacctcaattattgtctccactggaacaggtttcatggctcaagtggtttttcttgaccacatacttattgtaacagacagagtgacagccacagaaaatggtcttcccccacacaaagcaacacctctgtttgataagcttgcatttgagaagacacaacaagcactaggtggacatgttcctatcctattactaggagctgcttcttcacctcgacttgtggaagagatttgtttctcatatacaggaattaacaaccttgtcttgcatttcatctgttgtagcagtgttgatggcgcggtgcgcggactcggcggggatgatgagctggacgaaggtcatcgtctcggagcgcatcagatccattggcggcaagtttccaaagaaccgatccattttcccgggaatggatcttcggctccagatctcagaaaaccgttttgttttcctctgtca

SEQ ID NO: 85143 - DNA, 1818 bp, Glycine max
  Peptide Sequence Number=SeqID_176828
atgtcaagaaagctacgattcttcgaggatcaaatcaataaagctggtctaatgtcttctccttcagtcttgcaaacagatatttatctggaggatttagagatacaacttgctgagcatgaacatgagctaattgaaatgaactctaacagtgagaaacttcggcaatcatataatgaactcctggagttcaagattgtattacaaaaggcatgtcgttttcttgtttcaagtcatggcaatgctttttcagaagagagagaactggaggagaatgttttctcaaatggagactatattgagacaccatttttgtttgagcaggaaatgaggcatgcaccatcagatcaatctggtttaagatttatcagtgggataatttgtaaatccaaagttcttaggtttgaaaggatgttgtttcgtgccacaagaggcaatatgcttttcaatcatgcactagccgatgaacaaatcatggatcctatttcaactgagatggttgagaaaattgtgtttgttgtgtttttctctggggagcaagcaagaaccaagattctgaaaatttgtgatgcatttggtgcaaattgttaccctgttcctgaagatataagtaaacagaggcaaataacttcggaggaaatacagcagctgaagtggcaggccactggtactgctccaatatcatgttcagcttacaaggtttcatcccgtcttgctgacttagaggcaactctggatgctgggattaggcatcggaataaggctctagcttctgtaggaggccatttaacaaaatggatggacatggaggcactgcagcgtgcaacttttgacagtagttctcaagttggcataatctttcattcaatggatgcactggaatcaccacctacatattttaggaccaatagtttcacaagtccatatcaggaaattgttgatgcatatggtgttgcaagatatcaagaagcaaatcctgcagtttataccactattatattcccatttcttttcgcggttatgtttggtgactggggtcatggaatttgcctgttgctgggagcgttggttcttatagcacgtcaaagcaagctcagcactcagcttgcatcaattggaaagttgttttctagccagttggcggggaagtcgttcagagttgccttttctaaactctctcaagatgaagatgtccattctgctgggtgtggtgcacatgaacttgggaattcttttaagttatttcaatgctcgtttctttggcaattcgctggatataagtttgtgccccagatgattttccttaactgtctatttgggtatctttcccttctcatcgttgtcaagtggtgtactggctctcaggcagacctttatcatgtaatgatttacatgtttttaagcccttttgacaatcttggtgagaatcaattattctggggccaaagaccacttcaagttgtgttattgcttttggctgtaattgcagttccatggatgctctttccaaaaccttttatactaaagaagcttcataatgaggtgccgcttttgcctcccttatttcaaggacgcacttatggtgtgcttaataactctgaggttgatcttgagttggaaccagattctgccaggcaacatcatgaggaattcaatttcagtgaggtttttgttcaccaaatgattcactccattgagtttgttctaggttcagtttcaaatacagcctcatatctacgactttgggcattaagcttggctcactcagaactttccaccgttttttatgagaaagtcctgttacttgcttgggggtga

SEQ ID NO: 85144 - DNA, 360 bp, Glycine max
  Peptide Sequence Number=SeqID_176829
atggactcaaatttggtcaatcctaagcttcaggcaaagaaaagggatcctctagagtcgacctgcaggcatgcaagcttggcactggccgtcgttttacaacgtcgtgactgggaaaaccctggcgttacccaacttaatcgccttgcagcacatcctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 85145 - DNA, 1527 bp, Glycine max
  Peptide Sequence Number=SeqID_176830
atgttagatcttaatctcaatgcggaatggaccgattcgtttagtaacggtgactcgccgttaccgtcacagaagtttccagagggttcgaggaaccaaatggcggagtcagggacttcgaattcctccgtggtgaatgcggacgggtccagtaacggcggcggcgacgaggactcgtgctccacgcgcgctgacgatgtgtacaccaccttcaatttcgatatccttaaagtggaaggcgcgaacgacgtcgtaacgaaggagctcttcccggtgatgagtgaaggagctaaaggacacgctacgtcgtcattttcagcgaggaatggttttgtggatctctcgttcgatcgcgaaggaggggacagtgagatgaagatgcttcagcctcagaatcagcctcagactcagactcagactcagcaaccagcgaagaagagtaggagaggaccgaggtctcgaagctcgcaatacagagggcatcttttgacgaaattggtatttgagcttgtaggtggatttgacacggctcatgctgctgccagagcctatgatcgagctgctattaagttcaggggagttgatgctgatatcaatttcaatctgagtgattatgaggatgatcttaaacaggttaggagaatcagaagcaatttgttggatatgaaactagatggtgcgtatgatttgttttttcaccagtttcttactgggcagatgaagaatttgtccaaggaggaattcgtacatatactgcgtcgccaaagtactggtttctcaagaggaagttctaaataccgaggagtaacactccacaagtgtggccggtgggaagctcgaatgggacaattccttggcaaaaagtatatatatcttggtctattcgacagcgaagtagaagctgcaagggcttatgacaaggcagctatcaaatgcaacggaagggaagcagtgaccaactttgagccaagtacttatgaaggagaaatgaaatctgcagccattaatgaaggtggcggtcagaatcttgatctcaatttgggcatagcaaccccaggacctggtcccaaggaaaattgggggcaacttcacttcccctccatcccttacaacacacatggtggaagaagttcaaagatggaaaccaatgttaattctggaattggtaatccatctttgaaaaggatggttgtaactgaagatcgtccttcattatggaatggcatgtctcctaatttctttcccaatggggaaagagcagagagaatcggcattgatccttcaaaaggactccccaattgggcgtggcaaacacatggccaggtcaatgctaccccagtaccatcgttctctgctgcagcatcatcaggattctcaatttcagctacctttccatcgactgccatctttccaacaagttctatgaactcaattccccagagtctctgttttacttcatccagctcgcctacccgcaatgtatctgaatattattaccaggttaagcccccgcaggcaccaccatag

SEQ ID NO: 85146 - DNA, 297 bp, Glycine max
  Peptide Sequence Number=SeqID_176831
atggggcagatggctactcagttgaaccaagttcagtccaaaaattctgatagattgccttcacaaactatgcagaatccaaaaaatgtgagtgccatcaccttgaggtctggcaagcaaattgaagtgtctccaccagtagcagcacctgcacctgaacctgtcaagcttcattctatacctgaaaaagaggatgagccaactgcacaaaagagaaagcttcatgatcatgagggagctaacaaaaatttccatgcaggtggaccttcttctagtagttctaacttgcagttgtag

SEQ ID NO: 85147 - DNA, 465 bp, Glycine max
  Peptide Sequence Number=SeqID_176832
atggtgaaaagttggaacctcttacgtgccgatcaacgtctcattttcgccaaaagttggcccagggcttcccggtatcaacagggacaccaggatttatttatcctgcgaagtgatcttccgtcacaggtgctccagtggcttctgtttctatcagctgtccctccctgttcagctactgacggggtggtgcgtaacggcaaaagcaccccccggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaa

SEQ ID NO: 85148 - DNA, 529 bp, Glycine max
  Peptide Sequence Number=SeqID_176833
attggattttgagaacttaccggttgaagaccgaagaacgacgaagaacgatgaagaatcttcacgaaatcgctcacggaaacgtatcggaagcgttacggaagcgcgtcggagaacacagggaggtggttgccgcccagctcgcctaggcgagctgggttacttctaccagaacgcaccgccttctgttggaaccccttggaaggcccaaaacttcacggattgcctaacgatgggtgttaagtacctcgaggcagtcaagcgaaggttgcatgccaccaaaaacgaaattagggagatggccccgaaaaagcttcccgcaaagaggtccaggaaggacagcaccgaagaaggctccagcgttgccccacaagctgacgcagacttcgacaggcaccgattccagagcgcagagcatcaacaacgtttcgagaccatcaagggatggtcattccttagagaaaggtgggtccagttgagggacgatgagttccctaactttcaagaggagatagcccacagacactag

SEQ ID NO: 85149 - DNA, 908 bp, Glycine max
  Peptide Sequence Number=SeqID_176834
atggctacctcaccaaaagaaatttcagcttctggttcaccctctgcaccatcatctccgcaccaggaacaaccagaattcaacatccaacccatacaaataattcctggtcaagcttctgtccctgagaaactggttcccagaagacaacagggagtgaagatgtctgaaaaccctagccttgcaacaagtcctagggaagtagacacggagatggacaagaaaatccgcagtattgtgagtagcattttgaaagacgcctctgttcctgaagctgatgaagatgtcccaacatcttccaccccaaatgtttctgtgcctgatgttgagaaagatgttccaacatcttccgggccaaatgctgaagaagatgatcaagcgacaaaggagacccctgcaccaaaggcaccagaacctgctccaggtgatctcattgacttagaagaagtcgaatctgatgaggaacccattgccaacaagttagcacctggcattgcagaaagacttcaaagcagaaagggaaaaacccccattaagaggtctggacgaatcaaaactatggcccagaagaagagcactccgatcactcctaccacatccagacggagcaaagttgtaatcccttccaagaagaggaaagaaatttcctcgtctgattctgatgatgatgtcgaaccagatgtctcgacatcaaagagggccaagaaatctgggaagaaggtgcctggaaatattcctgatgcaccattggacaacatctctttccactccattggcaatgttgaaaagtggaaatatgtgtatcaacgcagacttgcggttgaaagagaactgggaagagatgccttggattgcaaggagaccatggacctcatcaaggctgctggactgctgaagactgtcaccag

SEQ ID NO: 85150 - DNA, 467 bp, Glycine max
  Peptide Sequence Number=SeqID_176835
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaatggtggcgaaacccgacaggactataaagataccaggcgtttccccctggcggctccctcgtgcgctctcctgttcctgcctttcggtttaccggtgtcattccgctgttatggccgcgtttgtctcattccaccgcctgacactcagttccgg

SEQ ID NO: 85151 - DNA, 513 bp, Glycine max
  Peptide Sequence Number=SeqID_176836
atgcgaccagagaagaaaccatggtcgtcactcctctgtaacgaaatcatcgaggaaatcttgtctcgtcttcccgtgaaacctttgatcccattcaagtgtgtgtgcaagggatggaactccttgatgtcagaaccctatttcataaaattgcaccttagcaaatctgctgggaaggacgatttggaacaccttcaattgataaaaaatgtctgcctcggatccatccctgaaatccacatggaatcgtgtgatgtaagttcgatattccattccctacaaattcaagcgttcttgttcaaattcgcaaacatgccaggttaccatctggtcggttcatgtaatgggttgcactgtggggttagcgaaataccagaaggatatcgtgtttgtttttcaaacaaggcgacaagggtgatatctagagaatcgccaacgctgtctttttccccgggcatcggtcgtagaacattgtttgggtttggctatgatccgtcaagtgacaaatacaag

SEQ ID NO: 85152 - DNA, 448 bp, Glycine max
  Peptide Sequence Number=SeqID_176837
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccaggcgtttccccctggcggctccctcgggcgctctccctgttcctgcctttcggtttaccggggtcattccgctgttatggccgcgtttgtctcattccacgcctgaccactcagtccgg

SEQ ID NO: 85153 - DNA, 249 bp, Glycine max
  Peptide Sequence Number=SeqID_176838
atggtggctggtaatacaacaattgagaaacctagagaagagtggtctgaagaagaaagaagattagtgcagtacaaattaaaggctaaaaatatcattacttcttccctaggaatggatgaatattttagggtgtcaaattgtaagagtgctaaggatatgtgggacactctacaagaatatgagatggagttgcaaagactaaatcaacatgaagaaatgataagaagaagaaaggaattgctctaa

SEQ ID NO: 85154 - DNA, 672 bp, Glycine max
  Peptide Sequence Number=SeqID_176839
atggcatttttgggagaaacaagcagtctgacgattatgaactccaaattggcttttatttttccgaatggatcgattattcacaacgaaattaatgtttatttccaaagttccactccaatacccattcgagtacctaacgcttgtggttttcaaacgctaaaaagcagaatgcacaatacccttcagctaaccgacaaacaatatttggatgaaatttactactggcagccattcacagatgcacataaccaattttgctttcaatttatgcaattgaaaaatgatgatgatgttaacacaatggtaatgtgtaatcatcaattctcttgtgttggcctgattgagttattatgcatcatcggtagaacactgaatgctatattaaacttacttcaagccactatgacccctactcatgatgccctgctatattataacgggaagtggaacatgccacgccaacacgactttgtcggttactcattcgcgggaaaaaatccaaaaaattttgacattccttccggatgtaccatcgatgaactgaaggatttgatcaagcaagttgcacctcaagggaatcccccttatggtcattatgagtattcagacaaagttatcaaatttgaaattattgagctgaaaactgacgatgacatgctaaggtcttag

SEQ ID NO: 85155 - DNA, 264 bp, Glycine max
  Peptide Sequence Number=SeqID_176840
atgtaccaacattttgtggtgtacaagaaaactcttctatttgagaacagacgatttttatttgaacctcttttgatatattgtgctgtcatcccaagagaaggatcaaacattgatgatgcagaggtgctaagatattgcaagaagaatcttgcatctttcaaagtccctgaaaaggtcttcattactgattctttgcacaagactgccaccggaaagattttgcgtcgtcttgtggcagaacacattgtctctcaaatttga

SEQ ID NO: 85156 - DNA, 963 bp, Glycine max
  Peptide Sequence Number=SeqID_176841
atggcggagccatcaaagaagagaaagggatcatcctccaccgctaccgctactgcccatcgccgtcacggcccatccggagcacccacagcacctattcctccttctttgtcatctccaagatcatcaacactgttttcatccgatgatcaacgtctacggtacctttctcaattttcttctagaataatcttagaccctaagtacctaaacgtagagttctttaatgatgaaacgtttgattgctatcaagtgtttcaaaattctggtcttgttgatttcatgtcatttaaattgccatattatcctgaacttgtaaaggtcttctactgcaatttaaaaattcaggatggtattattatgtctgaggtgcatggtacttctatggtcattgatcagtcacttttcttttctttgactcatttacccagtcaaggtgcaccttttgagggcaccattgttgatgactggaaatttgattattcgagtcatgatgctcgtcgcatatcgactgggccccatttggttcggtaccgaatgcataaggcattacgggccaatgcacctcttccttatccacatttgattactctatttttgcgtcattttcaaattccgcttgatgatgaaccctttgttcaagtcaagcgttcctttgcaattggtgctggtgcagtgacctcctttgggtatcgtaaagatcggaatggacaatggctgaagaaggatgcactccctcctcaagatgaacgtactccttcacctccccctcaacgtgaagattccgcactcatgaatgaagtcctctccgaattacggggtcttcgttcttatgttggtgaccacttcgactcgttagattcacgctttgccggtatggacattcgtcttacacagcttgaagaggatgtcggatacattcgtcagagtttcgatcttccaccaccacctccgtcttcttag

SEQ ID NO: 85157 - DNA, 376 bp, Glycine max
  Peptide Sequence Number=SeqID_176842
tcgggaaacctgtcgtgccagctgcattaatgaatcggccaacgcgcggggagaggcggtttgcgtattgggcgctagcggagtgtatactggcttactatgttggcactgatgagggtgagaaaaaaggctgcaccggtgcgtcagcagaatatgtgatacaggatatattccgctttcctcgctcactgactcgctacgctcggtcgttcgactgcggcgagcggaaatggcttacgaacggggcggagatttcctggaagatgccaggaagatacttaacagggaagactataaagataccaggcgtttcccctggcggctccctcgtgcgctctcctgttcctgcctttcggtttaccggtgtcattccgct

SEQ ID NO: 85158 - DNA, 901 bp, Glycine max
  Peptide Sequence Number=SeqID_176843
atggattcttcgttgatagaatggaaagaattaggggaagagggatccccggacaatgaaaacgaatgggaagatcgaaaagttggaagaagaaagaattttttggttcgacgcatagaattagctaagcattttctccgaacaaatatagaaccagaatggatggttttatgtcttttaccagttcttcctcccgaattgagaccgattattcaaatcgatgggggtaaactaatgagctctgatattaatgaactatatagaagagttatctatcggaataatactcttatcgatttattaacaacaagtagatctactccaggagaattagtaatgtgtcaggagaaattggtacaagaagccgtggatacacttcttgataatggaatccgcggacaaccgatgagggacggtccatcactttcattacatagatgtggattgccccgcgaaatagcaatagaacttttccagacatttctaattcgtggtctaattcgaaaacattttgcttcgaacataggaattgctaagagtaaaattcgggaaaaagaaccgattgtatgggaaatacttcaagaagttatgcagggacatcccgtattgctgaatagagcgccgactctgcatagattaggtatacaggcattccaacccattttagtagaggggcgtgctatttgtttgcatccattagtttgtaagggattcaatgcagactttgatggggatcaaatggctgttcatgtgcctttatctttagaagctcaagcagaagctcgtttacttatgttttctcatacgaacctcctgtctccggctattggggatcctatttccgtaccaactcaagatatgcttattggactttacatattaacgagcgggaatcgtcgag

SEQ ID NO: 85159 - DNA, 216 bp, Glycine max
  Peptide Sequence Number=SeqID_176844
atggggccaaaacaagttccgaggggctttatggggcagcaacagcgaactcaagcttcgaagggccgaaagggacaagttaaggttggaaagtatgatattagaggacaagttgaaggcttgtcaaaggttcgctttcactctgaatgggagtcaatagcttccaaggttgttagccaaagccaaggcaatggtggacgtgtactcagctcctga

SEQ ID NO: 85160 - DNA, 346 bp, Glycine max
  Peptide Sequence Number=SeqID_176845
atgactaggggcaatccaagtaatttacaaccctttgatcctgaaatagatagaacctttcatagattagttaggcatagtgtgcatcctgatcattctgtgcattttgagcattttgagtattctgttgctggtgattctgaatattctgactttgagcattcaactactaattttcatactgagaacatggctcaaccttcatctcgtgagaggactctcagggagatggctgcacctgattttacttatgaaagcttgtgcattcaatatcctgatgagggtgttccatatgttctcaagactggactaatacatttgctgcccaagtttcatggtcttgcag

SEQ ID NO: 85161 - DNA, 219 bp, Glycine max
  Peptide Sequence Number=SeqID_176846
atggcgaatgctagaggaaggacaccaccatttccatcttgtgatgtggccattaagagggtcccacagtattttccgtacaaatttgtaccgtcaacttgtatgatttggcttacagtacttgaaagcctctttacattgaccaaaagtccaaaaaactctatgaaactgacggtgttcgcaactaaacatattcccaacgataaaattgtcatgtag

SEQ ID NO: 85162 - DNA, 243 bp, Glycine max
  Peptide Sequence Number=SeqID_176847
ctggcaagacatctctgtgaaattaacaattactcatacagacctttgaatccaaatctatcaagttcatcccaaaggccaagggatagttatcctactgataggataatacttcagaatactaatgatggtcaaatccgaacagagatttatgttccagaacctgagtttcaaaaagtggaagatttggttgatgattattctgcattagaacaaactgggaagactataatgctcaattga

SEQ ID NO: 85163 - DNA, 390 bp, Glycine max
  Peptide Sequence Number=SeqID_176848
atggacgaaaatcaatggatgtatgacaatataatgtctgaagaaattgatatgaatgaaaaaaatgaaaacgaagctggtgtgaatgaagaacctgttgattgttctgatgcgtttaatacttcccgggtgtttgctacccaagatgatgttttgcagtgggctcgatcagttgcttatgaaattgaatttgaagcggtgacggtgattatgaggtcatacccaaacactggtatgagaggaaggactttattcttgttaattggttgtgaaaggagtgatcagtataggtgtaggaagaaagaatttatcagaagaaatactggcagttggaaatgtaggtgttcctttaagcttcgtgagaaacaagtggttgtaggccaaggatga

SEQ ID NO: 85164 - DNA, 213 bp, Glycine max
  Peptide Sequence Number=SeqID_176849
atgtcattcaataaggaagaggaggtatctcgttacggtggtagggagggtgtgcgttcatcaggaatgggaggtggcaggtcttgtttacgcacccattggtcatccatatccttttggtatccaaagaaggcaacaacaccagcaccaatagcaaatgatcatttgaccttaacaaaaggttcatcctctaaaggaacattacaatgctga

SEQ ID NO: 85165 - DNA, 183 bp, Glycine max
  Peptide Sequence Number=SeqID_176850
atgaggacaaaacaaagtatgtatgaaattaaaaatttggggtaccaaggattgcgagaattcgctaagcgcaaccttcagtggctgagcgcgaggaagaatccagaagaagatgagttgtcaagttcgctaagcgcaccactccagctcatcaagcgcaccacttcaagttctctaagctaa

SEQ ID NO: 85166 - DNA, 192 bp, Glycine max
  Peptide Sequence Number=SeqID_176851
atgagtctcgttgtgtctttctcctttgtttcctactccttttataggcccaagcggggtgatcatgcactgagcgcgataatgtctgggcttagcgaggcattcacacgcttagcgtgggattttgcgctaggcgcacctttaggcttcttcgagggtcttcttcgcgctaagcttgagcttgctcactaa

SEQ ID NO: 85167 - DNA, 205 bp, Glycine max
  Peptide Sequence Number=SeqID_176852
gcggttaaacctttgatactttgtgaatggggatacaaaaagaattctcaagcgggagaagggagacacaaaagaattcaggcggttagttctttgttcttttggaaaagggagaaaagagacacaaaaagaattcaggcgaaaaccagaaaacttcagaaagcttttggtacaaagaagaagaagaagttcaaagagattcaag

SEQ ID NO: 85168 - DNA, 246 bp, Glycine max
  Peptide Sequence Number=SeqID_176853
atgaaattgtgtagcataaaacttggtctctcattgggaggtaatgaatcaacaggaaatgataaagtaaaaagtgatcaaggccttcccatggatcctaagagaataaaggtcattcttgagtggcctactccaccaagtgttgaggaaacaatccctgagtttcaagaacctatggatttgaggtcaaatccttttcaagagggaggaaatgatgcaatcctaccccccaagggcattggatag

SEQ ID NO: 85169 - DNA, 315 bp, Glycine max
  Peptide Sequence Number=SeqID_176854
atggaccatgacgaaggtgtggtgaagggttttgccttgcaaccttcccgggtcggcggtgctgggttatggccccgtgctaagtttcggattggttggccccctcctcccccccgtgatcagttttgttgccaggattttgccaactttggctttgcgccccgttggctaagtctgtgcctcggtggtggatcatcatgtcataacatggcaagacacaaggggagggacgaatcaaagcgacaagggctgaatctcagtggatcgtggcagcaaggccactctgccacttacaataccccgtcgcgtatttaa

SEQ ID NO: 85170 - DNA, 372 bp, Glycine max
  Peptide Sequence Number=SeqID_176855
atggttaggaccagaggattaggtcgtgccttaggtcacgttactggcagaggtgtgggcagaggagatcatgatgattctgatgatgcttcgcagtgtcgacggcctactgcatccgcaagaaggcagcaagtacttgtgactgcggtgcacgatgagccagtggtccctgtgccagatgtagagactgacgtattctcgaatgacccgatggcaccatctgatgtaaaggacattggggcagacattcctgcagacacaggcgcgcaggctactaaggatgagcatgagggatttccaggtggtccaagcgacccatccgtgctgacccagtatgcgggtcacgttgcttgcagcgtatggacgggagag

SEQ ID NO: 85171 - DNA, 1770 bp, Glycine max
  Peptide Sequence Number=SeqID_176856
atgggccctatgctctctcctagagaactgctaggcatgacggagtcagcatcagagggactattgctgggactcagagaaaccgtggataagttgctctatggaatgcctcatctagacagaggtgacaaaaaggttctcaacaccttcgtgaggacatccaacttgatctacatgtgtaggatgatccacagtgtgttattcaacatactcatgcctaaggccttcaaggacaagttcaaccctaaggtgaagaagaaccccaatctttatggaatgctcttcacccaaatcttgaggctagatggagtggaggtttctttgatggatccatcatctggagccactcagctgaatggggctaccttcgtgaagatgggaattgctaaaaatttcccagagtatgtgcaaaggcatataaagaaagaaatgattgagactcctctgtctaatgttgatcagactataggaactcaagctaatcctttagatcttgagtctggagtgtcttatcaacaagcgcagggggagcaagccaagccaagccaacccagacacaaactacccatcaaaagaaaagaccacccaccatcttctaacttgcaacccttatcctcagtcaaaaagccaagaacccaacctccatctgacctcaaaaagagaaaaagttcagactcagactcagaccatgcacccaaacccaagaaacctaccatcaaaatcaaacctttcagccttaaccaccaactgaacctttaccatcatctcctaaacctgcttagaaccttggaccttctcaaccaacttcaaatagcaagagcagaaaaggccatgaaaaagaaggttgaagcagaaacaaaaaaaaaggttgttacccttgaaggacaagcttcaaaggatattcctgaaaattttataatagagtctttgaagacctcgacaaagaaagaggagttgagacagacaattgctagtgatcaagtacctgatgaagtggtacttgaagctatcaaagttgtgtttaaggaagacctgcagaaggcagagtttgatgccaatgtagacacaaagctccaaccagctatggtggaagacgcaatagctaaagaagaaagtaaggctctggatgttacaatgcttcaatatgttattaaagtctcattgcaagggtttgatgttgttgctgagtcagacaccgttgaaacaaaccctgggacatctctagattgtaaagcatctatggagctactgagaatgttcacttcgatgctatggaagttagactggaaattaggaagaagatctcaacctcagactgaactggagctagtgcttgttttggatgaaaatgtcaaactttttcatggcgtcaagggatacaaattgtctaaagggaaaaccagcaaccaagcatggagagaaaagatagatattgacacccaacgcttagacctagaaatgcataagattgagcttcaaaagttaaatttgatcaagctaggaaaagaagacaagccaattcttattcctaaggcaacctgctacaagggtaaagagaagttgcttgaagatgataaagatacacccccaatggcccttgttgatgttgttgatatggccataaaagtctacaacgaccctcttccatcccaaaagaaatatgttgatgctttcttggatagttcatctgatgaaaattttggggatgtgttcttttgcaagcttgaaaagaaggaagaagctaccatacaaaagggggagaagaagtaa

SEQ ID NO: 85172 - DNA, 774 bp, Glycine max
  Peptide Sequence Number=SeqID_176857
atgggttgggtctccttgaactgtgtgtccaagaagctatttaagttcgactcaaatgtctttctccacaaggaccatttcttcaagttcctaacttctgatgtggtggcttatggtttgccactgatgttcaatcaagaagaagagcctcgattcatgttctattggcagtttgacctcaccagcttcaagtctttaaacgaggatctgttgacccttttggagagggttgacaaggctatcttggagcagctgtcaactttgctggacgtgcggatcattctatcggtgagtgatcccctcattgccttggacagtaaagtgccttaccttgtcctttttgtgtctgagacgcctagttctggttgcccttcgagtttgcgagatcttcctccgactcaactgaacgtcgaggctcatactcctattgttgctattgtttctgctcctccacctcctcttgtcgtgcctattcaagagattgctctagctgctaaagttgatgcaccagccacttcaactggtcttgtcatggtccaccatcattgtacccttgctgagtgcgagtgtggcaaccatgagtgctcccaagatgtcgtgtcctccttcttcagctccccgggttcctcccttggctgtgatgagaagtttggctattatggaggagaatggacagcggcaccaggaggctctgagcaaggtggcgtccttggatgcaaaggtggtcaaatggagggctattgctcgcacggtctagagagtggagcgccttaa

SEQ ID NO: 85173 - DNA, 132 bp, Glycine max
  Peptide Sequence Number=SeqID_176858
atggttaaagaggagtgtaaggaggtgtcgagggaagaagccccagagtatcaagaacctctggatttgaggtcaaatcctttccatgggggaggggatgatgcaatcctacccctcaagggtattgtatag

SEQ ID NO: 85174 - DNA, 195 bp, Glycine max
  Peptide Sequence Number=SeqID_176859
atggaatcctatcccgcaagggcattgggtagaagactccaagtagattgggctagagatccaagggaaggccctagggttctcatgagccttagggaggtgagcttagctattagagagcttctcaaggaagttttctcaaagaaacttctcaaggaagttttctcaagaaagcttctcaaggaagctacctag

SEQ ID NO: 85175 - DNA, 413 bp, Glycine max
  Peptide Sequence Number=SeqID_176860
ccgttgtcccgttacccacttcaaagattcagtatgtcagggacgctgtgaactcattcattggatggcccagacatctagtgaaacctttatcttatgattctgaccttaatgtgcggaagccagttgaacatagtggtgatgcaaagcttgcaggtgaatccgatccattgggagagttgatgaagatattgttttatgtgtaccagaatccagtggaagtgccgtgggaggcgaaccaatctggacttcctgatattggggcaaaattttacatcactcatacagatctagcggaaataatatcaggtgacaagtgtttaaacatagcgatactacaattgtggaccattgtatatgcatatatgttcttgatagaagtaggaatagtgggggcaagatacgcgggttag

SEQ ID NO: 85176 - DNA, 883 bp, Glycine max
  Peptide Sequence Number=SeqID_176861
gatcccaccttcgagccaggacaatgtgggttctgtgggggttctgtgggttcgaccaacgacaatgtgggtgtcgacggagcggtttccggcagatttcgggcgggaggagaaagagaacagcgatttcaggcaggaggatgacaaagagaagaggcccgtcactgccattgtttttaccgttaagaagaaatttagtcactgcggttccgataagcctgctccagttcccggtccccctggcgccgttgaccaaaaataccgcactgcactcaaaaccgcaatgcaattcttcgatgatgggagccaagcgaagttggatctatcaaaagggatgtatgatgttggggataacatgaagtttggtttttcgatggcttttacagccacggtgcagtcttggtccattctggaatatggagatcaaatggatcacgttggccagttagacgccgctcagtattcgctcaagtggatcactgattttctcatcaatgctcacccttctgagaatgttctttatattcagtgctattgcgtcatgcttatggtctgggatatccagagctcaatgtcacctttgctctttgtcgtggcacctggtcctcaccggcagtcttgcgagatgtggaaagagttgcagactaaggtggctgaattacctaaggccaaacctcaaaagaggaaactgcaccaaggaagaggaggaaactattatcaagctacaccgaaaagaatcactgagggacaaaacaatgtggtaattattgatagaatgtgggctaggcttctatcttcaacaaatctgcccagctttacgattgctaagactgtctctaaagaaaaaaggcaagaagaagcaaacgatcatgtccctgagtaa

SEQ ID NO: 85177 - DNA, 225 bp, Glycine max
  Peptide Sequence Number=SeqID_176862
atgggtgttgaagtattggtcatcaaaatttctatttgtcgcaacctacctcacgacaggacggcgaaggcaaaatcgataagccaaagcgtccgtctccaagggagaaaacgagcggagttgccactaacgtttattcgagaaaatgttagaaaaaccaaaaagagatttgtggattttgaaaataagggttcgggagttgtttacgcatggggaaggtattag

SEQ ID NO: 85178 - DNA, 759 bp, Glycine max
  Peptide Sequence Number=SeqID_176863
atggaagttactcctctctcttccccttctccaatccatcgtctccatctccgtcacaaagaagcgagattcttggcggtgccttctaccctcttgtgtactcgtagaggaacaacaacttatgtacacccaattttgaggacttcacataactctcctccatgtagcttgcaagcaatctccaagaagcatgaaaatgtgtcgtggttatctgttagtcctaaattgcatgttcagaataaattcccgagagatgtagttgtaagatctgaacttactgctgctgggtctgctggagatggctatttgctacctgagctgaaattggaatctaaagtcaggggagtttgtttttatgttgtcactgccttttctgccatatttctttttatgctgatgctggttgggcatccatcagtgctcctgtttgatcgctacagaagaatgttccatcattttgttgccaaagtatgggctgcactgactgtagcgccattttacaaaattgaatttgagggattggagaatctgccacctccagatactcctgctgtgtatgtttcgaatcatcagagttttctagacatatatactcttcttactttaggaagaagctttaagttcataagcaagactgggatattcctctttccaataattgggtgggcaatgtttcttttgggtgtcatccctttgaagcgcatggacagccgaagccagctggtattctttcactattattattggaatcaattttaa

SEQ ID NO: 85179 - DNA, 348 bp, Glycine max
  Peptide Sequence Number=SeqID_176864
atgattgagcttctaataaaaaacttcgtaccccattgcccagaggctcttcgctatgcgaaggcctatcttgttgagagttctattaagcctttttctaagtccttcaagaagtatgggtttaacaaaaataagtttggtagaaagccttctttttctaaaaataataaaaatgcttttaataacaacaataagtctaaggacaaaaatacggggaatgaagtttttttccctttttgtgggcgacctaatcatttggccaagaactgttgtcaacgccatcaccaacctatgtcttttcttgaacctcatactaatgttgttaccattgttgtagccctaagttaa

SEQ ID NO: 85180 - DNA, 261 bp, Glycine max
  Peptide Sequence Number=SeqID_176865
atggataccgtagaagccaatgttgccttgggtctgccagtagatgcccgcacctatgagagtgcagcagatatgctgagtcactttgacatcaacagcatacgtttactttccaacaaccaggaaaaacgcactgctttgcagtccttcggtatcacgattaatcagcaagtccctttattgactacgcctaccacagaaaatctcaagtaccttcaaaccaagtcaatcaagcttggccacctgattccagacttgtga

SEQ ID NO: 85181 - DNA, 559 bp, Glycine max
  Peptide Sequence Number=SeqID_176866
ttatgggaattttacagaagcattacgggtgtcccggaagccccggaatcccattttcaacaaaacggggggtgtggtggccacctagcttgcccaggccagctcagctcgcccaggccagctcagctcgcccaggcgagctagggtgcagaagacgatgtcagtctctgcatgctatcaggcttttcgtcttacagatagcaaaaaggaacgtttatacggataatcactcgggtatttccgcccgtcaacgtgactcaaaagtcaatatgacagatcttgtgagcgcggaagatgacgtaaatctccgcgtgtcaacgggcttgtcggccacgattgacgaagggcgcaaagacgacgttagtctctgcatgctatcaggcttttcgtctttacagatagcaaaaagagtttatacggataaccactcgggtatttccgcccgtcagcgtgactcaaaagtcagtgtgacagatcttctgagcgcggaagatgacgtaaatctccgcgtgtcaacgggcttgtcggccgctattgacgaagggcgcaggaagacgac

SEQ ID NO: 85182 - DNA, 231 bp, Glycine max
  Peptide Sequence Number=SeqID_176867
atgctttgtgtaatcgattacaatgatttgggtacatctacttgggttgttgtgactgagaacatgagaaggtacatctcttgtggatcagttctagtggagggtacatccactaggttattcaaagagaacaaggaagggtacatcccttgtggatctttgcttgtaaaggctttttcaaggttgaacagaaatgtcaaggaccgcaggtcgcttggggactggatgtag

SEQ ID NO: 85183 - DNA, 1394 bp, Glycine max
  Peptide Sequence Number=SeqID_176868
acctgttgagattaagggagctagcatctttagtaagtgatccagttgattttcaagctcatcatgggaagttgctcagaattcttagagtagatgttgaggaaggatgcctagagaccctggttcagttctatgacccgctctaccattgcttcacatttcccgattaccagcttgtccccacacttgaagagtactcctacctagtaggtttacctgtgccagacaagatacctttccatggttttgagcctacccctaaaccctccgacatcgcagccgccctccatcttaaaacctccatcatccaagcaaaccttacctctaaaggaggcctccaaggtcttcccacccacttcctctaccaacaagcctccatatttgctgaagcagctagtatacttgccttccattctatcctagccctccttatatatggccttttattcttcccaaatgttgacaacttcatcgatatcaatgccattaaaatctttcttacaaagaaccccgtacccactctactcgccgatacctaccattctatccatgaccgtacccaggctggccggggaaccatttcgtgttgtgcacctttactctatcagtggtttaccttccacttacctcaatcccgtgccttcaagaccaatgatgacaagctttcctggcctcgccgaatcatgactcttgacccatctgacattgtttggtaccaagcagctagtgatgttggagagattattgtgagttgtggtgaatatcccaacgtacctcttttgggtatgcgtggcggaattagctacaacccacttctcgctcgacggcaattcgggtacccgataaagaaaaaaccaaacaaccttgccttgactaatgaattctatcttaaccatggtgatcactcgaacaaaagggaaagattcgcacaagcttggagcgctatccgcagactcaacagaagtcagttgggaaagaaatcagactatgtgcacgaatcttacacccagtgggttattgataggaccaagagctttggcctaccctaccgcttacctagatacctatcgtccaccatccccccatcatccttgcctatcccctttgatactaaggaagagtttcatgaacaattaaccaaagaaaggcaggaaaaagaaacttggaagaggagatgccaggagctcgagcaagagaatgagactttgaaagggaagatagcccaacagagccgtgagctttttatccagaaccagaggatgattgagaaggacgacttgcttcgtcggaaagacgccttgctccaccgagatgctagaaggaagaggaggtttgtggacttgttctcccgtgcacattcagattccgaggacccatctactccgggagtttga

SEQ ID NO: 85184 - DNA, 522 bp, Glycine max
  Peptide Sequence Number=SeqID_176869
atgaaggctgacatggacgcctcgaaagagcaagtgaccacaatgatggaggccatgatgagcatgaagaagataatggaagccaatgcggttgcagttgccgctaccagtggtgttgctgaggtgaacccgacgcctccatctggcctcaaccaaatgaatcatccaacctcagatatggtaggcatagacttgggaagtacgggcggcccccattatgtgcaaattcaaaacaagcatgccttcccaccatatggcttgcctcccaactatacaccacccaatgtggtgtacactcccagtgagaatgtcaataactccactcccacactcattgagagccaacaacctcaatctgatcatgcacatgtctctcaacctatgggggagacacatgaaattccccaccacaatctagccgactttgagccttgcctcagatatgccactgaagggcaagcaattggtggtatacccctgcaaaacactttggagggccctcaatttctcccccaaccataa

SEQ ID NO: 85185 - DNA, 633 bp, Glycine max
  Peptide Sequence Number=SeqID_176870
attgtggttagaactagagggttaggtcgtgccttaggcaggattaaagcatccgcacataggcaacaggaagctgcccctattgctgaggatactcctgtcgtgactaaagacgtacatgcacatgcagaagaagctgttgatgatgctaagggatttccaggtgggccgcatgacccatcagtgttgactgactatggtgaccatgttgtagtcatcgtatggaatggagaggaacatcctgaattgaagctatcctcccatggaaggaaggttcagaaatttgggaggcttgctcctaaagttgaagggccagtcgctgccacaggattaagtcttttgatcgcatgttccgtagacactggcgatcggggacttatatccgcttttgtggagaggtggcataaggaaactagcagtttccatcttcctgttggagagctgaccatcaccctggatgatgtggcctatctgcttcatcttcctattataggcgcattccacagcttcgagactctgcatgtcgacgaagcagtcttgatgttggtggagttacttgaagtctctggagagaaaggtagagctaagacaacacaatatcatggggcatacatacgcctatcatggctgtga

SEQ ID NO: 85186 - DNA, 363 bp, Glycine max
  Peptide Sequence Number=SeqID_176871
atgtgggatgctaccatgttcggggtgtttaatgaagactttccattgtacataaagcacaaaaatctctctgaaattgcacacggtggtcaatctctcagcatatctgttatacagttgtggattctgcatctgactgagacaagtatgcaagcggggaatttcgatatgtatggattcctcgagcgacaatccattcagagatctgggcaatcgcaatttgaatcagaaagttacatgaagagttggatgcagagttcaaaatgcgacgtctaccttggagcctacctgaatggcggacactggcaaatggtcatcattttgcttaaggaaacttgttgtctggttttgttacttgcataa

SEQ ID NO: 85187 - DNA, 234 bp, Glycine max
  Peptide Sequence Number=SeqID_176872
atgggcgagtcccacgtgaccgtacctgggtgtgtcgccgttcccattggcgacaccctcctctctccatcctacgtggcctatattgccactggtagtgacaatacacccctctctccagctttgtcgccactggcaatggcgggttcagccatgccgccagtggcaatggcggtttcctccacaaaacaaaccccctccattattttttttggaacagaccccatcccgtaa

SEQ ID NO: 85188 - DNA, 440 bp, Glycine max
  Peptide Sequence Number=SeqID_176873
atggagagaagtatgatagatgttgccaatggtggagcccttggagacatgacctctactgaagccaggaatttaattgagaagatggctttcaactcccaacagtttagcgccagaaatgatgctatagtcattagaggggtgcatgaggtagccacaaactcatctgcatcatctgaaactaagaagcttgaaggtaaactagatgccttggttaacttggtaacccaactggccatgaatcaaaaatctgtacctgtcgcaatactctgtggtttatgctcctctaccgaccaccagacagacctttgcccttctatgcagcaacctggagcaattgagcagcctgaagcttatgctgcaaacatctacaatagacctcctcaaccccagcagcaaaatcagccacaacagaacaattatgacctctccagcaacag

SEQ ID NO: 85189 - DNA, 259 bp, Glycine max
  Peptide Sequence Number=SeqID_176874
agttcgatgagttcaaagtggagaggcgtaatctacacaaatgcctcaccaacctccaggatggaagcacgtatgtggctgtggagattaaagccaggctctgtattccttgcaaggggtttattctgaatgctgagggccaaccatggaaactccttaggaaggatctgactacactagcccagacatggagtgtcttctcttactccaacttagttcccacatcccacacctcatatttgaacatggacagagccag

SEQ ID NO: 85190 - DNA, 204 bp, Glycine max
  Peptide Sequence Number=SeqID_176875
atggacaagtattgtccggtgccgagagtggtaacctcgatcgatgtggcagttgcaagtctgtcaagcttgacaagcccccgagcctggacaagtgttgtccgggctgcttatgttaggttgtctgaggtagacatgtttttggtttcacaggcaaggtctgaagtgtcaggcatgtgcggcgcatgcgcagtactctcatag

SEQ ID NO: 85191 - DNA, 396 bp, Glycine max
  Peptide Sequence Number=SeqID_176876
atggtgggagcaggtttgaaaaaggatcttagagtgtctagggttgtgccaggagggtctcttaatgccttcctttttcttctcatcggagttatttcacaaagacttgccatgttggagtcggtggctctcctagggtttcctcatttgggatcctggggaagaggatcaagctggcccttgcgaacagctgatgcactatctcccttcaaccctttgagcgaaatgtggcaaaaggaaaaaagaatccatggaccgaccccatcgtctccaccccgtaggaactacgagatcaccccaaaggacgccttcggcatccaggggtcgcggaccgaccatagaaccctgttcaaaaagcggaacgcattagctatccgctctcaggttggacagtaa

SEQ ID NO: 85192 - DNA, 668 bp, Glycine max
  Peptide Sequence Number=SeqID_176877
tgacttctacgtgccgatcaacgtctcatttcgccaaaagtggcccagggcttcccggtatcaacagggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcgcgagcgaaatggcttacgaacgggcggagatttcctggaagatgccaggaagatacttaacaggaa

SEQ ID NO: 85193 - DNA, 228 bp, Glycine max
  Peptide Sequence Number=SeqID_176878
atgaaccttcatggcacaagggctgacttaggatcgtctaggattaaaccttgttggaaaattcagaaaattgatcaagaaaaggatgggaaattggcaggattcaagggttgggcagtggctaatttcctgggacttaataagaacaaggttgaagatgaaatggtggaaggaaagaatcactctttctggcgagggcaacacacaaaggatgtgaaagacctttga

SEQ ID NO: 85194 - DNA, 306 bp, Glycine max
  Peptide Sequence Number=SeqID_176879
atgttcaaggcgatccaatggttaacaaattggaacgaagaggattttgctgagcttagaggggttgatggggactcggtgctgagaggaatgagaagaaggctacgtacgtgcacagtggtacctggagatatgtcgcgggggtcaggagaccttggggacgtcaggtggggtgctattgcccaaaaccaagcttggccaatcccgacccaacccgggcatagtcagtcagtgagaacctgtgacatacctaagcaggcgagctcctggcagtcaaccaataaaagaacaaagtgcacgaagtaa

SEQ ID NO: 85195 - DNA, 87 bp, Glycine max
  Peptide Sequence Number=SeqID_176880
atggtgggagcaggtgcgatgatttacttcacgggcgaggtctctggttcaagtccaggatggcccagctgcgtcaaggaaagatag

SEQ ID NO: 85196 - DNA, 180 bp, Glycine max
  Peptide Sequence Number=SeqID_176881
atggataagagcttgaagaaaggagaagatgaatggagggagaaggagagaaggagcacgaaattttgtgcctcaagggaggaaaaaagcccagagtttcaagaacctcaggatttgaggtcaaatccttttcaagggggagggaatgatgcaatcctaccccgcaagagcattggatag

SEQ ID NO: 85197 - DNA, 421 bp, Glycine max
  Peptide Sequence Number=SeqID_176882
gaagaactgttggatccctactgatctggcagttactattagaggggctaggagagcaagggcaaggccagctaaggctctttccacatctgcaactcctcctctagcacgtacctcagcagctccttctaccccatcttctacagactttcaacgtcttgaagccatgggggtacgaatagcaatctgcccacttgggccttccagatccttcctccagaagactgttgcttctggaggaagcaaccttgctcgcttgggtgagctgggtggcaagctcctcccctattttgctataaatagggggaggagtgaagaagaaaatggttcagccttcttggcacttctccctctcttgaaattgctgaggaaaattgtttccgtgaagaaaatccaagccgaggagcttcctcttcaacgg

SEQ ID NO: 85198 - DNA, 704 bp, Glycine max
  Peptide Sequence Number=SeqID_176883
agtttgtaggcagagatagagctgctgacgaggatgctggcgatgttcccgagaggcgtaggcctactgcctcagcccgtaggctacgcgttcatcagatgactacggagggacgtgatatggctgaggacgtcgctgacatgactgatgatgtccctgagcagcctacggaggcacctgagatgcgtgcggacgcacagggtgctgatagtggtgaggggtcagatggtgatgatgctgcagagggattccctggtggtccacgtgacccgtcagtgctcacatcatttgccgagcatgttgcacatgccgtgtggagtggacaggaacgtcctgatttgaagttagtgtcacatgggaggaagctgacactgattgggaggccagtgcctgagattgaaggcctggtggctgccacaggattaagtccactgatagattgttcagttattactggcgatcctggacttatatccgcatttgtggagaggtggcacagtgagactagcaccttccaccttccagtaggagagctgacgatcacattggatgatgtgtcgtccattctacatttgcccatcactggcgccttgcacagtttccacgctctttctacggaggaggccagattcttgctcacggagttgctggaagtgtctgcggaggaggccagagccgagacagcactcacacgtggagcatat

SEQ ID NO: 85199 - DNA, 105 bp, Glycine max
  Peptide Sequence Number=SeqID_176884
gctacagagtactctgatagactcacctatgagaatgttgaagtgggggcacttcatatgaaattttgggcaaaaatttctagagcgttcactataccgggatag

SEQ ID NO: 85200 - DNA, 174 bp, Glycine max
  Peptide Sequence Number=SeqID_176885
atgcaaaggactaaccgcctaagaattctttgtcttaacacactggagggtacatcctttgtggtacaagtagagggtacatctacttgggttgttttactgagaacaagagagggattttacaaggttattgaaaatcttaagaaccggtggttgcttggggactggacgtag

SEQ ID NO: 85201 - DNA, 213 bp, Glycine max
  Peptide Sequence Number=SeqID_176886
atgaccaagagcaaaggcaaggatccacttgaaggacttggaggacctatgacaagggctagagcaaggaaaaccaaggaagctcttcaacaagtgttgtccatactagttgaatacaagcccaagtttcaaggagaaaagtccaaggttggtttccaagcgttagagagaagggaaagcgattgtaacctccattttactgtcaatgtgtga

SEQ ID NO: 85202 - DNA, 321 bp, Glycine max
  Peptide Sequence Number=SeqID_176887
atggggttgcagtggctgattctcacctacgtggtcgcaaccgaagctgcggtggcaattctgctaacccttcccacgcccaaactcctgaggaaccgtttcgcctctctcgtttccctcattcttcaacccgcgcttttcattgtaccctttgcagggttccacctcttagatttatactggaaaaatgagcatcgcttgatgtgtacctctgaagtttgtactgctgcagagagagatcgatatgagaaatctctattggtaattggtaataaaacattttgcagcatgatttacattgttagcaagtctggattgtag

SEQ ID NO: 85203 - DNA, 549 bp, Glycine max
  Peptide Sequence Number=SeqID_176888
atggcccttattcgtcgccgccaccccaacctccgcctccctatcttagagcccactgagcgcaaaccccacttctcccttcccttagtaccccccaccaccaaacccaccaccaatgatgatatcaccattgatgaccttgagaagctcgttgttctaggccatggaaatggcggaaccatctacaaggtctaccataaaaccacctccaccacttgcgcgttgaagatcatccatggtggcactgacgtcaccacacaccgtcgtgccctcgtggaagcatcaattcttcgtcgtgccactaattgcccccatgtggttaacttttatagctctttcgagatgcccaccggcgatgtggcaatcctcatggagtacatggatggtggctcccttgagactgcccttgccgtcaacggcacattctctgaagagcgacttgtcacagtggcgcgtgatgtcctcgatggacttgcataccttcatgcacagaacattgtgcatcttgacatcaagcctgcaaacatcctcataaacactcaaggggag

SEQ ID NO: 85204 - DNA, 1359 bp, Glycine max
  Peptide Sequence Number=SeqID_176889
atgaagcatgtcttgaaaggaggactgcaaggacctttaagtagacagcttcctctttttaatgcatttagaccatctcaactagcaaatgttcaatgtccacgagatacccatttctgggtttatgaagatggatcttatgaggaagaagggcaaaataatattaagggaaacatatggggaaaggccaagtttttatatggaaacaagttttctgcagaagaattacaaaacatcaagcttatgattcaaagcaatatgtacaagtatctcagcattctacttgaaggacgggagcagtttgaagaggaagctctggcagagagagaatctacttcattagaaggtgaaggatctggacaagagacagcagctgacgaaaacaagctgagcgtttactctatcaatcaaagattcaagcacttttctgactggttactggatattatggccaccggagatttggaggccttcttccctgctgcaacgcgtgagtatgctcctatggtagatgaaatctggagagatcctgctgttcaggaaacatacaagagaagagaggaattacataatcttcccaatgttgctaaatatttcttggatcgggcaatagaaatatcaagcaatgagtatgaaccttctgataaggatatattatatgctgaaggagttactcagagcaatggtcttgcctttatggaattctcatttgatgataggagtcccatgtctgagatatacagtgaaaacatcaattatcctcctcatttaaccaaatatcaactgattcgcataaattcaaagggactgcgtgacggttgcaagtggttggaaatgtttgaagatgtgagggcaatcatattttgtgtttccctgagtgactacgaccagatgtggcctactagtactggtcagcttcgtaacaaactgctggcaagcaaagatctttttgagagtctggtgaagcatccttgtttcaaagataccccatttgtgcttctcctaaataaatatgatgtctttgaagacaagataaacaaagttcctttgtcaatttgtgagtggtttggagacttttgtcccgtgagaccccatcacaacaatcatgccctagcgcaccaagcatattactatgtagctatgaggttcaaggagctttattattcactaaccggccagaagttgtttgtggggcaaactcgaggccgggatcgcacgtcagtggacgaggcattcaaatacataagggagatcatcaaatgggacgatgagaaggatgaagatgtatatgaaatcaacccagaagagtcattttacagtacagaaatgagttcttctccattcatcagacaagaatga

SEQ ID NO: 85205 - DNA, 1422 bp, Glycine max
  Peptide Sequence Number=SeqID_176890
atggcatctttgagcatgacccagatcagaactgggaattgtgcatctgggtttggcttgaattgtgctgggaaggttaaggttggtcccagcagagttgggtttaaggtgtttgcttcagagactcaggctacagagcctgatcttagtgtcactgttaatgggttgcacatgcctaacccctttgttattgggtcaggtccaccagggaccaattacactgtcatgaagagggcatttgatgaaggttggggtgctgtgattgctaaaactgaatgggtttgtgttatagtaaatacagatacctggagctgtgttgtgatttgggaattaaggctgaaaactgaagagtttggagttctgtggccacagatcttcaattcttcatggtttagagtagttgacacttggatgctcctggtatcacttgatgctgcaaaagttataaatgtaactcctcgatatgcccggctacgggcaggtgcagatagatctgcaaaaggagaaattattgggtgggagaacatagaacttatcagtgataggccacttgaaattatgttgaaagaattcaagcaattaaaagaagagtatccggacagaattctcattgcttcaatcatggaggagtacaataaggctgcttgggaggagcttattgatagagtcgagcaaactggagttgatgcatttgaaataaatttctcatgtcctcacggtatgccagaacgcaaaatgggtgctgctgttgggcaagattgtgctcttctggaagaggtttgtggatggataaatgctaaagccacaattcctgtttgggctaagatgactcccaacataactgatatttcacagccagcaagggttgctctaagttcaggatgtgagggagtttctgccataaatacaatcatgagtgtcatgggaatcaacctcgatacactacgtcctgagccttgtgttgaggggtactcaactcctgggggttattctgcaaaggcagtccatcccatagcacttgggaaggtgatgagcattgcaaagatgatgaagtcagagtttgatagtgagaactatacactttctgccattggtggcgttgagacaggtggtgatgctgctgagtttatccttctcggggcaaacactgttcaggtgtgcactggggttatgatgcatggctatggtcttgtgaagaaactatgtcttgagcttcaagactttatgaaaaagcacaatttcacatccatagaagatttcagaggggtttctcttgagtactttactactcacactgacttggtaagaaggcagaaggaagcagttcagaagaggaaagccataaagaaagggttgcagtcagacaaagactggacaggagatggttttgtgcaagaaactgaaagcatggtttcaaactga

SEQ ID NO: 85206 - DNA, 3423 bp, Glycine max
  Peptide Sequence Number=SeqID_176891
atgctgccggttcttccaatcaaggggtggccattgctgctctgtcgtcgcggtagaagcaacaatcatgggactgatgctgccggttcttccaatcaaggggtggccattgctgctctgtcagtgagttgcggtagaagcaacattcatgggcatgatgctggttcttccaatcaaggggtggccgttgctgctccaccagccagtcgcggtagaagcaacaatcccaggaatgatgctggttcttccaatcaaggtttggccgttgctccgccggtgaatcgtggtagaagcaacaatcaagggaaagattctggtccttccagtcaaggggtggctgttgctgcactggcgagtcgtggtagaagcaacaatcatgggactcataggatggaaaaggaaaaggataaggggaacaagagtgggagtcaggtggagaagggattgggagtgggagtcagatactctagtttgcctcaactggtgcaagagattcaggagaagctcatgaaaggtactgtggagtgcatgatttgctatgagatggtccagaggtctgcggcggtttggtcttgctccagctgttactctatctttcacctgaactgcatcaagaagtgggctagggcaccaatttcaagtgatttgtccttgtctgtggagaagaatcatgagcttaattggcggtgtcctggttgccagtctgtgaaatttacctcttcaaaggagattaggtatgtttgcttttgtgggaagaggatagaccctccatctgatttgtatctgacacctcactcgtgtggagaaccatgtgggaagcctcttcagaaggtgttggttgctggagggaatagggatgatctttgccctcatgcttgtgtcttgcaatgccatccaggaccatgccctccctgtaaagcatttgctcctcctcggttgtgcccttgtgggaagaaaaatattaccacccgttgctctgatcggcagtctgttcttacctgtggacaatgctgtgataaacttcttgaatgtgggcggcatcgctgtgaacacatttgtcatgtgggtccatgcaatccttgtaaggttccaatcagtgcaacttgtttttgcagtaaaaagacagaggttttttcttgtggggacatgtctgtgaagggtgaaattgaagcaaaaggtggggtttttgcttgtggttcctattgtctaaagaaacttggttgtggtaatcatgtctgtagtgagatttgccatccaggaagctgtggggaatgtgaatttttacctagccgggttaagacatgctgttgtgggaaaacaaggttggagaatgaacgccagagttgtttggatccgatacctacctgctctaaagtatgtggcaagctgcttcattgtggcatgcatagttgtaaagaggcatgtcatgttggggagtgtccaccttgcttggttgaagtttcacagaagtgccgttgtggctcaacttcccgaactgtggagtgctataagactacgatggagaatgagaaatttttgtgtgaaaagtcttgtgggataaaaaagaattgtggaaggcatcgatgtagtgaaaggtgttgtccatttactaattcaaatcattataatacctttagtggggattgggctcctcacttttgttccatgccatgtggaaagaagctaaggtgtggccagcattcgtgtgaatgtctgtgtcacagtggtcattgtccaccttgtttccaaacaatctttaatgaattggcttgtgcttgtggtaggacttcaatacctcctcctctaccgtgtggcacaccgcctccctcatgtcagcttccgtgctcagttcctcagccatgtggtcattcagtctcacacagttgccattttggagactgccctccttgttcagttcctgtagcaaaagaatgtattggcgggcatgtagttcttagaaacataccttgtggttcaaaggatatcagatgcaatcatccctgtgggaagaccaggcagtgtggtttacatgcatgtggtagaacatgtcaccccccaccttgtgatagtcaatctggtgttgtgcaaggtttcaaagcaccatgtggccaaacatgtggtgctccaagaagaagctgccggcacacatgtatggctccttgtcacccttcatctccatgcccagatataaggtgtgaattccctgttacaatcacttgctcttgtggccgtgtaaccgcaaatgttccttgtgatggtggtggtagcagtagcaattataatgctgatgccatacatgaagcttccattattcaaacattgcctgcaccacttcaaccagttgatgcaaatggcaagaaagttcccctaggacaaagaaaactgatatgtgatgatgaatgtgctaagctggaacgcaaaagggttctcgcagatgcttttgacattactgctccaaatctggactctcttcattttagtgataactctctttcttctgaattgctttctgatttttttaggcgtgagccaaaatgggttttagctgttgaggagagatgcaaaattttagttcttggcaagagtagaggaataggaactgcacatggtttaaaagtccacatcttttgtcccatgctgaaggaaaaaagagatgcagtgagattgattgctgatagatggaagcttgcagtcaatgctgctggctgggagccaaagcgatttattgtaatttctgttaccccaaaatcaaaggccccagctcgtgtgataggggttaagggtactacaactttaaatgtgcctcttcctcctgcatttgatccattggttgatatggacccgcgacttgttgtctcgtttccagacttaccaagggatactgaaattaattccttggtgttgaggtttggtggcgagtgtgagcttgtttggttgaatgacaagaatgctttggctgtttttcatgatcctgcccgagctgcaactgcaatgaggaggttggattatgcaacagtttatcagggagctgttttggttgccccgaatgctggggcatcggcggcatcttcagctaccaatgcctggggaggagctctgccggcattgaaaggtaactcatggaaaaaggctgtggctcaagactctggttggggagattctggggttggtgaagagtggactgctggttctgtgaatatccagccatctgtttggaagaaggaagcacctctggctgcttctttaaatcgttggaatgtcttggagcaggagtcaagttcaagttcatcgtctacaactattagagctgatatttctgggaagaaaactgaaaatactggtgaagaaggtggctcaaaggaagaggaaaacttggatgcaacttctgaagtagttgatgattgggagaaggcttatgaatga

SEQ ID NO: 85207 - DNA, 723 bp, Glycine max
  Peptide Sequence Number=SeqID_176892
atgaagctaacaaagtttggaagtccttctgttgctgatggggttgatgtgaagtcatattccagcaaggttaaaagcactggaatatctgaacctctatcagcgtcagaagtaagattgaatccttcagccttcgtacaatctgttccttctagtgaaaaagagtggggaaaagtgtgggaggtgtttatacctcaatcaaagaataaacagggtcaacgttatggttttgtccgcttcaaaggcgtggaggacgcaggttggttggagagacaactggataacaaaatctacatagaagggaagaagttgtttgtcaacaaacccaagtttcagagaagaggtaaaagggaagtgggaagaacagggggtgaagtggttcgagtaaggaaggtatccatgaatcctatggaacccaaacaagccagaatcaacagtacgacctccactagtatgaaatcgtacgctgaagctgtcaagcacgaccataagacgaaagagaaggagattacgatgcctttgatggggaagaagggaccagaagttcctgatgtttccgtagttattcaaactgggaaggacaaaactagctggttggataatctctgggtgggccgtttaaaaaatagaggtatgtttgagaaggcggtggatgaggttcaggagatggtaggtatggatgtgaaggtatcatactggggggacgacaccattatcctttaa

SEQ ID NO: 85208 - DNA, 234 bp, Glycine max
  Peptide Sequence Number=SeqID_176893
atgccgatctccccctgcggatgtatcagttggtttgtgtcatcccgacatagttctacggagtgcctgtcacccccggcaaggtcatcaggtcccctactaatcaagctttcatcaagaagtactacgcccccaggcaggcgcagggcgaaacaccacaacagcctggggatggccagcaacaggcaacaaatgcaccgtcgccacctccagagcccctcagctcatccataa

SEQ ID NO: 85209 - DNA, 447 bp, Glycine max
  Peptide Sequence Number=SeqID_176894
atgcgtattggctggatcgtgatgccggaatggctggcgcaccaggcggtgatcgtgaagcaggcggcggatctgcataccaatatgctctctcaggttatcaccgctgagtatctgggaatgaatcgcctgaacgatcagatcgccctgatccgcgaagactaccgtaagaagtgcgtggcgctggccgaggcgctggaaagccgtcttggcgagcatcttgagtttagccgcccggaaggggggatgttcctgtgggcccgtttccgctatccgttcgataccatggcgtggctgaagaagacgctggaaaacggcgtggtttacgtacctggcgaagcgttctacaacgataatccggatactcgcactctgcgtctttcctattcgacggtatctgaagccggtctgctgaccgccgtcgaacgtctggcgaaatctctgtaa

SEQ ID NO: 85210 - DNA, 147 bp, Glycine max
  Peptide Sequence Number=SeqID_176895
atggtgaaagttggaacctcttacgtgccgatcaacgtctcattttcgccaaaagttggcccagggcttcccggtatcaacagggacaccaggatttatttattctgcgaagtgatcttccgtcacaggtgctccaaggtggcttct

SEQ ID NO: 85211 - DNA, 320 bp, Glycine max
  Peptide Sequence Number=SeqID_176896
gtgacttcgacccataccctacattcaccaccgagggaccggcatttaatgctatgcctcagcccaatactgcggaagctcctcaacactgcccactgcaacctctgcacttcttagtggggagactgcctccgatcaaggagaaaagggagaagttggatctcatcaaggagagattaagggtcgttgaagggtttggtgatttctcatttgttgacatggcagagttgtgtttggtgcctgacgttgtcatccctcgaatttcaaggtgccagatttcgataagtgcaaggggactacttgccccaagaaccacctga

SEQ ID NO: 85212 - DNA, 219 bp, Glycine max
  Peptide Sequence Number=SeqID_176897
atgtgtagtgattgcttagtgcaatcctccatcctcgccttttattcggagtaccaatatcccacgaaccctaagagaataaaggtcattcctgattggcccactccaccaagtgtcgacggaatgagcccagagtatgaagaacctcgggatttgaggtcaaatcctttccaaggtggaggggatgatgcaatcctaccccccaagggtattggatag

SEQ ID NO: 85213 - DNA, 87 bp, Glycine max
  Peptide Sequence Number=SeqID_176898
atgagctcacctaggcgagctggttgcttagacacgaagccatttcatggcccagtcctaggaagaaattcaactcacccatcatga

SEQ ID NO: 85214 - DNA, 1027 bp, Glycine max
  Peptide Sequence Number=SeqID_176899
atgactgcattaaagcgctatgacaatttcatcagcgatccgcaggacaagaaattgctggaggctgactacgctgccatcaaatcttacgatgagttaggcagcagcgcattaacactttccttgtcgaacaagaaaacagaggccagggatgtgctccttgccaaccaggaagcaattgaaagcgtgcaggccgctattcgtgcacacagacaatttaacaatgagttagcgaaacaaagtgctgctcaagctgcgacagttaagaaaagtgcagtgttcatgcttatcggcattgcgattgcggtattggctggtgtggtctccctgggcttttatatcaagcgtaacttgttcaaacaattgggaatggaacccgcccagttgaccgtgattgcccacaactttgttgaaggtaacctgaaccagaaaatcgaattaccggctgatgacaagagcagtgtggcttattccatccgtgtattacaacgtacattggatggtttggtgcagtcactgaactatgtcagccagcaacacgacgaaggcgatattgattgcacggtagaccagagccgctttaagggtggttactctgaaatggccgcaggcattaataaaatggtggcagggcatattgccatgaaccgtagcgccattgaagtggtgaaagcttttggtgaaggtaatctggatatgccattggagcagttcccaggcaaaaaagcctttgtcaacgaggcgattgagcaagtacgttcaaacatcaaacgcctagtaaacgatgctgatgatttggcgcatgctgccgtcgaaggccgcttgtctacacgagcagatgccagccagcatcaaggggatttccgcatgatcgtggaagggatgaacagcacgctagatgccgtagtcaaaccattgaatgtcacttccagttacctggataatattgcgaagggtgttattcctgctagtattactgaagaataccagggcgattacagcctgatcattaacaacctcaatactt

SEQ ID NO: 85215 - DNA, 210 bp, Glycine max
  Peptide Sequence Number=SeqID_176900
atgctagccatcatcagcaagtaccaagaggaattaaatctagccatggcccatgagcacaaagtggcggacgagtatgcccgagtgtacgcggaaaaggaggctagaggaagggtgatcgactcattacatcaagaggcaacaatgtggatggatcgattcgctcttactttgaataggagtcaagaacttcctcgattgatggcctag

SEQ ID NO: 85216 - DNA, 597 bp, Glycine max
  Peptide Sequence Number=SeqID_176901
atgacgatcgttgtcattgccgggcggaatcgatctttccaacgtgccgctgcgggatgcgctgggaactgcgctgcaatcggcgccgtgaatgcgctcgccgtcatcgatggtcggcatcgtgccgcttctggcgacgctggcggtgatgaatgtcgtggccgggctcgaactggttctgacgcagaataccgtgatccctcaccgatttctctcggcgctctccgccaggccccggccggaatacccggtactggccatcggtggtgcaatatacgcctttggctgcgtctttatgctgtgggtgaatttcctgaagcggcgcgggctgccgggctaccggtaaaatccttcgtggctggcgcattcgtgacgagcggtctgtttggcggcttcgcaggaatattatccgtatcctatctcagcggcagcaccaccgggtcgggtgaaatgctgttgcccgtggtggtcactgcgcttctcggcgccgtcttttcacgccgtctggtgccgacggtgaccggcacgctgctgtcggttctcttcgtcggtttctggtcacggcttcagcttctcacatttccagcacgctggtga

SEQ ID NO: 85217 - DNA, 447 bp, Glycine max
  Peptide Sequence Number=SeqID_176902
atgcaaacatgctttagtaaagagacaaaacttccaactgatcaaagcaacatatgctttttggatgaaaaacaatgtgtctattggggaaggaggcatttcatttctaaacgaccatttagaggaaacactgggtccaacaaagataggagaaaatcactcaaagtgtatcaatctcacacagtgcgtggcgagaaagttgctagcgcacaggattttgtcggcaatcaaagggagaggatcactttaggtcgtggtttccttttttgtttacttggtgacaattctatattgttcagatattgtctgggtaaggattatggtgagttgggattttggctcaaggcttgtagaacggctggttatgatatatgtcagggtttggccagcggttcggggataaaggggatgtcctacattatttccatgatacacatgcaacaatga

SEQ ID NO: 85218 - DNA, 105 bp, Glycine max
  Peptide Sequence Number=SeqID_176903
atggcgctaagcgcgccttcacggacaggaagcccttttttaagcctgacttgcaaagaatgtgagggaggaactttagcattgaaaaatgtattgtttccttag

SEQ ID NO: 85219 - DNA, 335 bp, Glycine max
  Peptide Sequence Number=SeqID_176904
gggcaagcgagcccgttgacacgcagagactaacatcgtcttcttcaccttgtcatccagagacagcgagtccgatgacatgtggagatacccaagtggttatccgtacaaaccaacttctgttaatctcgacccgtgaagttaggtggcaggcggaaataccccaagtggttatccgtacaaacacacttctgttaatcctgacccgtgaagtcaagtggcaggcggaaatactccaagtggttatccgtacacacacagttctgctaccccgacctgtgagaagtcaggtagcatgcggagacaccttatacggtaatccgcacacattttga

SEQ ID NO: 85220 - DNA, 369 bp, Glycine max
  Peptide Sequence Number=SeqID_176905
atgccgaccaggggatcagcggatgttgcttttaggactccgctggcaccttatgagaaatcaaagtctttgggttccgggggactctttcttgattctatgggtggtggtgcatggccgttcttagttggtggagcgatttgtctggttaattccgttaacgaacgagacctcagcctgctaaatagctatgtggagatcattgcaattgttggtcttcaacgaggaattcctagtaagcgcgagtcatcagctcgcgttgactacgtccctgccctttgtacacaccgcccgtcgctcctaccgattgaatggtccggtgaagtgttcggattgcggcgacgtgagcggttcgctgcccgcgacgtt

SEQ ID NO: 85221 - DNA, 294 bp, Glycine max
  Peptide Sequence Number=SeqID_176906
atggcacgcagcgtgtccgctccgtgcccctattcaagggacctatatgggagggagctaacaaggcttttagtggtaattcccaaggtggtcatatctctcttgaaggtctctagaggggtaagtcacggtaaaacattgcacaagattaaatggcctaactctctaaaaacagtccccagtggagtcgccaactgtcgcaacctacccttcggcgagagggcgacgcgtgactcgcgggatgcgtgttccacgaaaggaatacgcgcggagtcgccaccaacgtttatttga

SEQ ID NO: 85222 - DNA, 360 bp, Glycine max
  Peptide Sequence Number=SeqID_176907
atgggtcagctccagcgacaagcctttcgcaaagcttatggtaagatctgggacctaaccgtggcagaggactccacggaggccattgcctccctcgcccaatattacgaccagcctttgaggtgcttcacctttggggacttccagttaacacccacagtagaagagtttgaagagatcctgggatgccctctgggaggaaggaaaccatacctcttctcaggattctatccctccttagctagaatttctaagatcgtcaaaatctcgacacaggaattagactgtggaaagcaagtcgaaaatggggtggttcgggtactgtcgcaacctacccttcgacgggagggcgacgcgtga

SEQ ID NO: 85223 - DNA, 206 bp, Glycine max
  Peptide Sequence Number=SeqID_176908
gaagcaacctggctcgcctggggcgagctgagctcgcctgggcgagctgggcggcaacccacctcccctatttttctataaataggggaggaaccgaggcgcttccgaaacgtttccgtaacgttttccgtgaggaatctcgcaaaggtttcaaccgttcttcgacgttcttcattcgttcttcatcgttcttcgatcttcaacgg

SEQ ID NO: 85224 - DNA, 315 bp, Glycine max
  Peptide Sequence Number=SeqID_176909
atggttcaaggcaaatttgttccaactttgggggaggcactgggttttcataatggaggagaggtttgcaaagatgcaaaagagagtgatttattctgtaaaagggaaagaaaactatcagtctacaacatccatttctcctttgcctttggctttaaacatttagctccattggagcttgtaggcctaggatcttcttcaccaatggattccttttcttcttggaagatgaatggcagcggaatggagaaggaagagagagaggagacgccacttcaaggagaagatgagtctagaagaagctcaccaccatag

SEQ ID NO: 85225 - DNA, 444 bp, Glycine max
  Peptide Sequence Number=SeqID_176910
atgtcattggacttcacgggtcacgatagcaaaaggtggggcggtcgacaaaagcagggcttttgctccaactctctaccggaagatgctaacatctccagaaagggtgcagatgaccacaattgtctctgcttgtcaatcggacttggggtctccaaattgcgaggtgtggataatcgtaaggtgtctccgcatgctactggactctcgagccgctggatagcaaagggtgtgtgcgggttaccgtcgggtgtctccgcatgctactggactctcgagtcgctggatagcaaagggtgtttgcaggttaccatcgggtgtctccacatgccaccggactcttgggtcacggtaacaaaaggtggggtggtcgacaaaagcagggcttttgctcctacatatcctcaatttgtgatgaggaactcagacctacgtagttcttga

SEQ ID NO: 85226 - DNA, 560 bp, Glycine max
  Peptide Sequence Number=SeqID_176911
atggaggctggatctttgagcttcaataagaataagccatggaaggagaactttcaccaccaagagagtgtcttggataagaagcttagagaggaagtgaatcagaaagagagatgggcgtgggaattgaaggaaattagggagaaattgaattttgaacataacacatgggaagcttgcttgagaagcaaggaaggtagcttccttgggaagctagaggaagaaagcttccttgagaagagaagaggtgagaggaggcaccatccactagagaataagccatggaaggagaagcttcaccaccaagagagtgccttggataagaagcttagatgggaagctccaatggaggaagagaatgagagagagagagagagagagagaaagaggggggcatgggaattaaaggagattagggagaaaagcacatgggaagcttccttgagaagcaaggaaggtagattccttgggaagctagaggaagaaagattccttgagaagctagagaaggtagcttcgttgggaagtaaggaagaaagcttccttgagaagctagaggg

SEQ ID NO: 85227 - DNA, 300 bp, Glycine max
  Peptide Sequence Number=SeqID_176912
atgactacatttaaggttcccaacaaaaagctcactattctaatggaaaattgcctaaaattattacacataaatggaagactaagaggattggtatcatggcttatgcaagggaagatgaagatcaactgggtcaacattattgtccatatcatgtcgaagactaagaggatgatgctagcaaagatggatgagctcatgagagtggataaggaggattatgttgaacttaaggagttctctgagtctatctcaaaaaggttggatgttatgggagcaccacacgtggatgacatttga

SEQ ID NO: 85228 - DNA, 1809 bp, Glycine max
  Peptide Sequence Number=SeqID_176913
atggatatacccagaactcatcaagatgttatgaaggaatgctcaactcaaggacaggaaaaccattgtgtccaaggttcttggaaaagaggtagtgttgtccctgaactccatcgcaagatcatagagtgcatcagggaaggaagcacataccaagaagactatgagaaaccctataagagccatgtcccaaaagcactctatggaaaaattctcaatgagacagatgggaacatgaagactctggaaggagcggacgacatctactatgccaccctcgtcaataaactcctttgggaatactacgtcttccatgtcttcgaaggaatgaacgaggactccaagaagcccattatcaacaagcctatccctctagtgatcgaggatgatatccagcagaaaaggcagaagaagctggccaagactattgttgatgaagacaaggatctggaaacctttgtccttgctaaaaagggcaaagtccaaaccagaaaacaatccccagagcttgaagaggaggaagagattgttgccaaggagcaactgatgaagaagaaacatgaagggtccaaaccctttcttccagttcaaactaaaaaggctcgtccacaaaccattcctatcaagagaagtcaaagacagatatctgtaaggcttcaaggctcaaaagctaagggacttagtgaaatagaggacgaatgccctctaataatcccaaggaagcaaaaagtggagcaacaaatacctatatctagaagaagcaaaagattgagaaaggcaacttataatcctttcctcccttccaatgaagaggaagaccaaaccaatccacctccaacacaggcaaagaggcctctttcctccatcgacacattaaagtttccaacacttggatccacatggaataaaagctatagaccatgggagcaactagcagctaaggagattgaacacatcaattttggatacttcttcatggacaaggctaatgtatcccaacttggtctagatggtcctcattggatgcctaacatcgagcttcaccactcctatagcaaccatcagaatgggcccctgctaggagaatccaactccttcaatccaatggtccaaggagacattatgaagcaaatgtacataccagatcaggccactacttaccccttggactccacatcagtagaagcattgacatcaaaatggtgccagaaaaaacttgcccaagactacccatttatgattaaggcaagaaagagggctttaagatctacttcaatggagaaatgcccaacaagggtcagaaggtacaataggttaaccaaccaagggactataagcatctattccaagaaccctgaggacgacctcattgagcatctgaagaagacagggcctagtatgaagcagtctggaaagcaaagcttgctaatgaagctaagcagaaagctgatgcagaagccaaatgacaagttattgctaagagaaaggctgaagcaaaggcagaaaagactagacccgacaaataaggttgataaggctccaactgtaccaacctcacatgaagccacatctaaggacaccactgctatcacaatccataccactacatttgggcctacaacaatcaattttgctccttcaaaagttatgactaaagttcgggtcaaggaaattattagactggtaatggacaactttgctaataagcaaagggatgagaatcaagaattcagacgcaccatgcaacaagccatcacaattcattttagtagtcttaatgaatctttcatgaacctccaacaggcctag

SEQ ID NO: 85229 - DNA, 126 bp, Glycine max
  Peptide Sequence Number=SeqID_176914
atggggatgtatgcttgtccttgttgcatgctggttttcaagaaaaacaatgttttgactaatgagatgcaatatgtacatggggggtgcagtgaccatgttggatatccctggtggggtaaatag

SEQ ID NO: 85230 - DNA, 363 bp, Glycine max
  Peptide Sequence Number=SeqID_176915
atgggagaaatagaggaagttcaagagcggatgaaggacgacatggaggccatgatgagcatgaagaagataatggaggtcaatgcggctgcagttgccgctaccagcgccgttgctagggtcagggaggccaaaagttgggaagtacaggcggcccccattttgtgcaagttcagaacaagcatgccttcctgccatatggcttgcctcccaactatacaccacccaatgtttcacacactcccgatgagaatttcaataactctacccccatactcgttgagatccaacaacctcaatttgatcatgcacatgtctctcaacccatggggaagacacatgaaataccccaccacaatctag

SEQ ID NO: 85231 - DNA, 246 bp, Glycine max
  Peptide Sequence Number=SeqID_176916
atgagtgaccttggaagattactcaagtatttcggtgccgcaatatttctcaagtgttgcacgaccagagatccatactcccacttggctacgtatattgagatttgtaataccgtcaagcttgccggtctacctgaagatgcgactaggctcagcctattttcattttctttatctggggaggccaagagatggttgcattcattcaagggcaacaatttaaagacatgggatgaggttgtttga

SEQ ID NO: 85232 - DNA, 663 bp, Glycine max
  Peptide Sequence Number=SeqID_176917
atggttagaaccataggtttaggtcatgcattaggtaggattataggcagagccctgggtagacaggatgatcatcatgcagatgatgttccccagtggtgtaggcctaccgcattcgcacgtaggcaacgagaagctgtccttgttgctgaggatgttcctgagatgactgaggatgtacctgcacctggtgcagagggattaactggtgatggtgctgagggatcagctgctgatgatgctgagggattcccaggtgggccacatgacccatcagtgctgatttcgtttgctgagcatgttgcacatatcatatggaatggagaggtattcgatcggggagttatatccacttttgtcgagaggtggcacaaggagactagcagcttccatcttccagtaggagagctgaccatcacactggacgatgtggcgtcactcctccatcttccgatcataggcgccttccacagcttcgagcctctacatgtggacgaggcgatcatcatgttggtggagttgctagaggtctcgggtgaggaggctagagttgagattgcacagtttcatggggcatatgtacgcctattgtggccacaagatatctatcaaaggagatgcgaggcccgatgttcacttccccacacagttcctttttcttaa

SEQ ID NO: 85233 - DNA, 234 bp, Glycine max
  Peptide Sequence Number=SeqID_176918
atgaagaaacaacaatggaagagaagatgtagcggaagacaaaggagaagaggtgagaggaggcgccatccactagggaataagccatggaataaggagcttcaccaccaagatgagccttggataaaaagcttggagaggatgcttcaatggaggaaaagaaagaggaagagaaagagagagggggggagcacgaaattcaaggaagaaaaagggagagaatttgaactttga

SEQ ID NO: 85234 - DNA, 333 bp, Glycine max
  Peptide Sequence Number=SeqID_176919
atggaggccatgatgagcatgaagaagataatggaagccaatccggttgcagttgtcactaccaacattgttgctaaggtgaacccgatgcccccatttggccttaaccaaatgaatcatccaacctcatctatggtaggcaaagatttgggaagtacgggcggcccccatgatgtgcaaattcaaaacgagcacgccttcccaccatatggcttgcctctcaactatacaccacccaatgtggcgtacactcccaataagaatgtcaataactccactcctatacccattgagagccaacaaccccaaactgctcatgcacatgtctcttaa

SEQ ID NO: 85235 - DNA, 261 bp, Glycine max
  Peptide Sequence Number=SeqID_176920
atggagaaaaatgaagaaacaacaatggaagggaaggtaaagctgaaaattaatggagcttgcttgagaagtgataaggacatggcaaggactaagggcaaggaacctttagaaggacttggaggacctatggcaagggctaaaacaaagaaggccaaggaagctcttcaacaagtgttaaccatgctatttgaattttggcccaagttacaagtggagaagcttcggattgtcaattgcaccatgttccaagaagagtag

SEQ ID NO: 85236 - DNA, 232 bp, Glycine max
  Peptide Sequence Number=SeqID_176921
atcgcgtcttttccggtttttccgacgttttcctcaaataaacgttggtggcgactccgcgcgtattcctttcgtggaacacgcatcccgcgagtcacgcgtcgccctcccaccgaagggagaggcaccaacaggggcaccagtagaggctcccgacgaggcagatgaggcccgcgaggacgaagagatgactgatttacttgatttcttaggagggagcggggccacatga

SEQ ID NO: 85237 - DNA, 231 bp, Glycine max
  Peptide Sequence Number=SeqID_176922
atgttgattgatgttggaaatgctttggcatgtgcatgttgtgtatgttcatggcgggcgaagtgcactgaccttctagggtctttggcacttgctttgggacacgttcatacgttggatgttgtgtatgttcgtgggggacgaagtgcactgatcttccagggtctttggcacttgctttgggccacgttcatacgtcatggcccagacgtgggtgacaagcgtggttaa

SEQ ID NO: 85238 - DNA, 144 bp, Glycine max
  Peptide Sequence Number=SeqID_176923
atgatatgggtcccaaaaggatcctcagtttacactaacacacataaggacccaataaagtttgggtacctaagtcaaaaacttgattatgtcttaagtacagcctgcttagtgttagtcaattatgtgacaaaggctatctag

SEQ ID NO: 85239 - DNA, 237 bp, Glycine max
  Peptide Sequence Number=SeqID_176924
atgtcaccacgctctcgtgcgtcgtcatcacgttggaccagcctcaatgaggaactggaagagcttgttgcgaatgtgcctaaacacggagagtggaggaaaatgacaaacaggatgcagaatgtcgcggctccaacagaggcttttttccagaccgttcacgccagggaccagattttcggtgaagttggtaaggtatatgctgccaagtggaaggacgtactggatgttatatga

SEQ ID NO: 85240 - DNA, 249 bp, Glycine max
  Peptide Sequence Number=SeqID_176925
atgggctacgtgggagtacgtgagctcagttggaggtgggcaacaggggatggtgggtttatacgtgatttgtggatgtggaaaacttgttgtgcatcatcgcccgaccgccacctagtaccacatgtgatgggtaccccatattcctataagcttgagatgaggagagtggtacctggagatatgtcgtgggggtcaggagaccttggggacgtcaggtggggtgctattgcccaaaaccaagcttga

SEQ ID NO: 85241 - DNA, 165 bp, Glycine max
  Peptide Sequence Number=SeqID_176926
atgcccttttgcgggcgagcgagggcgaggctcacgggtgcgctttccaaaggaggaaaggtcgaaaaaagcggggcttttgctcctacgtaccctccatcgaagaggaaatcagacctacgtagttctttcttgagagtgaatcaagcgattctttttacttga

SEQ ID NO: 85242 - DNA, 90 bp, Glycine max
  Peptide Sequence Number=SeqID_176927
tggcggatgaacctgatttcagaattgattggtatcaacaaagcaaaaatcatcgggaagaaacagtgatctgcaagtctccttctccag

SEQ ID NO: 85243 - DNA, 46 bp, Glycine max
  Peptide Sequence Number=SeqID_176928
atggctgatgagcaacctagacgagtaacccttgaagactactcaa

SEQ ID NO: 85244 - DNA, 639 bp, Glycine max
  Peptide Sequence Number=SeqID_176929
atggcacgcaaactgaggcaagattttagcatttcaaaagccaaaaagttcagaagcttttccctcactctcacgttgctttttctccctttctcctccaccattgaagcctccatcaaagctccaaactttactcaccatttctactccaaatcgcaaaaggaagccattttcggagtcgtgaagcgcacctcaacgttgtgggacttcaaatttcaggtttgggtagacttcttctcacatgatttcgtgggtattgggtgtttgggagatatgatgggggttgatggggacccggtgctgagaggaacaaggataagggctatgtgggggtacgtgagctcagttgaagagttgatttgcaccatcgcccgattgccacctagtaccacatatgacggtgttgtacctggagatatgtcgcgggggtcaggagaccttggggacgtcaggcgagctcttggcagtcaaccaataaaagaacaaagaccacaaagcaaggaggcttgtgtggtggctggccagctatggatcttgagtgatatctggaatatggcctctggtaatcgattactaagggaagttgagatggcctctggtaatcgattaccaaggggtgtaatcgattaccaggcttag

SEQ ID NO: 85245 - DNA, 419 bp, Glycine max
  Peptide Sequence Number=SeqID_176930
gcgcattccacagcttcgagactctgcatgtcgatgaagcggtcttgatgttggtggagttacttgaagtcttcggagaagaagttagagctgagacaacacaatgtcatggggcatacgtacgcctatcgtggctacgagatatttatcaaagtaaatgtgacaccggacattggactgttgcagctcgtgcctatctgttgcatttgttaggttgcattctttttgctaacaagagtgcaacacattgttggatatatgagcattttccctctgttgttgagtctttgagtaatccagactatgatgagatgtcaccacgtgtctgccagtggattgctacgaaggcttcttcgaagtcattactagcatcgacgtaccggaaacgtctagatggactgacgattgctgatgtttga

SEQ ID NO: 85246 - DNA, 685 bp, Glycine max
  Peptide Sequence Number=SeqID_176931
atggacttcaaatccggcgtgacctttgacccgcagccgtcgctgcagcagggcgagctggatctggtcatgacctctgacatcctgccgcgcagcggcctgcactattcgccgatgtttgattatgaagtgcgcctggtgctggcgccggaccacccgctggccgccaaaacgcgcatcacgccggaagacctggcgacagagacgctgctgatttatccggtgcagcgcagccgcctggatatctggcgccacttcctgcagccggcaggcattagcccgcagctgaaaagcgtggataacaccctgctgctgattcagatggtggcggccagaatgggtatcgcggcgctgccgcactgggtggtggagagttttgaacgccagggtctggtgcagaccaaaaccctgggtgaaggattgtggagccgactgtacgccgccgtgcgcgatggcgagcagcgtcagccgattacggaggcgtttattcgctcagcgcggaaccacgcgtgcgaccatcttccgtttgtgcggagcgcggagcgacccatcggcgatggacccacagcgaagccaggatcaccgctccccaataatgaagctcggccagtgcgtctgttgctgccagatggtcaggttgaccaacatgccatccgggacatgcacgttgttgatgatccccagc

SEQ ID NO: 85247 - DNA, 216 bp, Glycine max
  Peptide Sequence Number=SeqID_176932
atgtaccctctacttgtaccacaaagggatgtaccctccaatgtgttaagacaaagttctcaggcggttagtccaatgaatctttgtaaaggggaaacaaaagatatctcaggcgaagaacaaggtttggaaaacagaaaacttagaaagctttttggcaaaggaagaagaagaaagatgagaaggaaaggtttcaagatttctcaaaagttgtaa

SEQ ID NO: 85248 - DNA, 963 bp, Glycine max
  Peptide Sequence Number=SeqID_176933
tttgacgagttcaaggaggaactcgagagacgccattgggatgagaagctgactgatttttctgacaacagtatagacattgccattgtgaaggagttttatgccaacctctatgaacccgaagataaatcacgtaagcaggtgagggtgagaggtcatttagtgaagtttgatgaggataccttgaacacattcttgaagacccctgtagtgttggaagagggggagaacttgtgcacttattctcgatttgcactcatgaggcctgatcctcaggagttggctgctaagctttgtatcccagggaagggattcgagcttaatgttgatggacaacctttgaagattctaaggaagaacatgaccatgctcgctcagacatggagcatggacatgaacctggggtacctcatctcctaccagatctctctgattgcacaacatgacacatccaaacttgtattccctgccttgatcacaactctatgcaaggctagaggagttcaattagactctagatccctggagagcttgagccctgccattaactttacatatattaagaagaactgttggaatcttgatgatccaacagtgacatttagagggccaaggaaggccaggggtaagagatcagaggcccccactactttagcaccactagaggcaccaactccttcttcttccacaacttcattacctcccattcagactccaatgttgcactccatgctccagagcatccacagggggcagtccattatcatggcctccgcagcccaggagcctgcttttgaggagctagcagcagtagtagcagagggggaggatgagctcacccctcctaagccttcttattttgatgcagagccatccccagcacccatacctgatgatgccataccatctgcaccaacacctgagttagagcaacctatctctcaggattcaccagctgctcag

SEQ ID NO: 85249 - DNA, 351 bp, Glycine max
  Peptide Sequence Number=SeqID_176934
cttgagaggattgatggggacccggcattgagaggaacgaggataagggctacgtgggagtacgtgagctcagttggaggtgggcaacaggggatggtgggtttatacgtgatttgtggatgtggagaattgtcttgcgccatcgcccgaccgccacctatggtacctggagatatgtcgcgggggtcaggagaccatggggacgtcaggcgagctcctggcagtcaacagataaaaggaactatgaccacaaagcaaggaggcttgtgtggtggctggccagctgtgaatcttgtgcttgaaaacgaggtcaggaagctaggagagcttctggtaatcgattaccaaggg

SEQ ID NO: 85250 - DNA, 189 bp, Glycine max
  Peptide Sequence Number=SeqID_176935
atggtgatgatgaggagtaaatctaaaagagttactcttggaacacatgcgggtgaagagaattacaatggtgctaggaaaagtgatgacgtagctccatgtggagcttgtaggcctgggatcttcttcatcaatggagtcctttgcttcttgaagatcaatggtagtggaatggagatggaaaaatga

SEQ ID NO: 85251 - DNA, 96 bp, Glycine max
  Peptide Sequence Number=SeqID_176936
atggattgtagcagtgattatgaggcttcgtgggaaaccagtgcatggagggaaaggttggatggtgaagttgatctgtgggattcacaatcatga

SEQ ID NO: 85252 - DNA, 333 bp, Glycine max
  Peptide Sequence Number=SeqID_176937
atgaagaacggaggaaaaccttcacggatttgcttacggaaacatctcggaagtgttacggaagcacctcggcttgcattttcttcacggaaattttttttccacccaaaacagctgaaatgcatagccatggggattagggaccctgagaacaacccccttttgcctttttataggaaaaatggggaggaggttgccgcccagctcgcccaggcgaactgggttgcttcctctagaagcaatccaacttcgaaaaacactctggaaggcccaatttcaaaattgttatttgcacccctccattttgataagttcaccccccttctttcgtaa

SEQ ID NO: 85253 - DNA, 1892 bp, Glycine max
  Peptide Sequence Number=SeqID_176938
atggagagcaatgctaggattttcaaagaatccttgataaagattcctgtcctttgggatagcgttttgaatttgcatatctttgctaatgtgaacacggtcatttttggcctattatataatttacgaggcttgactggttgttctcctagtgatcttgtcaagcaaagctacttcagttctaccaaatttagggtgtccaatggaattataggtctcccatatcatgtttcccagggtgttggttgccagctgagggggcagaattgttatgttgaagtaagtcttggcttccctagatctggaactgacaacacgttgcagccaaacaaaaatagtgttaggaatttacccaaacttcatgttgccgaatctcctattgtgggacgaagtgatcacaagggatcaccagatcatttgttggattatgataaaacatttctctatccagctgaggcagtgcttgtgccagttttacaaacatcattagcaaggtcttccttgagaagaacatacaacacagtaaattcctttcttacatggtatcagagcctgattttggctgcagaattggatgggaccatccctgcctggttcctcttcctttattcactgctaaagcctcaattttcttcggctttctgcagtgctggtaatgtggattgtactgaagatccttggaccgaaatcaatggaacccgcacacaaaatagttatgatagtagtagcaatagcaatagtagcagtattagtagcttaagtgccagctctagtgatagtgattacaagactacaagaccaagtgaactagaggcagatgctgattctttgacgtgtagacagtctatggtatcttctgctgatcagttggacagtgatggccccaaattgggctctaagcggtctcgaacaggggtgacagagtcattaagtacagctacaaacattcctgtgcaagatgcttacatgtctgattttggttccatggaagtgaacaattcagccattacaggagtaggaaatgatccaattgggtcttactgggactgggatgatgatgatagaggcatggaaatggatattcaagcccttctatcagagtttggtgattttggtgacttctttgaaaatgatgttttgccttttggagagagagaaacttccatccgagatcgtgggagagacagtgggagagagagagatggtagactgagacatagagtgtgggagagagacagggggagagagagagagggtagaccgagagagagagtgaacacaaagagagcaacaaacggctacaggaacgacttccaccaacggggatttcggagcaacacaaggaggttctggaggattgatgacgcttacttgcgaactcaacgagactccccctcacggaccgcatacgaagaacaggagcaacagaaacttgatgttaacaatcatggagcctgggtggaagtaacccgcaagaagaaaaggaacgagaaggataatagaggcagaccggatggaggcagtcatcaacgggaagaaaagaaagtgacatggagagacaaggctgatgttacgacatattacttctctagattccctgaagggatgatggagaaagacatgtggaggatcttccagaagtggggaaaggtgtgggaagtctttatttccaaaaccaaaaacaagttgggccataggtttggttttgtccgatttaaagaagtcatggatgagaagagattagagaggcagctagatactaatatcttcattggtggggtgaaaatgtttgtcaatagtccgaaagtcgacagggggaagatgataggcaatcgtgaaagaaggatcttgagtcacggtgagggagctactcaacagaagcacaaagctgg

SEQ ID NO: 85254 - DNA, 1695 bp, Glycine max
  Peptide Sequence Number=SeqID_176939
atgggatattttaataataatagctggaggtgggacatgaggtggaggaggaatctctttgatcatgaaagccagttggctgtgcagtttatggaggaaattagttctgttcctattcaacggcagcccccaggaactgcagaatctcaggcacttatgctttctgccccggattgtggagatgtcaacagcagtccaggtggtgtgatagatgttccaggtcaaatacttttgcctgttgggtttccttcctttgagagctttaacccccctccttcaacatccatagaggaatgtcttaacaaaagtcaagataacttgaataactccatgtctttgtgtccaaccaatcaaactcaactgttgtatacgagggagtttgatcatattatgaaagctgaagcaatgatgacatttgctcctgaatttggagctgttgatacccctacttgtgagttgtccacaacattattcagaagcccatattttccaaaatctcgaaaagcaaagagttcaaattcaagttcaaacaattatttatatggtgcagcaccacccacttctccttgcactgaaggatcagaggggaagaatggaatgtctgccaacacaaaaacaggttctggaaaatatgatgctagtactacgagtctccactcgaaatattactatacttttgtggaaagtaggaaagaaaaaaatgataaaaatcctgccacatgtaatgataacagcataactaaatctgaggggataccaccactctcaaacattggttctaatgctattgtcaaatctgccataaggaagacaactgaaggcacacatgaagcagagcatttccttctatctgcaaaaactttattagcaactgatatcacatgtgttacgttgcaagcttccatgtgcaggttacgccatattctcttatcttcaggtaacctaatgcctgttggtttgagtaggtcaactggggtttcatttttgaatcagcttcctagtgatccaagtatgacaacagacaacatatctggcaagtatgatgtgaagaagaaagaaaatataccaattagaattgcaggtgatattgatggtggaatgcttgatggccaccttaatgcccctgttggtgtttggcgcacattaggagcttcaaaagttgtaaaaccttcaaattcacctaacatggaagttgttccttcctttcctcataattctttcaatgaagagggtatcctttcttatggtctaaggaaaccacttcaggagcttcttgatgggatagcattactcgtccaacaagctatttcctttgttgatctggccttggatgcggattgtggtgatggtccttatggtttgcttgcaatgcaagaacagtggaggcgtggattttgttgtgggccttccatggtccatgctggctgtgggggaagtcttgcctcttctcattcattggacattgctggcttggagttagtggatccactttctgctgatctaggtccagcagaaaaatatggcatcctccaacagcttgctgacattaaacctttcctcttcaaaaacaatcttattcctatgctgccagatactgcatgtcaaggaaatccaccaacattgccatttttgaaagctattgccatttccattcccaaccatatgctggaggaagtgcatacgcgggttctctag

SEQ ID NO: 85255 - DNA, 492 bp, Glycine max
  Peptide Sequence Number=SeqID_176940
atgagtttagtcagatgcatccctccagtttctcctaatgatgcgctgctggccatacccatctctgttgggtctgacataaaaacggctttgaaatctgctttttccaatttggaagggccattatctgtaactgattggtgcaaaggacgcaatcaattggttgatactggaagcatagttgatggagtttctgctgaatccagcattaatgaatgtagggattcttcagaaccaatgagtccatcccaatcatctgttggtggatcttccagtattaagggtagaatttccaacttgatggataaggtggatgagacttctcaaaggagatctggccaggatttatgcagtacagagttagagcagctatcatgttcccggctaaaacctactctcattgctcttccatttccttctatacttgtagggcttttcatagtatttgagtgcattgggttgggtggtttagatgattatgatgctgcatag

SEQ ID NO: 85256 - DNA, 1659 bp, Glycine max
  Peptide Sequence Number=SeqID_176941
atgaaaagggtaatgttactggtattgtcatgcctatggatcgaatcattattgacggtggtccggggtgaagacccttatctctactttacatggaatgttacttacggcaccatctctccattgggtataccccaacaaggcattttcatcaatggccaatttccaggacccaatatcaattccaccagcaacaacaatctagttatcaatgtcttcaataatcttgatgagccattccttttcacttggaatggcatccaacacagaaagaattcatggcaagatggggttgcaggaactaactgccccattcctccagggacaaacttcacgtatcgtatccaggtgaaggaccaaataggcagttacttctactacccaagcacagccatgcatagggcagctggtggttttggtggccttcgtgtaaacagtcgcttgcttattcctgtgccttacccagatcctgaggatgaatacaccgttctcattggtgactggtacacaaagagtcacaccattctgaggaagttattggatagcgggcgctctcttggtaggcctgaaggtgtccttatcaatggcaaaacagctaaaggtgatggaaaagacgaaccactcttcaccatgaagcctgcaaagacctacaaatatagaatatgcaacgttggccttaagaactccctaaactataggatccaaggccattccatgaagcttgtcgagatggaaggctcccacgtggtgcaaaacatgtacgactctcttgatgtgcatgtaggggaatgtttttctgtgcttgttacagcggacaaggaaccaaaggattactacatggtggcttccacacgtttcaccaagactgttctaataggtaaaggtatcattcgttacacaaatggtaagggtcctgcctcacccgacatccccccggctccagtgggttgggcttggtctcttaaccaattccataccttccgttggaatctcaccgctagtgccgccaggcccaaccctcagggttcctacaaatatggtcaaatcaacattactcgtactatcaagctcgttaactcagttagtaagtctaacggtaagcttcgttatgcccttaatggtgtctcacatgtcgatcccgaaactccactcaagctagctgaatactttggaatttcggacaaggttttcaaatatgatactatcccagacaacccatcacctaacattggaaacgctgtaaccgtacaaccaaatgttcttaacattacccatcgcaacttcatcgaaatcatctttgagaaccctgaaaaaacaatccaatcatatcacttggatggttattcgttcttcgtactcggcatagagccaggcacttggaccccagagaagaggaagtcctacaaccttctagatgccgtgagcagacacacagttcatgtgttcccaaaatgttgggccgccatcatgttgacattcgacaatgctgggatgtggaacctaagatcggatattgctgaaagtcgctatcttggccagcagttatacattagtgttttgtcccctgagcattctcttagagacgagtacaatatgccagacagtaacttgctttgtggtcttgtaaagaatttgccaaaaccagcaccatactcctaa

SEQ ID NO: 85257 - DNA, 210 bp, Glycine max
  Peptide Sequence Number=SeqID_176942
atgaagcggaaaaagatgatgtatagagaaggaaggactagtgtaaaaacgagaggcaagcagagtagtgcgactatggaagaactctggtgggcttgcaatggcgcaaaacgaaatggtggctgcaaatggcacctcttggcatcatctgctggtggtggacaaagggtgaaagactcaatgagcattgcaactcatgaggcacattga

SEQ ID NO: 85258 - DNA, 2598 bp, Glycine max
  Peptide Sequence Number=SeqID_176943
atgcccaataggtatcaggatgattggctcaagacatcagcaaactctttgcagcactgggagaaggctcctctagagccctatgctctacagaaacctattacctatcatgttgtatgtcccgacattgatccccttacttctgctgctgctgatttttttcaacaactaggaacagtgtatgagacatgcaagctaggtactcattcacctcaaggcttggggaatcagatggagatagagtccgcaaagttgtcatcttgtggttttgttttacttgattgcccccaatcaataaagattgagagcagcaatgcatctcttgttggttcagtaagtgattattttttatctttatctaatggttgggacctgactagttatctcaagtctctttcaaaggcacttagaggtttgaaaattggctcttgcttttctacaaaccccggcgaaggaagtaacagttcatgcttggtaatctatgtggtgtgcccatttcctgatcccactgcaattttgcaaactgtaatcgaatcttctgttgccattggatcggttgcccaacagtcagatagagagaggagatctagcttgcacagccaggttgtgaaggcattaagtggcttgaccactgtcgatgaagcttcagcgtctaatatccttgtgctttctgggtttagtattccaaaattggtcttgcagatagttacagtggatgccattttcagagtcacaagcccatctgttagtgagcttgtcattttaaaagagactgcctttactgtatacagcaaggctcgtcgcatttcacgtggaatctctagtgattttgctcaatctgcatttcctagatctcattctgttttgacacaaatgccttctcccatctctgggatgtggaaagactgtgttggtcctcgaatggcaggacattctcttccaagagagggtgacattgatgctagcttgaggcctggtacttgggataattcttggcaaccaacaaggactggggggttaagctgtgatccaagtagaactggagataattttctttatgatgaaattcgttacatgtttgaacccctttttattctcgcagaaccaggttctcttgaaaatggtatttcagttattggtagtcccacttcagaatcttccaaggcattggcagatgacagtagtggtaactatgcacagagtacaagtacagctggaaatgcggagtctgcttcaagcactgatggatctgggtccgatccggagactcctccaagcctacattgttgctatggatggactgaagactggcgttggctcgtatgcatctggacagactcaaggggagaattactggactgcaatattttcccctttggtggaataagcagcaggcaggatacaaagggtctgcagtgcctatttgttcaaattcttcagcaaggttgtctgatacttcaatcttgtgatcctggccttgcaaagcctcgagattttgtgatagcacgcattggaggtttttatgagctcgagtaccttgagtggcagaaagccatttattcagttggtgtatctgagatgaagagatggcctctgcaattgcggaaatctatgtctgatgggatgtctgcaactagtaatggttcttctttgcaacaatcagatattagtttgatccccgaaagaactcttccttcctcacctagtcctttgtacagccctcatactaaatccactagttttatgaaaggcagtttagggcaacctactgcaagaaagcagcttatgggtggacattctatggttgacaattctaggggtttgcttcattgggcacaaagcattagttttgttgcagtttccatggaccatacgttacaactagttctgccagcagattcatcaactcctggtttggctgatcgcgtcaaccctggctatgatcgaattgctgctcctggtttggctgcaatccactctttcaaaatcggtattatcgcgcattcttggctcctagcagttacttttgacaacgagacgattgaggagtacttgtgcaaaatcaaagggtatgttgatgaacttgccagcatcgacgttcctgttcgtcacgaggaatgcgttgatgcgctcctcgaaggtctaccgtctgattacgcgccagtggtctctgttattgaaagtaaaaagcacactccatccatcgtagaaattgaagctttgctctatggtcatgaaactcgactcgcgctacaacagagatgcccatttcttgaggttcgtatggtcgcggtgccttttcggactgaggtgttggccgtggtggtggtgtcttcggcagaggatgcagcagtggacaatttgcaaacttccaatgtcaaatctgtcttaaatatgggcacactatcaatgtttgtcattttagtcagaacctccaacacctgggttaatccgaattctaagaatcctgctccaggtcacagccaacccagtgcaatgctcactaattcatcctctcatgggaatggtcaagttggtaccacctggattccagattctagagcgagttttcatgtgactggtgacacagaatattaa

SEQ ID NO: 85259 - DNA, 579 bp, Glycine max
  Peptide Sequence Number=SeqID_176944
atgaggataagcatttgtatcccttgtgggaagaagacctcagaaataaacattcttgagatcgaaaattcagtttttgtgtctggtaacaaaaggaatagcaaatttgagggaagtggtgggaagcttgttaatgaggtatacagctgtagtaaaggcataatcccaaaactgcaaggccagtctgttagagatgccaaaggaggctacaagagtagagaaaggtctgtattcaccttcccaatcagactgaatactcttaattttggtgttaagctgcaattcaaccatggacttgaaagcttggaaaacagaaatggtttcaaccttgcactttataggaaatatccagtgagagctgaactagagaagtcagcatttgaaatagtagatgcagacatcagcagtgaaggactcttgaagcttgagattatgaaaggagtaaagtccatcaacaccaaaaactcctttaagaaggatcttattggtctcgttatgccaacatcattaggagacacaaatgatgaggaaccaatgttagaaatacttaaaccttcaccattgcctatgaatatctga

SEQ ID NO: 85260 - DNA, 537 bp, Glycine max
  Peptide Sequence Number=SeqID_176945
atggactggccaaggaaagggatatggaaggacggaggatcaaagccttgttccatgatcaatactgggagcaataggaaaccatgttgtggtcgtagaagatttggtgttataattaggtcggaagtaaatgtggctcccaaacaaagaggaattctccgattgtcaaaacaaggagttcctcttgctgtacaagaggttgttcacaggaggatggatggacttgttgatgatcctaacgcggtgtatatgagctctgctattcttgataggtgggaagatagattgcacgacatttttaatggacaaccctatgatatgcttgatgctgctcttactgatatcgtctccaagtttcccttggatattaagggacatgatacaaaacatgagaatggatacgaggaaagcccaatacaacaattttcaagagttatatctttactgctactatgtggcgggaactgtgggcttaatgactgttccgataatgggcattgcccaggagtctgtcatcccaattcaaagtgtatatga

SEQ ID NO: 85261 - DNA, 1416 bp, Glycine max
  Peptide Sequence Number=SeqID_176946
atgaagaaaaagaagcaggtgccggagtggatgaacagtgctctgtggtccaccccctccgaccatggccgctttgacccaccctctcctcctcctcctccccctgtttctgttaaagaagattcccggacaatcccaaccaatcagaattcctctcctcctcctttttcttcttcatccgtttcttctcctactgcttccgccgatgacatctcccggcaggcccaggcccaggctcaggctcaggttcagttgttggccgagttatctaggaaggtgatagacatgcgcgagttgaggagagtcgcttctcaaggaatacccgatgctgctttgcgtcccaccctctggaagcttctgcttggatatcttcctcccgatcgtgccctttggttctctgaattaaccaaaaagaggtcccatcagtcagaaatcacgaggaggatgtacaactccaactccaactccgctgctcatgatatcgatgatgcaaaatctgatactcagactcggctcttgctttctagatcacaaatcactcatcaggaccaccctttgagtcttggcaagaccagcatatggaatcagttcttccaggacacagagatcatagagcagattgaccgagatgtcaagcgtactcatccagatatagacttcttctctggtgattctcattttgcaaaatctaatcaggaggctttaaagaccatattaattatttttgcaaagttgaactcaggtataagatatgttcaagggatgaatgaagtattggctcctctcttctatgtgttcaaaaatgaccctgacgaggaaaatgcagcctttgctgaagcagacacattcttttgttttgttgagctattgagtgggttccaagataatttttgtcaacaacttgataatagtatttgtggaatccgttccactattacaagattgtcccagcttttaaaagaacatgatgaagaactgtggcgtcatcttgaggtcactactgaggttaatccccaattctatgcatttaggtggattactctcctcttgacacaggaatttaattttgctgacatccttcatatttgggacgtcattttaagtgatccagagggtccacagctttatatatgtaattatgtacttaatattattatatatatgcatacaaaaattattaaatttgccagccatccttctttccgccattttggctatagcgttttggggctggccactaccttccgctatccgggatttgacaaactatgcttcctcaagccactgggtattgcatgcaattacagtggtgggtgggaatgtccgcagcaagctgcagctggccttcaagtgcttctgcatgttgtgtgtctttatgccaagaaatgcatatcatcatgcctcaaatccagctga

SEQ ID NO: 85262 - DNA, 384 bp, Glycine max
  Peptide Sequence Number=SeqID_176947
atggtgggatttctctatgttaactatcaagtcaatttaataagtctcttggtcaataacatcagagattttccatttccttaccaatggttcactgtataccagaccatctatttgcgggtttcttcatatgaaaactcagaagatctaaaacaagatgtgaggttgttgctttctcctgttagacttggagcacaagcattttcatgggctgctggaaaattagaatcaaatggattaggattacctacatcaccttcatcatcagatgttcagaaccgggtattgcaggctgctgccaaacatgaatcccaaccatctgatagtgaaggtaaccaagatccagttcctgaaccgacagttcctctcaatcagaatgtatga

SEQ ID NO: 85263 - DNA, 1344 bp, Glycine max
  Peptide Sequence Number=SeqID_176948
atgaatttgaatccaaatggaactatgttcctttcaattacgacagtggatgaggcgacgcacaggtacatggtatgcctgcatgctacgccaccccatattgtttcagatgggttatggggaagtggtgcaacaaataggaaaccagtgaaatcttttctcccattgtttgagttacaggatgggaaagagggcatggaccattgccatatcgggattgctattacccatattttgtgccttttcaatgatttggttgttgcattggtctcccacaccgtaatttcatttgcggtcatttcttccctccttagtgaacttcaaatccaaaactccgaacttgggaaattggcattatcttcagcattgatcagtgacatattgtgcacaatcgctaccgccatcggcactgcagttatgattactgagaattctaatgtcaaagatgttataagaaacgtcttggctttgatatgtttggctatctttaatccattagtgtgtcgcccaacaatgttatggatcatcaaacataccccagaagggagagctgtgaaggatgaaggacctccactgggatctgcattggttaagaagcttaatttccttggtaccaccttccttttgccaatcttcgtcactatcaatcatgcctgccttgtaccttccctctactgcaacatgcaaccgcgtgatgctgtctctcttgccctcattttgaactgcaaaggcgttgtggaagttggcctctactgcttcttatacgacaccaacgtaatcgatgggctagctagcatttggagtaatgattttgagcataatggtggtagcatgcattgtgcaatgcacaagtcatactctgatgagcatgacaacccagatgctgtatctgcatacccttgcacagcaatagctccacccaacctcatcgaacatgatgatgaagaggcattgtgtatagctaggagagcaattaggaacccggggatgaacattgttatttacaaccttgtttttaaagcagaagatgatgagtgggggcaagaggtggatgatgatgagctagaagatgtgaagcatgcacgtgaacataatataaggtatcaacaaatcatagaaacagaaggatcccagacagctgcttttcttagtgacatagtgaaagagcatgacttctttatagttgggaggcgccatgggaatgggattgagtctcctcaaactgatggacttacagactggagtgaattcccagaattaggtgccatcggtgattttcttgcttcaccagatttggagagtcgtgcttcaattttggtcgtgcaacaacaactctcaccatag

SEQ ID NO: 85264 - DNA, 3144 bp, Glycine max
  Peptide Sequence Number=SeqID_176949
atggttttgaggtgtgccttttcatttggaacaaatgtcgagaccacgagggacaaagagaagaaggaaaagagagacaaagaaggaagggatggaaagcgtaaggaaaagaaggacaaaaaagaaaaacatagagaaaaaaagaaagacaaggacaagaacagagataaagaaaagagcaaaaccggtgctgcaattgagaaagaatttccaggacaagctcagggtcccaatgctggtaaactacatcaaaaggaaatcaaaccaattgataagattgttttacttgaggataaacttaccaaacagtttgccagtaacaatggagagaaggctagagagaataatcatttttttgaggaaaacaaggattctaaattcctcctggatttggaaaggaggattagggataatgacggaggagctgagaatcaattggctcaaaagtttgcaactgcaggacacagaaagaatgagggagctgttagattggttactaagggtagtggcacctggcctgatggtaaggaaaggcttcaggataagggcattgatactagaatggttgataggagagaaatctgggctgagtcccgaccagttggaaatataacagttcagaataatgctggaaaatttcatcacagggttgatgaaatgcccaaatctttggaaaataatttttacaaacctttggaagcagcagttgaaggaaaagagagggttaaggaaaaaaaagatgataaacacagagataaaaagaaaaataaagagaaggggaaaaaaggacatgggaaggacaaagacaggagtaaagaaaagaaaaaggaggagaaagcaaaggagaatgctgaacatgaaaacagagagcagcagaataaattaaaagaaagcaccaaagctggtccattaggctcaaattctttcacacaggtttccaggcacatctatgagaattctgctgttggggaaaatctcaagaaacggaaggacattgaatcaaatggaattatgcatgcaaatgacaattggcccagtaagttgccaacgccctccccctctccctcccatctcactgaaaatgggaggatattggaaccctgccaaatttcccttcagaatacatctgataataggctagcagcagcctctaatatcaaggttgataacaaaaaacgcaggacaaatggcatcattgaagttctaccatctgcagtttcctcaaaaactcccactcccactgctaccttgccagctccagtcagtgaagcatctgcaaaaccacctcatccagataccaagtacataagtcaggtatattccgtacccaaagcagatgagtggtctgattttgatgaccaagagtggttgtttggcagcagtcattcgcaagaaaggaaacctgtagtgaaatcttcagaggttggggatacactgcagggaagcatctgtcataagtgtttacatgtttggtgcattgctggaggcttgattggagcagtagttctcacttcacgcgacgacatagtaattcatttacagattagacttcataaagaaaggcagccgcagattcccttgtttgggggattgcacccaattcgaaaggatcttgagagcagatgtgtggctgaagaaggtgtgcatttggcttcacaatatggagctcattcactgagaaattcatttgcagtgcaagctacaaagacagtattgggcagtttttcttctacaagtgaatcaggataccttacaagcacgtggggttattcaccagtgctgacagatggacatcattcactgagtaacggggaagtcagacacatggaaagttatcatttatctactgtgccagatgaacttgcggacttcgcagaacaggcaactgaaggatctaacacattagtgacaccagcacaaccagaaacactatcggctgcagatataatgcctgagaactttacatcaagtcctagttctattaatgtggacaatgaatcattagccagtacaaaagcaagtgttggagaccttgttgctggattcaatgaatcattcaatgcctcaatcaatgagggacaaaatgctttacgaagctcactggatacagccacttcttttgtagattctattgttaaaactgctactgaatctgtagataatacttttagcaaggcattttcttctgttgatcaaacaggggagttagcaaataaaaaattaaccagcttttcaagtgagctgactggagtcacaaataaagcacctgccgtggctattgatgtgttgcgccgcacaattgtagttgtagagagttctctaacaagtggggcttcctatgttgtctacttatatggctcagccaaggagctccttcccgcaggaattagggatacagtcaatgtatatgaagataaagcaacagaaatcttgaggcctgttgggtcagcaactcaaaggatatacatggctgtctattcattggagaagagtcttggcttggatccaaatgacccaatcattccatttgttgttcttgtaggctcttcagccacattatgggccttttattggttgtggacatatggaggttactcaggaaatttgtcccctaaatcagctttcgagcttttggctgaggacgcaaatgctgcacttattgatgtccgctctgaggaaatgcgagaaaaagatggaattcctgatctccgacgggctgctaggtttcgttatgcaagtataattcctcttgaggttgatggctccatacgcaagttgttgaagagtggtagagagcttgatgattccttgattgcagctattattcgaaatttgaagattgttaaggacagttccagggttatagtgttggatgctgatggtacttgttctaaaggcattgcaagatccttgagaaaaattggggtcaaggcaagtctttcgatacctgctgagatatttgctgcaaaactactgatatatttcataaaattctttgctgagtttagctttattggggttgaagagctctgtcatggggaaaagaatccatacttggttgaaggaggcttttattcttggatgaaacaaggtctccgtatcaaggaactcaaacctgagacagcactttccatcctcaatgag

SEQ ID NO: 85265 - DNA, 492 bp, Glycine max
  Peptide Sequence Number=SeqID_176950
atgtcccaacccagattcatttccatgatctccctctgtctggcccttgttctgttctacacctgcaatggcctaccatttgtggacctcaatttccatgaagtagatgtgatgaccaaaagggtttgcaccaagagcattggggagtgcctgagcttgacagagccggagatggattcggagaccaacagaagagttctggcaatgcagaaaaagtacattagctatgacacactcaagagagacatggttccctgtgatagggctggagcttcttactacaattgtcatgcaatacgagcaaatccttataatagaggttgtgagccaactcctgcagaactttcacttctattgctctttactttcttcaatgtttctaaagcaagattttgtggatcaaaagcaagccaacatgccatgtcttgttgttcaactcaggactatactaatctttgttcacctaacagcctctgcagtttgaaaagttaa

SEQ ID NO: 85266 - DNA, 1182 bp, Glycine max
  Peptide Sequence Number=SeqID_176951
atggtttcttatacaagttatttcatttatagaagagcagagaacccattgcaaatccttaaatttcgtagcatcttctttttctcactggaagctacatgttggcaaacatacggtaccttgagacattgtcattctgggtcagaacggggtaaaaatcagaaattgacaaacagggtggggcttttctgggacttggacaataaaccacccaattcaatcccaccttatgaagttgccaataagctgagaatagctgcatcttcctttggtgttgttcgttatatggtggcttatgcaaatagccacacttttagccatgtccctcaaggtgtccgggagagtaggaaagagaaggaactgttgtatcgtttagagaataagggtgtcatcaagccaaatcaaccttatcgttgtaaggtttgtgggagaaagttttatactaatgacaagcttgttaaccatttcaagcaactgcatgagagtgagcacacgaaaaggatgaaccagatagagtctgctagggggagcaggagggtgaagttggtggccaagtattctatgaaaatggaaaagtataagaaggctgcaagtgatattctcactcccaaagtggggtacggtttggcggatgagctcaaacgggctggtttttgggttcgaacagtgtcggataagccacaagctgcagatcaagcactgcaaagccacattgtggatatcatggatcataggcgggttgagtgtgtggtccttgtgtctgatgattctgattttgttgatgtgataaacgaagcaaagatgcgatgtctgaagacggttgtcattggggatattgatgaaggtttcttgaagaggactgctgatactgcattttcttgggaggaaattctgatggggaaagctaaaaagcaggctgtttcggttgtgaaaaactggaaggatcgtgatatcttaaaaaagttggagtggacatacaaccctgatgaggataaaagtaatttcaatctggatgataccgttactgaagcatctgaagatgataatattgaagatactacctgtgatgaagttgatgatgcctataaggatgacagaggttcttggtgggaattagattctgatgatgatgccacaaatagacagtcaggaaaattatctggtttatcggtgaataggtga

SEQ ID NO: 85267 - DNA, 768 bp, Glycine max
  Peptide Sequence Number=SeqID_176952
atggtgtatagtagtatacaattagccacgtccgatggcactgagtttgtgaaggcacaaaaatggagacccacaaaaaatggagaaccaacaaccggcacctatctccgtgacactgctacatctgctatccaaaacttcgctcccatcaacaaaatccaccaacatctctgcgcgtttcacttttactcatatgacatgagccggcaagtggaggcacaccatttttgcgcgcaccagaacgaggagatgaggcagtgccttatctacgacagccccgagaagaaagccaggctcatagggctggaatacatcatctccgaaaacctttacttgacactccccgaccaggagaagcgtctgtggcactctcacttgtacgaggtcaagagtggcctcttcttcatgcctaaggttcctgctctcattcagcgcccagacatggagactgtctgcaccacttatggcaaagtctttcatttctggcaggtcgataagggtcactctcttccatttgggatacctcagctcatgatggctctcactagagatggccagatctatgatcacctcctccaaagttctgcagagcgcatggggatagactatgaggaagaaagaaaagcgagagaatatatgacagggccagttcatggaattcatccattggcaaatggagggggtaagggccttgaacttcggctgagggaggttgaactcaagcacgatccatctccaccatccgtcaaagccaggattttattttga

SEQ ID NO: 85268 - DNA, 1755 bp, Glycine max
  Peptide Sequence Number=SeqID_176953
atgtctgagttgcttaatcaaaaatcagctatacaaggaaaaattccttccggctatttcaatgctctttttggtttgagtggtgattggtttcgtgatgctcatgacataaaatatcttgcttttgatggttatttcatttccctgtactatttgcaccttactgcttcacacctcatactgcaagaggaagtaaagaagtctgttccagctcaatgggacccagcttcattaaccaggttcattcagacatatggtacacacataataataggtatggctgttggaggtcaagatgtaatttgtgtcaaacaaaatcattcttccaaggttccacctggtgatctaagaagacatttagagaatcttggagattttttgttttcagatttaaaaagcccttctcaacaacaaaggaacagtaccccagaaggcaaacaaaaagttcctgaggtctttaatcgtgtgatgcaatcaagtacaacgcagttcgccagtatttcagaagcatcaagcaaagatggcctcactatcatttgttcaaaaagaggaggggatgtgttcaagcaaagtcactcaaattggctccaaacagtggcttctaatcctgaagcattcctcttcaagtttgtacctatttcctcacttctcacaggaattcctggaagtggctatcttagtcatgcaatcaatttgtatttacgctataagccccctccggatgatttacaatgcttcttggagtttcaaattccaaggcaatgggcacccatgttttatgaccttcctctgaggcatcaaaggaaaaagtgttcttccccttccctgcaatttggtttcatgtttcccaagcttcgtgtcagctgtgcacaggtagtaagtgaccaaaaacctgtggtaggcctacggatgtacttggaaggcagaaaaagtgatagacttgcaatacatgtacaccatctttcaagcctcccaaacacaatgatccactcttcatcaggcatatcattgtggcgaggatctgatgataatgaatccagtgacatctttctagaaccaataaggtggaagggatttgcaaatgtgtgcactgcagtggtcaaacatgaccctaactggttgcatgaaacaagtggtgtttatattgtaagtggtgcacaactcattagtaaaggaagttggccaaagaatgtgcttcacttgcgcctcctatacactcacatacccaattgctgtataaggaagtcagaatgggatggtgcaccagaggcttcaagaaaatcatcttttctcacaaatctaagcacaacattttcattcacacaacaaagtcctcctcagaagcaggctccaacagtacttgactctggtgtgtatccagatggtccaccagtgcctgttcgttcctgcaaaatgcttaaatatgtggatacaagtgaggttgtgaggggcccgcacgatgctcctggtcaagtttgcattgatagactactagtagttattcattcattttctaagttacttctctttcatgtatatgtggatacaagtgaggttgtgaggggcccgcacgatgctcctggtcattggttggtaactgctgctaagcttgtgactgagggtgatcacatgtacataggcatatgcttaatttctgatgactttgtacagtacagtatacataatgagtggtggttaacttcagccacaagaaaattagaatgtggctataatactgcattggtttggtgttga

SEQ ID NO: 85269 - DNA, 1449 bp, Glycine max
  Peptide Sequence Number=SeqID_176954
atgtggggcaagatattgcaatccataaggaaaagtctcataagccttcaacagaagtctatgaattctcgaaagagtgaagaagttgatagtagtgtcactagtgtgtctgtgtcactgcatgatggtgtgcagtgggtaaattgcaattgttgcatagaggaaaacaaacaatgcaattttgaccacattaatgcctcagaaggcgcaaataatgtccacgcccagcgtgatgccaacgccaacagttcttttactcatgctgtaatcaacatggtggggatgctcgtaggtttggggcaactgtcaactccatatgctgtagaaaatggagggtggtcatctgcattcttgcttatgggactaggagtgatgtgtgcttatagttctcacatacttggagtatgccttagaaagaatcccaagttaacaagtttcatggatattgggaagcatgcatttggatcaaaaggtagaaacgtggctgcaacaatcatctacatggaaatcttcatgtccctcgtttcctacaccatctcactacatgataatttgatcacagtgtttttggggacaaatttgaagcttcacttgcctaatttttcttcatcccagctcctaactgcggtggcagtcttcattgcaatgcctagtttgtggatcagagacctttcttccatatctttcctttcaagtgttggcattctcatgtctctactcattttcctgtgtgtagcagccactgcactcttaggacatgtccaatctaatcattccatacctgtcctccacctccataatattccatcagtatctggcctctacgttttcggctatggaggacatattgttttccctgaattatatacagccatgaaagacccctccaaatttacaaaggtttctattgtgagcttcgcagtagttacagcaatttacacgacattggggttcatgggtgcgaagatgtttggtaaggatgtgaagtctcagatcacacttagcatgccacaagagcacattgtaacaaagattgctctgtgggcaaccgtggtggcacctatgaccaaatatgcacttgaattcaccccatttgcaattcagctagagcatgcacttccaacttccatgagtgtcagaaccaaaatgataattagaggctgcgtaggttcattttcacttttgttcatactaacccttgctctgtcggttccatatttcgagcatgtactaagtctcactggctccctggttagtgttgccgtttgtttaattttgccaagtgctttctacgtgaagatatgttggggtcagatatcaaagcctcacttactactaaacctcttcctcatcatattcggctttgttcttgccgtgatgggcaccatttcctcctcacagttactactcaaaagtcttcaatcacataacttgaggcacaaggaatga

SEQ ID NO: 85270 - DNA, 129 bp, Glycine max
  Peptide Sequence Number=SeqID_176955
atggctcatacagattgtcaatccaaattcaaacgaaaacctaaacacttacctcgaaggagacagaaacaaagaagatgcaacaacgacgaagaagaaccaccaaccaagaagaagcatcagcaatga

SEQ ID NO: 85271 - DNA, 483 bp, Glycine max
  Peptide Sequence Number=SeqID_176956
atggcgtgcaggagcatgcttcgttcctcgattctggtggaacccttccaattgcaacctcttcattttagtaacagacccgttagggcttgtccgtttcgccgtggcaaaggagtgaccctccgttgctccagcaatgagacgccgtcgtttcaggacgatcaaggtccacctcaagaagccgtgttgaaggccatttccgaggtatctaaggcagaagggagggttggccaaactacgaacatggttattggaggcaccgtgtcggatgattctactaatgaatggctcactttggaccagaaggtgaactcatacccaactgttcggggattcactgcaataggaactggaggggaggacttcgttcaagccatggttgttgctgtggaatccgtaatccagcagcccattcctcaggctaattttgtgaccagttttgcttcagtccaacttttttcttgtaacttggctgtttcttga

SEQ ID NO: 85272 - DNA, 309 bp, Glycine max
  Peptide Sequence Number=SeqID_176957
atgggatgtttgatttcatcaatcttgttgtgcaccacaagggtagattcaaaagggatgatcatggcacattggaatatgtggatgttggagaatgacaaagatatcttgaacatgtgccgcatatgtattgctcaccttgccaaagatgtgcatgcctactttgagcatacaatggatgatttcttgaatctggtaggtggtgtgcttgatgaggttgtggtgaatcaaattaaggatagagctgaaggtattgatgctgaacttgacaaggaatttaaaggattgctaaccaaattcaaaatctaa

SEQ ID NO: 85273 - DNA, 951 bp, Glycine max
  Peptide Sequence Number=SeqID_176958
atggagttttctcaagatgattttgatcggttactgttattcgaacacacgcgaaagactgctgaagcaaactacgcagagaatcctcaagacgctgatgtacgtatcgttcttcattataccctaattaacctttcttcattctatgacttactttgctcacaccgcacgtgttttgtttccgaatttgtgaggtttctgttggaagttattctttgtcacattacaacatttaaaattggaaggacaaaacttagatacaacgcaattatcatcgaattggagttttatcgggtattgcgcataacaaagaatctgaccaggtgggggggagctttgatcgagttgtcgtcattccaagctcctagggatgccaaggcgatgattgatgatgccctttcgaagctggaggagtctttgctgatcaatccaactaagcatgacactctttggtgcttgggaaatgcaaacacgtcttatgcttttctaatccctgatataactgaggcaaagggttattttgacaaggcacttgagtatttccagaaagctgcggaggaggatcccgagaatgacctctatagaaagtccttgcaagttgccgtgaaggccccagaactacacatggagatccataaaaatgggcttggtctgatgagtaatgcgggatcctctgctacttcaaaagaaaagccttgtttagggtcatcatgcctcaaattttgtgggtacaaagcttctcatgttagcatgtcattagaaattgcatcttcaacaaatttttcatggtgtctatcaaagtactgccacactattgttttccatgaatctaaaaagcagaagagcaatgactttaagtatgacatatttggatggattattcttgcagtgggtatagtagcatgggtgggaatggccaaatctaacattcccccgccacctccaagataa

SEQ ID NO: 85274 - DNA, 2055 bp, Glycine max
  Peptide Sequence Number=SeqID_176959
atgcctggttttactgttggaaagaagagatttatccagccaaatatgtgtttcaccaatttgatcaatcaagataaatcaactctttcacaaaacaatcattgtttattccctgaggcactgaataaagattatagccccattctacctgggctgcctgatgatgtggctgagtattgtcttgcactcgtgcctcgttccaacttccctgctatgggtggtgtttgtaagatatggaggtcgtttattcaaagcaaagaatttgctactgtgcgaaaattggctgggatgcttgaggaatggctgtatttcttaacaacggactgtgaaggaaaggaaagttattgggaggttatggattgtcttggtcataaatgccgatcgcttccaccaatgcctggtccaggaaaggctgggttccaagtggtggttcttaatggaaagcttcttgtcatggctggttattcagttattgaaggaactgcctttgcctcagcagaggtttaccaatatgattcttgcctcaacagctggagcagattgtcagacatgaatgtgtctcgttatgacttcgcttgtgctgaagtcaatggtttggtttatgctgtgggaggctatggggtgaatggtgacagtctctccagtgctgaggtgtatgatccagataccgacaagtgggcactgatagagagccttcgccgcccaagatggggttgttttgcttgtggatttgagggtaagctctatgtgatgggtggaaggtcaagctttactattggaaactccaagtttgttgatatatataaccccgagagacatagctggtgtgagattaagaatggttgtgttatggtcactgctcatgcagtattaggaaagaagttgttctgcatagagtggaagaaccaacggaagctagctatattcagtccagaggacaattcatggaaaatggtaccagttccattgacaggaagctcaagtattggttttcgatttgggatactagatggtaagttgttgctattccctctggaagctgaaactgcttttcagacattgttgtatgatccaaatgcatctctggggtcagagtggcagacttgtgacataaggccatctgagttggtagtggagggagcagagaacccgaacgccatgtttggctccgctcaaccttcttcttctcccttcggcacccctgcattcggtaccccttcttctacccctgccttcggttcttccctcttttccacacccttctcttctcaacaaccacaaccacaacaacagcagcaacaacaaacacctctgtttcaacagcaacaacaacaacaaacttcttctgctttcggctttcagaattcactcgcattcgcagcaccgcaatcctcgcccttcccaaatgctcaattaaccactcagatggctaacgttgcacctgttcctttctccctcgccgatcgcgatgttcagactattgttgatgcatataaggatgatcctgggaaccccaagtacgcctttaagcatttgttgttcagtgtaacagaaccgcagtttagagtgaagcctgctggtgtatcagatatcatgtgggcagaggcaatagggaagcttcagggtatggaaagtcctgatagagaacgcctgtggccacagcttgttcagggttttaaggatctttcacaacgccttaaggtaatgagaatagtggaggcattggaggaaaaaggctgtcgtatacccttaacaaaaggggaagctgaacttgctgagaaattagccacaataactagaaagctgaaaggatctggagcggaactgtctagaagagtacaaaatctactaattgtatctcgtgttaaagctaatagcaatggatttggtagctccgtttatcttccagggtcaaccaaaattcatgaacagagtcttggtgatctacaagaggttttacagcagcagctggaggccattgcaagactaggcaatgttctgaagcgagatatacgggatatggagattatgatgaccgaggacacgaagaactga

SEQ ID NO: 85275 - DNA, 1104 bp, Glycine max
  Peptide Sequence Number=SeqID_176960
atggcaggaatgaatactggcattcaggacgcgcataatcttgcctggaaaattgcttctgtgattaagggtattgccccaacttcaatgctaaatacctacgaaattgaacgtaaaccgataaactggttgacatttattgctgtctattattgtcagattgctttattcaatacaagattaagtctagaaaactataaagctgccatgtctgttcctgctgcacttggtcttgatccaactgttgcaaacatagtacatcaatttattgttgatgggattggttccatcttaccatctggtttgcagaaggtagctttggatggaatttttggtataggtcgtgcacaggtttcagaatttgtcctaaatgaaagtaaccctcttggatcctcaaggttggctaagctaagacatatatttgaagaaggaaaaagccttcaacttcagttccctgctgaagatcttggttttagaaaatatgatgcacgagcactttgggggtgcctatctaactcagctattgaacttaggtacctacaaggagcacttatgccagagagtaaagatgttgaaagtcctccagaagtactaacagggcgtcggagggactacaccccttcagcacaaccaggatcaagactgcctcatatatttgtgagagtaaacccgttaagtgaggagactgtttctacacttgatcttgtgtcgggagataaagttgagttcattctcatcatagcacctgtggaggaatcttatcatctagctcgtgaagcattcaaggtggctgaggaacaagaaatttttctcaaagtttgtattttttggtctactgattctgttgaaggacttgagaaaggaagtaaagcagcattatcaccttggaagaattacctagatgttgttgaagtttggtcatcaacttcaaattggtgggatatgtgtaacatgacgaacagaggggctattttagttagacccgatgaacatattgcctggcgtacaagttcaggacttgctggggatcctagagtggaaatgcagagggttttttctgctatactgggagtacacggttcaaataaacaaatacacggatga

SEQ ID NO: 85276 - DNA, 1959 bp, Glycine max
  Peptide Sequence Number=SeqID_176961
atgcctccttatttgcctcttcggtgggagagtacgggagaacaatggtggtatgcatctcccattgattgcgccgccgcgaatggccactatgatctggtggtggagcttctccatctggacgctaacctcctcatcaagctcacttccctacgcagaatccgccgcctggaaaccgtgtgggacgacgagaaacacttcgaggacgtcgcgaaatgccgctcacaggttgccaggaatctgatgctggaatgcgaggcaggaagagcacacaattctctcattcgcgccggctacggcgggtggctactctacactgctgcctcggccggtgacgtggatttcgttaaggagctgttggggaagtaccctgctctcgtgtttggtgaaggagagtatggagtcactgatatactgtatgctgctgcgaggagcaattcttgcgaggtgtttgagcttctgcttcgttctgctctctcgccgccgcaaatggaggatgtttatgagagggacatgatgaatagagcggttcatgctgctgccagaggagggaactgggagatgctgaaacggcttgtgaggaacggttctggcgttttggggtttagagatactcaaggatgcactgttcttcatactgcagctgctagaggacaggttgaggtggtgagaaatctacttgcatcatttgatgttgtaaacttaacagatgatcaagggaacacagcattacatatagcttcttacgggggtcacttaccagtggttgagattctgattcttgcgtctccctcgctagcattgtttaccaatcactacggagatacttttcttcatatggcggtggctggtttcagaagtcccggtttccgtagactggacaagcacactgagctcatgaagcgattggtaagtggaaagattgtgaacttacgggacattatcaatgttaagaacaacgatggaagaacggctcttcatgtatccgtgattgataatattcaatgtgaacaagtggaattgttgatgtctgtgtcatcaattgatttgaacatttgtgatgctgatgggatgacccctttggatcttttaaagcaaagggcgcgatcagcatcatctgatattctaatcaagcaaatgatttcctctggaggggtctctaaatgtctggatgttgtggcaggaaatgccctttgcactcatcaaaaagctcatgtcattggaggcagtcctggaacttcatttagaataccagatgcagagatattcttgtacactggcattgagaattcatcagacgccaccaattatgatcaagcaagtgtggaatcatattcctgctcaaacgaactaaacaattctgactcagccaattccccacataacaagaagtctaattctgtcaatgcaaggcgctcaaagtttcgtctccactggcctaggagaagagagacaaaagcagctgcctcagaattggaagatgatgatgattctcatgatcctttcagttcaagtagaaacctggaagagtttccaatcccgttgcggcaaagatactcacaaccatgctcccttccaaacaacaaaagaacacaacctatgaggacttctcttcctagcccatcctccaatgtgaaattcagtgcaggcttaatgcaaggtgtaattcagctaaagccacattctgctcattcaactcctagtcctttccaggaattatcagtgtcttctctttcatacatcaagaaacaaaagggtgttgaaataatgggaccctcttgctctaatcgatcaatagatgacggcacacttctattgaactacaaacagtgttccttcaataagaaattgatgaatgggtatttttcttttggagcacagggccttgctgttgaagattccaatagctgcgcaaagtcaaacagcagctacaaacgtttaagttccatagttgcctaa

SEQ ID NO: 85277 - DNA, 270 bp, Glycine max
  Peptide Sequence Number=SeqID_176962
atggattccggcatgtcctgggctgatcaatgggacaacaacccagacccttctcctgcatcagacaaagacaagaagggaaaggatggctcaggcaagaacaataaatttgggaagactatgctgagcttcaaatgggtgaaagaactccgcaagaaaactcaaaatgtcgaggaggggcccaagggaggtgaagaagaagagtgtttatggtctttgattttcagcgcacatctggtagaggaaactgggaagcaactcgaggtttga

SEQ ID NO: 85278 - DNA, 800 bp, Glycine max
  Peptide Sequence Number=SeqID_176963
atgagtcaggctctgggcatacctgatagtggggtactagcagaaagtgaacccatttcaaggatagatcctaatgaaccattggataagcttctcctgaataagagattccggcagtcttttatggcgtttgctgatagttgcttggctggggagagtgtgcacttctttgatgaagtatatgagcttagtaaaatacctgaagatgactgtgttaaaaggatctacatggcacgacatattattgagaaatacatagttgcaggtgcggctatggaggtgaacatctctcatagaagcagacaagaaattttatcaacttccaacctcacacgccctgatctcttccataatgcacttaatgagatcattcagctgatgagaacagaagactccaatgtaagatctaatgagtacgagctggagcaaataacagggtggaacttttctccaagttcccttatcaaatttctcaagtgggtatgggtgatgttcttgaggacaccaaagaatctcatcaaagagtatggttcatgggctatgatcactggcttcactgatggaattggcaaggccatggcctttgaattggcatctaagggactcaaccttctcttggttggtagaaaccctctaaaacttgaggcaacatcaaaggaaataagagatggacatgatgttgaggctgtgcctccatctatgatcaagaagaaaaagggagcaatagtgaacattggctctggttccactgttgtgcttccttcatatcctctagtcacactctatgctgctacaaaagc

SEQ ID NO: 85279 - DNA, 285 bp, Glycine max
  Peptide Sequence Number=SeqID_176964
atgggttcgggttttgttttgtctgggagcagaatgggcgacgtgagcatgggtaacaagcctctggacaacggagggggaaacgacaaccgtcctatgaagatctcattccgagacaaggttatggacaatattgagaagcctcctgtgaaggaaaatttggctaagatcgtatatgaggatgacaatccaatgaagcctatggtcattattgaagattcagtctttgaaggactttgcgcaccgtggaaggatgccctaatggtgaagcatatctcacgatga

SEQ ID NO: 85280 - DNA, 1014 bp, Glycine max
  Peptide Sequence Number=SeqID_176965
atgcagctccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttaatgggcgacgtgagcatgggtaacaagcctctggacaacggagggggaaacgacaaccgtcctatgaagatctcattccgagacaaggttatggacaatattgagaagcctcctgtgaaggaaaatttggctaagatcgtatatgaggatgacaatccaatgaagcctatggtcattattgaagattcagtctttgaaggactttgcgcaccgtggaaggatgccctaatgggcattattggtaaacagcttggtggtgttaagattcagttgcaagatgttggtatcactttaaaggacttgtggaatggtggtaattggaattgggacagggctgctatgatttggaatcttcttcagctggatgttcaagttcatgctttagatgataatagctcgacttggcttcaaaggatctgcttggcagaccatggagcaaggaacaaggaagtcttttcggatcttgtcattcgtgtcgtattagtgatgaaccagatccttagtttactcgaaatagttaccaagacctgcaacaacaacaaaggctcatccagtggcaaccaccttaacctagagagcacaaactcaacgttccatggcagctcttttggtaacccgggcaaggcggggtttggcagtcttattcaggacaatcatggtcattggatcatgtggaatttcatccaacacaaatgcaaaacatcaagttatataccatggcattggtgtggcttggctcgaaggatctcaccatctaacttgtga

SEQ ID NO: 85281 - DNA, 650 bp, Glycine max
  Peptide Sequence Number=SeqID_176966
gcagatacgacatattccagctaatggtgaatctgtacgctgagaggtttattcagatgctaagattgcttagcgacagggcgaatgaattaacaaacattgagatcttaaagagaatgagagagagaaacagagtgagagagagagtacgagagggagagagatacagagatagtgagagacagagattcagagagggagagagtgagagagttcatgataggtacagagcgagagtgtgggatagagacagggtgagagtgagagagggtagaccgagggagagagtgtacacgcagagagccgtagatgacaggaacaacttccatagaagggggccaaggagcaacacagggcgttcttggtgggctgatgaagactactcaccctcacgtattgcatacgtttaccagaaggaccagagtttcgatgctgacaatcatggtacctgggttgaagtaacgcgcaagaagaaaacgaaagaggtgaccaatagagatggaccgggtcgtagcagccatcaacaggtaggacagaaggtgacatggagagataaggctggtatcacgactttttacttctctagattccctgaagggatgatggagaaggacttgtggcgcatcttccagaagtggggaaaggtgtga

SEQ ID NO: 85282 - DNA, 1211 bp, Glycine max
  Peptide Sequence Number=SeqID_176967
atgaatgaaaatcataatgatccaaaacagagccagcactggctaactcagctcatggtgtggtgtggggaggggaaagtagagaatgaggagtcctctgtccttccagcttccttgagagaaagagaggagagaatgggagaaaccggtatcattctcagcttccccggaaacttagacccgagagcagaagagttcagacccaacaccataaatattcaatgccaatggtaccctcttcctcctcctcttcctcttcctcttcccatacccctccctcctcctaacctcaccacctcctccacccgctccctcctcctcaccccggtccctctcacctcccactccgccctccgagccgagctccaggccttcggagacatcagagccctccaaaccgaagccctccgccacggcattctcaccgtccacttcttcgacctccgccatgcacaatccgccttcgccgccatccgctccatgcaactccacttccaccccaaccctggcctcctctctgcccactacgtcctccctaactccaactccctccccgactcccacaaccaaggcaccctcgtcatcttcaacctccaccccaacctctcctccgaccaactccgtcgtctcttccaacctttcggtactcttaacctcattcctttctttattattgtttctgaacttttttcattctttttgttgtttgttgtttgttcaatcaaaaatccatacatattaggtcccataaaggaattgagagataccccatggaaaaagaatcaaagattcgtggagttcttcgacataagagacgccgccaaggccttgaaacacatgaacggcaaggaaattgacggcaaacaggttgttattgagttcagtagacccggtggtcacacccgtaagttcttccatcatcattccaaaaccacagtacctcctctcaatttcaatgctcctcgcttgcattcctctcagaagaaatcaccgggaagtcccagcaatagtacgggatctattgatgcggaaatggggtcaatgagtttgaccggaggagaagttgaagagcagcattcttcttcacaaggccccacgcggaggaatcttggcagaaagcacaccacactagtagtaggaaacaccaagcaacaacaagtacctagaagtaggcactggaagggaaaacaagcgaagaaacacgaaactcg

SEQ ID NO: 85283 - DNA, 2481 bp, Glycine max
  Peptide Sequence Number=SeqID_176968
atggatcccgacggcgtggtcgcggcggaggcgcttatggcgtcgggtcggagttcggagaagctgagccttccatcactccaatccaaaatgaagtgcgatcccgaaggctacgaatcggagctactccttctctacaaccaattcaattcctcgctcgaactctttcagaaacaagccgccatgaacttcacctccatctccggcatcggcagcgaccccaccgtcgccaaggacctcggcgacagggccatgttcctcgcccacgtcactcctttctaccccaaacacctcgccgatttccccaaaaaactcgccgatttgctccgctgcgccgcccgcacgctgccttccggccttcgctgccacctcgcacacgcgctcattctcttatccaatcgaaagattgttgacattggagaaacgctgtcgttgttcatggagcttcaaaccctaggtgacagaacgctcaagaagttggcgtttgatcatgttgttcatagtataaggcgtatgaaccaaaagcataagaacgaagctaagaacagagcgcttcagaatgtcttgtttgacttgcttcagaaagaggctgaagagccagccaagagggcactcgtgactctatgtgagcttcacaggagaaaagtgtggtttgatgagagaacagcaaatgcaatctgcactgcttccttccatccaacatctaggattatgatagcaactttatcatttctgcttgattatgagaagattcaagatgatgatgatgacagtgataattcagacagtgatgatgaaaagacagaatcacctcaagttgtccttagcagggagacagtttataaggcaagccaccaaggtacagcagcaagcaaaaagaaaaagaaagcaaaactacaacgtgcaatacgcagcatgaaaaggcatcagcgtgtgtcatctgataggagcaaaaacagttattattcaccacttaaccatctgaaagatgctcagggttttgctgagaagctgttctcacgtcttaggagttgtaatgaacgatttgaggtaaagatgatgatcttgaaattaattgctcgaacagttggacttcaccagttaattttgctagagttctattcttttcttcagaaatatattcagccacatcaacgagacattacaaatttgcttgcagcagtggttcaggcttgccatgatatggttcctcctgatgcagttgaacccttgttcaaacaaatagtaaatcaatttgtacatgaccgttcacgtccagaggctattactgttggaataaatgcagtcagggagatatgcatgcgcatgccattgttaatgaatgaagacttgctacaagaccttgcgctatataagaagtcacgtgagaaggcagtttcaatagcagctcgatctctgattgggttattcagagaggtttgcccctcactgctagttaagaaggaccgtgggcggcctattgaccctaaggcaagaccaaaggcctatggagagcagaatgttgcgactgacgttcctgatgttgagttattgcagacggctattgacaatgatgatgagcaggagagtgatcattctgatggttctgcatgcagtgtctctgacaatgaccaggaaaatgatttgatgagtataaatgatgacgatgacaatgatgatgagaaccagttatgcagtgatgatcctgaaagtgatgatgaagccaaagatagtgatgttatatcagacgatgacgacgagagaagttctgatgacgaagctgatgttagtgatgctgatgaagttaagggggatgacattgaagacaatgaacaagctgatggagaggatagtgatgtttcagaacatgaagaagatggtgatctgcattctttaagtgatgatggacttgtgacaaaaagtacaatgaaagactcagcaaaaaagaggaagtttactgattttaatggtcaactgatagctgctgatacaagtctccgggctctgaagaaattagctgggagacaaatgggggatgtcataccagaatctaacgacggaattctttctaacgaagacttcaagaggatcaaagaactgaaggcaaaaagtgaggcaaaaaatgcgttggctcagcaagggctagcgaagtcagctgcaactaaggttccaagctctggtcaactaaatctaaagcgagtggatggtaccatgcttgaagctcacataaggaaaaagttgaacaaggatgaaaggttggcattggttagagcaggaagggaggaaagaggaaaataccaagctcgaactgctgtgaaacagaataagacgggtgggttaagcaacagacaaaaggaacacaagaagaaaatgcccttggctgcaaagagagataaggtatcaagaactcggatagagaaaaagaggaaaaatcagcgatctggcaaacagttccgtggaaagaaagcgtggaagcaataa

SEQ ID NO: 85284 - DNA, 2217 bp, Glycine max
  Peptide Sequence Number=SeqID_176969
atgttaggggaagcgggtaagaaggacaaagccccccccggtggtgttgcatggaaaacttattctcgttctgtttcatggactgataggtctcccaatagccgcaagccaccgacaaacagcaaaacaagaccacttttgccaccccttcagcctctctcaatcaacaaacgcaacgtggaggaatggcctagtgctggatctgatgatcttggagtttggccacttcctcagactccaagaggctcctcaacctcctcaagtcaacaacaacccaccaaggattttctcttcaagagggacaaattggccttctttgacaaagagtgttccagaattgccgagcacatatacttggggagtgacacggtagccaagaaccacgaactcctcaggcagaatggaatcactcacgttctcaactgtgttggctttgtttgtcctgagtatttcaaaggtgattttgtgtacaagacactttggttgcaggacagccccactgaggacatcacaagtattctctatgatgtgtttgattactttgaggatgttagagagcaaggtgggcgtgtccttgtccattgttgtcaaggggtttctcgatcaacggctttggtgattgcttacctcatgtggagggaagggcagagctttgaagatgcttttcagtttgtgaagactgcaagggctgtcacaaacccgaacatgggttttgcttgtcaacttttgcagtgtcagaaaagggttcatgctatgcctgcaagtccaaattctgttctcaagatgtatcgtatggctcctcactccccctatgaccctcttcatcttgtccccaagatggttaaccagccaggttcacaagctcttgattctcgtggggcattcattgtccatgttccttctgctatctatgtttggaatgggaaacattgtgactctgtgatgtcatgcaatgcaaggagtgcagcctttcaggtgatccgttatgagggggcaaaaggtcctattttgacaatccacgaaggtgaagaaccacccgggttttggattgctctttctattgagcaacgaatatcaggtgattctgaaaaagaagtggtgatcatggaggagccctctgaaggcatggagagtgctgttgaaccggttgattctgggatgactactggtccaagaaaaattgatgcatatgatttggattttgagattttccacaaggcacttgctggtggggttgttccacctttttccttgtctgatccaggatcagaaacttgtcttcctgctagagaacaaggttgggcaagactgaggaggaagtttgctagtggattgctcacatcccccaaattcatctgtgatgctgattcaaccccatgcaatgatcatcaacctagtgtatctgaggaagctgcatatgagcctttgtcaccatcatcaattcctccgtgtggttcaccggattcctttgaatgctatccaaatagggaaaaaggtagtcctgaagccatggacttctctgttcatggtgttgcttcatcattgccactgtctcctaccggcacatcaaatccttttccttgcttcataagctgcattccaaaattcaattccaagtcaccaacactctcaccttcaagttctgattacgccagttcatttactttttcgccttcctctaccaactggtccgacttgtccttggtgtcttctcggcagccatcaccatctggccttgaatcggctgaacccttttatgttaaagacgcgtctttctcagaaaattccactttacttcacaaagatgtctcttcacccttggaagaattttcagctaatcacacatttggaggggcgaactccaatttgcagttgaaaggttctttcctctccatcgccgagcgcagagggaatcatccaccgcctctgatgttgctaccctcagccagtgaatcctctcatgtccccaagaacaacgtggtaagatcactgtctttctctttgcctgaattagatgataatgtggtgaaggatgatgatacttgcaaacaatctgaccgtgaaaacaaaggaaaatggctaatatcagatgactatattattagttcaggtgttgaaccgcagagtgagattaatgacaaagaggatcgtggtacagagttatgtaataaaatggctgagcttgacatagaggagaaaggaaatgggatgagttga

SEQ ID NO: 85285 - DNA, 5337 bp, Glycine max
  Peptide Sequence Number=SeqID_176970
atgaagaaagctactaatcccaaccccttctccaccccccgccgccacgatttccaccgtccgccaccacccacccacggctgcggttggactccccgcccagtccaccaccgtccctaccaccaatggaggccccgattccacccccacgccgcccgcatcgaccgccctccggagccttatttcagggtggagctccgcctcggccgctgccccctccaccgcgacgacgtcgaggccctgatcgacgaatgccgctccagccacgacagcttcactttctacccaaccgacgacgtcgccgccgttctcaactaccggagctgggagcaggcgcgcgatgccgtcgtctggttctgggaggcgcggctcgcggagaagcacgatttcacgccggcgttggattccaacgttgtcgtcgtcaaggacgatgtggattgtcgccttcgaccggttttcgcgaggcacgtgaaagggttgatgatgatggaagaaggtaaggaggtgaagtttgggatggatgagtgtgaacggttggcgaaagaaatttctcggctttcgagttcgctgagtaagcccttgcgaattggcacgcaaaacgagcttatgaagaagaagaaagggctcgttgatgagaagaatctggttgaaaggaggttgaaggagtttgagtctgcgatgcagtgtttgttgaagtatttggaggatggcggtgatgacgtggagggtgttaaggtgtttaggtttgatggagggatattcttcaggaaatacattatcagcagtggcaattactggggggaaattgtgggcaaatgccaccgcaattgcggtcacaaagactccaaattccttgacattgcatgggaaattgggtcaaatgtgactgcaattgcagtcgctgaaaaccttgacgttgtggctgaaattgcgacgcaaactggagggatcttttgtgtgtttcctggtctggcaggcatttctggagcgactggttcagggaagagtacgcagctggtacagtttcttgctgattcaggcgttggttctgacaaatccattgtatgcacccaacctcgcaagattgctgccaaagcagtggctcaaagggtccagcaagaaagcagtggatgttatgaaggccaatcaatcaaatattgttctacatttttatcctcgcgtgagtttgattccaggataacattcatgactgatcattctttattgcagcactacatgagtgataataatttgtctggggtctcgtgcatcataattgatgaggctcacgagaggagcttaaatacagattttctgttgactttgttgaagagtttactttgtaggagggttgaaatgcggcttatcattatgtctgctacagctgatgcaaagcagctatctgattacttttttggttgtggaatttttcatgtgcttgggagaagctttccggtggatatcaaatatgttccttctgactgtggtggagattctggttctgctgttgttgcgtcatatgtttctgatgttgtcagaatggcaactgagattcacaaaactgagaaagagggaactattcttgcctttttgacctctcagatagaagtagaatgggcctgtgaaaagtttcaagctgcctctgcagtagctttgcccttgcatggaaaactttcatctgacgagcagttccgtgtttttcagaactaccctggaaagagaaaagtgatattttcaacaaatcttgcagagacatcacttacaattcctggtgttaggtatgtgatagattctggggtggttaaagacagcagatttgatcctagcagtgggatgagtgtacttaaggtttgctggatcagccagagctctgctgatcaacgggctggtcgtgctgggaggaccgagcctggtgtgtgctatagaatgtacttggaagccgattatcagtctatggacctaaatacagagccggagattcggaaagttcatcttggtgtagcagttctgagaatccttgctttaggagtgaaggacatgcaagattttgattttgtggatgctccaagtcctagctcaatagatatggcaatccggaatctaattcaattaggagccattgaactgaacaataatgctcatgatttaacttctgaaggttggtgcttggtgagaatgggaattgaacctaggcttgggaaacttattcttggttgtttcaaacatggtttgggtagggagggtatcatccttgctgctgtgatggccaatgctagtagcatcttttgcagagttggcagtgaatttgataagcaaagatctgattgtcttaaagtgcaattttgccattgtgatggtgacctctttactcttctctctgtgtacaaggaatgggaagctttgcctcgagaaaggaagaacaaatggtgttgggaaaacagcatcaatgccaaatccatcaggaggtgtcaagacacaattttggagttagaaacttgccttgagcgtgaacatgacattgttactccaagttactggctttgggacccttgtatgccctctaatcatgataagaatttgaaaagggtaatactgtcctcacttgttgagaatgtagccatgtactctggctgcaatcaacttggttatgaagtggcgcaaactgggcaacatgttcaactacatccatcttgttcattgcttgtatttgctgagaaaccaagttgggtagtttttggtgagcttctttccatttctaatcaatatttggtctgtgtgtgtgcatttgactttcaatctttattcaacctttgccctgctcccttgtttgatgtatccaaaatggaagagcggaagttgctaatgaagacactgtctggtctcggctgtattcttctcaagagattttgtggaaaagccaactgcgatttgcttgctcttgtttcacgtataaggaaagcttgtatggatgaacgcatcttcattgaagtgaatgttgacaagaatgaaatccacttatatgccacttcaaatgagatggatatagcccttgggttggttaatggtgttctagaatatgagaggaagttgttacgcacggaatgtatggataagtttttgtatcatgggtctggtttctctccacctgtagctttgtttgggtctggtgctgagataaaacatttggaacttgagaaacgttccttgagtgttgatgtgtgtcatccaaacataaatgaaattgatgacagggagctcttgatgttttttgagaagaatacctctggttgcatctgtgctgtgcacaaattcacaggcaatatgagggatggagatagggataagtggggcaggataatatttatgtcccctgatgttgtcagaagagctgctgagctagatggacaagagttttgtggctcatccttgaaaattgttccttcacagttgggatgggataaaacattttcgttccctgctgttaaagcaagaatttcttggcctcgtaggcttagcaggggatttgccatagttaaatgtgatataaaggatgtcaattatatcttgagagatttctataaccttgcagtaggaggaaggtatgttcgatgtgaaattggcaaaaagagtattgacagcgttgttataaatgggcttgacaaagagctttcggaagctgaaatagtggatgtgctaagaactgctacaagtagaaggattttggattttttcttggtgagaggggatgctgctggaaatccaccatgcagtgctttggaagaggcactcctaaaagaaatttacccctttttgccgaaaaggaaccctcacattattccttgccgagttcaggtgtttgcacctgagcctaaggattctttcatgagagctttgatcacttttgatggaagattacatttagaggcagcgaaagcattggagcaaattgagggaaaggtgttacctggatgtctttcatggcaaaagataaagtgccagcagttgtttcatagctccattatatttcccactccagtgtatcatgtgattaaggaacaactggatgaagtacttgcaagcttcaggaatttgaaaggtaatacattttcttctgtggatgcttgtcttgaatgcaacctgggcaggacagttaatggttctcaccgagtgaagataacggcaaatgccacaaggacagtggcggaagttagaagacctctggaagaactattgagagggaaaaccattgagcatgacagcctcacccctgtagttttccaactcatgttgtccagggatggctttagtcttaaaaactcattgcagcaagagacgggaacttatattctttttgacagacacaacttaaatttacgggtgtttggttccccaaacaaggttgctttggctcaggagaaggtgatacagtccctcctttctctccatgaagaaaagcagttagaaattcatctgagagggatggatctacctcctgatttaatgaagcaaatgattaagaattttgggccagatctccgtggactgaaagagagggtacctggggtagatcttacactcaacacacgtcgccatatagtcattcttcatggtagcaaggagttgaaaccgagagtagaggaaataatttttgagattgctcgttcaagccatcatttggttgagagatttgaaaatggacccagttgcccaatttgcttgtgcgaggttgaggatggataccggcttgaaggctgtggtcatttgttctgccggttgtgtctggttgagcaatttgaatctgctattaataaccaaggcactttcccagtatgttgtactcacagggactgtggagatcccatcctgcttacagatttgagatctcttttatttggtgataagttggaggatcttttcagggcttctttgggagcttttgtggcaacgagtgggggagcttacaggttttgcccttctcctgactgcccctcaatttatcgagttgcagatcccgagtctgctggtgagccatttgtttgtgggtcttgttattcagagacttgtaccaggtgccacttagagtatcatccttacctttcatgtgagagatatcaagaattcaaggaagatccggactcatctctgaaagagtggtgcagagggaaagaacaagttaagtgctgctcggcatgtgggtatgtaattgagaaggtagatgggtgcaaccacgttgagtgcaagtgcggaaagcatgtctgttgggtttgcttagagttctttagtactagtaatgactgttataaccatttgagaaccatacacttggccatcatataa

SEQ ID NO: 85286 - DNA, 153 bp, Glycine max
  Peptide Sequence Number=SeqID_176971
atggctatgagaactgagtgtgagctcaacaggtcctccaacttggagaggagtaactataggtgcggtaccaccgaagcaaaagcattattaaaagaaagaaagaatgtgtgggtcctctcttggatgccgtatattggtagagccatgtga

SEQ ID NO: 85287 - DNA, 130 bp, Glycine max
  Peptide Sequence Number=SeqID_176972
acctgagaagaaagagttgattatagttaagcaatccaagattctctttgagatggcgcattacttatcacaggcagcagttgaacaagaagtggtccaaaaagtctggcagcatgagcatgatggagag

SEQ ID NO: 85288 - DNA, 287 bp, Glycine max
  Peptide Sequence Number=SeqID_176973
atggttgttctgttggagcagaaattggcaaggattgagtatgaggatggcaatcctataaaaccgaaggttcatatagcagactctattttcgaaggattatgtgccgggtggcaacaagctttggcaggctttgagattcttgacattggcaatggatacttcatggtcaaattcgataaggatgatgatcgtaaaaaaagttctgttgcactgcaaagtgcaaacgctaataaaaccaagattcagattaacggaagaggtggcagaggaaacaactcaaacaa

SEQ ID NO: 85289 - DNA, 660 bp, Glycine max
  Peptide Sequence Number=SeqID_176974
atggagtccgcaatttcctgcaacgtcaaggattgtgacgaaaacgtgacggcaccacaatttaaaagcagcagcaacactggtaaaacgcgtatggaccagttcaaaagagcacagattgaacggttagaaaggagagattaccgcccaaatgtcagcggggacgaggatgatgatggagagagaacagaaccaggtatatccaacggtgaagagcacgtagcgaggcacatagggaccggcgaagtacctaagcgtgaaaagcaccatgcccgtgcagctgcagcaatagccttaaagcgtcgtcgtttagtggttttcttgggttggaaggagcctctgccttggtgtgataacaaatgtgcaaaggacaaaaacacagtgcatgttgctcaacatggaggcgaggtgcgacagaggtgtggtagcaaggctaggtttgacagaccagcgacggcacaatgcgacaacaaggctaggtgtgatgaaggtgcggcatcaaggctaggtgtgaccacacaacgacaaggtgaggtgcaggcttacttcaaatcaatggctgtttcgtatgttcacatgcttcaacgtaacagggctttccacaagggtaactctcctatcctaattgcatttacaaggcaagaaggaaccactgtttag

SEQ ID NO: 85290 - DNA, 129 bp, Glycine max
  Peptide Sequence Number=SeqID_176975
ggagaagcacttttagcacaagcgaaagaaagaaatcgtggtgcgtttctcgccggacttagagtagccaatgggaataggacaattagacttggcgatccggatttggtgtcccagatggcatcgtag

SEQ ID NO: 85291 - DNA, 468 bp, Glycine max
  Peptide Sequence Number=SeqID_176976
atggtgtcagttgaagcttcatcatcaaaggagtcagttggaagcgagtctgaggttcgagggtttcgcgacgaggggtctagcgacctgtcagtttttttaagtcagctgccacccaatgcggttgaaaaggagaagtgtctgtctcctcccatcatgcttccagagtatatgtgggttgacggagaggtaggtacctacttctcgtgttacaaccacgaattggacttgatcaacgtcattagttggttgttgatcaatgacatgacggacctagagacgtgctcgatcacactttgcatggttcggtcaaacgctactttgctcgcggaattcgtgttgatgaatcgtgacttcttctacatgtatgattgtctatttcgtgatttgcatgtgaaggtcccctttgatgattttagtatgggtgtcctctggatactcaatgttgcaccaacacaattgcattga

SEQ ID NO: 85292 - DNA, 981 bp, Glycine max
  Peptide Sequence Number=SeqID_176977
atggaagaattacggaaactagagaaagtacatagcatgctggaattcatggaatcacggggcgtttcaaacctcgatcatcactctaaccgcttcctcgctaatttcattctcttcttgatagaaccctccggagaccttgccataaacgacaagtgctccttgctttcccagcttattcccactctctcatcttcattccttgaagacgcgtatcaacaccaccttgacaccaccaagcgagaaaattctgctgttatgatgcagctagataaaatgaatgagaaattgctgcaaacaccctacaatggaaagtgtgtatttggagaaaaagatgagtggcagagagaaactaaattattggtttcttgcttctcaaatgacccagttagaccacttgcgactattcttgaacacaaaggccttttgacggaaaggataagagaagaacttagactaggagaagagtactgggctcttgaaagaaagctctgttctgcactaacaaacaaagagaagattcttgttgaagatgtgatgaaggctattcatttgaagtcttttgattatcgagtgctgaatcttcttctctatcaactgcaagggactaaggtggaggagttgcatatggagtttctctcaatttcggagttgctagtggaagttgctgatgatctgtatgattatgaggatgatgttttagagaacaatttcaatattttgcgcatgtttatccgaatatatggaccttcagctgccccttctatgctggcgaagtgcattggtgaggctgaagataagtatgcaagtttacagaaatcacttgatccacatctctctctgagctaccagaaaagatgtgcagaagccactaaagaaggtggaaaagtatcagaccacccacttggaacatggagtattccaactgtgattcaagatgaggaattgtatagattaaagctgaagtcagatatttcgtga

SEQ ID NO: 85293 - DNA, 267 bp, Glycine max
  Peptide Sequence Number=SeqID_176978
atggcaggaatgcacaatggaatggaagaatgcaggttgatgacaatggagggagggaggatggactcgcgtcacactagagaggagaaagaggcgtcaatggcgtgggtgattgatgtgggagggatggttaaagcttcatgtccttcacattgtattatggaaaattcaggaaacaacactgagaatgcaaaaagcaacaaccccaatttcaacgccataagagtccaacaccagtctctctcagcagcgaacatcttagcataa

SEQ ID NO: 85294 - DNA, 399 bp, Glycine max
  Peptide Sequence Number=SeqID_176979
atgacaatgttggtttccttagaagcattggcaatggctggcgcaagtgatgtggaatgtgccatggatattgaagaatgggaacgcaaagatttggagcagtatccaccaccccatttactagcccaagaagaagaagaagaaaggaacaatggagtatatggccttccgaatcacaacacatgggaatgtcacaaggaggaagaacatggtgtcaccttcaccaatcatcaagaaaagctagattcaactatatatggaaacaatatggttaaaatgcacgaggatgagtcagaacaaattacatcaacaatatttcgggaatcaaagttatctgctggtcttggacagtcgttggacctctcctgctttgcctacaacggctatatagcaaaatag

SEQ ID NO: 85295 - DNA, 2529 bp, Glycine max
  Peptide Sequence Number=SeqID_176980
atggaatatataatgctgaaaaacacaatacctgttagggaattttggcggtacccaacactgatgagaactttattacttgcatctggtatcttaatcgctggtggaactgctgcatatgtgcaatcaaggtttagagttaataaacatgatttatttggccattgcaatgggcacaacaatgataaagaagtcacagaggaggaggttgtgaagggtgttagtgctccaaaaaaaaagcaaaagaaagggttgaagtcactccaagttcttgctgcaattctactatctggaatgggcaaatttggtgcaagggatcttcttggtttagttgtgatagcggtgctgcgaactgctttgagcaacaggctagctaaagtgcaaggcttcctatttcgtgctgcttttcttcgacgtgtaccattgtttcttcggctaatttcagaaaatattcttttgtgcttccttttgtcaaccattcattctacgtcaaagtatataacagggactttgagtttacacttcagaaaaatattgacaaagcttatccattcccactattttgagaacatggtgtattacaaaatatcgcatgtagatggtcggataactaacccagagcaaagaattgccagtgatgtgccaaggttctgttcggagttgagtgaaattgtacaggatgatctaacagctgttactgatggacttttatacacttggcggttgtgttcgtatgctagcccaaaatatgtcgtctggatattggtatatgtacttggagctggtgctgcaatcagaaacttttctccttcatttggaaagcttatgtccaaagagcagcaattggaaggagagtatcgacagcttcacgcacgattaaggactcactcagaaagcatagcattctatggtggagagaggaaagaagaaactcatattcaacagaagtttaaaaccttggttaggcacatgtatagtgtgctacatgaccattggtggtttggcatgattcaggacttattattgaagtaccttggtgctactgttgctgttattttgattattgaacctttcttttctggtcatctaaggcctgatagttcaactttagggcgtgcagatatgttaagcaatcttagatatcatactagtgtcataatttccttatttcagtctctaggaactctttctatcagtgcaagacggctcaatcgtctcagtgggtatgctgatcgcatttatgaattaatggctgtatcaagggagctaagcttggtgaatgagaaatcttccctgcaaagaaatgcaagtagaaattgcatacgtgaagctaactacattgaatttgatggtgtcaaggttgtaacacccactggtaatgtcttggtggatgatctgactcttagggttgaatcaggatctaatcttttgattacaggtccaaatggcagtggaaaaagctcccttttccgggttctaggtggtctttggccattgatatctggacatattgtgaaacctggaattggctctgatcttaataatgagattttctatgtgccgcaaaggccatacactgctgtaggaacacttcgagatcagttgatttatcctcttactgaagatcaagagattgaaccactcacagatcgtgggatggtggagctgctaaaaaatgttgaccttgaatacctgttggaccgttacccgcctgaaagggaggtaaactggggtgatgaactgtcattgggtgagcaacagagattaggcatggcaagacttttctatcataagcctaaatttgcaattctagatgagtgcacaagtgctgtcactactgatatggaagaacgattttgcgctaaagttagggccatgggaacatcatgcattaccatatcacatcgtccagcattggttgctttccatgatgtggttttatccttagatggtgaaggaggatggagtgttcattataaaagggagggctcttctactgaagtggggattgatacgatgaaggcatcagaaacaaaacgacagagtgatgcaaaggcagttcaacgtgcattttccatgagcaaaaaggattctgcattttcaaatccaaaggcacagtcatattttgcggaggtgatatcatcatctccatctatgaatcatacaattccaccatctgttgttccccaactccattgtaatacaagggtattgccattgagagtagctgccatgtgcaaagtattggtgagtaccttctgtaaatatgctctcttaaggcctttacttgtgatcagtaatagtggtgaccatggtagtgatggtagcggtagcagtcaattgaatggtgattgggctggtgacaacaatgccggtgatgatggtgtgaaggtggcatttagtggtttggtagcagtggtcggtagaggtggtaatggcggctgtgatggcagagagagaccaaaacaaggaaaacatttatgtgatgtgggggtgattagggattgctatttagagggtaggggttag

SEQ ID NO: 85296 - DNA, 1188 bp, Glycine max
  Peptide Sequence Number=SeqID_176981
atggcattcaccaccaccgacatccttggaacaccccaccctcaaaggatcacattcttggagagggcgacaaagttgggttctttccgtaacagcttcgtggagaagaaggaaagaggaccactcgctatggatgcaatattgttcctattgcactgtctccgacaacatcgtcgacacgaagaagacagtgaagcgcgtggcagcaacgggtggggggagggtgatgccgtggagttggaggctcgatttgagggtaaagtaaaaaggaacacaagcagaatgcagagaggcacgccggtgagaaagccacacaccaacacctccgatctcctcacttggtcggaaactcctccgccggattccgccgccgccgccaccactcgctctggccagccttccgatagaatcagtaaggttctccacggcggccagctcaccgacgaagaagctcagacgctagccaagagcaaaccatgctcagggtataaaatgaaagaaatgactggaagtggtatatttgctgccaatggggaagattctgcatcagaagccaattctgcaaatttgaataacagaacaagcatacgcatgtgtcagcaagcgatgaatggaattagtcagatatcattcagcactgacgaaagcatttctcctaaaaaacctacctcaatacctgaggtagcaaagcagcgtgaactgagtgggactatgcaaagtgattcggacacaaagagtaagaagcaaatatcaaatgccaagaccaaggagctcagtggaaatgacatatttggccctcctcctgaaatcgtgccccgttcagtggcagctgcacgcactttggaatcaaaggaaagtaaagacatgggagagcctcttcccagaaatctgcgaacatcagtgaaagtttcaaatcctgcaggtggtcaaagtaacatcttatttggtgaagcatccgttgagaagacagcaaagaagatacataaccagaagttcgcggagctgacaggcaataatattttccaaggagatgttcctccaggctcagctgagaagcctctgagcagggctaagctcagagaaatgactggcagtgacatatttgctgatggaaagacagaaatcaaagaccctgtgcgaggtgcccggaaaccccctggtggagagagcagcattgccttggtttaa

SEQ ID NO: 85297 - DNA, 1839 bp, Glycine max
  Peptide Sequence Number=SeqID_176982
atgcccacgcttcatcttccagcacttttttgctctgtttgtgacttggagattgagatctatgtgtatgtcacccacttagccgctgtggacccacgatgcaaatgtttttattttcagccgccatgtgcggaatcctcgcagtgttgggttgcgtcgacaactctcaggccaagcgcgctcgcatcatcgaattgtctcgcagtcgaaaaatgtaggttgcggcatagaggtcctgattggagtggcatagattgctatgaggattgttacctagctcatcaacgccttgctattgttgaccctacttcaggggaccaacctttgtacaacgaagataagactattgttgtcactgtaaatggggagatatacaatcacaagcaattgagacagaaactgagttcccatcaatttcgaactggtagtgattgtgaagtgattgcccatctttatgaagaatatggagaagaatttgttaatatgctggatgggatgtttgcctttattcttcttgatacccgcgataaaagttttattgctgctcgtgacgctattggcattacccctctatacttgggttggggtcatgatggatcaacatggtttgcatctgaaatgaaagctctgagtgatgattgtgagagattcattgcttttcctccagggcatatatattccagcaaacagggaggattaagaaggtggtacaatccaccgtggttttcagaggatattccatcaactccctatgatccaatccttttgcgtgagacctttgagagggctgtagttaagagactgatgactgatgtaccttttggagttcttttgtctggaggattggactcatcacttgttgcttctgtggtcaatcgttatttggctgaatctgaaactgctcgacaatggggatcacagttgcatactttctgcattggtttaaagggttctcctgacttgaaagctgcaaaagaggtagcagattatcttggtactcgtcaccatgaactttatttcacagttcaggaaggtatagatgcacttgaagaagtcatttaccatattgaaacatatgatgtaacgactatcagagcaagtacgccaatgtttcttatgtccagaaaaattaaagccttgggagtgaaaatggttctttctggagaaggttcagatgaaatatttggaggttacctgtactttcacaaggcacctaacaagaaagagcttcatgaagaaacatgtcaaaaaattaaagctcttcatctttatgactgcctgagagccaataaatcaactgcagcatggggtgtagaggcacgtgtaccattcttggataaagaatttatcaacgtagccatgagtatagatccggagtggaaaatgataaggcctgatcttggaaggatagagaagtgggtgttacgcaatgcatttgatgatgataagaatccatatttaccgaagcacatattgtacaggcagaaggaacagttcagtgatggggttggttacagctggattgatggcttgaaggatcacgctaacaaacaagtcacagatgcaacgatgatggctgccaattttatttaccctgaaaacactcctactacaaaagaaggatacctctacaggacaatttttgagaagttctttccaaagaattcagcaaaggcaacagtgcctggaggtcctagtgtggcatgcagtactgcaaaagctgtggaatgggatgcatcatggtccaaaaatcttgatccttctggtcgtgcagcgcttggtgttcatgcagctgcatatgatggtgcagtggatacaaccaaaaatggacccctttaa

SEQ ID NO: 85298 - DNA, 1278 bp, Glycine max
  Peptide Sequence Number=SeqID_176983
atggattcgggtaacagtgggagtatgcaatcttccagcaccgccggtgatgaagagtacgattcacgcgccgacccatctttgtcgtcatcaatctctgcgttctttaatagtaactcccatccttcagctccaccacaaccaacaacgttaacaaaccacgttggtcctcctttctctactcagcaccaccacgtgttcgaccctttatcatccaattacttggatccgacacaaagatcgccgcaatcaaaccaaatcctcaacctcgacatggtgcggtccaaggttgccgccagatccggacccgattttagctccttcataccttcatcttccccacacaacaacaacaaccaagcttttctgttaactcaattgggaggaggaggagttaacaacgttggtgcttttcccagtaccactctccctccagaaagtggaggaggcggattagtaatgaatgaacaagtaaacagtagcaacaccaacaaaaacatggttcgaaacccgaagaaaaggtcaagagcttctaggcgtgcacccaccactgttctcactacggacaccacgaatttccgagccatggttcaggaattcactggcatcccagcacctcctttcacttcctcctcctcgtctttcccaagaacaaggttagatctctttgccacctctaatgcttcttcttcatccattattagagaacaaacaccttcttatcttcttcgcccctttgcacacaaagtccaagctcaagtaccttcttcaatcccaccaccctcttcctttcaacccatgttgaacaactaccaccaccaccaccaccagcataacccaattctcagcttccaatccattctccaaccgcatcaactcattggttctaaaactcaacaacaaccctccttggaaataccgcctagtgctcttgggttggaggaattaggattgaaccatgctcatcatcaaaacatcaacatgcgttcgtcttcatcggatggaacattgtcaagggtcaacaacgacaataacaacatgcgtggtccttcggcagattgggcccaggcccaggcccaaagaattgataacaatgatggaggacttttggggtctcttactggtgccaccttaaactacagaagcaatattgtttcggatcagcgagtcaaggttactaataattcggattttcatggagaaaaaggaccggaatgtgttgtggctgtacgaagcgaaggtatggtcgaatcgtggattaattgttcttctgattga

SEQ ID NO: 85299 - DNA, 1197 bp, Glycine max
  Peptide Sequence Number=SeqID_176984
atggcggtgatcaacaaagaaataatcgatgagccctacgaacaagaggagtgcatcgactacgagcagctgaagaaacgcatgtggaaggaccgtgtgcttttgcagaagctgaaggagaagcgcgagaagcaagaacccgacgtggaagcgaaacaagaggcgtcaaggaggaagaagatgtcacgcgcacaagactcggtgctcaagtacatggtgaagatcatggaggactgtaacgcgcagggcttcgtgtacggcatcatccctgagaaaggaaaaccagtgtccagttactccgacagcctccgcgagtggtggaaggaccaaatccgctttgaccaaaacgcccccgtggcgatctcaaagtacctcccagtcctcgaaaacgacttagacataagttcctacatacacctcctccaagacttgcaagactccacatgcactaggctctcttctctctgctctcatgcgcgcatgcaacactgtgcacctccacagaggaggtttcctctggagagagggctttcccctccttggtggcccagtggggaggaagtttggtggggccaacagggccttctggcccaagtacacggcccacctccttacagaaagccccatgacttgaaaaaggcttggaaggtttctgtcctcgctgcagtcatcaaacacatatctcctgattttgataaactcagaaggttggtgacacaatcaaagaccctgcaagataagatgacagccaaggacagtgccacgtggtccaaagtcatgatccaagaagaggcttggcttggactaaccgacaagtgcctcaaaatatctgcttcaaaccaagaagaagaagatgatattgcacagggtttgaagagaaagggcgcgtttggttttggtgatgctgcattggacacgatgtatgcttgtcagaacgtggagtttccacagagtgaggatgattggatgaacgtggctgttcagaatgatgtgagcctaggtgaggatgcgggtgggagtggaacattggaagatgacccttgttattggcttaacagcgttgaaaatcttgagttgcaagcggcgctggagttgttggtcagagataacgtggactttgctccaaatattccacagggacaagaggatgcagcctcggcttcggacttgggaacccatccaccgcaacaaggatag

SEQ ID NO: 85300 - DNA, 284 bp, Glycine max
  Peptide Sequence Number=SeqID_176985
atggctgattgctttctaactgatgttgttggaatacgtatcctgcctcactgcagggatgagtggatttggaaaccagaatcaagcggacaatattcagttagaagtgcctatggtgtgttacaagaattcttcccctatggtgggaatccatgtcttgggctaacactcttggagctttcccacagaaaccttggcaacacttctcccagcatgcgacatgtgtgcctaactgaaaaggtgataatagatggcggtgctggtggctggccttcacatggtcg

SEQ ID NO: 85301 - DNA, 1602 bp, Glycine max
  Peptide Sequence Number=SeqID_176986
atgggcgtaaagcgcgtggtgctcacctcctcgatctctgtgatggtggtgacgtcgccgatcatgaaggctgcgaggaaggagaagaagaactcgacagagttttggaggagggtcatgacaacgtcgcccttacagattccggggttggacaatcctgcgacgatcttgcatgaaacgagtgggtccgacgatgaggcatgggcgatcgacgaattcgaagaggttctcgaagtagtaggcgtggagaaggaggtggttggagattggtttggttttctggtggaatatctttcagatcccacgatcgtggggttcttggcagcagctgccgtgagcattgggctacaacaattgaaaggattatttgggatcgttaactttaccaacaaaactggtttattttccgtggtcaaatctctttggacatcgttcaaaaaccaaggcaaaaggaacaagaaactgatgtggttgtcacacgttgctcctctcctttctgttattgtatcctctgttgttgcatacaaaataaactttaacgagcttcaagtgaaggactacaaagttgaagtcttgggaccaattaaagggggcagctcgaatccaagctcactccatcagttaacatttgatagccaagttgtgggtcatttgatcagaatagggctcaccattgctattatttcactcacgggatctattgctgttggccgatcatttgcatctctaaaaggacacagtattgatcccaacagagaagtggtgtccttgggcataatgaacattgttggatccttaacttcttgctatattgcatcaggatctttgtcacgtactgctgtaaactacaatgctggctctgaaacaatggtgtcgaacatagtgatggcactgacggttctcatgtcacttaaatttttgacggggcttttgtatttcactccgaaagcaatccttgcagcaataattctctcggccgtaccgggactgattgaccttaacaaagcacgtgaaatttggaatgttgataaaatggatttccttgcttgcactggagcctttttgggagtcttgtttgcatctgcagaaataggccttgcaattgggatcacgatatcatttgcgaagataattataacctcaattcaacctgctacagcggttattggaaggcttccaggaacggatgcattcggcgatgttgaacaatatccaatggcggttaacattcctggggttttgatagtctctttaaaatcttcttggctttgttttgcaaatgcaaatcttgtggaggaaaggattgagagatgggtgaacaatgcaaaagctaaggaaggaagagaaagcaccttcacatacgtcattattgatgcctcaagtcttacgaatattgacaccgcgggaatagcttctctggtggagctcaacaaaaatctgatttcacggggagtaaagttagctatcgctaaccctaggtggcatgtaattcacaagctaagattagctaacttcgtgagcaaaattggaggaaggattttcctttctgtgggagaagcagtagatgcatgtgttggcactaaaataatggttgttgtataa

SEQ ID NO: 85302 - DNA, 2115 bp, Glycine max
  Peptide Sequence Number=SeqID_176987
atgccaccgtcaattgttacggaggaagtttgcactgcatgtgattttaatcgtcccggaaagacttgcctacgcaaacttgagtgggtttggcgtggagaaacattcatggctaagaaaagtgactattatgctttaaagacacagattgaatcagagtttgttgatgattctgagaagaacaacagagccttatctcactattctgagaaatcatcaaaatcttttcttgaccttcccaaggcagagcaacaatcaagactgaaagagcgtttaaagaaatattgccagaaggcatataaacgggtacttgacaaacctgttaccgaacttcgtgaagcaggaatctgcatgcgtgaaaatccattttatgttgacactgttcgcagtttccgggatagaagatatgaatataaaggtctcaataaggtttggaagggaaaactgtcagaggccaaggctagtggaaattctataaagatccaggaagcacaggatatggttgtgctttatgattcattgcaacttgctcacaagtgtatacttaattccttttatggatacgtcatgcgcaagggtgcaagatggtactccatggaaatggctggagtagtgacatatactggtgcaaaaatcattcagaatgctcgcttgctagtagagaaaataggaaaaccacttgaactagacactgatggtatctggtgtgcactacctggatcttttccagaaaatttcacttttaaaacaagagacccaaagaagaagtttacaatctcatacccatgtgttatgcttaatgttgatgtggcaataaataactcaaatgatcaataccagacactcacagatccaatcaggaaaacgtatacaactcgcagtgaatgctctatcgaatttgaggtggacggaccgtacaaggcaatgatccttcccgcttccaaggaagaaggaattttaattaagaagcgatatgccgtttttaatgatgatggaacccttgcagagcttaaaggttttgagatcaaacgcagaggtgaactgaagctaataaaagttttccaggctgaactttttgacaagtttctccatggttcaactttagaggaatgctattcagctgttgcttcggtggcaaatggctggcttgatcttcttgataaccagggaaaggatattgcagacagtgagttgcttgattatatatcagaatcaagtaccatgagcaaatctttcgctgattatggtctgcagaagtcttgtgctgttgccactgctagacgtctggctgactttcttggcgatacaatggtcaaagataaaggtcttcgatgtcagtacatagtagcaagtgaacccaagggcacgccagtaagtgagcgtgctgttcctgtggcaatatttgaaactgatgctgaggtaatgaagttctatgtccgaaaatggtgcaaggtctcatcagatgttgacattcgatccataattgactggtcctattacaagcagcggcttagttctgcaattcaaaaaattatcactattcctgctgcaatgcaaaaggttgcaaatcccgtccctagggtggttcatcctgattggttgcataagaaggtccgtgagaaggaggacaagtttcgccaacggaaattagttgatgcctttaaatcaatgaataggaatgagcactcaaaaaagcataatgactcaaatcgtgtccctcttgtgattgatgatgatattgttaatgagttggaggactttggaaacaaggacaggagttctacatgcaggcctagaccaattatacggcattatgaagctaataatgaacgacattcagggaagctcaatgatcaagatgtagagcaacagcataataaaccattacaacaaaaagttgacaaaaatgtagattatgaaggatggcttcaaataaagaagcaaacgtggaaagatattctggaaaggagaaagaagcgaagtgtatgggacttgagtcccacattggaagtatgtggttctactgtggggttttgtaaggccttagacattgactactattggggttgggttagtgtcaagttccataaaaaatccaagtttcacatcggctaa

SEQ ID NO: 85303 - DNA, 6777 bp, Glycine max
  Peptide Sequence Number=SeqID_176988
atgtataaagaggtagattatttatttccacgtgattctattctatcgaaagcggtggctcaagcgaacgtgaaggctgagcctatgagcttgcaggctgaagctgttgtcggtgctcattatgtaatgaaaatgtctgtgattctcctccatcaccgcaaaaccaatcgattcgcttctcagtctctgaagatctggagagggagcagtgtcctggttgatctgcttgggagagtcttcgaacgcaaagcgaagctggcgactacactcacttggaggtttgctgccagtaatggcagcacccttgctgctaatgatatggaaagaaatggtgatgggaaggctcaagattcagaggctctacctcctcattctgttctgaagatgggattgagagaacgtagcaacagcagcagcatggaggatccagatgggacattagcaagtgttgcccaatgcattgagcagctgcgtcagagctcatcttctatgcaagagaaagagtattctttgaagcagttattggagcttattgatatgcgagaaaacgctttcagtgctgttggctctcattctcaggcagttccagtacttgtttcccttctccggtcagggtcattgaatgtgaagatacaggcagcaactgtcttgggctcactttgtaaagaaaatgagcttagggtgaaagtcttgcttggaggttgcattcctcctttgcttggtctactcaagtccagttctgctgaaggtcaagtagctgcggcaaagactatttttgctgtctctcaaggtggtgccaaagatcatgttggatcaaaaattttttcaactgaaggagttgttccagtgctatgggagcagctgcaaaagggcctgaagactggaaatgtagttgataatttattgactggggcattgaaaaatctctccagtagcactgagagattctggaatgccacaatacaagctggaggagtggacatattaattaagttactgacaacagggcagtctagcactttagcaaatgtgtgctttttactggcttgtatgatgatggaggatgcatctgtttgttcaaagttgttgacagcagaggcaacaaaacaactcctcaaacttttaggccctggtaatgatgcccctgtcagggctgaggcagccggtgctcttaaagctctatctgcccagtgcaaagatgcaaggaaagagatagccaattccaatggcattcctgctttgattaatgctaccatagctccttccaaagagttcatgcagggtgagtatgctcaagcgttacaggagaatgctatgtgtgctttagcaaacatttctggtggtttgtcatatgtcatctccagtcttggtcaaagccttgaatcatgctcctctcctactcaagctgccgacacattgggggctttagcttcagctcttatgatatatgatgacaaggcagaatctaccagggcatcagatcctttggtagtagagcagacattacttgaacaatttaaacccggcttaccattccttgtgcaggaacggaccattgaagccctagctagtttgtatagcaatcctatactgtcaattaaacttacaaattctgatgcaaagcgtttgcttgttggtttaataacaatggctgctaatgaagtgcaagatgagcttctaaaatctctcttgacattgtgcaatactgaatgcagtctatggcttgcacttcaaggccgtgaaggagttcagctgttgatatctcttctggggctttcatcagaacagcagcaagaatgtgctgtttccctcctttgccttttatctaatgaaaatgatgaaagcaaatgggccattactgctgctggtggtatacctcctcttgttcaaattttggagtcaggatctgcaaaagcaaaggaagactcagcaacaatccttaggaacctatgcgatcacagtgaggatatacgtgcttgtgttgaaagtgctgatgccgttcctgcattgctgtggctgttgaagaatggaagcccaaatgggaaggagattgcagccaagactttgaatcacttaattcataaatctgatacagcaactatcagtcagcttacagcattattgaccagtgatttacctgaatctaaggtttatgttttagatgctttgaggagtatgctttcagttgttgctcttactgatcttctacgtgaaggtagtgctgccagtgatgcaattgttacaatgataaaacttttgagctcaaccaaggaagaaactcaggcaaagtctgcatctgctctggcgggaattttcgaaacgaggaaagatgtgcgtgaaagcagcattgctgttaaaactctttggtcagcaatgaagttgcttaatgttgaatctgaaagtatcttaatggagtcctcgcgctgcttggctgcaatatttctttccatcaaagagaacaaggatgtggctgctattgctagagatgcattactctccctagttgcactagctaactcttcagttttagaagtggcagagctggcaacatgtgctgtggcaaatcttattttggatagtgaaattgctgagaaagctgttgcagaagaggtcatcttggctgctaccagagtattacgtgaaggcacaatttctggaaaaacacatgctgctgcagcaattgctcgcctcttacattgtaagaggcaagttgattatgctgtaactgattgtgtgaatcgagctggcactgttcttgcattagtttctttcttagattttgctattgatggacatagttccacatcagaagctcttgaagcacttgccatgctgtccaggtcagatgtgaccggtgcacacagtaaacctgcttgggcagttttagctgaatttcctaaaagcataagcccgatagttttgtctattgctgattcaacgtcagtgttgcaggataaagctattgaaatattatctcgattatgtaaggatcagccttttgttctgggagacagtgttgttactgcctctggatgtatatcttctatagctaagaggataatcaattccacttctaaaaatgtaaaggtcaaaattggaggggctgctgttcttatttgtgctgctaaactaaatcatcagaggctggtggaggatctcaatagatcaaacttgtgtgctaatcttgttcagtctctggtcgatatgcttatttcttcacaggctactttggataatcagggtgatgacagcagggaagttatcagcatttgcaggcatacaaaagaagccaatgatggtaaatcaaacactggtaccgctattatttctggtgccaacttagctgtatggttactgtctgttcttgcttgccatgatgaaaaaagtaaaattgcaataatggaggcaggagcaattgaggttctcactgacaggattgcagattgtttctcacaatatagtcagattgactataaagaagatagcagcatgtggatttgtgctttgttgttggcaatattatttcaagatagggatatcatacgagcacatgcaaccatgaaatctataccagcccttgccaacttattgaagtcagaggaatcagcgaacagatattttgctgcacaatcaatagctagcctagtctgtaatggtagcaggggaacacttctgtctgtggcaaattctggggcagcaggtggacttatctccttgcttggctgtgctgattctgatatacaggatcttctggaattgtcagatgaattttctttggtgcattatcctgaccaagttgctctcgagaggttgtttagagttgatgacataagaattggtgccacttctcggaaggcaatacctgctttagttgatctgctcaaaccaattccagaacgcccaggagcaccatttttagcacttgggcttttgactcagctttctatagattgtccatcaaataagattgtaatggttgaggcaggggccctagaggctctttctaagtatctttcactaggtccacaagatgcaacggaagaagctgctacagatctgttaggaattctgtttagcagtgcagaaattcgaagacatgagtcagcagttggagctgttactcaacttgtagctgtcctgcgtttaggaggaagagctgcaagatatagggctgcaaaagctttggaaagtttattctctgctgaccatattagaaatgcagagactgctcgacaagctgttcaacccttggtggagattcttaatactggtttagagagagagcagcatgctgcaattgctgcattggttaggttactgagtgaaaacccttcaaaagcacttgctgttgcagatgttgagatgaatgcagtggatgttctttgcaggattctctcatcagattgctcaatggacctcaaaggggatgctgctgaattatgttctgttctttttggaaataccaggattcggtccacaatggctgctgcacgttgtgttgaacctctggtctctctccttgtaagtgagtttagtcctgctcaccattcagttgtccgtgcattggataggcttgttgatgatgagcaactggctgaattagttgctgcacatggtgcagttattcctcttgttggcctactttatggtaggaattatgtacttcacgaggccatttccagagctctggtcaagttaggaaaagacaggccagcttgtaaaatggaaatggtgaaagctggagttattgaaagcatacttgacatccttcatgaagcacctgattatctgtgtgcagcttttgcagaattgttgcgtatattgaccaacaatgctagcatagctaaagggccatcggctgctaaagtagttgaacccctgtttatgttgctgacaagagaagaatttgggccagatggacaacatagtgcattgcaggttttagttaatatcttagaacatccgcagtgtcgtgctgattactcattgacttctcaccaagttattgaacctcttatccctttgcttgattctccaatatcagcagtgcaacagttggctgctgagcttctctcgcatctacttttagaagaacaccttcagaaagatccggtgacgcaacagcaaagagctataaaggccctggttagtattgcactgatatggccaaatgaaattgcaaaagaaggtggtgttattgaaatttcaaaagttatattgcaatctgatccttccattcctcatgctttatgggagtctgctgcctctgttttggctagtattctacaatttagttctgaatactacttggaagttcctgttgctgttttggttaggctgcttcgatctggcttagaaagcactgttgttggtgcattaaatgctcttcttgtgttggaaagtgatgatggaactagtgctgaagcaatggctgaaagtggtgctatagaggctctcttggagctcctgggatctcatcagtgcgaggaaactgctgcaagactgttggaagttttgctccacaatgtaaagatcagagaaacaaaagttactaagtcagccatcttaccattatcccattatctcttggacccacaaacccaagcacaacaagcaaggttgttagcaactttggctcttggtgatctatttcagaatgagggtcttgctcggacaagtgatgcagtttcagcttgtcgcgctttagtgaatgtgcttgaagaccaaccaactgaagaaatgaaagttgtagccatatgtgctctgcaaaaccttgtgatgtacagtcgatcaaataaaagagcagttgcagaggcgggtggggttcaggttatactggatctgataggttcaagtgatcctgaaacatctgttcaggctgcaatgtttattaaacttctattttcaaatcataccattcaagagtatgcttctagtgaaacagtcagagcaataactgataaaggtgctatttctaatctgaattcattggtgagcaatgttgattctgtgtctaacaataagttgcttcaccttgataacctctctctagagtctagagtatctgctattgaaaaggacttatgggctactggatctgtgaacgatgagtatcttaaagccttaaattctctatttagcaacttcccaagactgagagcaactgaaccagcaacacttagcattccccatttggttacgtccttaaagacaggctctgaggctactcaggaagctgccttggatgcacttttcctgcttaggcaagcttggtcagcatgtccagcagaagtttcaagagctcagtcaatagcagctgcagatgctattcctttgctgcagtacttaatccagtctggcccacctcgctttcaggagaaggcagaatttttattgcagtgtttgccaggaacgttggtggtgatcatcaagtgtggtaacaatatgaagcaatctgttggaaacccaagtgttttttgcaagcttacactaggaaacactcctccaaggcaaaccaaggtggtctcaactggccctaatccggagtgggatgagagctttacatggtcgtttgagagtcctccaaaaggtcagaagcttcacatttcttgcaaaaacaagagcaaaatgggaaagagttcatttgggaaagtgacgatccagattgatcgggtagtaatgcttggagcagtatctggtgagtacactctgttgccggaaagtaaaagtggaccctcgaggaatttagaaattgaatttcagtggtctaacaagtga

SEQ ID NO: 85304 - DNA, 153 bp, Glycine max
  Peptide Sequence Number=SeqID_176989
atgggggagggatattgtatccagccttacccttgcatatgcaaagaggctatttccggattcgaacccatgaccaacaagtcaccaaggcacaactttaccgctgcaccagagctcgccctcaggaaaattgatctaccttctttctgttga

SEQ ID NO: 85305 - DNA, 1413 bp, Glycine max
  Peptide Sequence Number=SeqID_176990
atgtatatttcttggattgttgttattaagggagtatatgaaactaaggtgccactggaatttaatgcaattgtccagcttggttgtgtatgtaaggtggacaaaactgctaataaacgtagtctacaagaaccatggaatttgagtgaattgcacatgaagaccacagttgaatgcgcttatcttgaacaatctatatccttcttttatttttaccatagcatctctgagggacgggctatatatgttggatattttcctgcattaaaagcaataactgttgtggtagttaatccctatcaaaacaaagatttatcaccgacttttcttgaaagacaatttcacgatgcttgccagtctttgtctattgattcacctccgaggaatggcattaatttcaagttggactatgttgcacatgtcaaggatgctgaagcagtgatgcaaagagcaataaatggtcacagattcttggctggcaacaagttgctgctaaactggaatgcaacgttgtgctgcatcagtccaatggctaaatcaaagaattgctctctcaagatatgcccattttaccaaacaaagtggttaatcaagacaagtaaaaacatatgcaacactctttacatgtcgttaactgtggtaccgttggggaactttgaacttgactggcttatatttattgcggatatcttcttttcaagagcattgcatgataatcaacaggtactttggatatctgacgatggccttccagatttaggtggaattaatggtgaacagaactgttttgtggatgaggtccaacaacctgttcttacatatcctggagcttatagaaacgtaactgtggagctaaagatacaccacctggctgtaaatgctcttctcaagtacaacctagttaatgaaatggaaggaggcactctattgggatttggtcatgaacttgattctggagcattttccacaaatgatcaaaatggttttgatgagtctacctcatgtgcacaagcctttcgagtccttaaacagttgatccagcggtgcctagcagatgcagttacatccggaaatgtttatgctgattcaattttgcaacatctgtatagatggctttgcagccctaaatcaaaacttcatgatccagctctccaccagttactccacaaggtcatgcaaaaggtcttcgcattgttgttggcagagttccgcaagttaggtgctatgattgtatttgcaaactttacaaagattgttatagacaccgggaaatatgatctgtctagagccaaagcttactgtgatagtttgttaagaactatacaatcaagagatctatttgaatgggttgagcttgaaccactgcagttctggtgctcgttgctattcatggatcaggcctcactgctttag

SEQ ID NO: 85306 - DNA, 1002 bp, Glycine max
  Peptide Sequence Number=SeqID_176991
atgcagttcgggttaagaaccccagagataccagatgaaagcagaatctccagaggaagcatgagtataccttttaggttccatgagagtgcactgagcatgatggagtatgagaatgatcggagagtgagaagactgagcacggggcccttcaccctgaaaatcataatgcaaacaaattgtcccattcttgctcatatctgttgcgtggataaatttaagtggcctctcactaaggacactgttgttctccgagtcacaactcgcacctacgtcattgccctccctggcctcttatatgcccttcaattcccaagcctttgcactcgaccaagtctaagaatcctttcagatgtctttacgaaatatggccacttccaggatcttagaccccaaaagctaggtgggtgctcaatgcagttcaatgaaccaggaatgctggaaagtttgcgtcctcattttgaacacatagcacatgagaccctttttgagttagggaacatcccagggatttctcgtttctgcatggaagaccacaactcgagcttccttagggcgtgtcgcatgtcggcgatcacaaagatgataaagaaaagcatgcgtttgaagaaaatgacaagtagccttgtggagatcaatggcacaaacccacttgaggcacacctaggaagagcctatgctgtggcgagtacctacactcgccttgttgattctgctgagtatgcttcgcttgtttcctgtggcttaggtgagaaattggaaaatgttgtgtctcctctacggtttggttcggttgatgttggataccaggtttggaatctcaatcagctgggccttttgtctttcatgtctctcttgggaccccatgttgaagaggaagtggaatatgtgagtcacgttagttctagagaagagtggtggaatgccatggctgaaaaggatcaagaagaagctgaggcctctgcaaaagatgaaggcaatgaaaaaaatatggagtcatag

SEQ ID NO: 85307 - DNA, 579 bp, Glycine max
  Peptide Sequence Number=SeqID_176992
atgaggaggagcaacccaaacgtgtggttctcatcacaggatattccatgggagttcacggagaagaagtgcagagtggtggccaccagcaggttgcggtcgagcatggtagagctggaacacgacacacaagaattcgatgttcagtccgatgagagcatgagtaacgtggttgatgctgttgttgacaagcatggtgtaagggaaccaagggatccttggtcagatggacctgagaacataacacaatgccctattcagccaggaacaagtttcactcagaaggtggccttcacattggaagaaggaactctttggtggcatgcacatagtagttggactcgtgccactgtccatggtgtcattgtcattttacctgccaatggaacttcatatcctttccctgagccttatggacaagaaactcttatcattggagaatggtataagggagatgtgatgcaaattataaattcagccctggcaactggtgacgagcccattacatcagatgcttacaccatcaatggccaacctggtgacttctataattgctcaaaaggtacattgttgtcttga

SEQ ID NO: 85308 - DNA, 471 bp, Glycine max
  Peptide Sequence Number=SeqID_176993
atggaagaccacaacatcacaggggcgtgtcgcatgtcggcgatcacaaagatgataatggaaagcatgcgtttgaagacaatgacaagtagccttgtggagatcaaaggcacgaacccacctgagtcacgccaaggaagtaactacactcgcctttttgattctgctgagtttggaatctcaatcagctgcatgtctcacttgggacctgaagttgaagaggaagtgaaacatgtgagtgaaagacaagagtggtggaatattgtcatggctgatgaaaaggaagcagaagaagctgaggcctctgcaaaagatgaaggaaatggaaaaaaatatggagtcatagactatattgagtctaggagtgagacgagatcatgtatgatcgaggtcttggattctcacatttgtgttcttgaattatgtaatgatttgtctttaataagagaggggacaaaacagatgtcttaa

SEQ ID NO: 85309 - DNA, 1497 bp, Glycine max
  Peptide Sequence Number=SeqID_176994
atggcgatggtgaagagaagcattggtgtttgtaagaggctttctggttcttcttcttgtttgagcacttcaactgcaacaagtgataatgatattgctcggaggcttcagcttccaccatttgattacaaaccacggccatacaaaggacctttggctgatgaagtttttgccaaacggaaaaagttccttggtccttccttgttccacttctatcaaaaacctctcaacattgtggagggcaagatgcaatatctattcgatgagaatggtaggcgttatcttgatgcttttgctggaatagttactatctcctgtggacattgccatcctgaagttttgaatgctataatggagcaaagtaaactcttgcagcatacaacaaccatatatctacaccatgcaatagctgattttgcagaggccttggcatccaaagtgcctggaaaccttaaggttgtttattttgtaaattctggttcagaggcaaatgacttggcgatgctgatggcccgtttatacactggtaatatgggtatgatttccttaaggaatgcatatcatggaggaagttctagtacaattggactcaccgcgatgaacacatggaaatacccaataccagagggagaagttcatcatatcatgaatccagatccataccgtggaatctttggctcagatgccaataggtacgccagagaattgcaagatcatattgactatggcacatcaggaaaagttgctggatttatagctgaaacaattcaggcatgtataatccatccatcatgtttaatttctaaacttcagagtggtatttatagccacacacaccttagtgtgggagctggaggagcagttgaactggcacctgggtacctaaaactggtctatgacattgtacacaaagctggtggtgtctgcattgctgatgaagtgcaatgtgggtttgcgcgcacaggaagccatttttggggatttgagacacagggtgtcattcctgatatagttactatggcaaagggtattggcaatggtttgccattagcagctgtagttacaactccagaaatagcgagtgtgatggctcaaaagcttcaatttaatacttttggagggaaccctgtatgttctgccgggggacttgctgtgctcagagttcttgacaaggagaagcgtcaatctcattgtgctgatgttggttctcacttgattcagcgtttaagatccctgatgcaaatacatgacatcattggagatgtaagaggaagaggcttaatggtggggatagaatttgtcaccgatagaaaagagaagacacctgcaaaggctgaaacaacagcattgcacgaaagattcagagagctcggtattctagttggaaaaggagggctgcatggaaatgtttttaggatcaagccaccaatgtgtttcaccaaagatgatgcagattttgttgtggatgccttggactatgctatatctaagttgtga

SEQ ID NO: 85310 - DNA, 375 bp, Glycine max
  Peptide Sequence Number=SeqID_176995
atgaagcttaagtctggggaacttttgaagcatatcccttggaagaaaactgtagatccaaatctgccaacttcatctcaaaggccaaaagaaagttatcctactgataggataataccccagaatactaacgatggacaaatcagaacagagttttatattccagaaccagtgtttcaaaaggcagaagatttagctgatgattattcttcattagacagagactgggaagactataatgctcaattaatggaggatttattgcacaagaagaagtactgttatcatcacccggtatatggaagtctcacaagatcagaggtgcaaaattacaacttgtcattatccaccagatccgactacaggtcagactaa

SEQ ID NO: 85311 - DNA, 231 bp, Glycine max
  Peptide Sequence Number=SeqID_176996
atgcaggggcagtttttgcttgtaggcctaggatcttcttcatcaatggattcctttgcttcttggaagatgaatggagaaaggaagagagagaggagatgccacttcaaggagaagatgagtctagaagaagctcaccaccataggaggccatggataagagcttggaggaagaaggagatgaatgaagggagagggagagaagagcacgaaattttgtgctctaaatga

SEQ ID NO: 85312 - DNA, 420 bp, Glycine max
  Peptide Sequence Number=SeqID_176997
atggcacagtggagtgtttgcgcagtgcttctctccttcctcattctctcagtcggtgaaggtaccgatgttcagcgttgtggtggtcgtcggcggcatacgaagtatgcatttgtgttgggtgtgcattttggtgtaccgcagatggacgaagatcagtggatgtatgaaagtataatacctgaagaagtgaatatgggtcatgaaaatgaagaagaatgtggtgtgaatgaaccacatgtcgattgttcggaagcgtttaatacttctcagaggatgttttgtggtgggcttgatccgttgctcatgaaaatggatttgtggcggaagaaagaatttgttacaagagacaataagactaggaaatgtggatgtcccttcaagctttgtggcaagccagtggatggaggacaaggctag

SEQ ID NO: 85313 - DNA, 714 bp, Glycine max
  Peptide Sequence Number=SeqID_176998
atggaactgttgaagtgcatatttgaacgaagcccaaatttgttggaaagagacggcgatggcccctttccaacctgcaaaaatctcagcatcgaggagctctgcatcgtcggaatcaataaagtggatcttcccgccaccaccaagcacaactgcttggttgtcaatacacccacctcaaacaccatcgatgttgccaagcacataatgatgctccttgcagccatggccaggaatgtcgctcaggctgatgcgtctgtcaaagccgttgcaatggcttcaatcaagaatctgaaatcgaacaagcatcaatatgtgtcatggatggtgcaccttggtcgcaaaagcctaatcactagagttgctgatagaattggtgtgggagtgcatttcaacccttttgttacttggaatggaaagaagttgaaagatgataaagctcaaaagctggctctgcagcactggattgaggtgagaataagaaacttgattgtctccatatcgtatgcaagaatacaagaaaataaagaaaagagaatgacaaatgtgaagcatttgggagtagatatcttaggaacaataatatacacaggatcagctaaaatatttactttgaatgaaatagagaaagcaacaaataactttaattcttcaagaatattaggaaaaggaggcttcggacttgtttataaaggcaacctagatgatggctag

SEQ ID NO: 85314 - DNA, 642 bp, Glycine max
  Peptide Sequence Number=SeqID_176999
atggttgttaagcgtctcaaagtgatcaaccaagactcgtttgtctctggatggaaaagggactttgatagtctcaaaacaacgaaagcaagtgacatcggacttgccgtctctggacaacaagatgaccacactggtctctgcgtgtcatcaaacttggggtctctgaatgacgagctggaagatgctgacatttgcgggaagggtgcagatgaccacattggtctctgcgtgtcatcagacttggggtctccgaatgacaaggtgcagataatcggtgcagatgactacattggtctctgcatgtcatcagactcagggtctccgaatgacgagtcggaacattctgacatcttcgggaagggtgcagatgaccacattggtctctacgtgtcatcggacttggggtctccgaataatgagataaccgtaaggtgtctccacatgtcatcggacttgtcgtctccggatgataagggtgcggataaccgtgaggtgcggataaccataagaagtctctgcgtgtcattggacttgccatctccggatgacgaaggtgtggataataatgagtcttccacaaaggaaacagatgaccatattagtctctacgtgacaacaagctcgcttgtctctgattga

SEQ ID NO: 85315 - DNA, 375 bp, Glycine max
  Peptide Sequence Number=SeqID_177000
atggaaattaaaagagtagggaagaagaagacaaacacaagagatttatactggttcgacaacaacccgtgcctacatccagtccccaagcgacctgcggtccttgagatttcttttcaaccttgtaaaaatcctcttacaagcaaagatccacaagggatgtaccctcccttgttctctttgaacaacctagtagatgtaccctccactagaactgatccacaagagatggagaagggagacacaaaagaatacaggcggttagtccttcgttcttttggaaaagggagaagagagacacaaaaagaatttaggcggttagtccttggcgaattctttttggcaaagggagaagggaatgaaaaagatgaatag

SEQ ID NO: 85316 - DNA, 355 bp, Glycine max
  Peptide Sequence Number=SeqID_177001
gctgtcgtcccttgtgacggacgtgtggggtgctaataccttccccgcgcgtaaatacaactcccgaacctttcacttaaaagttcgtagatcgcgtcttttccggtttttccgacgttttcctcaaataaacgttggtggcgactccgcgcgtattcctttcgtggaacacgcatcccgcgagtcacgcgtcgcccttccgccgaaggggaattatagacataccatcttgttcaaagaaagtgacaagctagaagctgcaaaacagaaagaagccaactcatccatccctcaagtgcatgagataataagaaaatccatcaatgcatatatagtgtccaaggttgtacattga

SEQ ID NO: 85317 - DNA, 471 bp, Glycine max
  Peptide Sequence Number=SeqID_177002
atggaacaaatacctaaaatctctttgtcagaccctaatttcatctggggactatcattcactaatgttttgattctcgatagccgaattgtggtgttcgacactagtttccgcacaaagcaaaggatcactcaatgttttgatcaagaatacaaaaggataccaaggaatgagggaaaagggtctcctagctcgcccaggctagcatctagctcgcctgggccatggaattacctcctggctaagcaaccagctcacctgggcgagcttattacttcaaggctaaggcatgatggggggtgttttaaggggttagaaggttcaacattgaagggaattgagagaaaagaagaagaaagagaaaaagaagaagaaagaagaggaaacgaagccgagacgctaccgaatcgcgaccgcgatcagtccctatgtcgtttatggttctgtgttcttcgtgcggcagtcgattag

SEQ ID NO: 85318 - DNA, 240 bp, Glycine max
  Peptide Sequence Number=SeqID_177003
gtcttggagaggatcaacaacaatgcttataggatagaccgcctagaggaatatggagtgagcaacacctttaacattattgatttggttccttttgcaggtgtaactaatttagctgatgaggggtttgcagatttgaggacaaatcctattcaagagggaagggatgatgcaatcctcccaaggaggggacccatcaccagagccatggctaggagactccaagaagattgggcctaa

SEQ ID NO: 85319 - DNA, 210 bp, Glycine max
  Peptide Sequence Number=SeqID_177004
atggagaaatttgaaaagaaaaggacatggcatatcttagtgaaaagaaattgctttaagaaaaattacaatcaacatgggatgaaaatgatatgggtctcagcaaaaagagataacctcgtttataggctaaaagttacgaaagtgataaagttctttgaggaagaagtggtacatagatgcttgctgatgctcataaagagtcattaa

SEQ ID NO: 85320 - DNA, 153 bp, Glycine max
  Peptide Sequence Number=SeqID_177005
atgagaaatggccaccctccattgtctcagggcactggcacacccacgcaaaaaaatcccgaacatgggtacttgaacatgaaaaaagggctttttttttacgtgttagttgacggaaccggggaacgagactatttttttcaggttctttga

SEQ ID NO: 85321 - DNA, 639 bp, Glycine max
  Peptide Sequence Number=SeqID_177006
atggaaagagtagaaaaagtagttaaaatctcagtgcaagagttagaccgtgtgaagcaaagtaggaatgagatagttggaataccaagcaaacatttggagggaaaggcaaaggcattggctgatcaaggtgaatgggcttcatatgttgatgtcttagcattattgatatttggagtcgcccactttccaaatgtggaagggctaatggaccaagcattaattgatgctttccttgcctatcaccatagcaaggaaagcccgattgttgctatcttggccgatctctatgacacattcgatcgaagatgcgaaaagaacgacacaaaaattttttgttgtacgctagctatctatgtgtggcttgtctcacaccttttccgccaagaaagtaggcccacctgtccattgcaaggtcaccgcttatgcaccgagaagggaaaggtaaactgggagcaactcttggctagtgtggtaggggcatcccatccaaattcaagatgggggcgtactcgagagatgagaaattgctcatgcacttcttccaagatagcttggctagagccgcagtcattcggtgcaccaacttggaagcatctcgcgtccgctcgtggaaagactagattactgccttcataa

SEQ ID NO: 85322 - DNA, 954 bp, Glycine max
  Peptide Sequence Number=SeqID_177007
taccaaccattgaagaatttgaggaaattccaggatgtcctctcgggggaaggaaaccatatctttcctccgggtgtctcccctctttgagcagaattgcagctgtggtcaaggattcagccagaggtttggaccgcataaaacagactcggaacggcatagcgggcctgccacagaagtacctagaagacaaggcgaggggtatggccaatcaaggagactgggtcccgtttatgtatgtgttagctttgctaatttttggggtcgtcctctttccaaacgtggatggtttgatagacctagcggcaatcgacgctttccttgcctaccaccatagcaaggaaagtccggtggtagctatcttggcagatctatttgacacatttgaccgaagacaactagggtaccccatgaggggagcaccgacggaagaaagcatgtctcctttccttgtgagggatttcggcgcacaaaattccaagactatacaaagaatccataaggcatgggaaaccccgttaaggaaagatcaagaacttagaggcattcgtaatggcatcattggtgggtaccacgaatggctgaaagttcatatacgaagtttagattggctcgccaagttaaaagtcgtcagcgaagagagttttgaagcaccggaagaggacgaagaagtccaagctctcaaaagcgagttaggaaaggcgaaatttgccaaggagaagttcaagttggccgcaacacacattcggaaggagtgtgccgggttacgggaggagaatgcaattaccgcaagagcccttgaacaagagaccaaaagggctcgcaaggaagagtatggccggaacaaatttcgcggagctctgtggggtagcaatagtgaactcaagttgcgaagggaagaaagagaccagtcgcgagcacatagcatggttctgaaagaggagttgattgctt

SEQ ID NO: 85323 - DNA, 256 bp, Glycine max
  Peptide Sequence Number=SeqID_177008
gttgtcgtcccttgtgacgggtacgtggggtgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttgggcactga

SEQ ID NO: 85324 - DNA, 462 bp, Glycine max
  Peptide Sequence Number=SeqID_177009
atgtgcacgaaatggccccgaggaagcttgcttcaaagaggtccaggaaggataaagcgggccgaaggaaccagttccgctcccgagtatgacagccaccgctttaggagcgctgaacaccagcagcgcttcgaggccatcaagggatggtcgtttctccgagagcaacgcgtccagctcagggacgatgagtataccgatttccaggaggagatagttcgccggcggtgggcatcattggttacccccatggccaagttcgacccagacatagtcctcgaattttatgccaatgcttggcctacggaggagggcgtgcgagatatgagatcctgggtgagagggtcagtggatcccgttcgatgcggatgctatcagccagttcctaggatatcctttagtgctggaagagggccaggagtgcgagtatggccagaggaggaaccggtccgatggttttga

SEQ ID NO: 85325 - DNA, 231 bp, Glycine max
  Peptide Sequence Number=SeqID_177010
atggtcttgaagtgcaaaaggagcagtcgcgctcagcggaccatttgggctcagcgcacatccgacgctaagcacaacttcagtgcgcttagcgtgacaagggaatctagaagagcacaagaatcaaggccacgtgctaagcgcgagatcagcttgctaagcgagacgtttgtctcttgccaggctcaacacacgactagcgccaagcccaaatccacttactcacactaa

SEQ ID NO: 85326 - DNA, 294 bp, Glycine max
  Peptide Sequence Number=SeqID_177011
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacggcctgacactcagttccgg

SEQ ID NO: 85327 - DNA, 658 bp, Glycine max
  Peptide Sequence Number=SeqID_177012
atggccccgaggaaactggcctcaaaaagatccaggaaggataaagcggccgaaggaaccagttccgctcccgagtatgacagtcatcgcttaggagcgctgaacaccagcagcgcttcgaggccatcaagggatgatttccaggaagagatagttcgtcgacggtgggcatcactggtcacccccatggccaagttcgatccagacatagtcctccaactttatgccaatgcttggcctacagaggagggcgtgcgagatatgaggtcctgggtgtggggtcagtggatcccgtttgatgcagatgctataggccagttcctgggataccctttagtgttggaagagggccaggagtgcgagtatggccagaggaggaaccggtccgatggtttcgaggaggaggccatcgttcagttgctatgtataccggggcaggattttgcccggactgctgccgggagactggtgcggatcatgcacaccaatatgaccaccctgactcagatctggatgactttgctgctcagcaacattcagcccaacgaccataattccgacctccccctgccgaagtgtcagctggtgtacgccatcctgacgcggatgagcattcacgtggctcagttaatcgctgatgccatctatatatttgcag

SEQ ID NO: 85328 - DNA, 402 bp, Glycine max
  Peptide Sequence Number=SeqID_177013
atggtctttgccagtagtgccatcctccccgctggcttggctgtatgggcggagcgggttacacgttccactgtgccgagatgtgaggtgcaggtggtgatgatcgccccggggtatgcgctagcgcccttgacgggcactccaggacccgccaacgctcattcaaaccccggcctcatccgaccggaggtgtggataacgaggccaccttcacaaccttctcccttctgtcctttaggcatagctagcggcataggagccgactcgacgtcagcggcttcgtgccgcactggagtgatccaatatgtggttccgcacgttccaccacttctccgttcatttccaatactgatcgtgaaacaccatgagcagcaggatgttgaggtccgaaattcgaattga

SEQ ID NO: 85329 - DNA, 465 bp, Glycine max
  Peptide Sequence Number=SeqID_177014
atgaaggttacagcacttaagcagaccagccacgacatgaatgcacatataggtaaagctcgggctgcagtggaagagttgaagagatttttggtggctaattcattggaggaagtgaatagaaagctggataagttctacatggttcttatcttgaggagtctacattctgactttgatcatgtgcgtgatcaagttcttgttggagaccaagttccatcaatggactctctcatcactaggctgcttcgtgtgcctcatgcgctgaaagaagaaaatccagctgattctgtggaaacgtcagccatggttgcacctcgtgggagagggggaggtcgtaacagcagaggaggtcgcagtggaagaggtggacgtcctcaatgcacacttattgcaagaggatgggccacactcaagagaattgctactcccttcatggcttccctgacaaagttgtcaaggtag

SEQ ID NO: 85330 - DNA, 84 bp, Glycine max
  Peptide Sequence Number=SeqID_177015
atggcagaggtggcaacgagcaaagccagtggtagcaaggtcaaagcaaaagttgttgaggaacggagtcgctcgactataaag

SEQ ID NO: 85331 - DNA, 276 bp, Glycine max
  Peptide Sequence Number=SeqID_177016
atggtgaaagttggaacctcttacgtgccgatcaacgtctcattttcgcccaaaagttggcccagggcttcccggtatcaacagggacaccaggatttatttattctgcgaagtgatcttccgtcacaggtgctccagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 85332 - DNA, 431 bp, Glycine max
  Peptide Sequence Number=SeqID_177017
gcatctgagcttgtactgtataccgagttaccaaggttggatattgagttagctctagagttgatgttgcccgagttatctacaggagttgcagcaaggttgcattcacttgctgtcagcgtgagtaaatgggggcatttgggagtggaagcatgggaggagttgaggcaagtacgcataggtacgcacgcattcatgtactggagcggcatatcagtagtagtggatgaacgactcaggtcagtcgattcactggtgggagcagcaacaatagtgaaggtggagcaatcggctcacactaggaaagaaaggcatttgacgtattcactgaagagagcccaagttgttgaagttcccgctcgtacccgcctctctccaccagtactactaatcggtaagctagctcctcccttaaacgtgccaactcccca

SEQ ID NO: 85333 - DNA, 126 bp, Glycine max
  Peptide Sequence Number=SeqID_177018
atgactgcaaagaaaaataggagtggaaaagctgtggataaaggtgtggaagtaccgtatcctgtggaaactagaaataaccatgcccttcgaagaagcgttgtagcagatgccactctactctaa

SEQ ID NO: 85334 - DNA, 750 bp, Glycine max
  Peptide Sequence Number=SeqID_177019
atgaaaagagaaaaacatgcctcctatagtagtcataactcttgcaagagcctaagtgaagaacttcgtgactattacaaaggaaggcataggtcacatcttagacctcactcccatagaagagaaaaggaaagaaagcctcaagaggctaacattaacctctcatacttccatgggaaggacaataaagaccaaggtcaaggcatcttaggggtgacaccttctaagcccaaagatgataaggggaagacaatagaaaagcaagcccctaaggctagtatgcaagagaaaactagctctatagagtgctttaaatgtcttggaagaggacacattacttctcgatgccccaccacaaaaaccatgattatgaggggccaagacatttatagtagccaagatgagcctactacttcaccttcttctagtgaaagtgaagaagcaaaaggggaagaatctagtgaagaaatctacccccaagaagaaggacaaccattagtggttaaagagaagtgtaaggaggcacttgctagcattgccacacctcttgggcttgagtttattcgtcaagtaaagaagttgttggatgagggtttggttcgcaagagcttaaatccttgtgctttgttggtgcccaaaataggtattattaggcaccaagtccctaaaataactggtatgatgaatgttttgagtggtgcaaccctcttttgtaaaatcactcgtgcacctaacatcttcatggaataa

SEQ ID NO: 85335 - DNA, 506 bp, Glycine max
  Peptide Sequence Number=SeqID_177020
atgactaggggcaatccaggtgatttccaaccctttgatcctgaaatagatagaacctttcatagattagttaggcatagtgtgcatcctggtcattctgtgcattttgagcatcctgatcattttgagtattatgttgctggtgattctgaatattctgattttgagtattcgactactaattttcatactgagaacatggctcaacctccacctcgtgagagggctcttagggagatggctgcacctgatttcacttatgaaagcttgtgcattcaatatcctgatgagggttttccatatgttctcaagactggactaatacatttgctgcccaagtttcatggtcttgcaagtgaagatcctcataagcatcttaaggagtttcatattgtttgttccaccatgaagccccctgatgtccaggaagatcatatcattctaaaggcttttcctcattctctgaagggagtgacaaaagattggctatactaccttgctcccag

SEQ ID NO: 85336 - DNA, 426 bp, Glycine max
  Peptide Sequence Number=SeqID_177021
atgacagttgcccctctttacttgtcttttattggagatagaagggaagtatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 85337 - DNA, 246 bp, Glycine max
  Peptide Sequence Number=SeqID_177022
atgtgtggcaggggaaaattgtctttaggactggctcggttcaagtcccggacaatgttggcctcccactccgggtaccgcgccacagctaagaaacctgcatcaaactgcttccttacttcttctttaatttttaaagacatctcgggtctcattcttcataacttttgcttaaccggggaagacccaggattcaaaggcaacttatgctgcacaatgtcggaatccagaccgggcatgtcttga

SEQ ID NO: 85338 - DNA, 1227 bp, Glycine max
  Peptide Sequence Number=SeqID_177023
atggggactgtgagcggcaatgtgaccggtgcggccggtgacgcgctccaggctgtggcggtcaactatttgcaagggctcggggcgtctcaggtaaagacgatcgtctcggccctgggtgaagggccgcaggcggaagcggcgcgcgccgccatgcacgcgatcgtcgggtgcgcgggggccgccggcaagggcagcgattgcagcgcaggagcgctcggtgcgggttccggggctgtgcttaatgcgttgctgggtggcgatgcatcaaagatggccgcggaagagaaggaggtgcgtcgcaacctggtcggctcgctggtagcggggatagcaatagcgtccggtgtgtctggcgccgaggcggtttttgcagcgatcaatgagacggaaaacaacgccttgagcgtgcgggaacatcaagcgcgaattcaagaaaaggcgcaatgcaatttcgacacgcaatgcgaacagcgcgtcgcgaaaaagtataaagagatcgacaatcggaatcgaaaggcgttgactcagtgcgcaagcgtggacgtttgtaaggcagaaatagaagcagcagcggcgcagctcggagagtacagcagccgaattgcaaatttggaagaaaagctgcgtagtgacggcgggctgagtgcttccgagtgggaggagttgtcgattctaaagatatccgcgtcggtaatgcttgatgtggatcgcaatgctgcgatcaagaattaccttttgctgggaggcgatcaggccaagcagcttgcgtggaatgagatagcaaagacaggtgtggcaggggctgcggcggcagtgagcgctgttgggtctaataaggcgtcggtggcgggggtgaaaggaggtggatcaccaacagcttccatgcttccgaagaattttggcgaatcagttctcggacataacacccagattggagtgcgaaatagtaaagcggggacaatctctggtgctcacaaccgcgacgcctttctggagtcggttgaaataactggcgcgaaagttaccaacaaaatcacggatgtccattatccaggccttgtcgaatatagctaccagttgcctagaaccaacaccaatggcgaattgattggcggatacaagccgatatccacaaaacgacatacgatccaaagatcctaccagatagcaaggtggcggatatgtctaaccgtgccgcaattcaagccggttctttgtttataa

SEQ ID NO: 85339 - DNA, 585 bp, Glycine max
  Peptide Sequence Number=SeqID_177024
atggcggttaagctgcaaaaatccttcgctatgggattttacgtaactcgggatcatgccgacgccgtgcgaatcgtgtccggcaaggttggcagcgatcaggcacggatagtctcctcgatgtatgttgttgttttgttgcgtttgccgttccatgctgcgccgcaaggcgcagaagatcaaggcgataaatatttctcactgaatagggagattattggcatgaaaatcggcggtttagtggtttcactgacgacagtcttctcgtactccgcgctggcggaggtgccgcagggctacccggcagattatcaaaaagtcgttgatgccggggtgaaagagggcaaagtcgtggtttattccacaacggacaccaaagcggcagggccgttaattaaaggctttgaagcgcaatatcctgggattaaagttgaatataatgatatgaacagcaccgagctgtacaaccgttatattagtgaacaagctgccggcggcgggagcggcgacgtggtgtggagttcttctatggacacggcgctgaaattagccaccgattatgcgcaagagtatgcttcaccagaa

SEQ ID NO: 85340 - DNA, 426 bp, Glycine max
  Peptide Sequence Number=SeqID_177025
atgcattgctgcatcggcttctttaaagagattggcggaacggacggggctcgaacccgcgaccccctgcgtgacaggcaggggaatctctcgtttgccggttttttcagcttaacgacgcttttccacgcaaaatcagcggcttcaggcgcgccacaggcagctgccgcccttcttttgcaccagatcgagccggctctcatgcgccattatctcttcatcgctggcgctaaccacgcgcaggccggcgcccggacgaacgatgcgctgtatatgctcacctgccacctcattgctctgctcgccttccatcgaaaacgccagcgaggtctggccgccggtcatagtgaggaacacttcggccagaatctcggcatcaagcaaagcgccgtgcagcgtacgtttgctgttgtcgatctcgaaacg

SEQ ID NO: 85341 - DNA, 276 bp, Glycine max
  Peptide Sequence Number=SeqID_177026
atggcactgtttgagatggtagttgagtcctatgggtctgccatggtcgcacgcaaatgccaactagttgcctttgcactatgcacaactgcgaaaccaggtgcatttcaccggaatagaccttgggatctcggtattgcttttagaagccatgatttgaaaatccaacaccttgaggacaagaatccattagaaggtgttgagctatcaggaggatactggttcacagggagtatgttgttggcatgttgcttcccattgtgcaacacttcatag

SEQ ID NO: 85342 - DNA, 504 bp, Glycine max
  Peptide Sequence Number=SeqID_177027
atggaaatcttatccctaccgcctctagccagtcataccacaaaggagtacgtggccttgaaggacaagataaaggagttgatgcaggaaggtgcctttgccaactatacctacacccctaacaacaatagaggcagttaccgaggtcgtggcaagggccaaggaagtcatcatggaggtcgaggacaacaatcccacaaccacaggctagaacaaatcgatgccaagctagatcaagtcggcacctcgacagtcagggaaagggggggagacgcagagtcatcaacaccattgcagcgtgagccacatttctgcagcgagctcgaggagatcaatcccaccaataacattcaccgatgtcgactttgcaggggtcaatcccgagcaagacaacctaatgatgattatgatgctgcatcgagttgggccaatctcaaaccaaggagagatgaggaagacaagaagcttgattcagatagtgtgggtcatcctaaagggaattaa

SEQ ID NO: 85343 - DNA, 1632 bp, Glycine max
  Peptide Sequence Number=SeqID_177028
atggaggacggcgcgtggggcacgagcgtgatcgagctggttgaagatgcaggacgacgcgtgggtcacgtggtgcttgctgttggcagcaagagcatggtggcagagttggtatggaaaacagaggcgacgatggtgactgcacggaggaagaagatgggtagtattaataacgcgaaagtcatagcaaaactgctggacacccctagcagttcactgggtattttcgtttgggacgcaacaccattttctcctccaagtggacctatacatggacaaagcagtggttgcccattaagacttaaagagagcctttctcttcttgagaatgtccatgccaccgagaaagaagacgatcggcgacagagtggcccagtcctcgttctcggcgctgtagccagcaaagagttttcttctgggataaagcttgcgcttcaccaacgtggttgggtcgaacactggtttgagctcgctttggaactggtaatcgacccagtcaacgaagaaggacacagcgctgtacaacaagggataatattcttcgttcagagcaaacgagggagaaatagaagcctcgctcactacgcccttttctttgaggttccttatgagctgtcccacgcactcgataaagtcaccgggggaggcatcgatgtgctcgtaaagcacgtcgatgccgtccacgtggaggttgtagtcttcgttcttgatgaggtgcgtgagggactcggtggcgttgtcgatccaggggtgttgggtgccgcggttgccgatgctgatgaagactttgatgtcaacgttggggttcttgtccttgaagcgcgcgatggattcgggggtgaccttgctcaggtcccaggtcggtcggaaaacgccgttggtgggggcaccctcgtcgtcgtagtcgctggcgaaggtcagagcgatctggtactccttcaggaatttcgccgacacaaacacttgcgagaacgagtcgtcgaacgtgtattgccggaaaatcgacaacattgtgccaagagaccaatatatggaattgcaatttgggtgttgtgccagaaattgcccagcccaaggtgcccttatatacttcacttgtgtccaggccatattagaattaacatggagtatctatcacccacgtcaccgatccaaatgaagtctcttctcccatctccatcgtacatagcaaccaaatcaacggtccagaacgcgcttgaaaaaccggcatccgcatccgaacctgaatcctatcacaacactaacacagattttgattcgattcgattcgattcagtcgaggttttaagcagcagcaagatgtctgggcgtggaaagggaggaaagggattgggaaaaggaggagcaaaacgacatcgtaaggtgctccgcgacaacattcagggaattacgaagccagcgattcgtcgtttggctcgcaggggtggcgtgaagcgtatcagcggtttgatctacgaggagactcgcggtgttctcaagatcttcttggagaatgtcatccgtgacgccgttacttacacggagcacgctaggaggaagaccgttacggctatggacgttgtttatgcgcttaagaggcagggaaggaccctctacggatttggtggttag

SEQ ID NO: 85344 - DNA, 366 bp, Glycine max
  Peptide Sequence Number=SeqID_177029
atggcaaagctcagagattcggtgagaagcctcgccggagataatggatacgaatcaggaagaagaaaggtttcagaagcaaggaagaagaaaggtttcagaagcaaggaagaagaagggttttggaagaagctgagggggtttttgtttggagttctggcgctatttatggagagcaagagtctggtcaggacctgctcgaatcaaaaagagaggagagtctttaagaaggaattcccaggttcaaagaagtatttacgaagtacaaagctaagacaagaaagaggacttcgagccattgggcaattcgaactggtgtatggacgagtcgaagtcgaggcagcaagagttctggacttagcgtaa

SEQ ID NO: 85345 - DNA, 201 bp, Glycine max
  Peptide Sequence Number=SeqID_177030
atgtggctaaagatcggagcctttgcattgattgtatgtggaatatatagcgggattcttacccaacgtgtttttctttgtcatggtgattgtggcagaatgcaagtggaggttagcaagcatacggaggggtccaaggagaagatgctacgtcccaatggattgcccgaatccttgattcgatatgatggtattggataa

SEQ ID NO: 85346 - DNA, 1635 bp, Glycine max
  Peptide Sequence Number=SeqID_177031
atgtactcttcttcccatcaacgcatgctccacacaggctccaaaagcctcatcacttggttgatcctaatcaccattgtactctacaccctttattcttccaacattatcctcttcaacaatgaccaacaagattgccccactatcaccaccaatttaaacgaggctacccaagaaaaccttcgggtaagtacttacaacaatacatcctcaaaaactatagctaccgatgatgaaagtgttgaaaagaaaaaaccattagtagagaaacgaccaagagaggataatgatgacgacgaagaagaaggagaagaaaaaaacaaagaagaagaagaaaacaaatcccccgtggtagttagattaacacccaagcaaatgtctgagagacaagacactgagcttaaacatgttgtctttgggatagctggttcctccaacctatggcacattagaaaagagtacattaagatatggtggaggcctaaggaaactagaggggtagtgtggttggataaaaaagtgaggagtcaaagcaatgaagggttacccgatatttatatctcgggggacacttcaaaatttaggtatacgaatcgtcaagggcaaagatcagcgttaaggatatcaagggttgtcactgagacattcaagcttgggatgaaagatgtaagatggttcgtgatgggggatgatgacacgatgtttatggttgataatgtggttagaattctttccaaatatgaccatagacacttctattatattggaagctcatctgaaagccatgttcaaaacattcatttctcatatgccatggcatatggtggaggaggatttgccataagctaccctttggcccaggaactagcaaagatgcaagatcgttgcattcagcgctaccctgctttgtatggcagtgatgatagaattcaagcttgcatggctgagctaggggtgccactcacaagagaacctggctttcaccagtatgatgtatatggagatctactaggccttctaggggcacacccagtgtctccacttgtgtcactgcaccaccttgatgtggtgcaaccaatattcccaaggatgacaagagtaagagccctgcggcacctaatggagtctgtgaatcaggactcaggcagcataatgcaacaatcaatatgctatgacaaacaaaatttttggtcaatatctgtttcgtggggctacgtggttcaaatcttgaggggagtgctgtcccctagagaattggagatgccatcaagaacctttctcaattggtacaaaagagctgattacactgcatatgcattcaacacaaggcctgttgctaaacacccttgtcagaagcccttcgtttactatatgaccaacactcattatgactccaccacaaaacaagttgttggtgtttactctcgtgacaaatccaaatcccctttctgtcggtggagaatgaattcaccagagaaaatcacctctgttgtagttacaaaaaaaccagatccattgcgctggaaaaagtcaccgaggagggattgttgtagaatattgtcatcacgtaagagcacagatactctatacatatgggtgggcaattgtcaagagggtgaagttactgaattatag

SEQ ID NO: 85347 - DNA, 432 bp, Glycine max
  Peptide Sequence Number=SeqID_177032
atgtactctcagtcgctgagggctcgcaagttagtacgctccggccggtcaagaaagcaagaccttaatgcggagaatacacggatgattcgtaagtctgattctaaggcggacatgttagtccaagtctatatgtctttcttctctatcagcaagctggtagagctggcaaaacctgtcagtaaggatacattgaagtctatagtttcgccagttgagtcgattgatgaagtttgtaatcttgttggccttattaaagaccccatgaagcatctacttcttcgtgcactgaaagagacagaaggaagagtgcagttgaggaaagcaagagacattgggtcattcggtcactgcctcgtatgctgttcccccctcacgcttttgggggcttccggggggacagctatgagtccgttccctcactcccactag

SEQ ID NO: 85348 - DNA, 705 bp, Glycine max
  Peptide Sequence Number=SeqID_177033
atggaactcattgagaacatggcagcgagcgatcgggctatccttcgtgaccgttctcatgtcccaacaaagaaaagcctcctagagcttagtacacaagacgcaactctggcacaacataagttgatatccagacaattagaagctattacgaagacgcttaacaaattgccccaacaactacaagtagtgaatatttctcattcccctgttttgcaagtagagggatgtcccacatgtgtaggaacacatgagcctggacaatgcgcaatccaacatgagccctctcaagaaataaattacatgggcaatcctaatcgccaaggtttccaaggctactaccaaggaaacccgtctggatacaataacggattgccaagatttaaccagggaagaaactttaaccgaggctccggctggagaaatcaaggaaatcagtacaaggagcttaggcctcaaccaccataccagcaccctagtcacggtccgagtcagcaagaaaagccgtctctcagtatagaggaaatgatcttaagtttcactcaggaaacaagggcattcatccaggagacaagggcaaacactcagaagacgaaggcattcagtcaggagacaagagcgttcatccaggagacgagatcacatcaaaagagcacatatgcagctatcagaaacctggagacacaattgggccagctagcctag

SEQ ID NO: 85349 - DNA, 144 bp, Glycine max
  Peptide Sequence Number=SeqID_177034
atggaaaaggttgagggtctgcgtattttgaaaatgagggttcgggagttgtttacgcacggggaaggagaaagagtcgttaaggcattggaccttgaaacaatcttctcaagtttgaaaggcggagaatcgttaaggcattga

SEQ ID NO: 85350 - DNA, 489 bp, Glycine max
  Peptide Sequence Number=SeqID_177035
atggggagagtttatgagggatccactgttgttcataacattcctttgttgcctggccaagtaaaggtgagtgtggaggagcttacagatgcagatgctccagttcctgtacccactgatgaggtagctgtgtctctggcaaaaccacctccgaagccggatccggaggtcaatgatccgctttatctgatgacattgaccatcccagagcttttcttgaggccttatcagatggtggtcatccttcccaaggaacacctagttgtctggttttgttcattgcatagcaggccagacaactaccttaaggggattattaatagtgctatcaagggtcttgatgatgctccacagcctaaatcaaaggcttctgctaggcggattgtcgtcaagtgtaatagacaaaaaggaagtactgagttcagctactatgtgatgcactggatgtccaccattattttaggaacttttaggaataattgggaagcg

SEQ ID NO: 85351 - DNA, 231 bp, Glycine max
  Peptide Sequence Number=SeqID_177036
atgactgacaaaagtcctgtgatcatgcgggaaatcccagggccctgttggacttatccaggtccaaagggtggcctgggggaggtcggaattatgatcgctgggctggatgttgctgagcagcaacgtcatccatatctaggtcagggtggtcatgttggtgggcatgatccgcacccgtctcccagcagcagtccgggtgtgacaccctctaccccgacatataaataa

SEQ ID NO: 85352 - DNA, 264 bp, Glycine max
  Peptide Sequence Number=SeqID_177037
atgtcgcgaaacttcacggattgcttaacaatgggtgtcaagttcctcgaagcgatcaagcgaaggttgcatgccatcaaacaatcccagacgaaattagggtatggcactgggtttcaagggtgcttatgctttattattgtatttgggtatatgtgtgtgtgtgtgtgtatcatgagggtctattatggaaatctatccactattgctttaagtctgaaggaccctgttagtgtgaaggagaggagggaacgttttctgtag

SEQ ID NO: 85353 - DNA, 471 bp, Glycine max
  Peptide Sequence Number=SeqID_177038
atgatgagcatgaagaagataatggaagccaatgcggttgcagttgccgctactagggctgttgctaagtacgaacgaccccatgatgtgcaaattcaaaataagcatgccttcctgccatatggcttgcctcccaactatacaccacccaatatggcgtacactcccaatgagaatgtcaataactccactcccatactcactgagagccaacaaccccaaactgatcgtgcacatgtctctcaaaccgtgggggagacatatgaaattccccaccacaatctagccgacttcgagccctgcctcggatatgccactaaagggcaagtagttggtgctatactcctgcaaaacactttggagggccctcaattttgcccccaacaacaacccttgcattccacagcaagtaaaatccctcctattatggaaggaatgggaaaagttggatcatctagaggaaaggcttag

SEQ ID NO: 85354 - DNA, 306 bp, Glycine max
  Peptide Sequence Number=SeqID_177039
atggcatcttcgtcgtcatgctcatcaaatatacaaactaggcctggtccaattgatggtgatgttttgtggatgcaacctaagcatgtttcagaacatgtttggaatggggaaccagacaaaaaattacacatcagacgagcagtccccacgtatcaaggtgaagaacaaataccagaggaaattgttcctctgcttcggctatctgggttttactggataatgaagatgggatacctaaaaataaatgcgacattaattagtgcgttggaagatggaggtccaaaacacacacgtttcacttga

SEQ ID NO: 85355 - DNA, 666 bp, Glycine max
  Peptide Sequence Number=SeqID_177040
atgaaagttacagccctcaagcaaactagtcatgacatgatcgctcatgtgggtaaggctcgagctgccatagaagagctaagaaagttctttgtagctgattcattggaagaagtgaacaggaaacttgacaagttctatatggtccttattctgaggagcttacattcagactttgatcatgttcatgatcaagtacttgctggggatcaagttccatctatggattccctcatcactagatttctccgcgtgcctcatttattgaaggatgagaatcctaccgatggtgtggagacgtcagccatggttgcgtctcgaggaaaaggaggcagccgcaacaacagaggaggttggagtgaaaggggtggacgtcctcattgcacttattgcaagaggatgggtcacactcaagagaattgttattcgttgcatgggtttcctgacaaggtcgcacaagtctctaaatcaaagaaggtagagtctagattttctgatgaggagtatcaagagtatttgaagcttaaatccgagaaacccagtaaccaagctcaatcctcatctgtaccatgtttttcaacagcttgtatctctgaatccattgaaggttctagtccttggaaactcgactcaggtgcctctgatcatatttctgtgtccttataa

SEQ ID NO: 85356 - DNA, 114 bp, Glycine max
  Peptide Sequence Number=SeqID_177041
gtacttagggacggacgcaaggagaggctagggtcacgaccaataggtcgtcatccattgcctagcccaggacaaacggaaagcgccgctgcaaagcagcctagtatcctttaa

SEQ ID NO: 85357 - DNA, 213 bp, Glycine max
  Peptide Sequence Number=SeqID_177042
atggaaaaatccgacaagatgaatttcaaagggaagaaagaaaagaaaggatacatgacttgggaagataatgtcataaattattcaattggaagttggaagttggaagttggaagtagttattggaagttgaaagttaaaaatggaagttggaagttggaagtggaagttactggaagttggaagttggaaatgaaagttattggaagttga

SEQ ID NO: 85358 - DNA, 276 bp, Glycine max
  Peptide Sequence Number=SeqID_177043
atggagagacaatcaagtccattggcacgtagagacaaacatggtcatctgcctctttttgaagacttcaatgtctttcgaccgagactattacagtctcatttgccttccagagacaatcaagtccgttggcacgcagagacaaacatggtcatctgcctcttttcgaagacttcaatgtcttttgaccgtgactattatagtctcatttgccttccagagacaatcaagtccgttggcacacaaagacaaacatggtcatctgcctctttttga

SEQ ID NO: 85359 - DNA, 237 bp, Glycine max
  Peptide Sequence Number=SeqID_177044
atggttggtccctcaggtcctcgtgtcagcacaaaggagagttgtgttgatccctcagggaacgatcctgagacaggtgactcagacaagtgcgggttgtacatgagggatcaacatttcacaaaattcctttgttgcctggccaagcatctgactgaaacaagtatgcgagcggggaattctgatgtgtatggattcttcgagccacagtctattcagagatctgggcaatcgtag

SEQ ID NO: 85360 - DNA, 50 bp, Glycine max
  Peptide Sequence Number=SeqID_177045
atggatctcttcgggggcggagtaggtgtctgccatcgccttggccttgg

SEQ ID NO: 85361 - DNA, 372 bp, Glycine max
  Peptide Sequence Number=SeqID_177046
atgggtccagaactgaccggctcgcacgtgattggtctcgagcgtggctcatccaccattttatcacggcgaagtcggcccatgaacccagatttcaaccaaccacgaggcgggtgctcgcgggaggtcagcatacaccccgcgcagcaacattgcaggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgtatgtaaatgttgtgtcgtgacgactcccgcgggacaccgtctccgggcccccgggagtcgcacttaa

SEQ ID NO: 85362 - DNA, 528 bp, Glycine max
  Peptide Sequence Number=SeqID_177047
atgggaaacaccctcgtcgaccgcaaaaagataaaaaataaaaaatcacgtcttttccggtttttccgacgttttcctcaaataaacgttggtggcgactccgcgcgtattcctttcttggaacacgcaccagcgatcacgcgtcgccctcccgccgaagggaagatcatttacaatggcctaactaatgaaattaccctcacccatcttggcactaaatttttgttgcatcctcaaacaccttcacaggtggccaaagatcaactaactatgaaagataagagggatgaggaagaaaaactagaaaaacaaaagaaaaagaaggatagtaaggccttgtcttcaaaggccaaggggaaggaaaaggaggaaaaggattcctcagagaagattgttaacaaggaaaatcattttgcaaccaaaggtgatattaaaagagcgctccttcttaaacaatctttctaccttctcctatcaagggaaacatcccttagcacgccatacctcttgagcttgaggtattcctga

SEQ ID NO: 85363 - DNA, 373 bp, Glycine max
  Peptide Sequence Number=SeqID_177048
tggaagtgaagatgaagtaaggggtgaagagtctagtgaggaagtctacccccatgaagaaggtgacctcttaatggttagaaggctccttggagtgaagaacttagcgactattatagagggcaccatagttcacatactaaacatcactcccaaagaagggaaaaggataaaaggcctcaagagggtatgccctctattggctggacttcccttgttagggaacgaaggtcatggggatcctcgagtagagtattggaatgatcttaagagtgccttaggaagaggcacattccctcctactatgaaagggagcttgtggacacagctccaaaggcttaaacagaagagggagtatgagttgaagaaatag

SEQ ID NO: 85364 - DNA, 264 bp, Glycine max
  Peptide Sequence Number=SeqID_177049
atggaaagttcaaacgctgaatcttgctattggtggaaaaggtgttgtccaaccatgatgaaagccttgtttggcttccaagatttaactgatattgttgagaatggtgtagaagttccaagagacaatgctcctgatgcacaaaaggtaggattcaaagaattaaagaagcaggattgcaaaccattggtgattcttcatcagtgtgttgatgatacccactttgagaagattgcaggtgcaactactgcgaaagaagcctga

SEQ ID NO: 85365 - DNA, 138 bp, Glycine max
  Peptide Sequence Number=SeqID_177050
atggcacaagaatgcttcccaaatgaatatatgatgtggaattgcccctcaagtgtagatagatggcatgaaagttccttttcaaatgcaagaaatggccccaaggaaacttgcctcaaagagatccaggaaggataa

SEQ ID NO: 85366 - DNA, 393 bp, Glycine max
  Peptide Sequence Number=SeqID_177051
atgcttcgggcttccggaatacaatgggatctccgtaaagtggataattatgaatgttacgaagaatttgattgggaagttcaatggcaaaaagaaggagattccttagctcgttatttagttcgaattggtgaaatgatggaatccataaaaattattcaacaggctttggaaggaattcccggcggaccatatgaaaatttagaaattcgctgctttgatagagaaaaagagccagaatggaatgagtttgagtatcgatttattagtaaaaaaccgtctccgacttttgaattgccaaaacaagaactttataaagggaaatctccgcagggatacaacaacgtattccacctgaatacacaggtccttttggagttcttcaagctctag

SEQ ID NO: 85367 - DNA, 435 bp, Glycine max
  Peptide Sequence Number=SeqID_177052
atggcaagaatagccaaagtggtcaaggtctcggtgcaagaattggaccgtgtaaaacaaaatagagatggggtggttgggataccaaagaagcacttggaagagaaagcgaaggctttggcagatcaaggagagtcggcttcatttattgatgttttagcgctattggtgttcggggtcatcctctttccaaatgtggatgggctagttgatctagcgacgatcgacactttccttgcttatcaccacaacaaggaaagtctggtcgttgctgttttggccgatgcctatgacacatttgatcgaagatgcgagaagagcaatgcaaggattgtctgttgcacaccctctctttatgtacggctggtctctcacatttttcatcatgaaagtagacccgtcaatcccctacaaggtcaccgcatgtgtgcctag

SEQ ID NO: 85368 - DNA, 141 bp, Glycine max
  Peptide Sequence Number=SeqID_177053
atggctgcggagttcattgcttgttttgaggcatctaatcatgggatatggctgcgaaactttgtcactagtttcaataggagtacaaccaagtcaaaattcattgacatcaagtttctggttgtgaaggaaagagtttag

SEQ ID NO: 85369 - DNA, 173 bp, Glycine max
  Peptide Sequence Number=SeqID_177054
atgactactggtgatccaccccaacaaaagacaagtcaaggaaatgagaaaaagaaagaagatcagaatattactcaaggaagaactcaagaatattacaaaaggcgatccaccttaatgggagggaagtcgaaaaatcggcataaagaaaaaattcaagaatatagcacaag

SEQ ID NO: 85370 - DNA, 1017 bp, Glycine max
  Peptide Sequence Number=SeqID_177055
atgaccgaccctctcaatgagtcaatctcatgttttctcataagggtggacccttgggtactagaacctgtcgcctctagaggactacacgtcttcacctttcgagggctacatgccctcgccatcagagggctacacgccctcaccctcagaggacttcgtgtcctcgccttcagaggactacacttcctcgcctccagaggactacatgtcctcgccttcagagggctacacgcccacaccttcaaagggtcgtgtaccttcaccttcagaggactacacgtcctagccttgaaaaggtcatgtaccttcgccttttcaaagggctacacgccctcacctttagagaacttcacgccctcgccttcagaggactacatgtcctccactttagaggactacacgttctccacttcagagggctacacactcacacctttagtggactccacatccgcacctgaagagaatttaaggtcctctgcccttaaatgcttaaccgagacttgcattcccgttcctgggccaccccttgatcctggaggagggccacctatgcaagtacaaccagaggaggaggctatcatgcagctactatgcataccatggcaagatttcacccgtgccgctgcaaagaaacgagtgcggatcatgcgcaccaacatgaccactattacacagatatggatgacgttgctacttagcaacattctgcccagcgactgtaatgccgatctccccctgcggaaggatcacacccacaaagacacccagtggacccagagaaatccaacagggcccaggggtttcctgctctggttacgggcccctgttagtcctacagggtgcccgttccccctagcaaggtcacgccatcatgacttagggatcgtgcccacaagacacccagtggacccggagaagtctagcagggccctggggtctccaactttggttacgggcctctgtcagtcctacagggtgcccgttccccccagcaaggtcacgccatcatga

SEQ ID NO: 85371 - DNA, 351 bp, Glycine max
  Peptide Sequence Number=SeqID_177056
atgccatacgaatttcagtttttaaaaattaaagacagagacacttgggttgctacctttgcactcaaacctctgcatcctcttaaccttgagcaaattcttttactttctgctaagtgtgtacttcttctctgcatcatctttacttcatctcaagaacaatccaaaagcccattaggggcaatgtggctgaaaggggtgaagacccctatggttctatctagaaatcatgatgaacgcgctaagcgcacctatgcgcttagcctgttcatcgcaactgttaaaattttggatttcccgatgaacgtgctaagcggaccatgtcacgctaagcgcgttcgtccctgctga

SEQ ID NO: 85372 - DNA, 516 bp, Glycine max
  Peptide Sequence Number=SeqID_177057
atgcgccgaagcggcaggccgaccatgaacgacgtcgcggcggccgccggcgtgagcctgaagacggtctcccgcgtgatcaacgcggagccgaacgtggatgcggggatggcggcccgcgtgcaggaggccatcggtcgcctcggatatcaccgcaatgcccttgcggcgagcctccgctcgggcacgaacgacacgatcgcgttcgtcgccgccgacctgtcgaacgcgttctacatggggatcgccgccgccgtctccgcggtcgcgacccggcagcgcatgcacgtggtgatggcgtccagcgaagaggatcccgtcgcggagcggcggctcgcgctcgacctctgccagcggcgcgtggccgggctgatcctcgtcccgacggggaccgaccagtcctacctcgaggccgaagccgcgcacgggacctcggtggtattcctcgaccgtccagggcacggcctgtccgccgacaccgtgctgctggacaatcgtggcggcgcgtccgccgcg

SEQ ID NO: 85373 - DNA, 708 bp, Glycine max
  Peptide Sequence Number=SeqID_177058
atgcgatcatgggtgagggggcagtggattccctttgatgcagatgccctcagccaattcctgggtgacccactggtattagaggaaggccaggagtgcgagtttagtcagagaaggaacatggccgatgggtttgacgaggaggccattgcccagctgttatgtatatcgggtcaggattttgcccagacctctgtagggaggcgggtgtggatcatgcgcaccaacatgactatcctaacccagatatggatgatgttgctgctcagcaatgtcctgcccagtgatcataactccgagcttcctctgttgaagtgtcagctgggatgccaccctctagacccggataagtctaacagggccctggggcaagcgcagggtgatgcgccacaggccgcagacgcaccgccaccacctcatcaggctgatcccgctgggtcattaggcatggagcggtatctacagcacttggtgcagatacatgagtgtctctaccagctcagcctcagtcagcaaggccagggtttcgctccttttgcgtgccctactctagatcagtttagggttgaggtcgcatggcccggagattggccgaaggccctgacagaggaggcacctgcaggagctcccgacgatgcagaggaggcccgcattgatgaggtgatgacagacttgttcggcttcttgggaggaagcggagccacgtga

SEQ ID NO: 85374 - DNA, 111 bp, Glycine max
  Peptide Sequence Number=SeqID_177059
atggaagttggaggttggaagttggaagtggaaaagttggaaaatggaagttggaaggggaagtcactggaagttgaagttgcaagttggaagttggaatttgaaatttga

SEQ ID NO: 85375 - DNA, 732 bp, Glycine max
  Peptide Sequence Number=SeqID_177060
atgtggttcagactttgtaaacggatttttacaaagggagtggaaaatctcaaaagggggttaaaattttgttggtgggaaattaattcaccccttcttaacatttctgaggccacatgtccaacaagggaagttgtttctgattcattaacattggagagccttggtccagctattaatgtgtcttatgtaaagaaaaactgttggaacctagatgacctcttagttactttcagagggtcgcgcaaggccaaggggaagaggtctgaggctcccccatcttttgagattcccccttcctcagccctagcaccaattccatctgccccatctacatctacatctattcttccagttcctctatttgagtttgatgcgcaagtggcctggccaggagcccagccttctccttttggagggggtggggcctccgcagcccaggagcctactcctgaggagccagcagcagcagcagtagagggtgtacacatgtctcagaaggaggagacttctacagaccagatcccagagccatccctagcacccatacctgatgatgttgtaccatctgcactagcatctgagttagagcagcctatctctcaggattcaccagctgctcagccattagaagagaatgagcatgtgattggaagtatgactgaaaatgttagtcaatttgtcagattgattgtgaaggaatgcattgatcgtatcccggtgagagtgtga

SEQ ID NO: 85376 - DNA, 408 bp, Glycine max
  Peptide Sequence Number=SeqID_177061
atgaatgaaaaagtgaaggttattctatggatgaatgctctcctagaacctaagcttttgaatcctagaaaaaccattaattgttggcagcctaaccccattacaagcctagaaagtccttcggattcatttttgtgtgttcattactgtatgataggaggtgaaatgcaaagctgtgactctaatacttgtgctcttatctttgaaaaactgtatgcttgtgagagaacatttccattggatttgatgataaaatctatgcattttcagtgcaaaggagaatctagcagagcatcagcatcaaggccgcgcgctaagcatgagattagtgcgctaagcgcagcaagtgccttcagccaggctcagcgcacgactagcactaagctcgaatccacttacctgcgctaa

SEQ ID NO: 85377 - DNA, 717 bp, Glycine max
  Peptide Sequence Number=SeqID_177062
atggaggaagttgcacagttaggaagcattgatggcgtcatcgaccctccatcccccgtcagacaccacatgaagtggaagatggcccacactaagaaaacatgggagatgaccactgaggccgcaaaggaattcgctgcgaagatcggaccagctagaggagttgatcacaaaaaaagtgactcgacagctcatggcatcgttcagccagatgctgtctcagtttcagtcatagatgcaatctcagggacttgcactacctccggagcctttggttggtccctcaagtcctcgacaaaaccacctgaaaatctggatccggaggtcgatgatccgctttatcttatgacattgaccatcccagagcttttcttgaggccttaccaggttacatgggatgccaccatgttcggggtctttaatctagacttcctgctctacataaagcacgaagacctctttgaaatcgcacacggtggtcaatgcctcaacatatcagtgttacagttgtggattctgccagacaactaccttaaggggataattaacagtgctttaataggtcttgatgatgctctacagcctaaatcaaaggctcctgctaggtggattgtcatcaagtgtaatagacaaaaaggaagcactgagtgcagctattatgtcatgcactggatgtccaccatcattttaggaatttttaggaataactgggaagcg

SEQ ID NO: 85378 - DNA, 240 bp, Glycine max
  Peptide Sequence Number=SeqID_177063
atgaagaagactttggtgttctgcggtggtggtgcacccaaagggaacatgaccattcgggttatgcatgagtatgaccttactttgaaggagcttggtggtaccaatcctgggcagtttgtgggagaagaacatggaaggtttggactaaactcttttcttcagtcatctcagtttgttggagaggaaaaaggaagctttggacttttcttcattcatcttagtcattcggatcggtga

SEQ ID NO: 85379 - DNA, 510 bp, Glycine max
  Peptide Sequence Number=SeqID_177064
atgcataagaaaaaggaagcacatagcaggaaggctaggagaagaccaatgaaaaccatgtcccaaaagctctctatgggaagaacttcaaggaggtatatgggaagaaaaatgagcattacaacgttctatatgacatggccaaaatctggtccaacatcactcaaaaaagtttcttgcataaaactcaataaggactccaaacagtccatcatcagcaagggaaccttcattgccagacagttacacttcattgttgtcaacttgaaggcaatgaaagttgacattagaagaaatatgcccatccctcatattgatcaaaatgatattcaacaaaggaggcagaagaagctgaccagaacgactaatgaagataaagctatgaagacttttggactcgctaaaaaggatcaaagactccttagagagcagcagggcaaagtccagactaggaagcaagcccaacaagaaataatgtacgaggagcaacaaactaagaaaatacattag

SEQ ID NO: 85380 - DNA, 1191 bp, Glycine max
  Peptide Sequence Number=SeqID_177065
atgggctcagaaatctaccctgaggttcatgagaaccctagggccttcttcagcagctctagcctaatcctcttggagcctcttgctcatggctctagtgattggtcccttcctagggaggattgcatcaggaagggaccagtcactagagccatgagcaagaggctccaagaggattgggctagagctcctaaagaaggccctaggattcttataaacctcagggtagatttctgggcccatggtacaaggcgtctccaatcatctttcttccatcttcattctgctgccattgatcttcaaaaatcaaaggactccattgatgaagaagatccaaggcctacaagctctacatggagctacatcatgtgccaacgacactctgaggctcaggatattccaattccttcctccatttcctcatcctcattgttctcatcggaagaacaatgtacatggtacacaaacctcctttcctctcgttctatcattgatcctaagttcatagatatggatttcttttatgatgcgagtttcgaatgcattcaagcatttcaaaactcaaatctcattccctttatgtctttaaaactacatatggtcattgaccaatccctcttctatgatttgacccaattatctagcgaaggtgtaccatttgaagcggatatgaccggaaggcttcttgccagttcattggctcttgaaagccgcatccttcactatcttattgtttgtattttactcccaatatcttcaaaccttgcacaggtttctgaagaagatcttatagtcatgtgggcttttcataccggccgacaaattgattgggcacatctagtctggtatcgcatgcatgaggcattgcgattaaatgctcctttaccatatccacatttagtcactcttttccttcaacatttcaacatccctcttgattctgaaccttatgttccaatcaagagatctttcttgatcggtgctactgtggttgcgtcctttggataccgcaaagagcgtgatggctcttgggtaaaaaagggtactcaaccaaatgatgatgaaggacaattaccggttgaaggagacttttctctccttcaaagtattttggacaggatcacaaaggttgaagaagatgtcaccatcattcgcgactgccttgatttacctccaccaccatcagtttaa

SEQ ID NO: 85381 - DNA, 921 bp, Glycine max
  Peptide Sequence Number=SeqID_177066
atgtccgacatgatcaccctgatgaatagacttgcggtgcaagagggatacaacctcactgccctgcctgatgtgcgaattttgcgctccgatcgcccgcttgccagaacgccggtgctttacgatccggggatcgtgatcgtctgccagggcagcaaacgcggctatttcggtcaacagacctatttatatgatgagcagcactacctggcggtttcggtgccggtgccgtttgtgatggaaaccgacgcgtcagcagcacatccgctgctggcgatttatatgcatctggattttcagcttgtcgcggaactgatgctgcagattgaacagcatggcgccccgcatcctcccgtcgcgccgcaaagcatgatgtcgagccccatggacggcgcggtaaaaatggccgtacttcgcttacttgaagtcctggctaacccgcttgaggcggcaatcctcggcccggcgcgggtgcgtgagctttattttcgcgtgctgacaggcgcacagggcaacgcaatgcgtgccgcgctggccttgcagggccagtttggcaaaatcggtaaagcgttgcagcacatccatgccgcttacgcggagccgttaacgctgacgcagctggcgatgagggccggcatgagcgtgccgacctttcatagccatttcaaggcgataacgcagatgccgccgatgcagtatgtgaaatcggtacgcctgcaccaggcacggatgctgatggtgcgccaacaaatcaccgccgccgccgcgagttacgccgttggctatgaaagcccatcgcaatttaaccgcgaattcaagcgtctgtttggcctgccaccggcagaggagataaagcgtatgcagcatcacttcgccattccgcccgcgcagcctgcctcggtatttgtttcatcgcactga

SEQ ID NO: 85382 - DNA, 793 bp, Glycine max
  Peptide Sequence Number=SeqID_177067
atggcttacgtcattaccgaccgagaaaaactgcaagcgatttgggaggccgccaaagccggcgactggccggccgtgtatgccgcctccgtcgatgcgctcaccgatcccaaccatgccaaccaacctattcagggcgtggatatcgcggtgtatacctggatcaaaggcgcctatggcgtgaactcgaatcagggggcgtttgcccattacattcgcgaccaaaccaagctgcagtatgagctgcgcaccgggcatgttcccgatgactgggaaacgcgcatccagaatgcctccgacaacatcgccaaaaacttcgccaaaacgctgtttggcgtcgatctgagcagtgatcccaacgcgccgctgccggatactccgcccaccagcgccaaagtgccggacattcacgaggtcggcctgatcgacgccggcgcagcggcatccgaggtgttcaccgatgcctcctcgaccggcgcccccaactattcgccctgggccggcaccacgctgttctcctatttaggcgacacctcgttctttaccgaatgggtggccaccaacgatacctcgccttttaaggtcgaaagcggcacctacgatttgattgcggcggcgcaggtctccatgcagatgaaaaacctcagctacgtggttgaaacactgctggcgggcgaagtgcccacctatttgaccaccctcggtattggccacgagaccatccgcctcgccgccgaagcggcgcgtgatttctacaccgaatcctacggcagcagcgtgaccggcggcggca

SEQ ID NO: 85383 - DNA, 186 bp, Glycine max
  Peptide Sequence Number=SeqID_177068
atgttgatcctaagtgaatattcaactcctaaaactgtggtaaacaatcctagtgagttcaacatacataggaaggttgaaaggaattggaaaggaggattggtgccatcccttgaagaatttgagtcaagaagcaaggggccaaccaccttaagagctattggactaagaagtactccaaattga

SEQ ID NO: 85384 - DNA, 930 bp, Glycine max
  Peptide Sequence Number=SeqID_177069
gaatggggtagggggaataccaaggaagtgcttggaggagaaggctgaaactctggccagtcaaggagagctggtggatctagcagcaattgacacctttcttgcttatcaccacagcaaggaaagcccggttattgctgttttggcagatgcgtatgatacatttgacttaagatgcgagaagagtagtgcgaggattgtctattgtacgcctgctttttatgtatggttggtatcccacgtcttcaatcatgagagtagatctgtctgccccctacaaggtcatcgcatctgcgtcgaaaaggacaaagcaaattgggaagaactcttggcaggcatgacaagagcgtccattagttggttcccatggtggaaagaaggaggggagggagtgttatgctcatgtgaaggatttccaaatgtcccttggatggggacgaggggttgcattaattataatcccatgttggccataagacagttaggttaccctatgagaggtgcaccatcagaggagaccatcgcgcctttcatcacgcgaggtttcaatgaagctaatgtaaagacactccagaggatctataaggaatggaataaagcagaaagaaaagataaagaacttagtggaagtagccaaggtgtcataggcagctatcacaaatggttgaagtcgagaacgcaagggataacttggctcccaaagttaaagagtctgagcggggaagaggctgaaatgcttgaggagagtgaagacgtgcaagctttgaaagctgagctcgaaaatacaagagtagagaagaagaagctaaaggtggcaatcactagggtcaggaaagaatgtgatgagctgaaagatatcaacatgaccatagttgaagcgctagagcgggaaacaaaaaaagcccaaaaggaagagtggagcaggaacaa

SEQ ID NO: 85385 - DNA, 130 bp, Glycine max
  Peptide Sequence Number=SeqID_177070
cgcacccgtgagcctcgccctcgctcgctcgcgaagggcacgttgcgacagcagcggaatggagaaggaagagagagaggagacgctacttcaaggagaagatgagtctagaagaagctcaccaccatag

SEQ ID NO: 85386 - DNA, 168 bp, Glycine max
  Peptide Sequence Number=SeqID_177071
atggagcaacatcaaataaaagaactatcttctccaaattctaccaaaattgatcttgacaagagaatgtcaaaaaatagaagatctttgcaagatataatgtccatgagatgggtatcaaaatcaaatagaatgcagacagtcatccaagtacccaacaaggtttaa

SEQ ID NO: 85387 - DNA, 336 bp, Glycine max
  Peptide Sequence Number=SeqID_177072
atggaaaggaatctcttggaaaatttgatgcaaaagctgatgaggcgatttttcttggttattcattgcaaagcaaggcatatagagtgtttaataggagaacattatgaagatgcaagttttcaggataaggacactgctcttcgacaagtatccaaggttaaggatcttgaacaaagcaaggaaatcactgcaacacttcctaaagacctcccaaaggaatggaaaactcaaaaatacctttccttggacaacatcataggtgaaatatctaagggagtatccactcgctctatacttagaattttatgcaataacatggcatttatttcttag

SEQ ID NO: 85388 - DNA, 281 bp, Glycine max
  Peptide Sequence Number=SeqID_177073
atgacggtgaaaacctctgacacatgcagctcccggaagacggtcacaagcttgtctgtaagcggatgccgggagcagacaagccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgtt

SEQ ID NO: 85389 - DNA, 303 bp, Glycine max
  Peptide Sequence Number=SeqID_177074
atgaaagaagtggtggatcaaacgctgctgtcgaccggtgccaacggcgtcaaccgcgtcagtgagcacgatgtgcaggtgatttacgggccgcaggtcgagaaaatcgctaacgaggtgaaaaggactgaagctggaagtggagtcgctcaaatacggcgtcaacggcacgctgcggctgggcgtgatgccgcagtgcagcgtggcgctgccggcgttattgaaagcggtggaagcgcgctatccgcaactcgactatcgcgtttccgccatgagcgccgatcaactgctggaagcgcttaa

SEQ ID NO: 85390 - DNA, 355 bp, Glycine max
  Peptide Sequence Number=SeqID_177075
gatccaacatcacccgggccaccattactgccgtatcggacaggcaaggttgcccagagaaggaatctacagaggcaatgcttactacctcaaaagactggaaggctgttctgatgactcctccacggcttccacatatggcatagacgacgggcaacttaccaagatagggaacgactctcaccgagtggatccacgggcgtcccaaaagatagctgtaagccgggttaatatccattacttggaaggtaacctgacaagtatgggggccgatctgtacaaggaggtcgatctcccccctaacttctcggcgggtgccgtcgaaggcactgaccaccatggaacttggctttag

SEQ ID NO: 85391 - DNA, 435 bp, Glycine max
  Peptide Sequence Number=SeqID_177076
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcaggggacgcctgacactcagttccgggtgggcagttcgctccaagctggactgtatgcacgaaccccccgttcagtccgaccgctgcgccttatccggtaactatcgtcttgagtccaacccggaaagacatgcaaaagcaccactggcagcagccactggtaattga

SEQ ID NO: 85392 - DNA, 750 bp, Glycine max
  Peptide Sequence Number=SeqID_177077
atggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacacagtactgcgatgagtggcaggcggggcgtattttttaggcagttattggtgcctagaaatatttatctgattaataagatgatctctgagatcgtttggtctgcgcgtaatctcttgctctga

SEQ ID NO: 85393 - DNA, 105 bp, Glycine max
  Peptide Sequence Number=SeqID_177078
atgttggccatcatcagaaagtacaaagaagaattagatttggccaccgcccacgagcacaaagtggcggaggaatacacccgagtgagtcaagatgttccctga

SEQ ID NO: 85394 - DNA, 723 bp, Glycine max
  Peptide Sequence Number=SeqID_177079
acccctgttgttgtggaagagggggaaacactttgtgcttactctagatttgcactcctgaggcctaatcctcaagacttagctgctaagctctgtatcccagggaggggattcgagcttaatgctgatgggcagcctttgaagattctgaggaagaacatgaccactcttgctcagacttggagcgttctttccttttctaacctcatccacacttcccacacttattatgtcactcttgacagagccaaactcatttatggcatcatcatgaagatggacatgaatgtggggtacctcatctcccaccagatctccctcatagcacagcatgacacatccagactaggattccctgccttgaacacagctttatgtaaggctaggggagttcagtcagattcgaggtccctggagagcctgagtcctgccattaatttggcatatattaagaagaactgttggaatctggatgatcaaatagtaactttcagaggacacaggaaggccaggggtaagagatctgaggtccccaccacttcagcaccagagacaccagctccttcttcttccacaactccattacctcccactcagattccagttattcctccagcacctctacatatgccactcccagctcctatatctgcaggaccatcaaattttatttttacaccacagatgctttactccatgctccagagcatccacaggggatag

SEQ ID NO: 85395 - DNA, 507 bp, Glycine max
  Peptide Sequence Number=SeqID_177080
atgtcacccaccaggcaccctctggacccggataagtctaacagggccctagggtttctggcgttaatcacgggcctctgccagtcattcggggttcccgtcacccttagtaaagtgatccgactgccgatcactcgggccttcatcgagaagtactacatgcctaggcaggcgcatggtgatgcacatcaggccgcagacacaccgccaccactgcgacaggctaatcccgttggattagtaggcatggagcgttatctacaacacttggtgcagatacatgagtgtctctaccagttcagcctcagtcagcaggggcagggtttcgctccttttgcatgccctactccagagcagtttggggctgaggtcgcatggcccgatgactggcccgaggcccaggcaggggaggagcccacaggatcccccggtgaggcagaggaggcccgtatggatgaagaaatgactgacttgctcggtttcttgggaggaagcggagccacgtga

SEQ ID NO: 85396 - DNA, 588 bp, Glycine max
  Peptide Sequence Number=SeqID_177081
atggctgaaaaaaggaagatacgagaagaacaagcagcatttactgaggacccttcattgtacctcccaccatcaccaatttctagacacgagaaatggaagagtgcacgcacaaaacaatatggccagatgacatctcaagccgccaaagaaattgctgacaaaattgactctttggaagagcaaagcaggcagggcagcattgtgccttcgggacgtgatgatattttgaacatggctattggaagaccggagcatcctggtcgtgtacgtggggctgggataggggttacaattatgcagtactttggtccagcatcgcgtcggtctaccacttcatcaaacatcactgtagaacagttggctgatataattggtaacctaaaagaagaatggcaaagacaggttgaacaagaaaacattaaaagagaggaggtgtggatgaggagggtagaagaggaaaaacagcgcactatggacacatttaaaggacaaatacaagaagctatcaagttggagttgtcacaaattgcatcacaacattcagccccacttcagccaaatgatatacaagtattagcagcaagg

SEQ ID NO: 85397 - DNA, 70 bp, Glycine max
  Peptide Sequence Number=SeqID_177082
atgggaagccggaagatccatatcaccttcttagctacacacatggggcactgtacccccaaatgtgcaa

SEQ ID NO: 85398 - DNA, 400 bp, Glycine max
  Peptide Sequence Number=SeqID_177083
aaaaaagaaggaagtagagacgagagtcgtcatcacggaaagggcaggacggaccaaatcagtgtcttatctttgctttcctcttatctccgatgagagatacttggcaccctttgttgcacgatatgtgaagtcccgagatgtgccgaaaatcaaaaggaagcaggcttacgcgatccgtgaaaattccgtaagattcttcctcaagaaggctgttgattttggaggaagcaaccttgctcgcctgggcgagctgggtggcaagctcctcccctattttgctattaatagggggaggagtgaagggagaaggggttcagccttggcacttcttattctcttgaaattgctgaggaaaattatttccgtgaagaaaatccaagccgaggcgcttccgtaa

SEQ ID NO: 85399 - DNA, 1035 bp, Glycine max
  Peptide Sequence Number=SeqID_177084
atgaccggccctctccatgagtcaatctcttgctttctcataaaggtggacccttgggtactagtaccctcaccttcagagggctgcacgccctcacctttagaggattgcacgtcctcaccttcaaagggctacacgccctcaaaggactacacgtcctctccttcagaggactacacatcctcgccatcagagggctgcacgccctcactacatatcctcgccttcagaggactgcatgccctcacctttagagggctacacaccctcgacttcagaggactacacgtcctcgcctttagagaactacatgtcctcgccttcagagggccacacgctctcgccttcagaggactacacgttctcaccttcagaggactacacgtcctcgcctttagagggttgttcgccctcacctttagaggactacacgtcctcaccttcagaggacaacacgtcctcgccttcagagggcgagcaacctttagaggactacacatcctcacctttagaggactgcacgtcctcaccttcaaagggctacacgtcctctccttcagagggctacacgccctcaacttcagaggactacacatcctcgcctttagagaactacatggctgctcaccccctgatattggaggaaggccaactacacaaccagaggaggaggctatcgcccagctactctacatatcggggcaagatttcgcctgggctgctgcaaatagacaagaaggcgtagggcgaggcaccacaacagcctatggacaaccagcagtgagcaacagacacaccgccaccccctccagggtccaccttagctcatctacaaaggttggagcgtactgggcccatgatcgacaaatcgtcatcacacgtccagctcaagacgttaaagaagcgctactaggaggcaacctagaattggctgtgaagaagctccccgcgaagaggtccaggaagagcaccattgaaaagggttccagtgcagccccgcaagctgacacaggcttcgacaaacaccgattctag

SEQ ID NO: 85400 - DNA, 682 bp, Glycine max
  Peptide Sequence Number=SeqID_177085
attctcccctgctgtgattaacaagtacctgggcagaccgactgaaggagtggtggatattgatgttactgaacatcaaattgccaaggaaatcactgccaaacaagtccagcattggccaaagaaagggaagctttcagcagggaagctaagtgtgaagtatgcaattctacacaggattggtgctgcaaactgggtacccaccaatcatacttccactgttgccacagaatcttttgctgtcaaattacccattgccttccctactgtattgtgtggcattatgttgagtcaacatcccaatatgttaaaccacattgactctgtgatgaagagagaatcgcctctatccctgcattacaaactgtttgaggggacacatgtcccagacattgtctcgacatcagggaaagctgctgcttcaggtgctgtgtccaaggatgctctgattgctgaactcaaggacacatgcaaggtgctggaagcaaccatcaaagccaccacaaagaagaaaatggagctggaactgctgatcaaaaggctctcagagagtggcattgatgatgaagaagcagctgaggaagaaggagaagcagctgaagaagaagaagaagctgctgaggaagaggaagatgcagcagagcatactgaatcagatgatgattctgaagccaccccatga

SEQ ID NO: 85401 - DNA, 513 bp, Glycine max
  Peptide Sequence Number=SeqID_177086
atggctcagttaatcgctgatgccatctatctatttgcaggtatggcgcctaccagacaccttctggacccggataagtccaacaggtccctgggatttcccgctttgatcacaggactctgccagtcgttcggagtccccgtcgcacctagcaaggtaattcggccgcccatcacccgagcttttattgagaagtattgcacgcagagacaggcccagggggatgccccgcaggccgcagatgcgccgccacctcatcaggctggcccaactggatcatttgatacagagcagtatttgcggcatttgagccagggttttacttcttttctgtgccctactccggatcagttcagggcagaggtcgcatggcccggagattggcctgaggcccgggcaggagaagcaccagcagaggcaccagcaggggctcccgacgaggcagatgaggcccgcgaggacgaggagatgaccaatttacttgatttcttaggagggaacggagccacatga

SEQ ID NO: 85402 - DNA, 283 bp, Glycine max
  Peptide Sequence Number=SeqID_177087
atgaatatgcaaatgaatgatcggagcacttggatccaccccaaggtcaaggcgaacctattgtcataccctaatttcgtccggggacctttgcttgatgacatgcgacctttctttggtccttgtgagaatattcctccagaaggctgttgcttctggaggaagcaacctggctcgcctgggcgagctgagctcgcctgggcgagctgggcggcaaccacctcccctaccgaggcgcttccgaaacgtttccgtaacgttttccgtgaggaatttcgcaaag

SEQ ID NO: 85403 - DNA, 318 bp, Glycine max
  Peptide Sequence Number=SeqID_177088
atggtctcaaagaagctgaggaaaaaggatattcccatgctagctaacagaattgagatgaagagatcctcgtcacaggagtcagttgcactcaggaaatgcttacattgtgaggtgacaaagacgccgcaatggagagagggaccaatgggtcctaagaccctatgcaacgcctgtggggttcgataccgatctggccggctatttgctgaataccggcctgcagctagccccacttttgtatcatcattgcactcagactctcacaagaaggttttagaaattaggaacagagccacccaagtgactgttagataa

SEQ ID NO: 85404 - DNA, 3228 bp, Glycine max
  Peptide Sequence Number=SeqID_177089
atgatgtatgtcctctttgtgtgtgaaggtggctatgggactcttgaggagcttctagaggtgataacttgggctcagcttggcatccatgataaaccggtggggttgctgaatgtagatggatactacaattccttgttgtgtttcattgacaaagctgtggaagaaggcttcattagccccaaagctcgccacataattgtatctgccccatcaacaaaagagcttgtcaaaaagatggaggaatattttccacaacatgaaagagttgcctctaagctaagctgggaaactgagcagatagattactcctcaaattgtggcatgtctagagctgacttcaatctagctgtgaagcctaactactcttctgctcaatgtgaattctggttagaggacattgaatcatctactcagctttgtaaaatgggatttggtcgaaattcgacctcgagaagcggtgattacttggaagggatgctcaatgactatgttgggggaaggaacaaactgaaggctcagaaaagtgctgccacaactaagtttgtggcagcactcacgtgccttcaatttttctttgcagtctatgcaacattcctattgtattacatgggcccttccatcgatttaagaaccaagccagagttcacatgggctacaaaaattgcccaacaatggaagcaactcatgatcacaccccatgttattggtcactaccaagaagctgcttcctctctcatcaaggaggatcttcttcccacaactccttcccaagtgtgtgagaatgagaaaatagacttcatgcaaaagaagtccaatgatgtccaaatgataaagataaagagagagctctacgatgaggtgttgaacttccaaagcaaaaccattggcaccgagactctccaagagctaatggcaatgaaatccaaatgggacttaaagggtccaaagaggccaaaaatcacagtgttgctaaaccacttcaagcgaaagacactttgtgcacagcttgattctttgctccaacaaaccctcccttttcatcatgtttgggtgctctcatttgggagccccaatgaggtctcattgaagagaattgtggacacctataacgactcgagaatcagcttcataagctcaagctatgatttcaagtactatggaaggttccaaatggctcttcagactgaggctgatcttgtttatgttgttgatgatgacatgattcctggaaggaagatgctgcagattttggcacacgtggctgggacagacaagtacaagaattctgttttggggagtattggaaggatattgccctttagacagaaggatttcactttcccaagttacagaaaatttcggtctaaggaggcagggttgtatttgcccgatcctgcttatgatatcactgttgataaaattgtgcaggtggattttctttctagttcatggtttctctcagctgatcttgtcaagacactcttcattgagacaccttttaccttctcaactggtgaagatcttcacctcagctatcagcttcaaaagtacaaaaatgctggctcatttgttcttccagtggatcctaaggacaaggaaacttggggtgatagtgaacacaggcttgcatatgtgtctgaaaccacagtgattttcaaggatgtggttcaagtcagagatgatcaatggtggaaagcactttccacaggttatgtgactcagtgggctgcaatgtaccctcaaaaaattgatgcactcttctatgctcactcagttgatgaagtgaaagtccttgcaccacttcttgaaaagttcaggtccacagttggcaagaaggcctacattgttgtctctggaggcaattactgcccttgtgaagatgctgcaagagctctcaaatggcctgcattggtctgcaaggaacgccggtttaagatttttgatttggccgtcgaagccctttcaggggtgtcagattctgaggcaccagtgatacatgcagtgtacaccagcttgaagggtttgatcaaaattcacaatcccagtttagtgatcagtgtggctgaaattgaccctcatgtgagaaaagctctcaagatggcctcagaaaccaactcaaatggcaccacatttgttcttttaccaagttcttcagtttctcaagttctttggatggctgatctgcgttcaacagcattaccaaattggaatcggatgaggatctctgtgaacatcatcacacaaaatagagtcaattcactagcaaggcttctcaaatctctcagcaatgcctactatcttggagatgaaatccccattacttttaacatggatagcaaggtagatgaggcaactataagactagtaggttcatttgagtggcctcatgggaccaaaaccctgagaaggagaatcgtccaaggagggctcatccgggctgtgagtgagagttggtatccatcttctgatgatgactttggactcctactagaagacgacattgaagtttccccttactactacctatggatcaaatatgcactcatggcttaccactatgacccccaagtctctctccctgagctctcctccatctccctctacactccaaaacttgttgaagttgtcaaagagaggccaaaatggaatgccacagaattcttcaaacacatccaccccaacacaccttaccttcatcaactaccttgcagctggggggcagtgttcttccccaagcattggagagagttctatgtgtacatgaacatgaggttcactgaggatgccaaggccaacccagttcaaattccaaagtctagaacaaatggatggcaagcttcatggaagaagttcctcatagacatgatgtaccttagagggtatgttagtctctacccaaatttcccacaacaagcaagcttttcaaccaaccatatggaaccaggggcacacattagtgcaaaagacaatgtggttaagcacaacaaacgagactttgaggtgccactaatgaaagaagactttagaaactttttgccagcaatgaaaatgcctccagcaccaaggcttccatctctgaacctcttcaatcaaccagtttctctaaagggtctcaaagctgctggagctaagttgggacaagatgtgcttagatgtgacaatgccactgaggttgttgctgttgacaaagatactggtctacctcacacttgctccaaattctga

SEQ ID NO: 85405 - DNA, 258 bp, Glycine max
  Peptide Sequence Number=SeqID_177090
atggataatcattcatggtgttatccagcttgcattcaatgtcataggaaaactgacatccaaacagcatcattcacatgcggatgtggcaaggataatgatctgcttgttctgaggtatagagttgaagtaatggttacccaaaacgatgagagtagcaagtttttgctctgggaccgtgaatgtgctgaattgattggtcaaacagctgatgaagttaatagggtcaagattgaagtatgttcggggatcctctag

SEQ ID NO: 85406 - DNA, 450 bp, Glycine max
  Peptide Sequence Number=SeqID_177091
gggtccaccgaggtgcagctcgcgatcatcgccaagcatctcgggttcccgaacgcgctcaccggccgacttcctatagggtggccagggcgaaatccggacgctggagcggggagtccaggtcctgccgccggaacagagaggggtgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgagaaaaaaggctgcaccggtgcgtcagcagaatatgtgatacaggatatattccgcttcctcgctcactga

SEQ ID NO: 85407 - DNA, 1067 bp, Glycine max
  Peptide Sequence Number=SeqID_177092
gtcatttctcaagaacaatagctaagggacctgatactactacttggatctggaacctacatgctgacgctcatgattttgatagccatactaatgatttagaggagatttcccgaaaagtttttagtgcccatttcggccaactctctatcatctttctttggctgagtggcatgtattttcatggtgctcgtttttccaattatgaggcatggttaagtgatcctactcacattaggcctagtgctcaggtgatttggagagcatctggaataactagtgaattacaactctattgtaccgcaattggtgcattggtctttgcagccttaatgctttttgctggttggtttcattatcacaaagctgctccaaaattggcttggttccaagatgtagaatctatgttgaatcaccatttgacagggctcctggggttgggatctctttcttgggcaggacatcaaatacatgtatctttaccaattaaccaatttctaaatgctgcagtagatcccaaagagattccacttcctcatgaatttatcttgaatcgggatcttttggctcaactttatccgagttttgccgagggagcaactccctttttcaccttgaattggtcaaaatacgcagaatttcttacttttcgtgagattagatccagtaactggaggactaactggggtattggtcacagtataaaagacattttagaggcacataaaggtccatttacgggccagggtcataaaggtctatatgagatcctaacaacgtcatggcatgctcaattatctattaacctagctatgttaggttctttgaccattgttgtagctcaccatatgtattctatgcccccttatccatacctagctactgactatggtacacaactgtcattgtttacacatcatatgtggattggtggatttctcatagtcggtgctgctgcgcatgcagctatttttatggtaagagattatgatccgactattcgatacaacgatctattagatcgtgtccttagacatcgcgatgcaatcatatcacatcttaactgg

SEQ ID NO: 85408 - DNA, 231 bp, Glycine max
  Peptide Sequence Number=SeqID_177093
atggaagatttggagcaccaactgaatcagaatactagaagacattatggtggtaatagagtgggcaatgttggacccagcatctcgatatattatgcgcctcaatcagacatccgtgtgaaaagttatgaccatttgactttttcgagagcttccgttgttcaatttcgagcgtctccatatattattggcctaaatcggacatccgagtcaaaagttatggccgtttga

SEQ ID NO: 85409 - DNA, 813 bp, Glycine max
  Peptide Sequence Number=SeqID_177094
atgggatcaagtcaaaagccttcgcttaaaaagaggttctatcaagtcaaaatcaagagcttagaggtcactagtttacgagagttggggcaattaatgggtcaacttcaacggcaagccttccgcaaagcctatggtaagatttgggacctagctagggtagaagtctccatggaaccgattgcatccctttcccagtattataaccagcccctaaggtgcttcacatttgaggacttccagctagtgccgactgtgaaagagtttgaagaaatcctgggatgcccactgggaggaaggaagccatatcttttctctgggttctatccctccacgacaagagttgccaaggtagtgaaaatctcagcacaagagttggaccgtgtaaagcaaaacagaaatggggtagtcggagtaccaaggaagtgtttggaggaaagggcaaaggccttggcaaatcaaggcgaatgggcttcttttattgacaccttggcacttttgatctttggagttttcctctttccaaatatggaagggttagtggacctagtagcgattgacgttttcctcgcttttcatcatggcaaggaaagcccggtcgtcgccattttggccatgtatgacacgttcgaccggggatgtaggcccgtctatccgctacaaggtcaccgctcgtgcgccgaaaaaagaaaggcgaattgggaccaactcttggctagcatggaggggcatctgttaattcgttccctcgctagaaggaaggaagaatcaggattctatcttcatgcgaaggatgtccaaatgttcccttga

SEQ ID NO: 85410 - DNA, 225 bp, Glycine max
  Peptide Sequence Number=SeqID_177095
cgcttggggcatcccatggactgagcgaaaaggctcaggcgaggctcacgggtgcgcttttcaaaggaggaaagatgcacggagtcgccactaacgaaggtattagcacctctcacgtcgacaaaagcagggctcttgctcctacgtaccctccatcaaagaggaaatcagacctacgtagttcttcctttaagggtgaatcaagcgattctttttacttgaaag

SEQ ID NO: 85411 - DNA, 201 bp, Glycine max
  Peptide Sequence Number=SeqID_177096
atggaacagggacaaatagatatcctcatagctaggttccctgaccctaactatggtgttaaaacgaaaacaaagctaacaccaatgctctgggtcaaacacccacgttacttcatgaaagagttgagagcatttcaggttttacaaagggatatcatttggaaatttcgactatgccaatgtgaccggggctcagtgtag

SEQ ID NO: 85412 - DNA, 284 bp, Glycine max
  Peptide Sequence Number=SeqID_177097
gggaggagcttgccacccagctcgcccaggcgagcaaggttgcttcctccagaagcaacagccttctggatgaaggatctggaaggcccaatcaaggaaaagttgaagatgacagttatcaaggtctgaaaagaatgtcaagaactgagagacgtcaatgtggccaccgtcgaagcattggaatgggaaacaaagagggcccaaaaggaagaatggagccgaaacaagttctgaggggtgttgtggggcagcaacagcgagctcaagcttcgaagggccaatag

SEQ ID NO: 85413 - DNA, 75 bp, Glycine max
  Peptide Sequence Number=SeqID_177098
atgggtgtcaagtaccttgaagtggtcaagcgagggtcacaccccaacaaactgatgatcccggatgaaattagg

SEQ ID NO: 85414 - DNA, 1173 bp, Glycine max
  Peptide Sequence Number=SeqID_177099
atgcaggagataggcaccttccacggcggcgatttacaagggctgaccagcaagctggattatcttcaacagcttggcgtcaacgcgctatggataagttcaccgctggagcaaattcacggctgggtcggcggcggcaccaaaggcgactttccccactacgcctatcacggttactacacccaggactggacccgtcttgacgccaacatgggcgacgaagccgaccttcgacaactggttgatgaggcccatcggcgcggtatacgcgtactgtttgatatcgtcatgaatcacgccggttacgccacgctcgccgatatgcaggaatttcatttcggttcgttgtacctgaaaggcgatgaactgaaaaaaacgcttggcgagcgctggaccgactggaaaccggcgtcggggcaaagctggcacagcttcaatgattacatcaacttcagcgataaagcaggctgggaacaatggtgggggaaaaaatggatccgcaccgatatcggcgactacgacaatccgggtttcgacgatttcaccatgtcgctggcgttcctgccggacctgaaaaccgaatcgacgatcccttctggcctgccaaatttctatcgtcacaagccagataccgccgccaaagagatagccggctacacgccgcgggactatctgacccactggcttagccaatgggtacgcgactacgggattgacggtttccgcgtcgataccgcgaaacacgtcgaaccggacgcctggcagcagctcaaaacgcaggccacggccgcgctggcggaatggaaaaaagcgaatccgcagaaagcgctggatgatgcgccattctggatgaccggcgaggcctggggtcacggcgtaatgcaaagcgactactatcgccacggcttcgacgcgatgattaatttcgattatcaggatcaagcggcgaaagcggtggactgtctggcagacatggacgccaccttggcagcagatggcggacaagctgcagggtttcaacgtgctgagctatctctcctcgcacgatacccgcctgttccgcgaaggcggcagccgggcggcggaactacgctgacgctagagcagggctatggtttcgtgcgtgaaagcagcgctgataaagtgatggttgtctgggccggacagcaatag

SEQ ID NO: 85415 - DNA, 360 bp, Glycine max
  Peptide Sequence Number=SeqID_177100
atggcccgcacaaagaaaacatgggagatgacgactgaggtcacaaaggaaatcgctgagaagatcgattcctttgaggagcaggcatcacagggatccttcgtcccccatggacgtcaggatgttctcatcgctgttattggacgtccaaagcaccctggatgtgtccgtgctgctggaggcggtgtctccatcaggcaatacttcggatcggctccatggacatcctgcaactcttcctcactgcctcctgaaaaattacagcagctgacccaacaaattaggaaccagttagaggagttaatcacagaaaaagtgactcggcagctcatggcatcgttcagccagatgcagtcctag

SEQ ID NO: 85416 - DNA, 136 bp, Glycine max
  Peptide Sequence Number=SeqID_177101
tgaaagaggagtgaaaaaaaggaagattgggctttacgggacgttatttggtgaagaattgagtgagaatcgaaggtttgaagttctaggtatggaggaaaacgtggaggaagctttggctgcgcagcagctctga

SEQ ID NO: 85417 - DNA, 159 bp, Glycine max
  Peptide Sequence Number=SeqID_177102
atggagcatggcaattcaagtacaactattggacttgcaattggagttgcattggctattgactttggagtaggcatggtagcagcactgtcgcatgggtctggcttcaacttgcctatgggtggttcaactcgagagcagattggcagcattggctag

SEQ ID NO: 85418 - DNA, 285 bp, Glycine max
  Peptide Sequence Number=SeqID_177103
atgggcacttggggcaatggtagctcacccagtcgcccaggcgagctaagacttactcctaaagtaactggctcgcccaggcgagctggttccttcaccctgaagtcatttgagggcccaggcaagctaaaggctagcctaggcgagctagggtgttggaaactcaataaaaagaccctttcccccttcctttttgtttggctagcaagaatcaaaacatcagtgaatgatagtccccagacgaaattagggtatggcaccctgttcttgagaaagccaaggtaa

SEQ ID NO: 85419 - DNA, 357 bp, Glycine max
  Peptide Sequence Number=SeqID_177104
atggtagccataaccctagccaaggttcatcaacctccatttctccgagaatacgacttgaacgcaacgtgtgcttgtcacagagacgccccggggcgttccattgagcattgtagggctctgaagcgtaaggtgcaaggtctaattgatatgggctggctgaaatttgaggagaatcgcgtgattttcaactttcaccggaagtgggtgcaagccattggtctgtttgctcaagcgacctgtgctcctgagtttggacttccaagaccgttcaatcagagattactcgtcttgcgtgttggtggggctgccgtaaaacaacaaataaagttcaaaacaaataagtttcagaattaa

SEQ ID NO: 85420 - DNA, 756 bp, Glycine max
  Peptide Sequence Number=SeqID_177105
atggctcagccgttttcactgcgctacatgctggtggacggtcagggtaacttcggctccgtcgacggcgactccgccgcggcgatgcgttataccgaagtgcgcatgtccaagattgctcacgaactgttggcggatctggaaaaagaaaccgtcgacttcgtgcctaactatgatggcaccgagcagatcccggccgtcatgccgaccaagatcccgaacctgctggtcaacggctcgtcgggcatcgccgtgggcatggccaccaatatcccgccgcataacctggcggaagtcgtcaacggctgcctggcctatatcgacgatgaaaacatcagcatcgaagggctgatggaacacatcccggggccggacttcccgacggcagcgatcatcaatggccgccgcggcattgaagaggcctaccgcaccgggggtggcaaagtctacctgcgcgcgcgcgcggaagtggaggccgacgccaagaccgggcgcgaaaccatcatcgttcacgagatcccgtatcaggtgaacaaggcgcgtctgatcgagaagatcgccgagctggtgaaagaaaagcgtgtggaaggcatcagcgcgctgcgcgacgagtccgataaagacggcatgcgcatcgtgatcgaagtcaaacgcgacgcggtcggcgaaggtggtgctgaacaacctgtatgcgctgacgcaactgcaggtcaccttcggcatcaacatggtcgcgctgcatcagggccagcctaa

SEQ ID NO: 85421 - DNA, 285 bp, Glycine max
  Peptide Sequence Number=SeqID_177106
atgtttggctgtttcttgtccctgccccattttgctgtttttgctttgcctgcccagacctttcttgttgcccttgcatcctttggttctcttaaccttgctgtgaagttgcctaatggttctctaaagccagacctggggccaaaaacatatattgcttatggatttcctcaggagcttggacgtggtgattcagtgactaagctccattgtgatatgtctgatgcagtatgctctatttgcttatttctttcctgggctgttattttcaaggatttcttctaa

SEQ ID NO: 85422 - DNA, 339 bp, Glycine max
  Peptide Sequence Number=SeqID_177107
atgccctaccacaatctagtcgactttgagccttgcctcgggtatgccactgaagggcaaccagttggtggtatacccctgcaaaacaccttggaggaccctcagtatcacccacaactacaccccttgcattccacagcgggtaaaaaccctcatgctatggtagaaatgggaaagttggatcatctagaggaaaggctcatggccattgaaggaggcggagattatgtctttgctaactgtcgcaacctacccttcggcgggagggcgacgcgagactcgcgggatgcgtgttccacgaaaggaatacgcgcggagtcgccaccaacgtttatttga

SEQ ID NO: 85423 - DNA, 219 bp, Glycine max
  Peptide Sequence Number=SeqID_177108
atgacgaatgaaggagagcctaaggttgaaaaatcaatggctaacaaggataagaaagcaatgcttgagaaagcttacagtgcgattatgttgagtgtcagtgataaaagactgagtgacatatttaggaggtcaagatcagagactagagagtctcttgtcatcaatagacacgaccagagacacgaatgcaatagcaccacaaatgagaacagataa

SEQ ID NO: 85424 - DNA, 593 bp, Glycine max
  Peptide Sequence Number=SeqID_177109
gaaaatgcgcggagtcgccaccaacgtttatttgtggaaaacgtcggaaaaaccgaaggaaaccggtcatgaagaatattccagattcaggagttgtatttacgtttgaggaaggtattagcacctctcacgtcgacaaaagcagggctcttgctcctacgtaccctccatcgaagaggaaatcagacctacgtagttctttcaaaagggcgaatcaagcgattctttttacttggaaggaggcgagccaggttgcttcctccggaagcaactgccttctggaggaacatcctggaaggcccaagttacggaaccttacgggtcatgtaattactccttttttagctttcggaatgttacagaaactcacggattgcgtaacaatacttccttttgatttccggcatgtttcagaacttcacgtattgtgcaacaaagggcgccaagtacctcgaagcggtcaaccaaaggcaaagggtcactttggggcagttgcaggttgcccaggtgagctggagctcgctcagttgggtattaggggaccatcgtggaaagtcaacactttcaaccatgttgctttcgaagatggttga

SEQ ID NO: 85425 - DNA, 324 bp, Glycine max
  Peptide Sequence Number=SeqID_177110
atgggctgtgatttgtctatgatcgagaggaggtttggggtgaagcatttggactcttttaatactactagtgtcgatatgatgatatgccaagtttggaagtgtcgatatggaggaggagaatctgatcccaaagaggttttaggggtagataacacgggtgattttgaaggatctgtgtctattgtatcagatacgattggtatatccaatatcaatcaatggatacttcctcaaataagattcgattggtatattcaatatcaatcaacagataccttcctcaaagaaggcgggttctttgggagttctgaacaaaattaa

SEQ ID NO: 85426 - DNA, 141 bp, Glycine max
  Peptide Sequence Number=SeqID_177111
atgaagagcaagaatgggttatcgttgaaggtgaatttggaagcaaaagtgcaggctacgatgggaaatttgaaaatccccaaggttactctttggtatagcacaatgaagtacaatgctattttatgcagaacggtttga

SEQ ID NO: 85427 - DNA, 225 bp, Glycine max
  Peptide Sequence Number=SeqID_177112
atgactatactcgtggatgataaaagacttctgctcgagggggagactaccatgtggaagagactcacacttgagggggagatatgttgggttacaagtgtgaggtgtacccctcgaatctccccaacaggacctatcatctatatacaagttagtggaatacccatgagtgacaccacaatgaaggcagcacaaaggtccataaatagtggtggtatctggtga

SEQ ID NO: 85428 - DNA, 126 bp, Glycine max
  Peptide Sequence Number=SeqID_177113
atggaattcatgttaaagaaaaagattggactttcactttcactgactattgagcatgctggtgtcaggggagtgagagagatacttaacattatgtactcaaggatgatgcattatttattctga

SEQ ID NO: 85429 - DNA, 480 bp, Glycine max
  Peptide Sequence Number=SeqID_177114
atgatagaagtctctgttgaagccattgcatcccttactcagtattacgatcaaccactaaggtgtttcacgtttggggactttcagctagtaccgatcgtggaagagtttgaagagatcttcggatgcacgctaggaggaagaaagccatatcttctctctgggttctacctttctgtggaaaggatagctaaggtggtcaaaatctcggcgcaagaattggaccaagaggcacttagaggagaaggcgaaggcattggtggatcaaggggaatgagcttcgttcatcgatgtcttggcgctattggtatcgtcctctttccaaatgaggatgggctagtggacctagcggcgatcgacgccttccttgcttatcaccatagcaaggaaagtccagagatgcgagaagagcggcacaaggattgtctgttggacacccactctttatgtatggctgatctcacacctctttcatcatga

SEQ ID NO: 85430 - DNA, 264 bp, Glycine max
  Peptide Sequence Number=SeqID_177115
atggcgccgcctcttacctcttctcctttgtcttccgctgcatctcgagggacatgctacgtgcacccaacaacattgctggtgcacccaacaaatagtgaatgggcgaaattgcccttatgcaatctcgtcattcggaagaacatacttccgaatgaagttccggaagacgttcttctggaaaaacttccggaagaaggttctttcggaagcccaccttcttctttcagaagaaccttcttccggaagttgttttttaaatga

SEQ ID NO: 85431 - DNA, 465 bp, Glycine max
  Peptide Sequence Number=SeqID_177116
atgacgactaacaggggacccctaagggcaaaaggccactttggggctgttggagctcgcccaggcgagctgaaccatagccctgaagtagctagctcacccaggcgagctaatttcttaaccatgaagtattttgatggcccaggcgagccaaatgctagcctgggcgagctagggtccagaaaaacccagaaaaagacccttttgcccccttccttgggtcatcttgaaatttatctcaaagaaattgaaaatcacgagagagcaccaactctttgtgacaaggatgttgttgagcagagtcagcaaccaacatcttttgaaaggggggatcatgtctcttgtactcaacatgcttatggcaagaatgtttctatgaatccttgcatccagcacgatttagaagatggcataccttcgcaagagcccaacaaggatataaactttaccaaggtctacccttaa

SEQ ID NO: 85432 - DNA, 96 bp, Glycine max
  Peptide Sequence Number=SeqID_177117
atgaggaaaatgcaaggatcatgcatgggtgaacataacatgcgaacgatgagagtagaatgtatgcagttggcagaacaaaagcatgctaaatga

SEQ ID NO: 85433 - DNA, 507 bp, Glycine max
  Peptide Sequence Number=SeqID_177118
atgccccaccacaatctagtggactttgagccttgcctcggatatgccactgaagggcaagcagttggtggtattcccctgcaaaaaactttggagggccctcagtatcacccacaaccacacccctcacattccacaacggttaaaaaccctcatgctatggcaaaaatgggaaagttggatcatctagaggaaaggctcagggccattgaaggaggcaaagaatatgcctttgttaacctagaagagttgttcctagtcccaatatcatcacccctcccaagttcaaggtatcggactttgacaaatttggtcttcaccggcgaaaggatcgaagtgggtctgaaaaaaggcaaatttgaccatcctgctttgatgaatgagaaaactggggcaaatgaagaggatgagaatgaggaaggaacccatgttgaggctgtcattactcagccaatattagctcctctcattacccaccacccagtcatccacaaaggccatccctaa

SEQ ID NO: 85434 - DNA, 291 bp, Glycine max
  Peptide Sequence Number=SeqID_177119
gatctggctatgatagaagtctttgttgaagccattgcatccctcactcagtattacaatcagtcgctaaggtccttcaatggtgattttctaccatggagatgcagcggaaggcaaaggagaataggagaggggaggcaccatccactagggaataagccatggaagaaggagtttcaccaccaagaatgtgccttggataagaagcttgaagaggatgctttaatggaggaaaagaaagagagaatgggggagcacaaaattgaaggaataaaagagggagagaagtga

SEQ ID NO: 85435 - DNA, 642 bp, Glycine max
  Peptide Sequence Number=SeqID_177120
atgggggtagacttcctcactagactcttcaccccttactttatcttcacttccactagaggaagggcaagaagtagtctcctcttgactactataaatgtcttgacccctcatgatcatggttttctttgtggggcattgagaggcaatgtgacctctcccaagacatttgaagcatttaatgttgctagtcctttcttgggaactagtcttaggggtgtatttctctatggtcttacccttatcttccttggggagttcaaccttgtccctcacttccatattgagcccactagggaacctagctatgcttggtctttcctcctccctaagtccagctctaaaaggagtagttccatttgtgtctatattcttcaacactcatactccctgtctaagcctttggagcttgtccataagctccctttcatagtaggagggaatgtgcctcttcctaagggaactcttaagatcattccaatactctactggaggatccccatgaatccttcgttctttaacaagggaagtccaccaatagagggcgtacccttgaaagctaagggtagccaatggaacttttctctcttcgctaatatgatggcaagcaaagagttgttcaaccttcatttcccaatctaa

SEQ ID NO: 85436 - DNA, 426 bp, Glycine max
  Peptide Sequence Number=SeqID_177121
atgtctgaagaaattgatatgaatgttgaaaatgaggaagatgcaggcatgaaagtagaacatgttgattgctttgatgcctttaatacttctcagttatttgctacctatgatgaagttttacatcgggctcgattgatggctcatgaaattggatttgttgccctgataatgaggtcagacacaaatgctggtgttagaggatgggccttatttttgttaatagcttgcaaaaggaatgatgattataggcctaagaagaatgatttggttagaacatgcactagtaatggaaaatgtggatgcccatttaagttgggtgtgaagctagttttgggaggagaagaatggatggcgaagttaatttatgggactcacaatcatgaaatgacaaagtcgtttgttgggcatccatatgcgggttga

SEQ ID NO: 85437 - DNA, 215 bp, Glycine max
  Peptide Sequence Number=SeqID_177122
atgcctgataacgcgcagagactaacgtcatcttctgcaccttttgtcatccaggggcagcgagtcgggtggtgggcagagataccttatggtcatccgcgactttcatcgaccgaaaggaacgaattcgacagtgtcaggatgatgggtgtgcaaatagcaatcaggcccacttgggccttccaggatgttccaatagaaggcggtggcttctg

SEQ ID NO: 85438 - DNA, 654 bp, Glycine max
  Peptide Sequence Number=SeqID_177123
atgcgcgatgaactatcgcggctttaccttcccgctgtggggattctcgccaacaccgacatctcctacgatccgaaccatatcgatgcggaaacctgcatggcgtggatggaaaactatcgtgccggtctgtcccatcagcagcagttgcggatgtttaaccagctcgatagccacgataccgcgcgctttaaatccctgctcggcaaggatgtcgcgcgtctgccgctggcggtcacctggctctttacctggccgggcgtaccgtgcatctactatggcgacgaagtggggctggacgggaacaacgatccgttctgccgcaaaacgttcccgtgggcgccagagcagcaggacaaggtactgttcagcctgtatcagcggctggcgaaactgcgcaagcagagtctcgccctgcgctacggcggctgccaggtggtgtatgctcacgacaacgtggtggtctttgtccgggtttatcagcagcagcgcgtgctggtggcgattaaccggggcgaggcctgcgaagtggtgctggaatattcaccgctgctggcagataaaacgtggaagagcaaagagggtaaagcgacgttgcaggacggcgtgctttcgcttccggcgatctccgcggcggtctggttcggcagttaa

SEQ ID NO: 85439 - DNA, 219 bp, Glycine max
  Peptide Sequence Number=SeqID_177124
atgtcgcgggggtcaggaaaccttggggacgtcaggtggggtgctattgcccaaaaccaagcttggccaatcccgacccaacccgggcatagtcagccagtgagaacttgtgacgtacctaagcagtgtttaaaaattgaaacagaacgttcagtagctactggtaatcgattaccatttgtgtgtaatcaattacacaatgttatatgctactggtaa

SEQ ID NO: 85440 - DNA, 246 bp, Glycine max
  Peptide Sequence Number=SeqID_177125
atgtatacgataagaccactagaagcactatgttgtccgtgtctcgatgaacgactagtgggacagataaaaagtgaaatatgtggagaagatactaaaaagaagagcagagcaaaggcacaggttacgttccgaccaaccacccttaccaccagtctctctagctctcatgtaggagtagcagcaacaccacacttacatccctccactggtgggggagtccgatacaagagagagtaccgatga

SEQ ID NO: 85441 - DNA, 255 bp, Glycine max
  Peptide Sequence Number=SeqID_177126
atgcctacggacgtggaggcactacttgttgggctcaaggttggtggtcaagacggacaacgtggccacaagttcttcatgactcagaagaagctgagtcctaaacaggcgcgatggcaggacttcctggcagagttcgatatggtgtcggaatacaagcctgggaggacgaatcaggttgctgatgcgctaagccggaaggcggagctagccgccttgaaactagaagaggtgtcggccgtaagccaacattaa

SEQ ID NO: 85442 - DNA, 383 bp, Glycine max
  Peptide Sequence Number=SeqID_177127
gactctgccagtcgttcggagtccccgtcgcacctagtaaggtgattcggtcgcccatcacgcgagcttttattgagaagtattgcacgcagagacaggcacagggtggcgaccctcaagccccagatgcaccgcctccacctcctcaggctgacccagctgggtcatttgacacggagcggtatttacggcatttgcttagcctcagcctgcagagccagggttttgcttcttttccatgccctactccggatcagtttagggcagaggtcgcatggcccggagattggcctgaggcccaggctgcagaggcacccgctgagactctcggcgagccagatgaggcccgcgaggatgaggagatgtcagatttgctcggctag

SEQ ID NO: 85443 - DNA, 249 bp, Glycine max
  Peptide Sequence Number=SeqID_177128
atgacatgttcacgcaagtgtgccaaaaaccatgaccatgttgtcaacgtctcaccttcgaccaccgcgaatgctagaggaaggacaccaccatttccatcttttgatgtggccattaatagggtcccacggtatttgccgtacaaatgtgtgccatcaacttgtatgattggcttacagtacttgaagcctctttacattggccaaaagtccaaaaaacactatgaaactgacggtgttcgtgactaa

SEQ ID NO: 85444 - DNA, 440 bp, Glycine max
  Peptide Sequence Number=SeqID_177129
atgagtgatcatccatctagtgttaatggcgaaggtactagtcataaggaccctctatctaaaatcttagatgagttgagttccctcaagttatggaaagaaaaactagaaagaaaggaaaaagtaaaagatagggtaaaagtaaatcaagatgagaggggacaaataagggaagaagaaagaaggaaaatactaaaagagttaagaaacgaaaaacatgcctcctatagtagtcataactcttgcaagagcctaagtgaagaacctcgtgactattatgaaggaaggcataggtcacatctcagacctcactcccataggagagaaaaggaaagaaagcctcaagaggctaacattagcctcccatacttccatgggaaggataatgtagaggcttacttagattgggaaataagtgtagagcaacaacttaaaaggaa

SEQ ID NO: 85445 - DNA, 186 bp, Glycine max
  Peptide Sequence Number=SeqID_177130
atgggacaccttagtgatcaaggggttcccatgaaccctaagagaataaaggtcattcctgagtggcccactccaccaagtgttgagggaaggagcccagagtatgaagaacctagggatttgaggtcaaatcctttccaaggtggagggaatgatgcaatcctaccccgcaagggcattggatag

SEQ ID NO: 85446 - DNA, 277 bp, Glycine max
  Peptide Sequence Number=SeqID_177131
gctggcttgcgaaaggaaaaaggaagcagaagcagagcgggaggagaaaacactaacttccccgcagggaacccggaaactatctttcctctccggaatatatcttcttaatgttgccctagctcaagtgaactacggagctgaggtcacattcatttctagaggaaatcctgatcttcttatcgttcgtgacttccacctaaagtcattgcgttcagccctctccctatggtcgagcaactacgtacctttcttttctagacctcatgtgggagag

SEQ ID NO: 85447 - DNA, 286 bp, Glycine max
  Peptide Sequence Number=SeqID_177132
tggagcgggtgctatccgagaacaattggccgatctggatttgagaattcttatggattcttcgttgatagaatggaaagaattaggggaagagggatccccggacaatgaaaacgaatgggaagatcgaaaagagaaattggtacaagaagccgtggatacacttcttgataatggaatccgcggacaaccgatgagggacggtcataataaggtttacaaatcattttctgatataattgagggcaaagagggaagatttcgcgagactctacttgggaaacgg

SEQ ID NO: 85448 - DNA, 239 bp, Glycine max
  Peptide Sequence Number=SeqID_177133
gaattcaaaattcctgtgactggtcctgagtgtcctatgtctgcacatcctcctcatctgtcagatgaagcactggaccctcaggtatctctaagacaggggtggaagggtctgctgcatgctgaggtgaagatggatccaatgttggtgatgggggctctgaaatggcctcaagagatctctcaggagtggcagcagctacctatgtcgtctgtgtgtcgattgcctcctcctctaca

SEQ ID NO: 85449 - DNA, 1106 bp, Glycine max
  Peptide Sequence Number=SeqID_177134
ccagcgttaactggaaacacgcgctgcgcaatgcgctgataccgattgtcaccatcgtcgcgctgaattttggcagcctgatcggaggtgcagtggtgacagagtcggtgtttaactggccgggtattggccgcctgctggtggattcggtgaaataccgcgactatccggtgattcagggcgtaacgttagtggcggtaaccggcgtggtgttgatgaatctggtcggtgagatagtgattggcttgctcaacccgaaaataagccgccgcccgcgccgccgccgccagatcgtgaggtttttgcttggcaacccttccatcacgaccggaggcgggctggtgctgctagtggtgctggctgccctttttgcaccgctgatcactcactgggatcccatcgagcaggatctgttgaacacgttgcaggcaccttccgttgcccactggttcggcaccgatgattacggccgcgatatttttgcccgcgtcatttatggcgcgcgcatcacgctatttgaggtgagtctcagcgtggccatctcaatggcgatcggcattcctctgggcatcatctcggggctggctggacgcaaaattgatgcgctgatcatgtggctgatggatattattttcgccttccccggcatcgtactggcgattctgattgtcagcgtgctcggcgaggggctgacaaacatgctgatcgccatttcgttgttctcgatcccggtgtatgcacgtctgagtcgcaacctgacgctgggactgaaaaatatggagtatatcgaagcggcgcatatgcttggcgtgcgatacccgcgcattatcacgcactatattctgcgcaacgccattggcccgctgattgtacagtcgacgctgacggctggtgcggtggtgctttctgccgccagtctgtcgtttctcgggctcggcgtgcagccgccgatgccggagtggggcaccatgatgagcgatggccgcaactttctcgggctaaatatttacgtctccctatttcccggactggcgattttgattaccgtgctcggttttaatttgctgggcgacggcctgcgcgatgtaatggataaacgtttatga

SEQ ID NO: 85450 - DNA, 107 bp, Glycine max
  Peptide Sequence Number=SeqID_177135
atgtctaaatgccctaggagtggggtatcatggccccaagcgaaggatgatgatgagtgtagccttgatgaaagcacaaccaaaggctccctagcgaaggtgttatg

SEQ ID NO: 85451 - DNA, 309 bp, Glycine max
  Peptide Sequence Number=SeqID_177136
atgggattccggggcttccgggacacccgaagcaacccaactcgcctgggcgagctaaggtcgcctgggcgagctgggcggcaacctcctccccctttttcctataaaaaggctgaagggggctgttctaaggatccctcagccccctggctatgtatttcagctgttttgggtgaaaaaaattgtttccgtgaagaaaatccaagccgaggtgcttccgtaacgcttccgagatgtttccgtaagcaaatccgtgaaggttttcgtccgttcttcatcgttcttcatccgttcttcgttcttcaacgg

SEQ ID NO: 85452 - DNA, 183 bp, Glycine max
  Peptide Sequence Number=SeqID_177137
atggctaagaaacataaccaaccgcaagctgtccaagccacacctgattttagaatcaacactcctatcgctcaagccattgtgaaatggagaaggaagaaagatgattggaggcgccgcttcaaggagaagatgagtgaagcacaagctcaccaccataggaagccatggataagagcttga

SEQ ID NO: 85453 - DNA, 222 bp, Glycine max
  Peptide Sequence Number=SeqID_177138
atggttcagctaagcgcacattgctacactaagcccaacatcttcacttcattggaagtgcgcttagcgcaggtagtggcactaagcctgaaacactcactgctaagcgcatattgcagaaagatttttggtgttgcagaaagcgctaagcaccgctgctgcactaagccccaaatgcttattggaagttacaacttcaagttgggcttagcgcggggctag

SEQ ID NO: 85454 - DNA, 381 bp, Glycine max
  Peptide Sequence Number=SeqID_177139
atgaataaaaaggtgaaggttattctatggatgaatgctctcctagaacctaagcttttgaatcctagaaaaaccatgaattgttggcagcctaaccccattacaatcctagaaagtccttcggattcatttttatgtgttcattgctgtatggtgaaaaggaggctaagttttgaattgcaaaatgtagcagttaggctaagctcaacagttgggctaagcgcatatccatcgctaagagcagctttagtgtgcttagcgcaaaagagaatccggcagcagcttctacagacaaccagggcacagaattccagagcagccacaggcctctttggggaaaagagccctagaagcagaaaagaggagcagcttgtgcattga

SEQ ID NO: 85455 - DNA, 339 bp, Glycine max
  misc_feature (282)..(282): n is a, c, g, or t
  Peptide Sequence Number=SeqID_177140
atgtaccctcccttgttctctttgaacaacctagtggatgtaccctccactagaactgatccacaagagatgtaccctctcttgttctcagtcaaacccaaggaaaagggagacacaaaagaattcaggcggttagtcctttgttcttttggaaaagggagaagagagacacaaaaagaactcaagcggttagtccttggcgaattctttttggcaaagggagaagagatgaaaagaatgaatagcacaagttttcaaggtttagaaaaccaagaaaacttntggaaagattttggcataaagaagaagaagaagttcaaagagattcaaggcttgtaa

SEQ ID NO: 85456 - DNA, 414 bp, Glycine max
  Peptide Sequence Number=SeqID_177141
atgcgtggggtgctaataccttccccatgcataaaaacaactcttgaacctttcacacttaaagttcgtagaccacacctttttcggtttttccgacgttttcttcaaataaacgttggtggcgactccgcgcattttcctttcttggaagacgcacccgtgagcctcgcgtcgccctcccgccgaagggtaggtggccttgttggtgcttgcgcgcttagcgcaactctggaccgcttagcccgcattagtgaatttcgacttagcgcgtgtcttcttgctcaacagatggactcaagaagtgcgcttggcgggatgaaccctcgcttagcgaacatgcataactcatccttcttccagattcttccttgtgctcaaccaagggaatggtgtgctcagcggatggctcgctaa

SEQ ID NO: 85457 - DNA, 315 bp, Glycine max
  Peptide Sequence Number=SeqID_177142
atggatccacctcaagcaaaagctacaaagggtggcttctacttttttcccacatatgacatgaaaagaatattcgttaatgcaatgcgtctgagtaccaccaacgtgccaatggacttggccagagtgctattagctttccagaaaaattgttggattggagatagagataggtcaaattctttagctaagaaaaaccagaagggaaagaaccagttatgctatttgatgcaagaccggacagttttgagtgccgagagacggctaagagtgttgggaggaattggaccactcaatccagttctgggtatatag

SEQ ID NO: 85458 - DNA, 474 bp, Glycine max
  Peptide Sequence Number=SeqID_177143
atggcatcaaggaagagagcaagaactgaggacatcccttcatcatccaacccatctccttcgacagcagccatggaaccagatgcccaacaagcacattctttaattcatatgttgcaaagcttattcaggggacaattgatgatcgtatacaaccagcatgagttggatcacaacaggccaatcatatctatggagcagtttctggaaaaagtggcatggcctgaagctcagctccctctggaaagagcccataaggttgttcctcccggacctgtactagctaggactgagccaacatcagttgaaccacaacctcctgtagtagatccacatgcttctccggaacttgagacattgtctcctccagcactacctctgataatcatccctgatgacttagctgatgaagctgctgctccttttgattcaccatcttgcaacatagacgatggttctgacttttttgactag

SEQ ID NO: 85459 - DNA, 438 bp, Glycine max
  Peptide Sequence Number=SeqID_177144
cgtctgctgagtgcaacactcctaggctaagcgcgaggaagactctggaagaagatgagttgtacaggttcgctaagcgcaccgcttcatctcactatacgcaccgcttcagttcatccgctaagcgagaaagacacgagctaagccgaaattcactaatgtgcgctaagcggtccataaggagtttggactgggattcaaagctttgcatgtctagggtttctagagatagaaaggtccaagttccagagagttttgagagattttgctgtgtgaagatctgcagagaccagagcttgaagcaggagccggcttcctggtatggacagctaaatcctctgttggatcttccctggtcattcaatagtggaaactggtctgactctaaagtccttgatagtatagggctaagttgtcgtactatcacgaggaatcggg

SEQ ID NO: 85460 - DNA, 282 bp, Glycine max
  Peptide Sequence Number=SeqID_177145
atggtgcaaaaaggtcggtttatgaagattgatattttttcacccaatgcccacccctacatgcattgctttctccgtctcattatcattgtcgtcctagcttgtgatgagaatcccaaaactgcccaagtacaaggacctatgaccaagagtatgaccaaacagtcagataataccctccaacaaatggtatcagccatacttgacaaggcccaagtggagaaggatgaaggcccagaggcactaccaagaatcttaattgttgttgaaggcccaaactaa

SEQ ID NO: 85461 - DNA, 821 bp, Glycine max
  Peptide Sequence Number=SeqID_177146
atgtcagcatctcccgatagagactattttagtctcgcacaaaagaaagaactacgtaggtctgagttcctcgtcacaaatggaggatacgtaggagcaaaagccccgctcttgtcgaccaccccaccttttgctatcgtgacccgtgaagtggagatacccaagtgggccaacgaacctgttgacatgcggagatttacgtcgtctttcgcgctttctgtcatcctgacccgtgaagtcaggagacatgcggggtaccgtatggttatccgcacctttcgtcaaccaggggcaaacgagctcattgatgcgcagagactaacatcgtcttctgcactttttgtcatcctgacccatggagtcaggggttccgtgtggttatctgcacctttcgtcaaccagcagagactaacatcgtcttctgcaccttttagccatccagggacagcgagtcgggcattcaagcccgacgacgcatgggattcttctttgatgggcgaggacgatcaagggcagctgtcataccctaatttcgtccggggaccattgtctggtggcatgccaccttcgcctgaccgcctcgaggggggtgcaaatagcaaccaggcccacttgggccttccaaggggttccaacagaaggcggtgccttctggtggaagcaacccagctcgcctgggcgagctgggcggcaaccacctccctcttttctcctataaataggggaaagagggcagagcaaaaatacgtttccatgagcgatttcatgaagattcttcaccgttcttcgttcgttcttcatcgttcttcggtcttcaaccg

SEQ ID NO: 85462 - DNA, 378 bp, Glycine max
  Peptide Sequence Number=SeqID_177147
aagtacattgatgcttctattaaaaatctagaagttcaagttggacaactagctaaacaactatctgaacatggaagtggatctttctcagcaaccacacaagtcaacccaaaggaacattgtaacctaattacaacaagatgggggactgtggttggtttgaaggataatgatgagaaaaagaataaagatggagttgaaaaagaaaacgagaaaaatgaagtgatgactagtgaaaaagtggtaagtgaagaagagaagaagaaatcaaatgaacaaaccaatgataaaggtaaagctatagtaaaccatccaccaattgagcatcttccttatccacatgctctgtcgaagaaagataaggaaaggcattactag

SEQ ID NO: 85463 - DNA, 384 bp, Glycine max
  Peptide Sequence Number=SeqID_177148
atgggagcttctgatgaagatgtcgaagttgtctacctcagagattttccattttcattagcatctaaggcaaaaacatggctccaatcacatccaaataaaagccttaacacttgggaagaggtgaaggagaaattcctagcgagtggttcgaaacctcaaaccaagatgatccttgatgcctcagctggaggcactatgatgtccaagagtccaaagaaagatattctaatcattgactccacaatagctagtgattatcaaagtcatcatgatagagctttgactcaaagaaaagataagccaacttcctcaacaatatcaccaaggtggaccacagaaaacacatcaagctcaccaagttcagcaaattttgagatgtga

SEQ ID NO: 85464 - DNA, 225 bp, Glycine max
  Peptide Sequence Number=SeqID_177149
atgcatcaacgaaggcctacagcatccgaacgtaggcaacgggaagttgcccctattgttgaggatgatcctatggtgactgaagacgtacatgcacatgttgaagaagttgttgatgatgctgagggatttctaggtggaccgcatgacccattgttggatttcccttgcagttacttcttggtccaattttcctttatacaaatatgttcaagggaaatctga

SEQ ID NO: 85465 - DNA, 288 bp, Glycine max
  Peptide Sequence Number=SeqID_177150
atggcgacttcgtgggcagaagacacgtggaagcccaacccgccagtgttgctggcgacttcaggtggaagcgtgtcccgccagctctactggcgacttcgtccctgtgctaaaatcgcagctttgactggcgatttccgaggctaccatgctagggtgcaggacgcacataagccatttccgagggagctccagactgcaactgcaacgcgcagagaagcagggaatcgccagtttgactgcatccacgcaggaaaaaaagaggaagctgttggtgtttctgtttga

SEQ ID NO: 85466 - DNA, 363 bp, Glycine max
  Peptide Sequence Number=SeqID_177151
atgattatagtggggtatctgggagtatccaaaacttcctttatttcttcacatgatgctagggataatgagttggtagggatgatttctttggctatattagaggttagggttaggaaggaagataaatggttttggagacaaagggaagggttagcctctagttcaagtctaactgatggaggtggtgagtggtgtatccatacatcggatgcttatgaggcatgtgatttgaacatgttaaaaaataacctaagattaggagtaccaatgagatatctaaattttttcttaaaatcagttaagtgtaaacaagtgccaaagctagagggaattggaaggaggattggtgtcatcccttga

SEQ ID NO: 85467 - DNA, 357 bp, Glycine max
  Peptide Sequence Number=SeqID_177152
atgggctcaaaaatctaccctaaggttcatgagaaccctaaggccttctttatcagctttagcccaatccttgtgcagcctcttgggaagattgcatcaccttttgcttcttcactttcatttgaggaaggtgaattgcgcttaactcatccgtgggctaagcgcgcatccactgctaagcgcaacttcagtgtgcttagcacaacagaagaatttggcagggcatcatcatcaaggttgcgcgctaagcacgagatcagtgcgccaagcgcaacaattgtcttcagccaagctcagcgcacgactggcgctaagctcaaatccacttactcgcacttagcgcgagggtggcgctaa

SEQ ID NO: 85468 - DNA, 108 bp, Glycine max
  Peptide Sequence Number=SeqID_177153
atggaagatgctaagcctatgaaaactccaattcatgcttcccagcctctgagtaaagacgaatctgatttcaatctgatcctcaagaatcacatcaaaaggttgtaa

SEQ ID NO: 85469 - DNA, 630 bp, Glycine max
  Peptide Sequence Number=SeqID_177154
atggagaggagtatgatagatgctgccagtggtggagctcttggagacatgacccctgctgaagccagaaatttaattgagaagatggcttcaaactaccagcaatttagtgccaggagtgatgctattgtcattagagcagtgcataaagtagccacgaattcatcttcatcaggtgagactaagaagcttaaaggtaaactagatgccttggttaacctggtaactcaactggccatgaatcaaaaatttgcacttgttgccagactctgtggtttatgctcctctgccgaccaccacacaaacctttgcccttttgtgcaacaatctgaagcaattgaacagcctgaagcttatgctgcaaacatctacaacagacctcctcaacctcagcagcaaaatcagccacaacagaatgacatctccaacaacagaccatacattcctccaccaatccagcagcaacaacagcaacaaccccagaaacaacaaacagttgaggcttcttcgcaaccttcccttgaagaacttgtgaggcaaatgactatgcaaaacatgcagtttcaacaagagaccagagcctccattcagagcttaactaatcagatgggacaattggctacacagtaa

SEQ ID NO: 85470 - DNA, 1494 bp, Glycine max
  Peptide Sequence Number=SeqID_177155
atgaaaagagaaaaacatgtctcctatagtagtcataactcttgcaagagcctaagtgaagaacttcgtgactattatgaaggaaggcataggtcacatcttagacctcactcccataggagagaaaatgaaagaaatcctcaagaggttagcattaaactcccatacttccatgggaaggacaatgtagaggctaatttagattgggaaataagggtagagcaacaacttaaaaggaagtctacttcaaaatcttatggctctcactcttatccaaagaaagaccaagggcaaggaatcttaggggtgagaccttctaagcccaaagatgataaggggaagacaatacaaaagcaaccccttaaggctagtatgcaagagaagactagctccatgaagtgctttaaatgtcttggaagaggacacattacttctcaatgccccaccaagaaaaccatgattatgaggggccaagacatttatagtagccaagatgaggctactacatcaccttcctctagtaaaagtgaagaagcaaaatgggaagaatctagtgaagagatctgcccccaagaagaaggacaacctttaatggttaaggaggagtataaggaggtaagtgtctcctccaagaggttagctaagaaggaaagacattttgaaataaagacaaatattaaagaaatttcccttcttagacaacctccacattttctcctttgtaaaaagacacttgttagcattgccacatctcttaggcttgagtttattcctcaagtaaaggagttgttggatgagggtttggttctcaagatattaaatccttgtgctttgttggtgcccaaaataggtattattaggcaccaaatccctaaaataggtggtgtgatgaatgctttgggtggtgcaacactcttttgtaaaattactcatgcacccaacatcttcatgatttgtgcacatagggactcattaggtagggttcccatgaaccctaagagaataaaggtcattcctgagtggcccgctccaccaagtgtaagaaaaatttggggcttccaagacttaacaaacttttacaaaaggtttgccccatatttttctatacttgtagcaccactcattgagttggtgaggaaccatgttccttcatgggaagatgcccaggaaatgagttttcagaccttaccttacttcaacatactaaacaccagtgttaagggaaggagcccagagtatcaagaacctcaggatttgagctccattggagctcgtaggcctaggattttcttcatcaatggattcctttgcttcttggaagatgaatggcagcggaatggagaaagggaaagagagaggagacgccacttcaaggagaagatgagtctagaagaagctcacctccataggaggccatggataagagcttggaggaagaaggagatgaatgaagggagaaggagagaagagcacgaaattttgtgctctaaatga

SEQ ID NO: 85471 - DNA, 508 bp, Glycine max
  Peptide Sequence Number=SeqID_177156
ttctgaggaccgtccaccaaagcagtccagagtcagaggtcatttggtgaagattgatgctgatagactcaacacattcctggagacacctgtggtattagccgagggagagactctacccacatactccaaatactgcaggttgcctacggacttcaaagagatagaggctgccttatgcatacctggccgagggttcatcttcaactctgagggctatccttggaagattctcaggaaggatttgactacactagctcaggtgtggagtgtcctctcatactccaacttggaccccacatcacatacctctgatctaatagtggacagagctaggttgatctttagcctagtctctcacttggatatgaacataggagcattgatctctggccagatgacctctatagcccagtctaacacttctagacttgggttccctgctctgatcaccgcattatgtaggccagaggggttgtctctgacagcgttacctttgagcgcctga

SEQ ID NO: 85472 - DNA, 117 bp, Glycine max
  Peptide Sequence Number=SeqID_177157
atgtctccgccattgctgtgcccttggctagcactcggggaagttcttagactccgtgttcaaacctttgctcgtgagtcgccgctagatttagcttctctttgcacttatcgatga

SEQ ID NO: 85473 - DNA, 1014 bp, Glycine max
  Peptide Sequence Number=SeqID_177158
gaaatggctccaaggaagctttccgcaaagagatctaggagggacgccgcggccgaaggaaccagtgccactcccgagtttgacagccatcgtttcaggagcgccgagcaccagcagcgtttcgaggccatcaaaggatggtcgttccaccgagagagatgcgtccagctcagggacgatgagtacccagattttcaggaagagatagctcgccggcgttggacgtcgctggtcactcccatggctaagtttgacccagatatagtcctagagttttacgctaatgcttggcccacagaggagggtgtgcgggacatgcggtcatgggtaaggggccagtggattccttttgatgtagacgccctcagccagttcttgggtgacccgctagtgttagaggagggccaggagagaccattgccagctgttatgcataccgggtcaggatttttcccggaccgctgccgggaggcgggtgcggatcatgcgcaccagcatgacaaccttgacccagatgtggatgatgttgctgctcagcaatgtatgccacctaccaggcaccctctagacccagataagtctaacaggaccctggggtttccagcattgatcacgggcctctgccagtcattcggggttcccgtcacacctagaaaggtgattcgaccgtcgatcacctgggccttcattgagaagtattgcacgcctagacaggcacagggtaatgcaccacaggccgcagacgcaccgccaccacctcatcaggctgatccagttggatcatttggcacggagcggtatctacaacacttggtccgcagggggcagggtttcgctccttttgcgtgccctactcttgatcagttcagggctgaggtcgcatggctcggagattggcctgaggcccaggcaggggaggcgcctacagaggctcccggtgatgtagaagaggcccgcatggatgaggagatgacagatttactctgtttcttgggagggagtggagccacatga

SEQ ID NO: 85474 - DNA, 354 bp, Glycine max
  Peptide Sequence Number=SeqID_177159
atgtcaaatgtttattatccagatgaacaacagacaccaactaacactacacaacatgatcaatttgtcggtgatgacaactcagattccactgatgatgatgtaaatatgacacaggaaaacattgatatagaatactcattaaatgacccaacaatagacgatcttgatgattatgatgaacagacctttctatctgcctcatctgcataccaaaatacaggtggtacttacattgatatcggagatcctattgcatgggaatgcccacattgtaaggctatgatgtggtatgatgagaggataaataaagacacaaacaaacaaaccaaggttttcattatgttgttctga

SEQ ID NO: 85475 - DNA, 375 bp, Glycine max
  Peptide Sequence Number=SeqID_177160
atggatacaaaatacccatgctttagcaccaggcacacagcccaggtgcaacaacaaggtgttctatttgctcgtatccgagttatccgaagggagcaactccctttttcgttttccttgaattggtcaaaatacgcagaatttcttacttttcgtggaggattagatccagtaactggaggtctatggctgaccgatattatacaccatcatttagctattgcaattcttttcttgatagcgggtcacatgtataggactaactggggtattggtcacagtataaaagacattttagaggcacataaaggtccatttacgggccagggtcataaaggtctatatgagcctaacaacgtcatggcattctattaa

SEQ ID NO: 85476 - DNA, 180 bp, Glycine max
  Peptide Sequence Number=SeqID_177161
atgactgttaaaaagaggctaagtcatggagtgctaaaagagacaattgagctcagctcatcagttgggctaagcgcgcatccatcactaagcgcagcttcagcacgcttagcgcaacaaaagaatctggcagagcatcaatatcaaggttgcgtgctaagcacaagatcagtgcgctaa

SEQ ID NO: 85477 - DNA, 213 bp, Glycine max
  Peptide Sequence Number=SeqID_177162
atgcagtttttcactaaaataggcaatagggtgcctgctctacggctggaaagtgcaccggatcgtgcaagtagtataaaacgcctagtcctgatcaagcatcatcctcagatccctcttgttggactaaacttgaccaaaactgcattaagacaaatatacaaacaactaggttaccgtaccttgatccctcgtgaaaataggataaactag

SEQ ID NO: 85478 - DNA, 540 bp, Glycine max
  Peptide Sequence Number=SeqID_177163
atggagggccaaccatggaagcttctcagaaaagatcttaccaccctggctcagacatggagcgtcttctcgtactcaaacctagctcatacatccctcatttcagatttgaacacagatagagctaggtcggtctatggcttaatcacaaggatggacatgaacattggcggtttgatctctagacaaatgaccatgatggctcaatctaactcttctcgtttaggcttcccagctttaatcacatccttgtgtagatcaaggggagttggatctgatgctctcacctcctacgaaaacctaaggctgagctctcggactttagatgccaaattgcaaagcttgtttgaaggacaaattctcattatgcaaagcttgcaggaactagctcagcaaaggccaattatgagtgtagagcagttcattgaaaaggtggcctggcctggagcccgaccttcttttgtgggggataatgaaagttttacagcccaggcacctcaacaacatgagctagaaccagaaaaacgatcactcatctaa

SEQ ID NO: 85479 - DNA, 465 bp, Glycine max
  Peptide Sequence Number=SeqID_177164
atgggaagttggcttcacccttgttacaccgttttccatgagcaaactgaaaccgccccgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtgggcagggcggggcgtaaattttttaaggcagttattggtgcctagaaatattttatctgattaa

SEQ ID NO: 85480 - DNA, 288 bp, Glycine max
  Peptide Sequence Number=SeqID_177165
atggcaatgatggtggcccgagtgatgttggggtacggctacaagctcggaatgggtttgagcaagaacaacggcgacaaaaaccagcctgccaaaggggccctgccctgccacagcagtaaaagctttataagtgcgggtttaagacacgaaggccaagtcgccgcgatattcgaggatgactccccgaggagatcggatttggtacggccatgtcctcctggtttccgactaggaaattggcgagtggaggagcgcccagacgtttacatgacaagcataatataa

SEQ ID NO: 85481 - DNA, 393 bp, Glycine max
  Peptide Sequence Number=SeqID_177166
atgacaagagtacaatgcaaaatagtaagatttattttggttgatctgcaaaagctcgcatatcaaaatgagtctttcctcatgacagaacaagctaaacaggtgttttatgttcaagatccttgtgatgaaaggcacatggctacaccacccagctcccctcctcctcatcctgagtcagcaaaaccttcgtcgtctacgtcgaagaagacaagaaaagaaacacggcttaaatcattggctactagactagttggggcagagagaccaatggttcatgtggatcctgccattgggaaagttgatggtccccacagaaagaaattaagaacatatatggggatcgtcgctcggcggatgttacatatgataattggaaacaagtccatgtag

SEQ ID NO: 85482 - DNA, 591 bp, Glycine max
  Peptide Sequence Number=SeqID_177167
atggcttccaactcccagcagtttagcgccagaaatgatgccatagtcattagaggagtgcatgaggtagctacaaacccatctgcatcatctgaaactaagaagcttgaaggcaaactggatgcattggttaacttggtaacccagctggccttgaatcagaaatttgtacctgttgcaaggacctttgtccttccatgcagcaacctagagcaattgagcagcctgaagcttatgctgcaaatatttacaatagacctcctcaacctcagcagcaaaatcaaccacagcacccacaattatgacctctccagcaacagatacaaccctggatggaggaatcaccctaacctcagatggtccagccctcagcaacaacaacagcagcctgctccttccttccaaaatgttgttggcccaagcagaccatacattcctccaccaatccaacaacagcaacaaccccagaaacagccaacagttgaggcccctccacaatcttccctcgaagaacttgtgaggcaaatgactatgcagaacatgcagtttcagcaagagaccagagcctccattcagagcttaaccaattag

SEQ ID NO: 85483 - DNA, 444 bp, Glycine max
  Peptide Sequence Number=SeqID_177168
atgcttcactctatgatgcagagcctctgtagagggcaggtcattatcatgcagagtcttcagagctcatgcctgccatctattatgagcacagatgagttcctgactctagtggcttggccaagagtccagccttctccttctggagggggtgggacctccatagcccaagagcctatgccagcagaggagcctatgccagatgcagaggatgagcctgttcctcctgagccatttatctttgagattgatccaatcgctcatgaggaagcagcagctcaggagcctacttctccagttcatatctccacagcacccattcctgaggattcccagccatttgcaccagcattggagctagagcagcctactgtgcaggatccaccagctgctccgatgttggatcttaatgagcatgcagaggatcacccgcaggaggactga

SEQ ID NO: 85484 - DNA, 1038 bp, Glycine max
  Peptide Sequence Number=SeqID_177169
atgccgctggatatgccagaatctgtgctggtccgtttcaaaggccaaatgcaacctggtatcaccttacgtgacctggtaaatgcgattccttacgcagcgatccaggaaggcacactgactgttggtaaacaaggcaagaaaaacgtgtttaacggccgcgtactggaaattgaaggtttaccagacctgaaggtggagcaggcatttgagctggctgatgcttcggctgagcgttctgccaatggttgtactgtgctgttgaataaagagccggtgattgagttcctcaactccaatatcgtgctcatgcagaacatgatcgaaaacggctatgccgatgcacgcacgctggaacgccgtattgccagcatgaaagcctggttggaaaaaccggagctgttgcagcctgacagtgatgctgaatatgcccatgtgattgaaatcgacctcaatgagatcaaagaaccactggtggcttgcccgaatgatccagacgatatcaagcccttgtctgccgtggtaggtgacaagattgacgaagtgtttattggtagctgcatgaccaacatcggccattaccgtgcagcaggcaaagtgctggaaggtgcagggggtatcccgacccgcttgtggattgcgccgccgacccgtatggatgaagcgcaattgcgtgctgaaggggtgtactccacctttggcgtggctggtgcgcgtacagaagtgccgggctgttccttgtgtatgggtaatcaggcacgcgtggctgacaaggcgacagtattctctacctcgacacgtaactttgacaaccgtatgggtaaagatgcacgcgtgtacctgggatctgccgaattggctgcggtatgtgccaaactggggcgcatgcctagcgtgcaagagtacctggatactttgggcagcaagctgaccaacacggcagagatttacaaatatctcaactttaaccagatgatccaatatgcgggctcgctggaaaatgtgaagaaaatcattccaattaaagaaactgtatag

SEQ ID NO: 85485 - DNA, 483 bp, Glycine max
  Peptide Sequence Number=SeqID_177170
atgggcagaaatgtctccgcattgattggtaaatctgttccccaaatccctgaaaaatgtaaagatcatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcgagatttcctggaagatgccaggaagatacttaa

SEQ ID NO: 85486 - DNA, 162 bp, Glycine max
  Peptide Sequence Number=SeqID_177171
atggattggcggcagtttcaacattgctccccttttgatgcaatcctccctaggaagggaccaatcactagaaccatgagcaagaggctccaagaagattgggctagagctgctgaagaaggccatagggttctcatgaaccttaggggctccatattgtag

SEQ ID NO: 85487 - DNA, 321 bp, Glycine max
  Peptide Sequence Number=SeqID_177172
atgccgccaatctctgggctaaacgaaatttgttgcggcaggtgctggctaagcgagccctctttcgctaagcggtatatattgtttatggcattgagaaagagagcaagaactaaagacatcccttcatcttccaacttacctcctccgacagaacccatggaaccagatgctcaacaagctcatcccatgattcctatgttgcagagcttattcagggggcagttgatgattgtatacaaccagcaagagttagctcacaacaagccagttatatccatggaacaatttctagaaatggtggcctggcttgaagcttag

SEQ ID NO: 85488 - DNA, 288 bp, Glycine max
  Peptide Sequence Number=SeqID_177173
atgagtgtttcgcccttcgggatactacttgtttgtgtggatgcgaaatctaccggcaagtgcaccgggtcgtcaagtttgttcaataagcaggcatttgcaaacagaatcatgattgtgactgaaagtaaaagtatgttctattctaattacaaagcaataaatgcgttgggtcctcttactgagcaaattgatgcaattaaggatgtttctctaattaaagatgttcatgtgtcctatgctgaaggctcaagtactaaacaccgatgtctcgtgagtttagcctaa

SEQ ID NO: 85489 - DNA, 399 bp, Glycine max
  Peptide Sequence Number=SeqID_177174
ggtgacatcaaggtggctcacaaagcactcaagtcccaaaactcacaaaataactcttcaatcccggacttggtacagaactcgtgcagccttcatgtttatatagcagtgtgcgtttctgggctgcaacagcttgcgttggatgagatctatcactttcctgaaaaatctgcacttaaagaactaaaagatcaatattttcgggccggatgtcaggacatcgtgtccgacatcgtggatcctgcgcactctgttaaagatataacagatttatgtgtccagtattttcgagccggatgtcaggacatcgtttccgacatcgtggatcctgcagcttcaattcttcatttgacattttatcttgccttgtgcattgtgcagcccgatctgattccttga

SEQ ID NO: 85490 - DNA, 682 bp, Glycine max
  Peptide Sequence Number=SeqID_177175
atgcattccaaggttattttgatgatgccaaagaatcaagagttaagcaaattccaaagattcaagaatctagtttcaagaatcaagattcaagactcaagaatcaagtttcaagaatcaagattcaagaataatcaagatcaagtttcaagactcaagattcaagaatcaagagaagacttaatcaagataagtactaaccgcctgagatatcttttgtttccccttacaaatattcaaaggactaaccgcctgagaattctttgtcccaacacattggagggtacatcctttgtgggtacatctacttggttattcaaaaagaacaagggagggtacatcccttgtggatctttggcttgtaaaggattttacaaggttgaaaagaaatctcaagaaccgcaggaaaacactcgccaatgcttggaggctgaaggtcaagttgtgacctgggaaaccttcaagagggtatttctggagaaatacttccttgaagatgttaggaacaagaaggaaatggaattcctagagctcaaggcattggatagaagactccaggtagattctgccagagatccaagggaaggccttagggttctcatgagccttaggctaagctctagcttctttaggaatcttctaaaggaagcttctcaaggaggtgagcttagttatgagaggg

SEQ ID NO: 85491 - DNA, 657 bp, Glycine max
  Peptide Sequence Number=SeqID_177176
atgacccgcacgaagaaaactgggcaaatgacttctgaggcagctaaggaaattgccgacaagattgtaagatttcttagagaagtaggcctcacaaggttcctttgtcgcccatggacatcaggatatactgactattgccattgggcgaccagaacaccctggtcgtgtgtgtgttactggagtcggtgtcacgatcaaacaatactttggaccggctccaaggacctcctgcacatcttcatccatggctcccgaagacctagagcaactaacacaaaaaatcaaggaccaactggaggagtcgatcatagaaaaagtgactcgagaactaatgttgtccttcaactagatgcagtcccagtttcactgcctcctaagcctaagattggtccttcagttgctcatgtcagcacaaaggagagttgtgttgatccctcagggaacgatctagacacgagtgactcagagaaatgtgggttatacatcgaagaaaatcctccccacctagttgccctaggaaaactttatgaggggtccacaatctttcacaacatccctttgccccatgatgaagtcaaggttggtgttgaggaagttagagatgtagatgcttcatttcctatacccactgaagaggttcaattagtggggtag

SEQ ID NO: 85492 - DNA, 723 bp, Glycine max
  Peptide Sequence Number=SeqID_177177
atgttccgtgaagaaaatctaagccgaggcgcttccgtaacacttccaagacgtttccgtgggcgatttcatgaaggctttccaccgttcttcatcgttcttcgttcgttcttcgtcgttcttcgatcttcaaccgaccacgtctttttccggtttttccgacgttttcctcgaataaacgttggtggcgactccacgcattttcctttcttggaagacgctcccgcgagtcacgcgtcgccctcccgccgaagggtaggttgcgacaataatgaaatatatttgaatgttgttggaggtccaaattacaaggggaacgtgtacaggctaggtactttgaggaaaaggtttagttgctcaaaatcagctccatctacttctattgctcctgtggaagaccaaatagaggaaatgcatgagacaattaataaattgtatgctgagcttttggaaaaggcaaataaggagaagacacttgaggaaaagatgttgcaaatgatgaagaatcatgaccaccaaagtcaggagatgcgacaacagatgcaagaacaaaatgagaaaattcctcaacaaaataagcaaatgcagcgtatactacaacacttgcatattcagtctatcatgctaactcctagtctatcgcctaccatagcagatggaactgagcaccatattaatgatgctcaaattgatcatcctcatgacatgggaaatgatcattga

SEQ ID NO: 85493 - DNA, 1485 bp, Glycine max
  Peptide Sequence Number=SeqID_177178
atgtcatctccgattgtccagccattgctcccaccctccgcactagccccaccggaactgtggggtccttttaggaataggaatgggtcattgggtcttgaagctcaaaagtctaaaaccttaggctttttctttgtgggagtcttgaagttggttgggtttaagaaagggtacatcatccttttaggagaggtggtgaacgagaaatgcttgctcttctattttggtataatctctgtgaatgataccatcacatcaaccagattcatcagggaccctgaggctataatctcaagcaatggtgacttcaagctcggattcttcagccctgaaaaatccacaaatcgctatgtggcaatctggtatctctctgaaacctacatcatatggatagccaatagagaccaaccacttaatgattcatctggggtgttccaaattcacaaggatgggaatcttgtggtaatgaatccacaaaataggatcatatggtcaacaaatgtgtcaatcattgctaccaatacaagtgctcaacttgatgattccggaaatctgatcctgcgtgatgtttcagatggaaaaatactatgggacagtttcacacaccctgctgatgttgcagtgccatcgatgaagattgctgccaacaggctcacaggcgagaaaattgcatatgtgtcatggaaaagcagttctgatccttcttctggatacttcaccgggagccttgaacgcttggatgctccagaagtgtttttttggttcaacaaaacaaagccatattggagaactggtccatggaatggaagggtcttccttggatcaccaaggatgttaactgagtacctatatggctggcgttttgagcctaatgataatggaacagcttatctaacctacaattttgaaaatccctctatgtttggagtcctgaccataactccacatggcacacttaaattggtagagtttttgaacaaaaagatatttctagaacttgaggtggaccaaaataaatgtgacttttatgggacatgtgggccttatggaagctgtgataactcaactttaccgatttgcagctgttttgaagggtttaagcccagcaatcttgatgaatggaacagggaaaattggactagtgggtgtgtgaggaatatgcaactgaactgtgacaagttgaataatgggagtgatgttcaacaagatgggtttttggagtaccataacatgaaagtgcctgactttgcagagagatcaataaatggagaccaagacaaatgcagagcagattgcttagcaaattgctcttgcttggcctacgcatatgattcttacattggttgcatgttttggagtagggacttgattgatttgcagaaatttccaaatggaggggttgatctcttcattcgcgtgccagcacaacttctagttgtaggtatgtttttctctccttctacacaatattttggagttatttag

SEQ ID NO: 85494 - DNA, 601 bp, Glycine max
  Peptide Sequence Number=SeqID_177179
caacatccagcccaacgatcctaattccgacctccccctgccgaagtgtcagctggtgtacgccatcctgacacggatgagcattcacgtggctcagttgatcgctgatgccatctatctatttgtaggtatggagcctaccaggcaccatctggacccggataagtccaacagggccctgggatttctcgctttgatcacaggactctgccagtcgttcggaatccccgtcacacctagcaaggtgattcggccgcccatcacccgggcttttattgagaagtattgcacgcagagacaggcccagggtgatgctctgcaggccgcggacacgccgccacctcatcaggccggcccagctggatcatttgatacggagcagtatttatggcatttgagccaaggttttacttcttttccataccctactcaggatcagtttagggcagaggtcgcatggcccggagattggcctgaggctcgggcaggagaggcaccagcagaggcacccgcagaggctcccgacgaggcagatgaggcccgcgaggatgaggaaatgaccaatttgcttgatttcttgggagggagaggagccacatga

SEQ ID NO: 85495 - DNA, 687 bp, Glycine max
  Peptide Sequence Number=SeqID_177180
atctagctttggtaaaggagttttatgccaacctttacatctctgaaggaccttcaccaaagcaagtcaaggtcagaggccacgtggtgaagattgatgcagacagcctcaacatctttctagaaacacctgtggtactagctgagggtgaaaccttacccgcatattccaaatactgcaggttgcccacttatatcagagaaattgaggctgccttatgtatagcagatcgggggtttgttttgaatgttgaaggccaccttgggaagattctcaggaaacatttaacaactcttgctcaggtgtggagtgttctctcgtactccaacctggctcctacttcccacacctcagacctgacagtagatcgagctaggctgatctttggcctagtctctcagatggacatgaatgtgggagctctcatctctggtcaaattacatctatggcccagtctaactcttctagacttgggttccctgctcttatcaccgctttatgtaagtccagaggggttgcttctgacagcctagtcttcgaacgcctgagcccggtcattaacttggcctatatcaggaaaaactgttggaaccctgatgatctgacagttactatcagaggggccaagagagcaaggagaaggccagctgagaccccttccacatctacagctcctcctccaacat

SEQ ID NO: 85496 - DNA, 600 bp, Glycine max
  Peptide Sequence Number=SeqID_177181
atgggtgacctagaggaagtacaggaacagatgaatgccgacatgtcggtttcgaaagaacaaatggcttctatgatggaagccatgctgggaatgaaacgactaatggagagtaatgcggtcaccgccgccgccactagcacgactgccgaggcagacctggctctcccaactgcgcaccatcctgttccaaacattgtgggacgagggagaagcacatcggggcatgtcagcagcccccatctggggtacaatcgaggtgcttacccctacgatttaccacccaactacacaccacaggccatgcatgaagatgcggagcgcgctcagggagacgtcaactcctactccccgtttcccgctaaggggcctgtgcccaacgcactatctcaacccaacatcacgggagagcctcaaacccacccaacgcagccaatgcttctgtccgtgggagggccgcccccggcagcggaaggaaaggaaaaactcgatctcctcgaagagagattaagggccgctgaaggattcaacgattatcctttcgcagacatgactgacctgtgcctggtgccggacgtcgtcatctctccgaagttcaag

SEQ ID NO: 85497 - DNA, 828 bp, Glycine max
  Peptide Sequence Number=SeqID_177182
atggtcgttcaggtcctggcgatagcggcgcagttcatcgtcgatgatggactgggcgcgcttgtcgcgcacgatgccttcgcgcgtgaacacctgcacgtcgatcacggtgccggtcatgcccgaaggcacgcgcagcgaggtgtccttaacgtcggacgccttttcaccgaagatggcgcgcagcagcttttcttccggcgtcagctgggtttcgcccttgggcgtgaccttgccgaccagcacgtcgtcggcgctgacttcggcgccgatgtacgtgatgcccgaatcgtccaggcggttcagttgcgtctcggccaggttgctgatgtcgcgcgtgatttcttccggacccagcttggtatcgcgagcgacaaccgtcagttcctcgatgtgcaccgaggtgtagcggtcatcggccacgaccttttcggagatcaggatcgagtcttcgaagttgtagccgttccagggcatgaacgcgatcagcatgttctggcccagggcgagttcgcccaggtccgtcgatgcgccgtcggccagcacgtcacccttggcgacacggtcgccacgcttgacgatgggacgctggttgatgttcgtgttctggttggaacgcgtgtacttgatcaggttgtagatgtcgacaccgacttcgccggcgacgttttcttcgtcgttcacgcggatcaccacgcgttcggcgtcgacgtggtcgaccaggccgccacgcagcgcctgtacggtggtgcccgagtcaacggccacgggtgcgctcgatacccgtgcccacgacggcttttccggacgcaggcaagcacggcctga

SEQ ID NO: 85498 - DNA, 639 bp, Glycine max
  Peptide Sequence Number=SeqID_177183
atggctagtgtgatcaatttatcctgctaccatcatcatcatattcatcttcttagtcctaggttttgctccttatcttatcatcttagaaaattttatctcaatgtttggctgtttcttgtccctgccccattttgctgtttttgctttgcctgcccagacctttcttgttgcccttgcatcctttgggattggcttgcttggccacagatattgaaattaaaagattggcctccttctaatttatttgaggaacaattgcctcgtcattgtgctgagttcatatcttccttacccttcaaggaatatactgatcctcacaaaggttctcttaaccttgctgtgaagttgcctaatggttctctaaagccagacctggggccaaaaacatatattgcttatggatttcctcaggagcttggacgtggtgattcagtgactaagctccattgtgatatgtctgatgcagtaaatgtgttgactcatattgctgaagtgaaactggattctgatcaacttactgtcattgagaagttgaagcaaaagcatctcgagcaagagaaaagggagctacttggtgatgatcaggatggagaaactaatgttgacatgcttaatataattcatcttctacaataa

SEQ ID NO: 85499 - DNA, 378 bp, Glycine max
  Peptide Sequence Number=SeqID_177184
atggggatcgcacccgcaagacacccagtggacccggaaaagtccaacagggccctggggtttccagctctggttacgggtctctatcagtcctacagggtgcccgtacccccccggcaaggttatgtcatcatagggatcgcacctgcaagacacccagtggacccgaagaagtccaacagggtcttggagttgtcaagctctaattacgggtctctgtcagtctacgagtacttgtcaccccagcaagggcatcaggcccctactaatcgagcttcatcaagaattactgcgtctccaggcaggcgcagggtgaaacaccacagcagcctggggatggccggcagcgggcaacagacgcaccgccatcacctctag

SEQ ID NO: 85500 - DNA, 492 bp, Glycine max
  Peptide Sequence Number=SeqID_177185
atgaatggatcagaagggggggctgggttctatttccgggccgggcgggaggggagtttactcaacccattccccagtcttccgcactgctcaagtaagtgtgcgactccgtatgaggacctccttcccttctgcccactctccgttcacacggttctcaaagcagaggaggaagggtgggcagcagttatgcttcggatgcttcgccatagaatagatcgacccagttcccgttcttttccggtgcactcgctttatatctccgacacacaaggaaggacgcggtgggaaggaagcagccctagcctctgtccggccgatcattccgctggcatcttgcattcacgcctccgtttgactgccgctcggggatggagttgtagatacgttagtcttagcggatcgttggctccacctgttatctccttctacgacatgctgttgtcgtcgccatattccatatgtaacttagtcatctctgcctcgctgcgg

SEQ ID NO: 85501 - DNA, 517 bp, Glycine max
  Peptide Sequence Number=SeqID_177186
caaaataggggaggagcttgccacccagctcgcccaggcgaacaaggttgcttcctccagaagcaaccgccttctggaggaagaaactggaaggcccataagttacggaaactcacggattgcgcaacaatacttccttttaatttccgacgcgtctcgagacttcacatattgtgaaacaaaggatgccagatcgtcatttgatccaaaaaataccaagactgaaaggaagaataggaagaaacaagcaaccactaaaacactgggaccaaagcattacaacaacatagtcattcctccttccagcgataaggtcgtgaaattaaagccaacactgcttagtctaattggcttacatccctttgctggaatggatcatgaggatccatacacgcatttgtctaccttcatggaactatgcagtactatgggagcttctgatgaagatgctaaagctgtctacctcagagcttttccattttcattagcaggtaaggcaaaaacatggctccaataa

SEQ ID NO: 85502 - DNA, 354 bp, Glycine max
  Peptide Sequence Number=SeqID_177187
atggcaagagtagcaaaggtggtcaagatctcggtgcaagaattggaccaagtgaaacaaaatagaaatggggtggttgggataccaaggaagcacttggaagagaaagcaaaagctttggctgcactattggtgttcggggtcgtcctcttttcaaatatggatgggctagtggatctagcggcaatcaatgcttttcttgcttatcaccatagcaaggaaagtctggtcgttgttgttttgggtggtgcctatgacacattcgaccgggggatgcgagaagagcagcgcgagaattgtctgttgtacacccgctctttatgtatggctggcctctcacatttttcgtcatga

SEQ ID NO: 85503 - DNA, 461 bp, Glycine max
  Peptide Sequence Number=SeqID_177188
tacaatctaaatcccttaacgaggatccattggagggcaagtctggtgccagcagccgcgttaaaaagctcgtagttggaccttgggttgggtcgatcggtccgcctccggtgtgcaccggtcggctcgtcccttctgccggcgatgcgctcctgtccttaactggccgggtcgtgcctccggattctgatcctattgtgttggccttcgggatcggagtaatgattaacagggacagtcgggggcattcaacgaaagttgggggctcgaagacgatcagataccgtcctagtctcaaccataacgatgccgaccagggatcagcggatgttgcttttaggactccgctggcaccttatgagaaatcaaagtctttgggttccggggggagtatggtcgcaaggctgaaacttaaaggaattgacggaagggcaccaccaggagtggagcctgcggcttaa

SEQ ID NO: 85504 - DNA, 234 bp, Glycine max
  Peptide Sequence Number=SeqID_177189
atgttcagcccttctggtattgagaaatctctcgaaattagtgagaaaaattgtttccgtggaaaaaatccaagtcgaggtgcttctgtaacgctttcaagacgtttccgtaagcgatttcgtggagattcttcaccgttcttcatcgttctttgttcgttctttgtcgttcttcggtcttctaccggtaagttcccgaaattgaatctttcaattcattctatgcacccttag

SEQ ID NO: 85505 - DNA, 988 bp, Glycine max
  Peptide Sequence Number=SeqID_177190
atggtgaccgatgccaagcatgtgattctgtccgtcaatccggcttttaccagaatgctgggcttcacactcgacgatgtcataggcaaaacgcctaaaatcctctcctctggcctgcatgacgccaacttttaccgcagcatgtgggaaagtgtgagcaactttggccattggcgaggtgagatttggaaccggcgcaaaaacggcgagatattcccggagtggctctccatctctgaagtgaaaaatgaggcgggggaaatcagccattatgtgggcacattcagcgacttgagtgacctgaaatccgcgcaaaaggaaattcagtacctggcatcgcacgatgcactgacaggtctccccgacattacccacttcagggacaggctggaaaatgcaatttccatcgcagcagcagcgaatcaaaaaatcgccctgctagcgctcaacctggataatttcaagttccttaatgactcactgggttatgcttcgggcgacaaactgctcaagctatttgccgaacgtctcaaaggctgtttgcacgaaacagataccatctgccgccatggcggtgacgaatttattctcctcctcaacaatatgcacgacgatgattccatcaactatatggtggatatgctgctgactgaagtgtcatcgccgtttgcctttgcaggcagcaacatttctacctcatgctcgattggggtcgctgtttatcccactgatggcaacgactttgaaaaactgtttggccgcgcgcgcaaagccatgtcacacgccaaagaagaaggccggaacacggcacgcttctttaccgaaaaactcaataccgatagcctgcattatttaaatattgcttatggcctgcgtgaggcattggcgcatcaccagtttgagctgcattaccagccgcaaatcagccttaaaaatgcacaagtcatcggggccgaagccctgatccgctggcatcacccgcaaaacg

SEQ ID NO: 85506 - DNA, 186 bp, Glycine max
  Peptide Sequence Number=SeqID_177191
atggcgaccagcaatgaatgggagcacattcgtgatatcgctgcaaaatcaggagcgaatacgctccgtatcgccgcgatactgacattttttaataacagcgatgcagagaccattgataaaaaaacaatggaacaagcctttaccatcatggactggatgtccgggaacttcatcagtggttaa

SEQ ID NO: 85507 - DNA, 640 bp, Glycine max
  Peptide Sequence Number=SeqID_177192
agcaccctggacgtgtccgtgctactggagccggtgtcacatcaagcaatacttcggatcggctccacggacatcttgtggctcctcctcactgcctcctgaagaattacagcagctgacccagcaaatcaaggaccagctagaggagtccatcacagaaaaagtgactcggcagctcatggcatcgtttagccagatgcagtcccagatgcaatctcagggacttgcactgccaccggagcctccacttggtccctcaggaaacgatcctgagacgggtgactcagataggtgcggcttgtacatcgaagcaaatcctgctcgcctggttgccctggggagagtttatgagggatccactgttgttcataacactcctttgttgcctggccaagtaaaggtgggtgtggaggaggttaaagatccagatgctccaattcttgtacccactaatgaggtttccttagtggggcatgcaattcacaccttccttgtttggccgacacatctggtcaagtttttatcacagcagacagttgtgtctctggcaaaaccacctcaaaagccgaatccggaggtcgatgatccgctttatctgatgacattgaccatccccgagcttttcttgaggccttactag

SEQ ID NO: 85508 - DNA, 420 bp, Glycine max
  Peptide Sequence Number=SeqID_177193
atggataagaatgaagttttgaaggtgcatcaatatattgcttgcttttggtacagagctggtttgtcattcaacctcattaaattgaaatgctttgagaatatggttgtagccattggtcaatatgggccacatttgcccattccaagctatcatgatatcagagtttcactcctgaagaaggaagttgaatacactgaaaatttgatgaaaggctatagggagcaatgggtcaagtatgattttaactctcaagctggtacaatgttttttaagtctgttgatggctttgattttgtgaagataggtgaaaagctttttgagttgcttgatgctattatggagaaagttggagaagagaatgttgttcaagttgtaattgataatgggagcaactatgtttcagcgagtaagttgtag

SEQ ID NO: 85509 - DNA, 390 bp, Glycine max
  Peptide Sequence Number=SeqID_177194
atgcaagaggaagatgaagatgaagaatcaaaagatgaagaagacttctcactctttgtgaagaagtttcacaaatttgtcaagaagagaagaatcgagaggcgtcaaaatttcaaccatgaaaaagattccaagaagactctccaactctttgatgctacaaatgcaaccaacttggtcacatcaaagcaaattgcccctcaaacgagcaatggccagagaagaatgagaagaaaagtcatgaagaaagaagatccaagaaggcgtatattgcataggatgacaatgactcatccaatggttcggagaaggagatcaaccttctatccaaggactatgagagcgatgagaacatctctcaagaagattaagcaaaaagtaaaagtctga

SEQ ID NO: 85510 - DNA, 612 bp, Glycine max
  Peptide Sequence Number=SeqID_177195
atggataatgaagagggcgtgcaagaacagatgaaggccgatctatcggccttaaaagatcaaatgacttccatctcggaggtcatgttaaaactccagaaaactatagaggataaagccacggcaaccgcctccagtatagttagggaaacggagccggttctgcagcctgccttaaatccgggccgagacagaaacacggcagtgtttggtcgaaggtatagcccgcaagcttatccttatggcttgcctccggacttcactccccgtgccaccccggaagatttaagccaagcccctactttcaaggggcagctcccaccttatgacgactatcccgggcaagacgacgaggaaggagatacccatctcggtcccttgctccacctcaaagatccgtccccccatgaactaccccaaccaaacatagtccgccatatcccgacttcacccacacccgtaaaagaatctgttcccttcgtggaagataagggaaagattcaggcgcttgaagagaggttgagagcagtcgagggcctcggcaattacccattttcggatctagcggacttatgtctcgtacccaatatcgtcatccctcccaagttcaaa

SEQ ID NO: 85511 - DNA, 249 bp, Glycine max
  Peptide Sequence Number=SeqID_177196
atgtcatctccattggcactttcatcgtggcttgacatgtggcatgtcaccattgccactggcgacatagccagtggttgtcaccactggtggctgcgacgtggaaatcagcatattggcaatgatgatcttagagttttccgtcgcaaattggatatcatgaaacaacataaggagccatacacaacaactgtgatggcagcgttgcctccaatttgtgtggttggaaatgtagcttggttcgcggtg

SEQ ID NO: 85512 - DNA, 333 bp, Glycine max
  Peptide Sequence Number=SeqID_177197
atgcataaggcattgcgattaaatgctcttttgccctatcctcacttagttactttgttccttcaacattttaatatccctcttgattttgaaccctatgttccaatcaagagatctttcttaatcggtgctgatgtggttgcctcctttggttaccgcaaaaagcgtgatggctcttgggtaaaaaagggtgctcaaccaaatgatgatgaaggacacttactggttgaaggggactcttctctccttcagagtaatttggataggtttgatggacttcaaacctgtgttggtgagaggtttgactctttggaaagtcaagtgaacacatga

SEQ ID NO: 85513 - DNA, 225 bp, Glycine max
  Peptide Sequence Number=SeqID_177198
atggaaggagcagattcccgtgaagtgaaggccaagttgctacctaaaagtgtggctgctaatgagtcacattcaggggaagctgctgtttgtgaaacatcttctgtgccattcgaggatacaacttccagaaaaaagcctaggctggtgaaaaacctcgtcggacgcctaggagtacatgacaggacatgcctcacaatgggtaagtcaggtcactctcactaa

SEQ ID NO: 85514 - DNA, 513 bp, Glycine max
  Peptide Sequence Number=SeqID_177199
atgactaggtccaaactaggtgacttgcatccatatgatcctgaggtaggcaggacatttcataggttgagtagaaataataggagtgtagttgtgcatgatagtgtagttctagatagtagtatagtgcatactaatttcactagtgatttcattcctaattttgtctttgagcctactgttagtgcttttgagtctggaactagtgttgagctaataaaaatcaaacttttaaggaattggctacacctaatgttgtgtatcaatcttggtgtagtcaatatcctgagactgaggagtatgattgatgtagctggtgaaggtgctttaatggacaaaattcctgttgttgcaagacaattgatttccaacatggcaataaatgaccagcaatttagtactagagtggttgcaacatccaaggcttctacaactgaagtttttgtttttatgattgctaataaccaaaggctagagaataaacttacagaattaaaatcccttgggagatag

SEQ ID NO: 85515 - DNA, 861 bp, Glycine max
  Peptide Sequence Number=SeqID_177200
atggctacaccacccaactcacctcctcctccttccgagtcagcaacaccttcttcactgtctacgtcgaagaagacaagtaaaacaacacgacttagattgttggctactagaccagttggggtgggaagaccaatggttaatgttgatcttgtcactaggaatgtcgatggtccccacagaaagaagttaagtacatatttggggattgtcgctcacgataagttgatgaaggagaagcaaaagaaacacttggaggaagcaacccaatttgggagcactgaaacagtcgttgatcctccatctcccattagacgacatgtgaagcagaagatggcccgcacaaagaaaactggccaaatgacatttcaagcagcaaaggaaatcgcagacaaaattatttatcattttcctttgttagtgggaagctttgtcgcccatggacgtcaggatgtactgactgctgccattgggcggccagagcaccttgatcgtgtccgtgctgttggagctggtgtcatgatcaaacactactttggaacgacttcaaggggctcctgcacctttttgtccatgggactcacactgtctcatgaggctgaggttggtccttctactacttgtgccagcacggtggaaagttgtgtcgatcccttgaggcaggacctagaaatgggagacttagacaaatgcgggttgtatatcgatgacagtccttcccgaatggttgctcttagaaaagtttatgaggggtcaacgaatgtccacaacgttcctttgggaaatgatcaagtgaagttcaatgttgaggaagttcgagatgctgatgcttgcattcctgtacccaatcaagtggtttag

SEQ ID NO: 85516 - DNA, 174 bp, Glycine max
  Peptide Sequence Number=SeqID_177201
atgtcgctaagtggtagtgtttattttgtgaagatggcctccaggaaacgtaagagcattggggcaaggccaactgctcagtatgatactagacggttccattcacttgattcttggaaccgttatacagatcatgtcttagggaggagtatttttaccagagaggaaggttga

SEQ ID NO: 85517 - DNA, 312 bp, Glycine max
  Peptide Sequence Number=SeqID_177202
atgtctcctccacctctacgacctcacaatcactcacagactcatcttatgctctcaggatggcttcctcttcatgctcagttctctgccagtggccttgttggtgcttgtgcgcttagcgcgaatctagaccgcttagcgcgcattagtgaatctcggcttagcacgcatcttttcgctcaacggatgaactcaagcggtgcgcttagcgggatgacacctcgctcagtgaacatgcacaactcatccttcttccagattcttccttgcgctcagcggatggagtgttttgctcagcgaatggctcgctga

SEQ ID NO: 85518 - DNA, 384 bp, Glycine max
  Peptide Sequence Number=SeqID_177203
atgtcctgggttaatcttatcactgtaatgccacaaaatcatagggaccattttctgcaacatggaatggaggtagcagatggagtcaggtccaaaacctggaaatgctggtggattgctttaacttggacaatatggcaccatagaaataaggtggtgttccaagatacaacttttcatggaaccaaactgttagaagatgccatattcctattatggtcgtggatcaaagcaatggacaaggattttactcttcattttaaccaatggtcctctaatcttaaggaaggattagaccaaacatacctacgtgaggtggcgaaggagaagaagcacagacttctgacgatgctcgagtgcgacgaacacgatgctcgaccttag

SEQ ID NO: 85519 - DNA, 357 bp, Glycine max
  Peptide Sequence Number=SeqID_177204
atggaacccaaaaggaaaaaggtggagtctctcaaggacaactccactgttgctactggatttgttgctaactcaggtgcaacaaagcatatgacttgtgatagaaatatgtttacacagttttcctctaacagttttgttttagtcattataaacgcgaatgatgtttcttccccagttatgggtagtggtacaaatatacatatgaaggagaagattggcagtggtaaaagaagtgaaggattatactatcttaaaggtaattctcaatataccaaaggaaaagcattggctcactttataagtgatgaaacacaagctaaaaataaaagagatatttggcaatggcataaatga

SEQ ID NO: 85520 - DNA, 378 bp, Glycine max
  Peptide Sequence Number=SeqID_177205
atgctcgaaagttttaaacaacaagaacaaatgtcagttctggaattgtacatagaaaaggatgtggcgggtggttctatatttcattctgcaaatttgcttacatcatgtggaaataatttatcttataatgagacacaaccgccaacaaatatgagcaatttacatgttgacgaagatgatgatgattatcttgtgtctaactcatacgttgaagagtctttagacgaagatgacagtgttgacgatatatctgatacagacgatgaagtcaccgacataattcaaccagtaagaattgttcaccaaacagaaggtgcacaaggaattcaaaatccattttggaatgatgctttgcattataacaatatcaactag

SEQ ID NO: 85521 - DNA, 750 bp, Glycine max
  Peptide Sequence Number=SeqID_177206
atgacgactgaggccgcaaaggaaatcgttgcgaagatcgcgacacagggatccttcgtcccccatggacgtcaggatgttctcgccgctgctattggacgtccagagtaccctggacgtgtccgtgctgttggagccggtcagctgacccagcaaatcagggaccagctagaggagtccatcacagagagagtgacgcggcaggtcatggcatcctacaaccagatgcagtcccagattcagtcgcagatgcaaactcagggacttgcattgcctcttgaccctctagttggtcccttcggtcctcgagtgagcacaaagggaagttgtgttgatccctcaggaaatgatcctgagacgggtgactcagataggtgtggcttgtacatcgaaacagatcctgcccgcctggttgccctggggagagtttatgagggatccactgttgttcataacacttctttgttgcctggccaagtaaaggtggttatggaggaggttacagatgcagatgctccagttcctgtacccactgatgaggattccctagtggggcaagcacttcacaccttccttgcttggccgacatatctggtcaagtctttatcacaacagatagttgtgtctctgccaaaaccacctccaaagcccgatcaggaggtcaatgatccactttatctaatgacattgaccatcccagagcttttcttgaggccttatcaggttacatgggatgccaccgtgtttggg

SEQ ID NO: 85522 - DNA, 192 bp, Glycine max
  Peptide Sequence Number=SeqID_177207
atgtcttcggatagcaaagggaactgcaacaatctcaacaaacaattagaaacggatgaccatcatgtagaagcaagcttcatgatgatgaatcaagttgattcaagtagttttgataatgacaaagatgatgacaaaaagcccaaaagaatgatttcaagattgagtcaacaagttcaagatcaagtttaa

SEQ ID NO: 85523 - DNA, 228 bp, Glycine max
  Peptide Sequence Number=SeqID_177208
atgcctagcgctgttcatgtgtcctccaccaacgagtctgggagccccgcgaattcattgcctagcgctgttcgccaattctccattctcagtcttattcggagacccatgaattcattgcctagcgctgttcatgtgtgctccaccaacgagtttggagcaaagcgaattcattgcctagcgctgttcgccaattctccattctcaattttattcggagacccatga

SEQ ID NO: 85524 - DNA, 300 bp, Glycine max
  Peptide Sequence Number=SeqID_177209
atggctcctcgtgttgtgcctttcagcgaatatgcatcacgcctttcatgcacggggtttcagtctttgacccctcactttagcaaccgacggagggtactccagtgtcgccttaaaacatgggatcaagtcaaaatcaagagcttagaggtcactagtttacgagagttggggcaattaatgggtcaacttcaacggcaagccttccgcaaagcctatggtaagatttgggacctagctagggtagaagtctccatggaaccgattgcatcccttcccagtattatgaccagcccctaa

SEQ ID NO: 85525 - DNA, 549 bp, Glycine max
  Peptide Sequence Number=SeqID_177210
atgattatgaggggccaagacatttatagtagccaagatgaggctactacttcaccttcctctagtaaaagtgaagaagcaaaaggggaagaatctagtgaagagatctacccccaagaagaaggacaacctttaatggttaaggaggagtgtaaggaggtaagtgtctcctccaagaggttagctaagaaggaaagacattttgaaataaagacaaatattaaagaaatttcccttcttagacaacctccacattttctcctttgtaaaaagacacttgttagcattgccacatatcttaggcttgagtttattcctcaagtaaaggagttgttggatgagggtttggttcgcatgagattaaatccttgtgctttgttggtgcccaaaataggtattattaggcaccaaatccctaaaataggtggagtgatgaatgctttgggtggtgcaacactcttttgtaaaatcactcgtgcacccaacatcttcatgatttgtgtacatagggactcattaggaataatcaacatgaaaatacagaaaaag

SEQ ID NO: 85526 - DNA, 231 bp, Glycine max
  Peptide Sequence Number=SeqID_177211
atggcagcggaatggagaaggaagagagagaggagatgccacttcaaggagaagatgagtctagaagaagctcaccaccataggaggccatggataagagcttggaggaagaaggacatgaatgaagacaaagggagagaagagcacgaaattttgtgctctaaaagagctctgaaatctgaacccactaatccaagatcaattccaagattctccactaagtgtccttag

SEQ ID NO: 85527 - DNA, 198 bp, Glycine max
  Peptide Sequence Number=SeqID_177212
atgttcctcatattcaacagtgctttgaaaggacttgatgatactccacaacctaaatccaaggctgctgctaggtggattgttgttaagtgtaatagacaaaaaggaagcactgagtgcggttattacatcatgcactggatgtccacgataatcttaggatctttcagaaataatttggaaacgtattttaattaa

SEQ ID NO: 85528 - DNA, 189 bp, Glycine max
  Peptide Sequence Number=SeqID_177213
atgcttcaagaggttcttcttgatgaggatgtaaagaggaaagtgaatattgagtttgccaacttctccgatggaagagaaggttttgatgatcttgattctttaaatgatagaggggtgggaataggccaggccagaccaggctttaaaaggcctgagcctagcctacgattaatttttgaggcctga

SEQ ID NO: 85529 - DNA, 183 bp, Glycine max
  Peptide Sequence Number=SeqID_177214
atgggtgtccttgtcgctatagcattcggtagtgggcattttactctggctgtcttagctgttcattgcccggcaagtgatatgctgaaggtcgtatacgctcgagtagctgctcgttccgcgataggagcccaatggcgcaggcagtgggtcttcccaatcgatctgctatatgctcgataa

SEQ ID NO: 85530 - DNA, 132 bp, Glycine max
  Peptide Sequence Number=SeqID_177215
atgtcggaggtgctagcgaaacctttggggactaccacacgctgcggttctgcaacaacggcgattccggccactgaaatcgacgcgtgcccctgggctccgctggagcatgcagagttggagagagggtag

SEQ ID NO: 85531 - DNA, 408 bp, Glycine max
  Peptide Sequence Number=SeqID_177216
atggaagtgcccgcgcagaagcgtcatcaaacggctgatctgcgctttattcagataggttggcgtgccgccgccccagtgaagttggctgacgtgacgaccggcaaacagcggcgcgcgatgcacaatttcttgttcgagtgcatcaaggtattggtcggctttgtgctgctgacgggtcacaattttattgcagccgcagaaataacagagcttgtggcagaacggaatatggacgtagagcgacagcggacgctcaggatagcgcgcgacagcctgctgaaaatcatcctcgccaaaggcatcagagaactccagcgcggtggggccaaatcccagtcgatagatggtacagacatgctcactccttccgttggtgtcgcgttcgtatacggcggcccgttctga

SEQ ID NO: 85532 - DNA, 195 bp, Glycine max
  Peptide Sequence Number=SeqID_177217
atggcaacaagggtgacctctggtgtctcctcagcatctacctcgacctctggctatagctcctgggctttaggagcctcacctccccccaaaggagaaggatggactcctggccaggccgatgctgagccaggtcgtggatactctgcatcaccaggcataagccatggtggaggctctgcacatcggcactag

SEQ ID NO: 85533 - DNA, 579 bp, Glycine max
  Peptide Sequence Number=SeqID_177218
atggcagaaccatcgaagaagagaaagggatcatcctccagcaccgctgctactgcccatcgccgccacagaccatccgaagcacccacagcacctattcatccctctttgtcatctccaagatcatccacgttgttttcatccgatgatcagcgtctacggtacctttctcaattttcttctaggatcatcttagaccctaaatacctagacgtagatttctttaatgatgaaacgtttgattgctatcaagtgtttcaaaattctggcctgattgatttcatgtccttaaaattgccacattatcctgaacttgtaaaggtcttctactgcaatttaaaaattcaggatggcattatttcttctgagggcaccattgttgatgactggaaatttgattattctagtcatgatgctcgccgtatggtctgcaatgaccaagctgaaatgactgcctctgaggaggatttgattctaatgtgggctttccttaccggtcgtcagatcgaatgggctcacttggttcggtaccgaatgcataaggcattacgggccaatgcacctctcccttacccttaa

SEQ ID NO: 85534 - DNA, 526 bp, Glycine max
  Peptide Sequence Number=SeqID_177219
atgggtcaaatccaacgtcaagctttccgcaagacatatggaaagatctgggatttggctatgatagaattagtaccaactgtagaagaatttgaagggatcttgggatgcccgctaggaggaaggaagtcgtacctgatttctgggttatacccctccatggcaagaatagccaaagtggtcaaagtctcggtgcaagaattggaccgagtaaaacaaaatagaaatggggtggtcggaataccaaggaagtacttggaagagaaagcgaaggctttggaagatcaagatgaatgggcttcattcattgatgtcttagcattattggtgttcagagttgtcctctttccaaatgtggatgggctagtagatctagcggcaatcgatgccttccttgcttatcaccatagcaaggcaaggaaagtctggtcgttgatgttttggccgatgcctatgatacatttgaccggagatgtgagaggagcggtgcaaggattgtctactgcacacccgctctttatgtatg

SEQ ID NO: 85535 - DNA, 102 bp, Glycine max
  Peptide Sequence Number=SeqID_177220
gttcaaacacttgagatgccactaatctttggaaacactggttctggaagcacaagtcaggccagaaaatggaacatgaatagcataaggtgggaaggttag

SEQ ID NO: 85536 - DNA, 723 bp, Glycine max
  Peptide Sequence Number=SeqID_177221
gctacgattactcttcaagatgtgtcagtcttgttaggtcttcgtaatgagggggcaccattaattggtcagactaatcttgattggactgaattgtgtgaagaattattgggagtcagaccagaagaaggtgaacttcaaggcagaggtgttctatttgtggacaaaagcagtagtaaagtttcgctaaggtaccttcaatttttacgggactttgagcagtgcaacacaacgctgcatgactttggctccaaagagaattcctctataatggaaaacaaaccactcggacacaggtggctgcgacgtggaaaccaacatattggcaatgatgatctaatagttttccgtcgtaaattagatatgatgaaacgacatgagtttgtgtgggagccttacccaacaactgttatgtcgatgttgcctcccatttgtttggttggcagtgtggcgtggtgcgcagtggtgccactcatttgtttccatgttgtagagtggcaccaaccggatagggtgttgcgacaatttggaatgcaacaacctattccagagtctccttcgcaaccacagaatatccatgggctaacgctgaaaggcaaacaagatgaaaattggttccagctgttgggcccctttatcagtcagtggaataatcgagatgagtttagggtcgacatttatcctcgacaagagggcctattgagttttaactcggattacatg

SEQ ID NO: 85537 - DNA, 814 bp, Glycine max
  Peptide Sequence Number=SeqID_177222
ctcagttggaggtgggctacaggggatggtgggtttatgcgcgcattgtggatgtggaaaacttgttgtgcaccatcgcccgaccgccacctagtaccacatgtgatggggtgaaacttcctgcttttattgttgaccacagagtggtacctggagatatgtcgggggggtcaggagaccttggggacgtgaggcgagctcctggcagtcaacagataaaaggaaaacaagaccacaaagcaaggaggcttgtggtggctggccagctgcttggaaaacgaggtcaggaagctaatgaagcctctggtaatcgattaccaagggggtgtaatcgattaccaggcttaaaaagggaactggagttgatggaagctctgatcgtgatggcggcgcagctaatccgtgatcgagtagagatggagtgcctagagggagcttgggagaccctcgaaggcaacacgaggtgccgatttcggggcaccattcgattcacggctacttctttggtgcatccagatgaacctgcacggacgcttcagcgcactgtggagtggatactacccacgcctacaccatatcgtctagtggagcccgttcaagtgatcgaggtaacgtcatccgaggaagaccctgaggaggacctggaggagctacctcctgagcctgctgtggatgcccttgactttctagagggtgatgaggatccacttcttgaggtggattctctcgaggaagtcatgtcggcatctgaggcagactctacggaggatagcggcccgagggagatggcgatcagcggaggctcttcatccta

SEQ ID NO: 85538 - DNA, 498 bp, Glycine max
  Peptide Sequence Number=SeqID_177223
atgtacaattatcatgagaaaggaagagctcttgatcttgaaagtgtattggcggacttcatcacatatcaagctagctctaaagatgacctgctaatgcaattcaagggtacagtagattcaatgcaacaagcatttaaaagagctaagactcagattggtaacttggtggacgacatgattaaagttatggtcagaagagaagaagagtatgcagagattgaaacacatcaagaaagcattcttcaagttaacacaatacatcatcaattgatcaccaaagaagaaaaggatgaagtcttcgttattctagaatatccctgcatagcaactactggatatgttgtaggcaaaggtaaaggtcggttggaactcagtgtagaggatcagaaaatctcctttgacctctttgaagcaatgaaacacccaaatatgagtgatgcctgtcttgaagaagatgaggtggagcaggagatagcattatcagcttcaaccatg

SEQ ID NO: 85539 - DNA, 276 bp, Glycine max
  Peptide Sequence Number=SeqID_177224
atggcaatttcaacatgctttcaacaagtttcttcacaaataactatcatgaagcagaaaactagcaaaactacccatcatatctcccaaaaccccatacccacgaaattcaagagggaaagaagtccacccaaacctgaaatttcgaagtcccacacaaatgatggccaaaggttggagctttgtttggagcttcaatggtggatgaagaagaaggagaaaagcaacgtgagggagagggagagagagctgtctgaaatttgttggataagttag

SEQ ID NO: 85540 - DNA, 222 bp, Glycine max
  Peptide Sequence Number=SeqID_177225
atggtgcagttatggtttgggataagggtaaaacacttgcctgtgtgggaaaaaaccggtggaccattcggtcctgccaacaaatcttattcggagccccatgaattgattgtcattcatgcatcctccaccaacgggtctggagccccgcgaattgattgcctagcgctgttcatgcgtcctccaccatcgagtctggagccccgcgaattgattgcctag

SEQ ID NO: 85541 - DNA, 294 bp, Glycine max
  Peptide Sequence Number=SeqID_177226
atgaccggtttccttcggttttttccgacgttttccacaaataaacattggtggcgactccgtgcattttcctcctttggaagaggcacccgtgagcctcgcctcgctcgcccgcaaaagggtaggttgcgacaatctcacatgtacatcgccatgaaggatgcacaactcgacaacacctttttgttgatcacattatggagctatgacgaaactattgatccagatgaacatctagatgtgttcctcacccaggctaatctctacaccaacgatgatgcgatcctatgttga

SEQ ID NO: 85542 - DNA, 285 bp, Glycine max
  Peptide Sequence Number=SeqID_177227
atggacaatggagagagagttctaattctagttccaacagggagaactgatgaagataagttcatgatgatgctgctgaagaggagagggatagggatgcgtgataagagggagttcagttgcgtccaaaatttgttcaacttggatatgtcgatgatatacggcaataagtttgttaggctgccaagggatgaggaatatccttattttcttgatacgatgatggccaattttgtcattgacaacaacttaaaagccactttgtggggggaacaatgccactag

SEQ ID NO: 85543 - DNA, 282 bp, Glycine max
  Peptide Sequence Number=SeqID_177228
atggcaacggaatggagaaggaagagagagaggagacaccacttcaaggagaagatgagtctagaagaagctcaccaccataggaggccatggataagagcttggaggaagaaggagatgaatgaagggagaggaagagaagagcatgaaattttgtgctctaaaagcaatgtgacctctcccaagacatttgaagcattcaatgttgctagtcctttcttgggaactagtcttaggggtgtatttctctatggtcttacccttatcttacttgggttttga

SEQ ID NO: 85544 - DNA, 349 bp, Glycine max
  Peptide Sequence Number=SeqID_177229
atgacccgtgcctacatccagtccttaagcaacctcttgagatttcctttccttgtaaaaatcatttacaagcaaagagccacaaaggatgtaccctccattgttctctttgaacaaccaagtagatgtaccctctacttaaagcgaaccacaacggatgtaccctcccttgtgttcactattacaactaagaagctacccgcttcttacacagaattctcagacggtatcaactcgcccaggcgagctggttgcttaaggatgacgacatttcatggcccaggcgccggagatgctgtagatgccggagctgatattgaccatgttgtagaccttacaacagctcagg

SEQ ID NO: 85545 - DNA, 319 bp, Glycine max
  Peptide Sequence Number=SeqID_177230
atggagcaacctaagaattacctaaccctacccgccaagcaaacaaaaaattctcagctcatcaattgggctaagcgcgcacctatcactaagcgtaccctcagtgcacttagcgcaacaaaagaatctggcagagcattaatatcaaggccgcgcgctaagcgtgagatcagtgtgctaaaggcagcggttgtcttcagccaagctcagtgcatgaatgacgctaagctcaaatccacttactcagcacaccacaatgcctatttcgggaaaagagctctcgaggcagcaagaggagtagcttttgtagagagaccta

SEQ ID NO: 85546 - DNA, 663 bp, Glycine max
  Peptide Sequence Number=SeqID_177231
atgaggggagcaccaacggaagagagcctctcgcctttccttgtaagagatttcggcgtacaaagtctcaaggttatacaaagagtccacaaagggtggagaagtccgttgaggaaagacaaagagcttaggggcatccgtaaaggcgtcatcggtggttatcatggatggctaagagttcatacgcgagggttagattggctctccaagttgaaagttatcaatgaggagaacttcgaagctccagaggaagatgaagaagtccaagctctaaaattggagctagggaaagcaagactcgccaaagaaaagttcaagtcaaccgctacaaacatccggaaagagtgcaccgagttacgagaggaaaacgcggccactgcaagagcccttcaacaagaaaccaaaagggcccacaaggaggaacatggccgagataaattccgaggagctttgtggggtaacaacaatgagctcaagctccggagagaggaaatagaccagtcacgggtgcatggcatgatcttaaaggaagagttagctgcttgcgcaagatccaagaggagtttggctcaacacttggaagccacagagcaaagcatgctagctatcatagggaagtacaaggaagagttaaaccagtctgtgacccatgaacaaaagcta

SEQ ID NO: 85547 - DNA, 198 bp, Glycine max
  Peptide Sequence Number=SeqID_177232
atggtaccccacgtgccttttgatgaggacataaccaagggcaaggaccatgaagcacttgaagggcccatgaccagaggcaaacttaaacaagcccaacacatcatagagacaaggctggcccaagtggagaaagatgaaggcacagaggcagaggcactaccaagactactaattgttgttgaaggcccaaactaa

SEQ ID NO: 85548 - DNA, 333 bp, Glycine max
  Peptide Sequence Number=SeqID_177233
atgggggagatgcttgccacccagctcgcccaggcgagcaaggtgacttcctccagaagcaaccgccttctggaggaatcttctggagggcccaagtgggcctggcatgtcacggaacttcacgaattgcctaacaatgggtgccaagtacctcaaaatggtcaaatgaaagttgcatgccaccaagcaaagtggatgtatcctccactagaactgatccacaagagatgtaccctctcttgttcacagtcaaacccaagtagatgtaccctgtacttgtaccacaaaggatgtaccctccaatgtgttaagacaaagatctcaggcgattaa

SEQ ID NO: 85549 - DNA, 144 bp, Glycine max
  Peptide Sequence Number=SeqID_177234
atggagaattgcactaagcaatcactacgcatggctccaaactcgaaggattttctcgagggtggtgtttttggagaggaagctgggtgtttcggtcttttcctctttgttcatgtggggtgggatattgccagtcgagaatga

SEQ ID NO: 85550 - DNA, 480 bp, Glycine max
  Peptide Sequence Number=SeqID_177235
atgacgaagtcaatggtcaaaccaagaaacattctcctgactctgaaggagcacaatgccaataattgtacgaccatcaaacaaatacacaatgcaagaagtgcatattgttcttccattagaggaagtgatattgaaatgcaacatctaatgaagcttcttgaacgagatcagtatattcattggcatagattaaaggatcaagacgtggttcgtgatatcttttggtgtcaccgtgatgcagtgaactttcacataaacaagaacgtgaaggccaaatgtaaatcgttaattggtcaaagaaatgcttgtgaatatgtcatgaatgcctggggaactcttgttgattgtccttcagagcatcagtttgatgagtgcctaaagaggtttgaaatggtttgttcaccttggccaatgtttgttgattatgtcaaggatacatggataatctcacacaaggaaaaatttgttaccgcgtga

SEQ ID NO: 85551 - DNA, 336 bp, Glycine max
  Peptide Sequence Number=SeqID_177236
atgccgatctccccctgcagaagtatcagttggtctatgtcgtcccgacatagggatcacgaccacaagacacccagtggacccggaggagcccaacagggccctggggtttccagctttgggatcatgcccgtaagacactcagtggacccggagaagtccaatagggtcctggggtttccagctctgattacgggcctttgtcagttctacgaagtgcacgtcacccccagcaaggtcatcaggccccctaccaaccgagctttaatcaagaagtactgcgcccccaggaaggcgcagggcgagacaccacagcagcccgaagatggccgatag

SEQ ID NO: 85552 - DNA, 471 bp, Glycine max
  Peptide Sequence Number=SeqID_177237
gcctcattctttgatgttttagtgttattggtgttcggggtcgtcctctttccaaatgtggatgggctagtggatctagcagcgatcgacgctttcctttcgtatcaccacaacatggaaattctggtcgttgttgttttggttgatgcctatgacacatttgaccgaagatgcgagaagagtagcgcaaggattgtctgttgcacacccgttctttatgtatggctggtttctcacttttttggtcatgaaagtagacctgtttgtcacctacaaggtcaccacatgtgtgccgagaaagggaaagcaaattgggagcagctcttggctggtatggctaaagtccctgaggaaagcaaagacgtgcaagccttgaaagtgaaacttgaaaggacacaagtggtcaaggaaaagttcaagacgacagccatcagggtcaggaaggaatgtgatgagctgagggatgtcaat

SEQ ID NO: 85553 - DNA, 288 bp, Glycine max
  Peptide Sequence Number=SeqID_177238
atgagaggtgctaataccttcctcaaatgtaaatacaactcccgaatctggaatattcttcatgaccagtttccttcggtttttccaacattttccacaaataaatgttggtggcgacttcgcgcattttcctctcatggaagatgcacccgtgagcctcgcctcgctcgcccgcaaaagggtgttgagggaagaagcccagagtttcaagaacctctggatttgaggtcaaatccttttcaaggaggaggggatgatgcaatcctaccccctaagggtattggatag

SEQ ID NO: 85554 - DNA, 324 bp, Glycine max
  Peptide Sequence Number=SeqID_177239
atgcgaacatgctttagtaaagagacaaaacttccaactgatcagagcaacatatgctttttggatgaaaaacaatgtgtctatcgtttggatgttagcatttcgtttctaaatgaccatttagaggaaacactggattcaacaaagataggaaaaaatcactcaaagtgtattaatctcacacagggcaaggattatggtaagttgggattttggctcaaggcttgtagaacggctggtcatgatatatgtcagggtttggccagcggttcggggataaaggggatgtcctacattatttccatgatacacatgcaacaatga

SEQ ID NO: 85555 - DNA, 297 bp, Glycine max
  Peptide Sequence Number=SeqID_177240
atgtcgtcgtggcatagggattgtgcccgcaagacacctagtggacccgaagaaggccaacagggtcttggagttgccagctctaaatacgggtctctcaaggtcatcaggcccccctaccaatcgagctttcatcaagaagtactgcgcccccaggcaggcgcagggcgagacaccacagtagcattgggatggccggtagcgggcaatagacgcaccgccaccacctttagagttcacctctgctcatccataaaaaggtttgagtattgcctacaccacatggccgacccatag

SEQ ID NO: 85556 - DNA, 1069 bp, Glycine max
  Peptide Sequence Number=SeqID_177241
atggcgcgcccaggggtgcagctgtttgtctacggccgcgacggccagcagcagggcagcgcaccggcgcgctatccggcgcgccagacgcgtgaaccagcgcggcgggggtgttccacaaatgatgtaatcgccgtcagcaatcagcaggtttttttctgccacgaagaggcgtttgtcgaccagccccagctgctgcaacagctggcggcgcaggtgccaggcttcccagcccgatttgtggtgccgcgcgatcgcgtgtcagtggccgatgcggtgaacacctacttgtttaacagccagctgctgcagcatccggacggcggtatgcggctggtgctgccggaagagtcgcgccagcatcccggcgtgtggcgctacctgagcgagctggtggagagcggcggcccgattcgcgcgctgcaggtgtttgatctgcgtgagagcatgtgcaacggcggcggaccggcttgtctgcgtctgcgcgtggtgttaaccgaggcggagcgtcaggccgtcaatccggccgtgctgatgaacgatcgcctgtttacgcgccgacctggccgatccgcagctgctgagcgaagggcgaagcgcgctggacgagctgacacagctgctagacttaggcagtgtctacgcgtttcagcgttaacgccgggggcaaatgtgttgccccctgtgtcagaaaggaggcatactatccctgacaccgcatacgcccacgcagcaggcgctggtcctctccgccgggattcacggcaacgagaccgccccggtggagatcctcaacctgttgctgacgccgctgctgcagggggaaaaaccgctggccgtgcgcctgctggtggccgacgtgccggaggcgcagcgcgcgctccagctggagcaggcgctggagaacttctggtgcgagtgcctcgatcacgaaattcgctggcatctcgatttgcacaccgcgattcgcggttcgtggcatacgcgctttggcgtgatgccgctcaacagccagccgtggccagcagattttttacactggctggcagcggccgaactggaagcgctg

SEQ ID NO: 85557 - DNA, 228 bp, Glycine max
  Peptide Sequence Number=SeqID_177242
atgtaccctctacttgtaccacaaaggatgtaccctcctgtcgcaacctacccttcggcgggagggcgacgcgagactcgcgggatgcgtgttccacgaaaggaatacgcgcggagtcgccaccaacgtttatttgaggaaaacgtcggaaaaaccggaaaagacgcgatctacgaactttttagtgaaaggttcgggagttgtatttacgcacggggaaggtattag

SEQ ID NO: 85558 - DNA, 111 bp, Glycine max
  Peptide Sequence Number=SeqID_177243
atggaggcttcggaggaagactatggagatggaaatgggaaaaatcaatcaaggcaatatattgagggcaaaattacatctatgaatgttcagcctaaaaagaaaatatga

SEQ ID NO: 85559 - DNA, 231 bp, Glycine max
  Peptide Sequence Number=SeqID_177244
atggcagcggaatggagaaggaagagagagaggagatgccacttcaaggagaagatgagtctagaagaagctcaccaccataggaggccatggataagagcttggaggaagaaggagatgaatgaagggagaggaagagaagagcacgaaattttgtgctctaaaagagctctgaaatctgaacccactaatccaagatcaagtccgagattctccactaagtgtgcttag

SEQ ID NO: 85560 - DNA, 138 bp, Glycine max
  Peptide Sequence Number=SeqID_177245
atggaaaggaaggtggtttctgatggagggttgtgtggagaggaagcaatgaggagaggtggtttggcgggtgttgaagctggtatggcagccatggaaggcatccatggactctcaacgaaagcaccaaattgttag

SEQ ID NO: 85561 - DNA, 167 bp, Glycine max
  Peptide Sequence Number=SeqID_177246
aattgactgctgagccgtatgagtcagcgaaattctcaagtacggttctaaggaaaggaattgactctcctattccgaccgaggagaacaggccattcgacagggagactcggaagttgcggagtcttgatttaatcaggccgatgaatattggaaacgagctatag

SEQ ID NO: 85562 - DNA, 502 bp, Glycine max
  Peptide Sequence Number=SeqID_177247
atggggacaaatcaaatcgggaaaaagttctatcaagtcaagattaagggcctagatgtcaccagccttaaggagttaggacagttgatgggtcagctccagcggcaaacttttcgcaaagcttacggtaaaatctgggacctagccatggtagaagtctccatagaggccattgcctccctcgcccagtattatgatcagccgttgagatgctttacctttggggacttccagttgtcacccatggtggaagaatttgaagagatcctaggatgtcctctaggggaaggagaccatacctcttctcagggcgaatgggccccgttcatagacattctcgcactgttgatcttcggaggagtcctctttccaaatgtggatgggttggtggatctagcaacgatcgacgcttttctcgcctatcatgaccacaaggaaagcccggttgtcgctatgctagccgacctatatgacaccttcgaccgaagatgtgagaagagca

SEQ ID NO: 85563 - DNA, 231 bp, Glycine max
  Peptide Sequence Number=SeqID_177248
atgtcttggataccacttttccgaaaaatcctcctacttctcataaagtctctaagcaccgccgccctacctactcggaaccctcatctactcttcgagacaagagcatctagagcaatggctagtgacggaagatcatttttccctctcttgggactaagtgaagacagtcactttcaagcactcgcgctaaaactaaaaagatgcggcttagccagctgcactctttga

SEQ ID NO: 85564 - DNA, 315 bp, Glycine max
  Peptide Sequence Number=SeqID_177249
atgaccgcaatgctgatctccccctggggaagtatcagttggtctgtgtcgttccgacatagggatcgtgcccataagacacccggtggacccggaggagcccaacagggccctggggtttctagctctaattacgggcctctggatcgtgcccacaagacacccagtggacccggagaagcccaacagggccctggggtttccagctctggttacgggcctctgtcagtcctacagggcacccgtcccccaagcaaggattgtgcccgcaagacacccagtggacccgaagaaggccaacagggtcttggagtt

SEQ ID NO: 85565 - DNA, 570 bp, Glycine max
  Peptide Sequence Number=SeqID_177250
atgacaatgatagtagacacattaccagtattctactatggaaaatggtgggctacgcaccttcaaagctttgcggatttggtctttgccagtgaaaggatcgatctgggtctgaaaaaaggcaaatttagtcatcctgcttggacgaatgagaaaactggggcaaatgaagagggtggggatgaaggagaagcccgtgctgtgactgccattcttatacgaccaagtttcccaccaacccaacaatgtcgttactcagccaataaccaaccttctccttacccaccgcccagttatccacaaaccataaccccagccaaggttcatcaacctccatttctccgagaatacgactcgaacgccacgtgtgcttgtcatggagaagccccggggcattccgttgagcattgtagggctctgaagcgtaaggtgcaaggattttcaactttcaccggaagtgggtgcaagccattggtctgtttgctcaagcgacctgtgctcctgagtttggacttccaagaccgttcaatcagagattactcttcttgcacgttggtgggggtgccgtaa

SEQ ID NO: 85566 - DNA, 324 bp, Glycine max
  Peptide Sequence Number=SeqID_177251
gcacttgctagcattgccacacctcttgggcttgagtttattcctcaagtaaagaagttgttggatgagggtttggttcgcaagagcttaaatccttgtgctttgttggtgcccaaaataggaataatcaatatgaaaaatacagaaaaaagtgatcaacgggttcccatgaaccctaagagaataaaggtcattcctgagtggctcactccaccaagtgttgagggaaggagcccagagtatgaagaacctcgggatttgaggtcaaatcctttccaaggtggagggaatgatgcaatcctaccccgcaagggcattggctag

SEQ ID NO: 85567 - DNA, 110 bp, Glycine max
  Peptide Sequence Number=SeqID_177252
atgtggctccgcatgcccccggactcttgggtcacggtaacaaaaagtgtggtggtcgacaaaagcagggcttttgctcctacaatttgtgttgaggaactcagacctac

SEQ ID NO: 85568 - DNA, 381 bp, Glycine max
  Peptide Sequence Number=SeqID_177253
atggcagaatcgtcgaagaagagaaagggatcctcctccaccaccgctactgctggccatcgctgccacggaccatctgaagcacccgcagcacctatccatccttccttatcatctccaagatcatccactctgttttcttccaatgatcaacatctacgaattttgcttccccgattttcaaatttggctcaagcctctgaggaggacttgattttgatgtgggctttccttaccggttgtcagatcgactgggctcacttggttcggtaccgaatgcataaggcattacgggccgatgcacctctcccttaccctcaattggccactctgtttctctgtcattttcaaattccgcttgatgatgaaccttttgttcaa

SEQ ID NO: 85569 - DNA, 540 bp, Glycine max
  Peptide Sequence Number=SeqID_177254
atgggggttgatgaagacaaccatggggcagagcaaagcggcggtgtcctcgccctaggcacggctgatgtagcgggactcgccggcgacggggtcctgaagccgaatggaatcacgcattgcgtagcgcagatctcgaaaataccgcagccgcgaaacgattccacgagggacgaccgaaccgctatcttattcgtgtcactcgtggtcgacggtgaagccatcttcgcatgcgctgttctggttggtgtggaagcaaagcttcatgatgaatcaacaatgattcaaagctcaaaagatcaaagaacaactcaagtgaatcaaagaacatctcaagtgaatcaagaacaagtcaagagttcaagaatcaagaagaattcaagactcaagaagaaagtctacaatcaagaatcaagattcaagattcaagatctcaagaatcaagatcaagattcaagactcaagattcaagaatcaagatcaagattcaagactcaagattcaagaatgaagaaaagactcaatcaagataagtattaa

SEQ ID NO: 85570 - DNA, 210 bp, Glycine max
  Peptide Sequence Number=SeqID_177255
atgaccaaattgcccataccgataaaactcatagaggcagaatttggcaattttaactcaaacctaaccccaaagagagtgctcatcgccctggggggcgtttcacacaagcctcgaggtgatcatggtcagcctttagctttcagagctcctcctcatgccgttgctccatctacgcaatgcggttttggagttgctggagagtattag

SEQ ID NO: 85571 - DNA, 432 bp, Glycine max
  Peptide Sequence Number=SeqID_177256
atggcacatcagtgtaccagtgaagttttgctaaccattcatgaacaggttcatcttggtgacgaatgcatccaaccaattctccatcctatgaacctattgagtgaccgaaagagttctttccctccacgtcatgtcaacttcatcgggctttggcagatggtttcgatgggtcttccatctcttgggtgtttgtttgcttcatggcattcatctccctttgcagggcgagatcagggaatgattgtcaagcacttgacacaagatgttaaccatggttgttgggctcccattttcagaggaattgtcgtgtttgttataattgatgataatgatgcggtcaaaggaaaagtttttcctagccccatgatgggcaccaaatgttcttatcatatttggcaagaggttgctcacggtggtgctcctttgtga

SEQ ID NO: 85572 - DNA, 207 bp, Glycine max
  Peptide Sequence Number=SeqID_177257
atgcatctggtcatgggccctcaagtgcttcatggtccttgcccttggttatgtcctcatctgatgcaatcctaccccgcaagggcattggatagaagactccaagtagattgggctagagatccaagggaaggccctagggttctcatgagtcttatggtagattttgagcccatggctaaatatgagcccgcttatcttttgtaa

SEQ ID NO: 85573 - DNA, 474 bp, Glycine max
  Peptide Sequence Number=SeqID_177258
atggggtttccaagcattagagagaaggagaagggattacaaccttcattgcactatgtgcatgcgatgagcatttctccctccatagacattattttgcacatcccaacggtgaagattgtagaagcaaagcttcatgatgaatcaagattgattcaaagatgttttgatgataacaaagatgatgacaaaggtgatgacaaaaagctcaaaggtcaatcaaagaatgagttcaagatgttcaagatagaatcaagaacacttcaaaactcaagaggaaagttgaagaacacttcaagattcaagaggaaagttaaattcaagaatcaagaatcaagattcaaggatcaagcttcaaagaatcaaggatcaagcttccaagaatcaagatcaagattcaagactcaagattcaagaatcaagagaagacttaatcaagataagtatgaaaagtttttttttttcaaaaactaa

SEQ ID NO: 85574 - DNA, 1351 bp, Glycine max
  Peptide Sequence Number=SeqID_177259
atggggaaaatgcgacgaacctggaacgctcttccagaacaacttattccggaagtttcttcaaaagaagtggttcttccggaagatgagcataatgcggttgatgttccccagaggcgtaggcctactgcattagcccataggcaacaggttcatcagatgactgaggatgttcctcacatgattgaggatgtccctcatatggctgaggatgcacctgagatgattgtgcacgtacaggctgatgatggtgctgaggggtcacatgctgatgatgctaagggattcccaggtgggccacgtgacccatcaatgctgacttcatttgcggaccatgttgcacatgccatttggattggacaagaacgtcctgagttgaagttggtgtcacacgggaggaaggtgatattaattgggaggccagtgcttgagattgaaggactggttgctgccacaggattaagtccattgatcgggtgttcagttgttattggcgttcttggacttatattcgcatttgtggagaggtggcacagggagaccagcaccttccaccttccagtaggaaagttgacgatcacactggatgccactcctccatctgcctatcagtggcgccttccacagctttcatgctctttctgtggacgaggcgatatttttgttgacagagtgagatgcgaggcacgacgatggattgtagcagcttgtgcttatctgctacacctaggagttgccgcgctggttcatatgtgtgaccagttagatgaagcttctaggaccacgacacggcagattaggtggtacctgactttattacatcactttccgagtgtgcatcagtgcgtcacagatgatgcgtacgaggagacgtccccacgtgctccccggtggctaacgacaaaggcgcatatgaagggaattacaggagcgccataccgggcacgttgtgatgctttgacgggtcagctgagatgggatcctatggtggtcacagttcgactggagagggtgctacggcagtttggttacattcagagcatccctccgccgcctgtatctgcggattacatggagtggtttttccaaatatcccaccaattcatgataccaacccaggaaggtgaccagcccagacatgcacctgccccagaccatgaggagtacatgcagccagccatcccacaggcgatcgcagaaaggttggagcgtgtgctcaaccttaggatggtcactacaggcacagagttacaagatattatgcaaacttgcctcacgatcgccaggggggtgccagtgcagatggaagtgtcagggctcgacagagacggcgcacagagcattgattatt

SEQ ID NO: 85575 - DNA, 198 bp, Glycine max
  Peptide Sequence Number=SeqID_177260
atgaatagaaaaaataacaaaaattttgataatagaagggagacaccacaattcaagagacttgataagccaaaaagaaagattgccacaagagtcaagacaaaggatcaagctgaatgttttgatgatgccaaaggttcacatgcgtctcaaagctttattcaagacaaagaaattaaagatattcaagatggatga

SEQ ID NO: 85576 - DNA, 411 bp, Glycine max
  Peptide Sequence Number=SeqID_177261
atgatgttaggtggaggaaacatcgacgacgacaaaagaggtgctgctttagtcgaggtgaaagtgttactagtcggtggtgattgttgtggtggttggttcatcgtcggaggtacaccagatgaagttgatccgtatgttgatattacacatacggatcaagttgtgtttggtacccgagatgatgttttgcagtgggctcaatcagttgctcatgtaaatagatttgtggcggtgattatgagttctgacacaaacactggtagtaaaggaaggacttcatttgtgttaattggttgtgaaaggagtggtcagtataggtctaggaagaaagattttgttagaagagatactgagagtaggaaatgtggatgtcccttcaagcttcggtgggataccagtggttggatg

SEQ ID NO: 85577 - DNA, 405 bp, Glycine max
  Peptide Sequence Number=SeqID_177262
atggttgaagctactcgatcaaaggcaagtgttgatcgctgggaagaggcattcgcgagactctcgtcttccatgtcttccaagttcaatgagctcctacaccatatgactcagctagagacagcgcacgcttcgccaagcttggatattcaagatgacacagttcttcgagtatcatgcaactccagatcacgaaagactcaccataacatctttttacatggaaggctcagcattagcctggtttcaatggatgcacaggaatggtcaattatcttcgtgcctcactcattggttcaagcagtctcctttgctagactacatgaggaaaggatgctagataggcgacgatcttctgttcgaacctcccctagttcatcgtacatgaggaaaggatatcactag

SEQ ID NO: 85578 - DNA, 1707 bp, Glycine max
  Peptide Sequence Number=SeqID_177263
atgaaaagagaaaaagatgccttctatagtagtcataactcttgcaagagcctaagtgaagaacttcgtgactattacgaaggaaggcataggtcacatcttagaccccactcccatagaagagaaaaggaaagaaaccctcaagaggctaacattaacctcccatacttccatgggaaggacaatgtagaggctaacttagtttgggaaataagggtagagcaacaacttaaaaagaagtctacgtcaaaatcttatggctctcactcttatccaaagaaagaccaaggtcaaggcatcttaggggacaatgtagaggctaacttagtttgggaaataagggtagagcaacaacttaaaaagaagtctacgtcaaaatcttatggctctcactcttatccaaagaaagaccaaggtcaaggcatattaggggtgaagcccaaagatgataaggggaagacaatagaaaagcaagcccctaaggctagtatgcaagagaagactagctccttgaaatgctttaaatgtcttggaagaggacatattacatctcaatgccccatcacaaaaaccatgattatgaggggccaagacatttatagtagccaagataaggctactacttcaccttcctctagtgaaagtgaagaagcaaaaggggaagaatctagtgaagaaatctacccccaagaagaaggacaaccattagtggttaaagagaagtgtaaggaggtaagtgtctcctcccagaggttagctaagaaggaaactcattttacaataaagacaaacattaaagaaaatttccctcgtagacaacctccacattttctcttttgtaaaaagacacttgctagcattgccacacctcttgggcttgagtttattcctcaagtaaagaagttgttggatgagggtttggttcgcaagagcttaaatacttgtgctttgttggtgcccaaaataggtattattaggcaccaagtccctaaaataggtgttatgatgaattttttgagtggtgcaaccctcttttgtaaaatcactcgtgcacctaacatcttcatggtgtgtgtacatagggacccattaggtagtgatcaaggggttcccatgaatcctaagagaataaaggtcattcctgagtggcccactccaccaagtgttgaggggaggaggccagagtatgaagaacctcaggatttgagctccttcttccatggcttattccctagtggatggcgcctcctctcacctcttctcctttgtcttccgctgcatctccatgatggaaaaccaccattaaaggacctcattgaagctcaaagatccagccttcatagaagccccacaagcaagcttccatcaaataggtttggcaaacctccccacattgtgaaggtgttcaaggagacacacactaggaaaaaggacaatacttgggtggataagagatcagagcaaaaacctatggagactttcgaaagaaattacaggaatgctctagtggtgggatgtaggcaattaaacctgcatcaagagggagactttcgaaagaaattacaggaatgctctagtggtgggatgcaggcaattaaacctgcatcaagaggtaaattgtgggatgatgttgctggaggccttggggacgtctttatggggttggaaacatgtcctcccattataggcttagtgtggaaacagtaa

SEQ ID NO: 85579 - DNA, 153 bp, Glycine max
  Peptide Sequence Number=SeqID_177264
atggaggctggatctttgagcttcaatgaggtccttcaatggcaaaggagaagaggagaggggaggcaccatccactagggaataagccaaggaaaaaggagcttcaccaccaagaattgccttggataagaagcttgaagaggatgctttaa

SEQ ID NO: 85580 - DNA, 126 bp, Glycine max
  Peptide Sequence Number=SeqID_177265
atgaagaaagagtgtcccaaggttgcctgtggaatcgaccaccaagtgatgatgaaaggttcttctttgtgggtgatggcaagaaggttgcagtggaagctattggaacttttagattacagttaa

SEQ ID NO: 85581 - DNA, 423 bp, Glycine max
  Peptide Sequence Number=SeqID_177266
atggtcatccgcaccctttgctatccagagacaatcaagtctaatggcacgtgcagaggaaacatggtcatccgcaccatttttgctatccagagacaatcaagttcgatggcccgcggagacaaaacatggtcatccgactttttgcaatccagaggcaatcaagtccaatggcacgtagagacaaaacatggtcatccgcaccctttttgctatccagagacaatcaagttcgatgacacgtggagacaaatcatggtcactcacagcttcagcgcgcttagcacgacagaagaatctggcagggcatcaatatcaaggccgcacgctaagcgcgagatcagtgcactaagcatattagttgtcttcagccaggctcagcgcacgattggcgctaagcttaaatccacttactcgcgctaa

SEQ ID NO: 85582 - DNA, 430 bp, Glycine max
  Peptide Sequence Number=SeqID_177267
gacaaggcatcatctaaggaggtgggagttgatagaaatgtgattagtgaagtggggcctaggccaagggtgtggagagtttataccaagaaaaagacaaaaggaatgaaagatgatgacgtggctgatttggtggggtcgcctttaggtgatttaggagcactgcgtgcttgggaattggttgctattaccagcaatttacttcctctggacttagaaattgaagctacattgcgaaggaacagggtcgagaggagaaggaaacttctgcaagacagaacagttgcatccattcttgaggaggagactcatttctacgacttattatcacctaattcaccatcatcaagggaatctgccactcaattacctgaagccattaccatggcagaagagtatgaccagaggattacccttgaggattattcaa

SEQ ID NO: 85583 - DNA, 804 bp, Glycine max
  Peptide Sequence Number=SeqID_177268
atgaaaagcgtaattgcagcggcggccatgtcgcttgttatttctgattttgctactgctgaggaaacaaaaggtaaagcgatgatgaaaattgaaccttcaacaatttcggaagctgatattcgttccgtctcaccggctcttgcgcgctttggtcgagaagcgattactgaagatctgtggacacgcgatgccctctcgcccagggatcgtagtatggtgaccgtcgccatgctaattgccagaaaccagcctggcgaccttaagcactatatagacattgcccttgataatggcgttacgccagcggagttgtcagaaatcattacccatctggcgttctactcaggttggtcaaatgccatgtcagccgtcagcgtgaccaaagcagtatttgaaactcgtggcgtcacggcagatgtacttcctgaagcttctccggacctgcttcctctcaatcaggaagcagaaaagcagcgttcagagacagtggaaaaaaatgttggcccaatatctccgggcctggttaaattcactacagatccactgttcctggatctctggcaaagacccgcgctgaaaccccgcgacagaagtatgattacggtcagcgcgttaatcgcatccggacagagcgcgcagattggctatcacctcaatagagcaatggataatggactttctgttgaggaagctggtgagatcgttacccaggccgcgttctacgctggctggccaaacgcatttactgctgctccggttgtcggagaggtgctaaacaatcgatcatcgagtaaaaggtaa

SEQ ID NO: 85584 - DNA, 333 bp, Glycine max
  Peptide Sequence Number=SeqID_177269
atgggtgaccaaaatgaagtacaggaacagatgaaagtcgacatgtcggctttgaaagagcaaatgacttccatgatggatgccatactagggatgagacaactaattgagaataacgcggccatcgccgccgctcttacccctatggattaccacctaattacacaccaccagtcatacgtgatgacgcgggtcatatccctccccccatccttgaaggggagcctcctcgacagtcagacgaggtccacgaggatcgtcgagagcatgcccagggagacatcgattcctactccctgttccccgccgaggggccggcacccaacgcgctaa

SEQ ID NO: 85585 - DNA, 204 bp, Glycine max
  Peptide Sequence Number=SeqID_177270
atggagaataagatgaagaacaaggaattaaactccattggagcttgtaggccttggatcttcttcatctttggagtcctttgcttcttgaagatcttggaagcagaatggagaaggaagaaagatgattggagatgccacttcaaagagaagatgagtcaagaagaagctcaccaccataggaagccatggataagagcttga

SEQ ID NO: 85586 - DNA, 225 bp, Glycine max
  Peptide Sequence Number=SeqID_177271
atgaagaaaaagaaaaagttgaaaaaaataaaaaagggaaagaaaagagtagaagtgagaaagcaagatgtggaagcaatgccttccaagattattttgatgatgccaaagaatcaagagtcaagcaagtttcaagaatcaagatcaagattcaagattcaagaatcaataatcaagaatcaagattcaagaatcaagagaagactcaatcaagataagtattaa

SEQ ID NO: 85587 - DNA, 367 bp, Glycine max
  Peptide Sequence Number=SeqID_177272
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtgcgccgatcccgtggccatcagatatcgttccgtctggctacgtcctgatgcaggggcaggcgtttgacaaatcagcctacccaaaacttgctgtcgcgtatccatcgggtgtgcttcctgatatgcgaggctggacaatcaaggggaaacccgccagcggtcgtgctgtattgtctcaggaacaggatggaattaagtcgcacacccacagtgccagtgcatccg

SEQ ID NO: 85588 - DNA, 739 bp, Glycine max
  Peptide Sequence Number=SeqID_177273
atggcgttatcctcgcaaaatggcgctcaggcctttggcgccggcgtacgcttcggcgaaggccagcagatcgggcgcgtccagcggcgtgcgggcggcgcggtaaggttcgccgagcaggtgatacttgttgatgcccagcgtgtgatacggcagaaaatggatctccgacacgccgatctcgtcggcggcgaagtcgacaatcgcgcggacagagtggcgatcggcgttgaaatcggggatcagcggcacgcgcacggtcattggcacgccgtgcgccgccagccggcggaaattgttcatcacccgacgggcggagccgccggtccaggtgttgaaacgcgcttcatcggtgtgtttgagatcggccaacagcagatccagccagggcaacgaaggggcgatgtaacgccacggaacgtgcagacaggattcgacggcggtgtggatgccggcttcgcggccgcgccgcagcagctccgccgcgacctcaggctgcataaagggttcgccgccggacaatgttacaccgccgccgctgcgcaggtagaaaggcttatcccgcatcacctcggccatgatatcgtcggggttgacggcgctgccgcacaggctgagtgcgccggtcgggcaggcggcggccagcgccgaatagtcgtctgcgctgatgacatcgcgccgcaccgtcaatgctctctcgtcacgccgcaggccttgtgggcagcgctcggtgcacagc

SEQ ID NO: 85589 - DNA, 204 bp, Glycine max
  Peptide Sequence Number=SeqID_177274
atgccggatgaaactcatatcgtcttcaagccgagtgatacgagaatccatcgcatcaaagcgctcaccaaaaatgctcgaagatcacggagctccttgaggacttcagtcaagagtgaagaagaggcatcctgttgcggtggtagagacagtgtacactcatctaaaatgggaggtggcaggtcttgcttgcgcacccattga

SEQ ID NO: 85590 - DNA, 138 bp, Glycine max
  Peptide Sequence Number=SeqID_177275
atgggttgcttaaggaggaagcaactaggtggcaagctcctccacgttgttgaaaatgaaaatccaagccgatgtgcttccgtaagcgattttgtggaaattcttcatcgttctttgtcgttcttcagtcttcaaccg

SEQ ID NO: 85591 - DNA, 549 bp, Glycine max
  Peptide Sequence Number=SeqID_177276
tggacgaggtacatttgaaggataacctcacctataaagcacaacctcagaagatcactgatcgaaggatgaagtcactaagaggaaaggagatcgcgttggtgaaggtgcagtggggaaccgatgagggtgattcaacatgggagttcgaggatagggaaaagtgggggcaagatacgtgggttaggctgattaaggaagagaaatccataactggaagagaaacgcgagggactggaaccagagaaacggcacgcaaactgaggcaggactttggcatttcaaaaggtcagatttttctcttcatgtggctgagcatgagtcacatcaagagaaaagtgggccttttgctccactcaaatggagacatccaaagaaaatttcagaaagctcttctctctctcacgttgccattctcttcttcttcctccaccattgttgcccaacaaagctccaacctttggtcaccatttctgctccaaatcgcgaaaggaaggcattttcggagtcgtgaagcgcatctctacgtgtgggacctcgaaatttcag

SEQ ID NO: 85592 - DNA, 288 bp, Glycine max
  Peptide Sequence Number=SeqID_177277
atggaaaaaccgccagcaacgcggccttttacggtcctggccttttgctggccttttgctcacatgtcttctgcgttatcccctgattctgtggataaccgtattaccgccttgagtgagctgataccgctcgccgcagccgaacgaccgagcgcagcgagaaacagctatgaccatgattacgaattcgagctcggtaccctccttttcctacaacttcttggaatggacaacaatctttcatttgtggtccttttcttagaacttcttggaaaggccaagcattaa

SEQ ID NO: 85593 - DNA, 354 bp, Glycine max
  Peptide Sequence Number=SeqID_177278
atggtgaaagttggaacctcttacgtgccgatcaacgtctcattttcgccaaaagttggccccagggcttcccgtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 85594 - DNA, 381 bp, Glycine max
  Peptide Sequence Number=SeqID_177279
atggtgaaagtgggaacctcttacgtgccgatcaacgtctcattttcgccaaaagttggcccagggcttcccgctgtccctcctgttcagctactgacggggtggtgcgtaaacggcaaaagcacccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaa

SEQ ID NO: 85595 - DNA, 75 bp, Glycine max
  Peptide Sequence Number=SeqID_177280
atgggtgcagatgacaacggtgtagaagacgacgttagtctctacatgctaccggactctgagtctgacggatag

SEQ ID NO: 85596 - DNA, 324 bp, Glycine max
  Peptide Sequence Number=SeqID_177281
atggaggatgagtgctctgaggccactatcccagagccatttactacagaggaggaggcagacgacacacagacgacacaggtagctgctgccactcctgagagatctcttgaggccattttagagcccccaacaccatcagtggatccatcttcaccccaacacgcaacaaacccttccactcctgtcttagagatacctgagggccagaccacaccagtcctgactctggatacttctcctccagctactccagtgcttcatctgacagacgaggaggatgtgcagacacaggacactcaagaccagtcacatgaattttga

SEQ ID NO: 85597 - DNA, 483 bp, Glycine max
  Peptide Sequence Number=SeqID_177282
atgagcctaaaccgaggtcaaagcataaccacagacatttatcgataccctataattgtcgggtcagacatgttcaattaccaggttgttaccattaatgacaatgaggatattgatgacatgttcaatccctccgacctaaatgtccaaccaactactcaaatccatgttgctcaatctcaaagtaatgaaatatcacatgactatcatgctaaaaacgggttgccggatgaagtagttggtgacttcagtgacaatgaagatgaaattttggcggtcaatgatgacaacaacatcaacgacaacaatgataatgacatccaatttcttttccaaccggcaacaactaaaaatgtctatcgtccatatccaaattgcgttgatattggtgacaaccaagtgattgacaatcccaactataggcattttttggacctaccacaacaatctaaatcacaggatggtgagctatatgttggttag

SEQ ID NO: 85598 - DNA, 186 bp, Glycine max
  Peptide Sequence Number=SeqID_177283
cttggaggggttgatggggacccggggctgagaggaatgaggagaaggctacaacgtgcacgtgagctaaatttaaagagtggtacatggacatatgtcatgggggtcaggagaccttggggacgtcaggtggggtgctattgcccaaaaccaagcttggctaatcccgacccaacccgagcatag

SEQ ID NO: 85599 - DNA, 144 bp, Glycine max
  Peptide Sequence Number=SeqID_177284
atgaagaatgattttgttggttataggaggttgttgtatgaggacactggatcattgaggtctaggctgttgtacggtaattgttgtggagacggtagttgtagttgtggacatgactattgtggagatggtggttgtggttga

SEQ ID NO: 85600 - DNA, 162 bp, Glycine max
  Peptide Sequence Number=SeqID_177285
atgggtaaagattcatggtctttggatcgtaaccattttcttaaagaacttgcaaaatggtctgatggtatatcaacttgcttggtggcagacagatttgaggaattaaagcagtccctacttgttgagggattatccatggttaccatggataagtactaa

SEQ ID NO: 85601 - DNA, 300 bp, Glycine max
  Peptide Sequence Number=SeqID_177286
acttatcaaggtaatccttgtggcgtctaccctgacttatcttccttaaccggaagtggcgtctacccagacttatcttccttcaccggaagtggcgtctacccagacttatcttccttcaccggaagtggcgtctaccctgacttatcttccttcaccggaagtggcgtcatccaaaaactctacagcctgtatcaagtgatccgccccgtaagattcacatcatctggtatcagagcttcggctcttgatacagtgggcctcaaacagacaaccgtagcaaaagttatgagcatttga

SEQ ID NO: 85602 - DNA, 171 bp, Glycine max
  Peptide Sequence Number=SeqID_177287
atgaaagtagatcaggaaaattgtattaagcctaagctatttcatggaaaccttgcctcaacaaagccgtggaacggtggaagggaagaggcggagaggccgagaggggcagcggcggcggcagcgcacaacgcaatggaagaagaggtgcaaccgcacagttcaccgtga

SEQ ID NO: 85603 - DNA, 153 bp, Glycine max
  Peptide Sequence Number=SeqID_177288
atgttgggtgcaccagtcataatgttgggtgcacctaacaacacccttgtcatgttctcaccaaaccgatgcaaaagaaatttcagaaactcagaatttcagagatgtgctggaagaggggggtttagaggatgtggcctcagtattccttaa

SEQ ID NO: 85604 - DNA, 1488 bp, Glycine max
  Peptide Sequence Number=SeqID_177289
atggcgcatcataacaatattagggtttcgatttgcttcctcttcgcgtcatcccttctttctctcttcgctcagatctcctccgggaaggagttcgttctcactttgaatcgctccaacttctccgacattgtcaccaaacacaacttcgtcgtcgtcgagttctacgcgccttggtgtggccactgtatgaagcttgctccagagtatgagaaagcagcctctatcttgagtagcaatgatcctccagttattttggctaaagttgatgcgaatgaggaaaagaacagagaacttgcaagccaatttcaggttcagggatttccaactattaagattctgagaaatgggggcaaggttgttcaagattacaaaggtccccgtgaagcagatggtattgttgactatttgaagaagcaaagtggtcctgcaacaactgaaattaaatctgcagatgatgctagtgctttgattgacaaaaataaagttgttattgttggggtctttccaaaattttctggggaggagtatgagaatttcaatgcattggcagataaattgcgttctgaatatgatttcagtcacacattgaatgccaaacaccttccacgtggagaatcatcggtgactgggcctgtagttagattattcaagccatttgatgaactttttgttgacttctatgattttaatatggaagccttatcgaaatttgttgaagaatctagtgtccctattgtgactgtctttaacaatgacccaagcaatcacccttttgttgtcaaattctttgacaatccaaatgtaaaggcaatgatgttcttcaacttcactgttgacaatgcggattctctcaaatcaaaattccgtgaatctgccgagcaatatagacaacagggcataagctttctagtgggagaccttgaggctagtcaaggtgcattccagtattttggccttaaggaaaaccaagtgcctctaattgtcattcaacataatgatgggaaaaagtttttgaaaactaatgtggaacctgatcacattgcaacttggttgaaggcgtacaaggatggaagtgttgaaccattcaagaagtctgaacctattcccgaagttaacaatgaatctgttaaagtagtagttgcagacaatcttcaggacattgttttcaactcagggaaaaatgttttgctggagatttatgctccttggtgtagtcactgcaaaaagttggctccgatattggaggaagttgctgtttcatatcaaagtaatcctgatgttattattgcaaaactggatgcaactgccaacgatataccacgtgatacttttgatgtacaaggttatccaacagtgtacttcaggtcagcaagtggacagatatcacagtatgatggaagtaggaaaaaggaagacatcatagatttcattgaaaagaaccgggataaagtggatcagcaagaatcagtaaaagatgagctttga

SEQ ID NO: 85605 - DNA, 606 bp, Glycine max
  Peptide Sequence Number=SeqID_177290
atggaacgtgtatttgatgtactgagaaatcataggaatttgggcaacaaggacgatggaggtcgaaaaaagtcaggattgaatgttgcaaccacagtgttgtctacaagcttcaatgttcatgtcacatcgagaatgtcaaaaaccgtatctaattatagagatcgtgatatggatgatatagtggatttgtgcgctaaagatagagccactagtcatggagctgaaactactatggatgatgatgaagtgatgagtagagaaacaaataaagtggaattcatgggtttaggtgctagtgctactatagacttagaagaaaatacaaaaggaaaaagacaaggttcaacttcttttgacacgcaatctcacaagagaaggatgggagaaaaagaaggaataacagcttctttggataaaatgaccaactcttttgatcgaatgatagaaaaaatggatggtaaagtcgatgatgaagatattcaagaagtgttacgtgagacagctttaataccagatcttaatagacaacaatgggataaagctattaagtggtcaggtgacaatccaaagcaattagctatcgtgaaagcccttccaatttaa

SEQ ID NO: 85606 - DNA, 1212 bp, Glycine max
  Peptide Sequence Number=SeqID_177291
atgaacaattgctggttcagagtgaaaacaaatgtagcaaagccccacaagggtgagattggaatagtgtttgaacaccctacccaaccagcaaaccaacccggtggttggatggtaaaggaaaaacatttggagaaatcactagagaaattaccaaccctaagaaagagtggttccacacaatccatgaacacatcctcaaaaatgttcaccatctctgaagtcaaaaaacattgcacctctgactctacttggatcatcatccatggccacgtgtatgactgcacccgcttcctcaaagaccaccctggcggtgtcgatagcatcctcataaatgcagacaccgactgcactgaagagttcgatgccatccattccgacaaagcaaagcaaatgcttcaagattttcgaattggcgacctcatgagcacatgcagggcaatggctacacctcatactcatcacccaacaactccgtgcatgacaatttcgaattcgccaatttgcctcttattaaggaaattaatcaccacaccaccaccaccacgcgagaaaatctcatgcaaactcgtgtcaaagacttcgatttcccatgatgaccaacttctaggtttacctgtgggaaagcacattttcctatgcaccaccatcaatgacaagctatgcatgcgagcctacactccaacaagtagtgtggacgaagtagggttttccgaacttgtcatcaaggtttacttcaaggcgtgcactccaagttcccaaacggaggactcttgtctcaacatttggactccctccccattgggccacatagagtacaccgcaagaggcaacttcttggttcatagaaagcaaagattcgccaagaggctagccatgttggctaatggaactgggatcacacctatttaccaagtggcgcaaacgattctgaaggacccagaggaccgcacaaagatgcatgaggtctatgcgaacaaaactgaggatgatattttgttgaaggacgaaatggatgtgtgggaaaaaacacattgtgatcgattcaaggtgtggtatgtggttggaactgctagggagggatggggatacagtgtggggttcatcacagaaagtatcacgagggagcaccttccagaaacgtcaagggatgccttagctttctttgacttgtggaccaccacctatgattcaattcgcagtgcaacctaa

SEQ ID NO: 85607 - DNA, 288 bp, Glycine max
  Peptide Sequence Number=SeqID_177292
atggacgaagatcaatggacgtatgactatacgatgtcacaagaagttcatatggattatgataatgaagaagaatgtggtgtgaatgaaccacatgttgattgttcgaatgcttttaatacctgtcagtgggctcgaacagttgcccatgaaaacggatttgttgcagtgattatgaggtctgacacagatactagtagcagaggaagaagttcatttgtgttaattgggtgtgaaaggagtggcttcgtgggaaaccagtgcatggaggggaaggttggatggtga

SEQ ID NO: 85608 - DNA, 120 bp, Glycine max
  Peptide Sequence Number=SeqID_177293
atggtacccaattgttcttctccgtgcggtggtccgacgacaagcaaaggcggctcgtggtggtcaccagtggtcagtggtggtggaggaggaggttgggggtgttgggggagggtttag

SEQ ID NO: 85609 - DNA, 378 bp, Glycine max
  Peptide Sequence Number=SeqID_177294
atgaaagaaaaaactcagatcctcaagaacctatgcttcatgagtcagtacctttgcggatatctacaagagaaaggagaaagtgctattctagatgattatgtggtatttctccaggaacatgagaaaaataatggtatgatggaagatgacccagtcaacttccatcaagccatgcaagattccaactcagaaaagtggattgaagcaatgaatgaggagtataagtccatgcaagacaacaagtttgggaacttgtccaattaccaaagaccaagcaagattccaaaggtaatgtggagaggtataaggcttgtcttgtggcaaagggctatacctaaaaggaagggattgactttaaagagactttctctctag

SEQ ID NO: 85610 - DNA, 423 bp, Glycine max
  Peptide Sequence Number=SeqID_177295
atgtcgcattttaacttttaccactacaagaaaaatgatctatacctacggacaaaaactgtcattataaataaaaaatccgtagagctgaagggtgataaagctgcaaagagtggtgaaatagaagtagagtcaggtgatgagcataaccacacagagaatcataaaccatgcaacatgtccaaggagagtggaaattcaatcctaatcccacacaagggtcaaggaatagctgaaaaactcacattggggcttacatttcgcttatggtgcctgatgggacttctagttcccagggtggtgtcaaaaagttggaccttcaatgtactgagaaaacacaacagcaaaccattgaaattagtgcatttggaagattttatttacaacttatcttatgacatacatacttatgtaagtatttga

SEQ ID NO: 85611 - DNA, 1028 bp, Glycine max
  Peptide Sequence Number=SeqID_177296
atggcacctcgccttgacccccctccatggcaagcccccttccacgcccccgagttggcaccttggttgacagtcccatcattggtaacaactgccagaatgggtttgctaacatcactgcatgctaagtgtgccaatgtcggtcatgcgaaagaccacgacgacctgctcgattacgaccttggacaacttcccaaacagcctaaacacctcccagaatcccttccttgcaagtctcggcttccaaaagcacatggaaaacgttgctttggatttcggaggaacttaagaggtgggaaatatcctctcaacccaaacgcccaatcttattattcgacaccaaataatcaagtattttatgatcctcgttttatccatcactacgtgcctccttctaatttgggggtttaccctccgtctccgtttccgtttccctgtgatcagaacgtgaaaacggttcaagtgtgggccagggttagaggaaggaagcttctagctgagaataatgctagggcaaagcctcttggtaatcgcgcagttccgtttccaaacaccgttcaagaagctaagacctcttctatcaccactgtcatgattcgcaatattcctaaccaattcaagtttgaagacttgcagctaatactggacgagcattgctttaaacagaacaaaagcgctgaggatcctaaggcttggtccaagtttgatttcgtttatttgcccatggattatgggaaacatgcgatagagaagaaaaagtcgaatttgggatacgcgtttgtgaacttcaccactcctgctgctgcgttcaagttctacagcgagttccaaggtttcgagtgggatgtcgccaaaaacaagaagatatgtgaaatcaacgtggctcagtatcagggtggtgcattacagaatcgacaactgggtttgcaagcgcagtgggtggaggatggtggctcgattccaatgacgagtatggaggatgaaagaagggagagagatgagtctgatgacaatgggtgggtgagacg

SEQ ID NO: 85612 - DNA, 330 bp, Glycine max
  Peptide Sequence Number=SeqID_177297
atggagcatcaaatcttcgcacaaccttaccttcaaaacacagccgtgttacgacaactccaaaaaggggtactcactggcttcgacggtgccgccacacgagacgccggacgaggtcacgggggtgcgggcaaacgccacagtgttttcaagtgcaccgtcttaacttacctgtgcgctaccaacaaagacgggcacccacggccaacgtcgttgaatgtgtcacgcgccatgcacatggcacataaaatgctcagttatttacggaactgccaccgctactcctactacgacgtttttgacggaaacgatgtggaacgcgcgttgtaa

SEQ ID NO: 85613 - DNA, 105 bp, Glycine max
  Peptide Sequence Number=SeqID_177298
atgcaacataagagcacaatcggagatgctagagaaagaacaagagcagaactggactacagcggtgacgctactcttgcactgacagtggtgattaaacattag

SEQ ID NO: 85614 - DNA, 282 bp, Glycine max
  Peptide Sequence Number=SeqID_177299
atggtgattttccaccctggagatgcagcagaagacaaaggagaagagcttggagaggatgcttcaatggaggataagaagcttggagaggatgcttcaatggaggaaaagaaagagggagagaaagagagaggggggagcacgaaattgaaggaagaaaaaaaaggagagaagttgaactttaagttgtgtctcacaagactctcattcatcaaagttacaacgagtgttacacatgcttctatttatagactaggtagcttccttgagaagctttcttaa

SEQ ID NO: 85615 - DNA, 255 bp, Glycine max
  Peptide Sequence Number=SeqID_177300
atggaggttgggaagaacggtggtgaagtgaaaggtgggtgtccatggattaaattcacagacctaaatttcatttccaacactaccaggggaaagtttgatggtttcaaagatgcagacaccaatgtatctcctgctctttcaaggagggacatggccacacagatgaacctagagggtagctcatgctcctctcccagtttgaggccttctttatggtgttgttgtagcatgcttttgcttgctaatgcttga

SEQ ID NO: 85616 - DNA, 1569 bp, Glycine max
  Peptide Sequence Number=SeqID_177301
atggctcagaattatgtaattgttgcattgggtttggtggtgtatgcttggacatggatgcaaggtgcacatggtgagtacttgattggggttgggagttatgacatgactggtccagctgctgatgtgaacatgatgggttatgccaaccctttacagaacactgctggtattcatttccggctaagagctagaactttcattgtggccgagagccttcaaggccctaggtttgtttttgtcaaccttgacgctggaatggcatcccagcttcttactataaaggtgcttgaaagacttaattcaaggtttggaaatttgtatactgaagaaaatgtagcaatcagtgggactcatacacatgctggtcctggcggttacctgcaatatgtggtttactctgtgacttctctgggttttgtgaaacaatcctttgatgccattgcgaatgcaatagaacaaagcattattcaagctcacaacaacctcaagcctggttccatttttatgaatacaggagatgtgaaggatgcaggtataaacaggagtccaagtgcatatctgcaaaaccctgcagatgagagagcaagatatcccacaaatgttgacacacaaatgacccttatgaggtttgtggatggagcaagtggtaaaaatattggagcattcagctggtttccaacacatggaacctccatgagcaatcaaaacaagcttattagcggagataacaagggtgttgctgctagactctttgaagattggtttgcttctcaaaacaattctactaacaccaattcaacagtaccagaggttgacattgatttcagtattataataataatggataatgcagatattggacaactaatgaagaaagcacaatcaattaaggccacaagaggaaaggattgcaagaaactagcaagccaagcgtccaaggtgaggaagaatgatggatccttatttgttggagcattttgccaatcaaatgttggagatgtgtcaccaaatgttctaggagcattttgcatcgacagtggaaaaccttgtgacttcaaccgttcttcatgccatggcaatgaccaactttgtgtaggcaggggacccgggtacccagacgaaatattaagcacaaagattataggtgaaaggcaattcaaaactgctgtgaaactgtttgagtctacttcagaggaactgtctgggaagattgactaccgccatgtgtacctgaacttcacagacattgaagttgaattggacagcaacaaggtggttaaaacatgccctgcagcacttggtcctggttttgcagcaggcactacagatgggccaggtctttttgggtttcaacaaggtgatacaaagatcaatccattttggaagaatgtgagagattttctgacaaaaccaagtcaatatcaagtggactgccaaaacccaaagccagttctgttgagcaccggcgaaatgttttatccttatccttgggcgccagcaattcttccaatccaaatcctaaggctgggaaagttgatcattctttctgtaccaggaggtttgtaa

SEQ ID NO: 85617 - DNA, 462 bp, Glycine max
  Peptide Sequence Number=SeqID_177302
atgcagtcccagtttcagtcgcaaatgcaatcacagggactcgtactgcctcctgaacccaaggttggtccttcagctacttgtgtcagcacaaaggagagttgtgttgatccctcagggaatgatccagatacaagtgactcagacaaatgtgggttgtacatcgaagaatatcctccccgcttggttgccttaggaagagtttatgagagatccacaaccgttcacaacattcctttgttgcatgatcaagtcaaggttggtgttaaggaggttaaagatgcagatgctctcattcctgtacccactaaagaggttaagggagatgtgggacctgcaaaacctccagataggccggatcatgaggtcgatgatcccctatctaatgacattgaccattccatagctttttctgaagctattataggttatgtgggatgctaccttgtttggcctgtttaa

SEQ ID NO: 85618 - DNA, 2928 bp, Glycine max
  Peptide Sequence Number=SeqID_177303
atggatgagcagaatatgataagggctgttgcttcttcctctaactcttcttctatggtatcttctaaaaaatatgatgtttttctaagctttcgaggcgaggacactcgtaagaacttcacaagccatctttatgaagctttgaagcaaaagaagattgaaacctatatagactaccgccttgaaaagggagatgaaatctcggcagcgctcatcaaagccatcgaagattctcatgtatctgttgtcatcttctcagagaactatgcttcctcaaagtggtgcttgggtgaactgggcaagattatggaatgcaagaaagaaagaggacagattgtgataccagtattctataatattgatccatcccatgtgaggaagcaaactgggagctacgagcaatcctttgcgaaacatacgggagaacccaggtgcagcaaatggaaagctgctctcactgaagcagccaatttagctgcatgggactctcaaatttacaggactgaatctgaattccttaaggatattgttaaagatgttttgcgaaaattggctcctagatacccaaaccaccggaaagaactggtaggagttgaggaaaactatgaaaagatcgagtcattactaaaaattgggtcaagcaaagttagaattctgggaatatggggcatgggtggaataggtaagaccaccctcgctagtgctttatatgacaaattgtctcctgaatttgaaggttgttgcttcctcgcaaatgtaagggaagaatcagacaagcatggatttaaagctttacgtaataaacttttttctgagttgttagagaatgaaaatctttgttttgatgcatcatcctttttagtgtcccattttgttttgagtaggcttggacgcaaaaaagttttcatagtcttggatgatgtggatacctcagagcaactagaaaatctaattgaagattttgatttcttgggacttggaagtagagtcattgttacaacaagaaataagcaaatatttagccaagttgataaaatatataaggtcaaggaattgagcattcatcactctcttaagcttttctgcttatctgtatttcgagaaaaacaacctaaacatggatatgaagatctatcaagaagtgcaatttcctattgcaaaggtattcctttggctttaaaagttcttggtgcaagtcttcgttcaagaagtaaacaagcatgggagtgtgaattgagaaaactccaaaagtttccaaatatggaaattcataatgtattaaaattaagttatgatggcttagattattctcaaaaggagatatttctagacattgcatgcttcttaagaggaaaacaaagagaccatgtaacaagcatattggaagcttttgattttcctgcagcatcagggatagaagttcttttggataaagctctcataacaatttcaggtggcattcaaatagaaatgcatgacttgatacaggaaatgggttggaaaattgttcatcaggaacatatcaaagatcctggaagacgaagtcggttatggaaacatgaggaagtgcatgatgtcttgaaatataataagggaactgaagttgttgaaggcgtaattttagatttgtctaaattaaccgaggatctatacttgagctttgatttccttgcaaagatgactaacgtgaggtttcttaaaatccatagttggtccaagtttaccatatttaatgtataccttcctaatggtcttgactcattgtcttataaactgaggtaccttcactgggatggattctgtcttgagtctttgccatctaggttttgtgctgaacagcttgtagaactttgcatgcattgtagcaagcttaaaaagctttgggatggggttcagaatcttgtgaatttgaagacaattgacctttggggatcccgagacctggttgagatccctgacttatccaaggcagaaaaacttgaaagtgtttctctttgttattgtgaaagcctatgccagctccaagttcattcaaaatctcttggtgtacttaacctctatggttgttcatcacttagggaattcttagtgacatcagaggaattgacagaactgaacttggcttttactgctatatgtgcattgccatcatcaatttggcaaaaaagaaaactcagatctctttacctaagaggttgtcacaatctcaacaagttatcagatgaacccagattttgtggttcttacaagcactccatcacaacattggcctctaatgttaagagattgcctgtgaacattgaaaatctttcgatgatgacaatgatttggttagatgattgcaggaaactcgtgtctttgccggagcttccgctgttccttgaaaagttaagtgcctgcaactgcacttctttggacacaaagatcactcagcagcaagtgttacaacacatgttacaaagtcgcataccctacttacgcaaacactatcttaagtgttatgatgaagaatatttcttcccgggggatcatgtgattgatgagtgtaggtttcacacgacacagaattcaataaccattccttatcttcagaaacctgaattgtgtggtttcatttattgcatcattctctctatgggaccactcttagagtgtgatgtttcctgctctgtctatcaagatggcataagggttggctggctcgaaaggttgttggaatacgaaaatttgatttcagatcacgtggtgattttgtatcatgacatcagtgaatttgacaaaataagtgaagtgcatgatcatttcttcagcaacataacatttatatttgaaaacaatgaagaccgcataacagagtttggtgtcttcccggtatatgcctcagaatcagggttgaagttggttggtagcaaggaaatttttgaatga

SEQ ID NO: 85619 - DNA, 219 bp, Glycine max
  Peptide Sequence Number=SeqID_177304
atggaaacacacaagttgagcttagctcatcagtgggctaagcgcgcatccaccgctaagcgcagcttcagcgtacttagtgcaatagaagaatctggcagagcatcaatatcaaggtcgcatgctaagtgcgagatcagtgcgctaagcgcagcagttgtctttagccaggctcagcgcatgactgacgctaagctcaaatccacttactcgtgctaa

SEQ ID NO: 85620 - DNA, 198 bp, Glycine max
  Peptide Sequence Number=SeqID_177305
atgggcccgaaatctaccctaaggctcatgagaaccctaaggccttctcttgcatatctggcccaatctacttggagtcttctatccgatgcccttgcgggtaattttcttctcctctcggctctgttcctccttaacgtagcttcaatcttcaagtccagaggaactagattgcctatgggagatctatgcatataa

SEQ ID NO: 85621 - DNA, 408 bp, Glycine max
  Peptide Sequence Number=SeqID_177306
atggctaggggcaatccaggtgatttacaaacctttggtcctgaaatagatagaaactttcatagattagttaggcatagtgtgcatcctaatcattctgtgcattctgagcattttgttgttggtgattctgaacattctaattttgagcattcggctgctaattttcatactgagaacatggctcaatctccacctcgtgagaggaatcttagggagatggctggacctaacttcacttatgaatgcttgtgcattcaatatcctgatgaggatgttccatatgttctcaagactggactaatacatttgctgcccaagtttcatagtcttgcaggtgaaaatcctcacaagcatcttaaggagttccatagtgtctgttccaccatgaaaccccctgatgtctag

SEQ ID NO: 85622 - DNA, 408 bp, Glycine max
  Peptide Sequence Number=SeqID_177307
atgtctaacattgtctgcaagctaccagctattatctataagttaggaattatctgcaaaggctataacagcccctacaaacaaggagccacaattaggctccactcccataaataccaagttccattgaaccctcaacacatcccacacacttcagcacacgagcaacaagcctgtgcacatctctctctatcactcactcgagcctcatttaagcatatacttgctttattctcctcactcatgtacttacttaagcgtcagagtcctttattttgcctaggatcttcttcatcaatggattcctttgctccttggaagatgaatggcagcggaatggagaaggaagagagagaggagatgccacttcaaggagaagatgagtctagaagaagctcaccaccatag

SEQ ID NO: 85623 - DNA, 210 bp, Glycine max
  Peptide Sequence Number=SeqID_177308
atggcatcttcatcatcatcttcatcacatgttaacattaagtctggtcccatcgatgctaataacatgtttggaatggggaagaagataggaaattacatatcagacgagctgtccccacgtatcaaggggaagaacaaattcctgagcaaatttttccttttcttctacaatctggtttcgcctggattatcaagatggggtacttaa

SEQ ID NO: 85624 - DNA, 213 bp, Glycine max
  Peptide Sequence Number=SeqID_177309
atggcttctacaagtggagatgctactccaccatctccaaaaaccacaaggctcatgagtgaagaagagaggtcaaatcatctaattcttctcatggggaagatgaagggtataaagaggatgaggggggaaggaggaatgagaggtatagggagagaagaaatgataatagatatagaggtaggaaaagagaggaagggattgagggagtga

SEQ ID NO: 85625 - DNA, 1140 bp, Glycine max
  Peptide Sequence Number=SeqID_177310
atgcataagcctcatcgaacagggaaatggacgctacggccaccaccaacaactgaagatggccaagtcacattcttttttaccaatttcctgatgagacttacagcgaaggacatgtggggtgcgctaggagggatcgtgatcagtggggtttgtctttgtgcgaatgtctcgcgttttgatgccgctgatcgttggcaacttgcattggggagaagggaagttgcagggtctggtcatggtggcctgtggaggtctaggggtgttcttggtggagggggttttgttgcaacaccatctagtttggtggcggcttcagtggtcgatgatagttgttcaatgcttggaagatggcttggtatgcgcggggaaggggggtgtcaggaaactactacactcggaggggtcatttctggtgtgggtgaccccattgggtgcgtctttggtcttattggagacatcggagttacaacgggtgttggaaatcttgtgtcggtggatgagtatatggcctgtaggggtcgtttggatatagttagggtcctagtgcatgttaaagggtttcacaacattgatacgcatgttctggtagacgtgggaggtgaaccttttgacatttgggtgaagcaagatgggtatacctctctatgtccttcttgctcaaacaacccaaagggcgagggggatggtgatgagactgatgatgagttggagttactgagtcttatagcagatgacctacaagtggatcaatcaagggttataggtggcagggaggggtctagagctagatctggtgttccgattatgatgaaggtgagcgactatagtagccatgctgctaagtttgtggaggaggttcataaggaggttgtatcttcaaacccccagccaagacgaagttgggtggttccgagatttagtcaacgtgaattgaggagatctgctagtgttattaccactctgagggttgtggatcattctgatgatgcaatggcctggcgtgtgtggtcgatggttagtgcttggggtttgaaggctaagggggtagatgagaagtggattaggtggatcgaggagaaagaagccagagagcgtgaggcaatggtttctagggagaggctaattattcccccatga

SEQ ID NO: 85626 - DNA, 132 bp, Glycine max
  Peptide Sequence Number=SeqID_177311
atgatttcttgtctagccaggccccattacaagccaataaaagttcttagtgatccaccaaatgtaaatataaaaactggaggtgtcacaagcaaaaaggccagaaaaattgaagaaaagaagaaaatctga

SEQ ID NO: 85627 - DNA, 174 bp, Glycine max
  Peptide Sequence Number=SeqID_177312
atggccattgagggttttacaatgagaaggggtgaaagaaagaaaggaagggatgggctttgggccttcgtaggcgcgctcagcgcaacaccccctcgctcagcgcgtgtagatcgcgcgcttagcgcacatgttgtaggcttagcgcgcgcttctgttggatcatgggcttag

SEQ ID NO: 85628 - DNA, 501 bp, Glycine max
  Peptide Sequence Number=SeqID_177313
atgtggatcgtgggattggttgggaatgcacttttagcgtgttttggacttcgaattgtgttatgggttgtaatttggaaggttgaatgtgggagtgggagtgggagtgagagggggagggggagaggttgtattactactaaggaacttgggactgtgatgcggtcactagggcaaaacccaactgaggcagaactgcaggatatgattaatgaggttgatgctgatggcaatggaaccatcgacttcccagagttcctcaacctgatggctcgcaagatgaaagacaccgactccgaggaggagcttaaggaggctttccgtgtgttcgacaaggatcagaatggtttcatctctgcagctgagctccgccatgtcatgacaaatcttggggagaagctgaccgatgaggaggttgatgagatgatccgcgaggccgacgtcgatggtgatggacagatcaactatgaggagttcgtcaaagtcatgatggccaagtga

SEQ ID NO: 85629 - DNA, 339 bp, Glycine max
  Peptide Sequence Number=SeqID_177314
atggattttgattcaaaagttttcttgctgctaccactaccaaacaacttgaaccctgattctgaggcatacactgggaagactgcacacccttttatcccagtaagagaagtctgccccagagaagtgcaatttgcaacactcaccttttctaaggatggtgggagcttcgacatagacactagtttcctacaatcatctaacaaaagttgtctcaaccttgaaagcaatgacttccaagattattttgatgatgccaaagaatcaagagttaagcaagttccaaaaaatcaggagtcaaaaagcttcaagaatcaagtttcaaagaatcaagattga

SEQ ID NO: 85630 - DNA, 321 bp, Glycine max
  Peptide Sequence Number=SeqID_177315
atggctgaagatgttcaacctttgttgactgaagtccgtgatagtggcctgttgaaggaagttgagactttaacccaaagccttacacaagcgactgaggatttgagaagggtacactcatccattatgacccctgagaacactgaactgctccaaaagtccatatatactctgatttttaccctgaagaacattgaggttggaccctattttttaaatggcctacaaaatgttagctcggatattttgggtttcactggcgatgaagctacaagaaagagtttgaaattacttatcaagtccctcagcaggttattgtag

SEQ ID NO: 85631 - DNA, 453 bp, Glycine max
  Peptide Sequence Number=SeqID_177316
atggcatatgacagaagagggcgtaggtacagtcatatgacaactaatctatctgaatgtgtaaataaagttttcagaggttgccgcaacacaccaataactgcccttgttatgaaagagattcagaaaaatcaagaaaaggcttgttctcacattgtccgcatttatgatattcaagaacaatgtttgaagttgaggaggcttatgatcctatgtctcaacgaggtggacaaaagtgggaatgaggatgcgattcttccatctgatgagtcgtggacacttgttcctgatccaagttttattcgtatgaaaggaagaccaagatcaacacggttaaggaatgagatggattggagggaaccttctcaaactcgtcaaaaatgtggtagatgtggtgtacaaggacacaatcgacgcaattgtcctctacaatctaatcagggcagttgttaa

SEQ ID NO: 85632 - DNA, 650 bp, Glycine max
  Peptide Sequence Number=SeqID_177317
atggtcagaggtgactttgactccttgcatgattctaatttccaagataagaaatcccgccaggatataaatcaaaggagaaattttcagagttttaccaatcctttgcctcacaagaactcttccttggttttgaatgcagactctactcgtgaagcgtctgcttataataacactaaaaatcgtagaaagggtactaagcatggttttgatggtatgagatatgactctgcttctaaccctagtgatcactatgaaaagaataaccttgtggttaagcagacaaattctctgctacatggctatgaaaacaacagcctgaagaatgtacaaagggttccacgcacgtgccactgcggcgacgccaacatccctaagctctgtcgcgctagacaattccagcttcaccaggtgcttgtaccatgcgccgaggctcagctgcttggttctcgtgaacctccacgaccgagaaaccctagtgtcggtcttgaggcatttgttggggcagtcatcggtaacagtgaccaatggggtgaattgcgggagggaatttttggtgtatggcgagaggaagagaagaggagaatggatttcgctggagagagtgacatcagggcaatgcggaggttgatcgagattgaggcagaggg

SEQ ID NO: 85633 - DNA, 370 bp, Glycine max
  Peptide Sequence Number=SeqID_177318
atgtattgtaggcggctggacaaactgatccccgatgttgtgtgttggattccatatggtgaccaccgttcgtttagagaatttgagaccattctgccacatcctactgcgccttcgtcttctattgaagaaatggatgctagatggatgcagttcgatatgcctcaacaactggtggcggcaatgacacctgatgaaatagacgttgatgtgcatcgtcctcaacatgcagtggatggttatgtagcaattgtagataaattggagagactactgaacctaaggatcctgaccgaaggaacagaagcctatattgttgctgaagaatgtctgagcatcgcaagaagctacattggccaaccaactgtag

SEQ ID NO: 85634 - DNA, 405 bp, Glycine max
  Peptide Sequence Number=SeqID_177319
atggcaaaacttgtttgtcacttgtttgctgatgggcttgggcttcagctttcccatcactatctcattaggcttcttctttgtggttcatcttcttcgttgcttcctcatcttcgtggttcctggttcatgcttgttcttcttcttcgttggttcatcttctcccagataatagttagagctagaggtttcagacagactttaggccgagcaataggaaaagccctggggaagagagaggctagtgatgatgataatgatgtctccagcagcgaaggcttaccacatctacccatagagcagcaacaaccacctgttgaagaaggtgttactgatgttgaggattttccaggtggaccccatgacacatcagttttgagagattttgaaaatcaattgctttga

SEQ ID NO: 85635 - DNA, 324 bp, Glycine max
  Peptide Sequence Number=SeqID_177320
atggccagggatagattgataaatagtcaagtagataatgtcagattgaaattgatagaagctcgtgaaaaagatggtcgtatatacaatctgccaaatgtttctgaagttgctgctcttattgttggtgattttgatggaaactcaagcagagatattattgttgaaactcaaaatggagaattacaaagaatacataaattgcactctagctatctaggattgcagtaccctctactcttcccttatggtgaagatggatatagacctgacatacttcacagctctacatccgctagcaaaaaaggaagagaaattgtctga

SEQ ID NO: 85636 - DNA, 672 bp, Glycine max
  Peptide Sequence Number=SeqID_177321
atggatgtcttgtttctagctcagtatcggtacttaggaattaagtggcttgatggggaagtgatctctagaaatctatatagaggctttaaagtggggactaaggaagtggaggtcaatttgttacaatatgcggatgacacaatttttgtgggaaagttcaatgtggataatgtggtgatcttaaaaagtatgatgaaatgttttgaactagtttccggtttgaaagtgaattttcacaatactggtttggagcaaggaggtgaaatattttccacaattgaggagaaatttggaagagtgttagattctacatatttgggttggcaaggaatgtgtgatggtggttcaacacctaatgagtcaatttggtggagggtcataaagaagaagcatttgctggaggaatttttagcattgatagataatgttaatattgaagacattggaggggatcattgggtttggaccgtggatccatcaaatatattcacgattaaatccacttatcttgcattgcataatttaaaggttacctacaaaggtgtattcaactcttggaatatggccttgcttgtggtttgtgccatcaatatgaagaggatatttcacatgttctcttctcatgcaaagtggtacaaactatttggtggagatggtatggaccattga

SEQ ID NO: 85637 - DNA, 1425 bp, Glycine max
  Peptide Sequence Number=SeqID_177322
atgtctcgtataaatttgtctctcaaggatgataacttgacaatgtctggaacaaaattgtttccaaaggaagatatcggaaagaaacgaaaaatgtcacctggactgaatgggtttttgattgtggaggccaatgggggtcttaaccagcaacgctctgcgatttgcaatgctgtggctgtggctggactcctgaatgcaatactagttatacctcagtttgagtttcacaatgtgtggaaagatccaagtgaatttggggatatatatgatgaagatcattttatatctgcacttgatggttatgtgaaggtggtcaaagaacttcctgaggcactaatggagcggcataattacaatatgactaatatcactaacatcagagttcaagcttgggctcctgtcagttattaccttggagttgtttctcctatcttgcaaaaggaaggggtaattcgaatagctccatttgccaatcgtctggcaatgagtgtccctccacatattcaatttctaagatgtcttactaattataaagcattgaggttttcttcttcaatatctgcactaggcaagaaattagtttaccaaatgattgagaagagctcaaggacagatggaaaatacattgctgtgcatcttcgttttgaggaggatatggtagcattctcttgttgtgtatatgatggaggaaaggcagaaaagttggaaatggattcagttcgagaaaaagggtggaggggaaaatttaaaagaaaagaccgtatcattttgcctgacctcaatcgggttgatggaaaatgcccactaacccctctagaggttggtatgatgctgcgtggcatgggatttgataacaatacttcaatatacttagcttctgggaaaatatatcatgcagagagatatttggctcctttgataaagatgttccccaatctttatacaaaggagtctcttgcaacatcagatgagcttgctcctttcatgagttgtaacaagaaccacgacaaagtttatgcaccgacctcaagaatgcacgtgatgataaaggatggctattcctcccaattggctgcactggactatacagtatgcttgtctagtgaggtttttgtaacaactcagggtggtaacttcccccattttttgatgggccataggagattcctctatgatggccatgccaagacaattatcccagataagcgcaagcttgttgttcttttggatgacgtgagtattagttggagagctttcaaggatcagatggaagacatgctcggtgaaagtgaccgcaaaggaatcatgcctaaggtcctatacagaagtaattacttagagctaaacgtaggagatggaactctcataacagcacgcaaaatttgggtacattgcaccaatctgggtagctatttccaatga

SEQ ID NO: 85638 - DNA, 1656 bp, Glycine max
  Peptide Sequence Number=SeqID_177323
atgtcaatatttcttggtaagacagaaaaggttgatctggagaacactgttgttgacgagagccaaagacagttgaatgatcaagaggcttcctctagattgaggcaggagaaatctagtgaagcaagtgcaagtgagtctgaggatgataacgagagaaatgatgcagccgaggaagaaacagatgaagatgactccgctttttttgacactcgtgattttctatcatcatccaattcttttaaaagtaatggatctgatattagggcctcatctttctcttcagatgatggactctatacagttgaatcagaggaggatgtagatccttcaattaaatctgttggaggcaactatccttctgttaaacgacgtaggaaattgcctgaccctgttgaaaaggagaaaggcgtcagtctttggtcaatgattaaggataatattgggaaggatctaactaaagtttgccttcctgtttattttaatgagcctctctcatctctgcaaaaatgttgtgaagaaatggaatattcgtatcttatagaccgtgcatatgaatggggaagaaggggtaatagtctcatgagaattctcaatgttgctgcgtttgctatatctgcctatgcttcaactgaagggagaatttgcaaaccatttaacccattactaggggaaacatatgaggctgactttccagataaaggaattcgatttttctcagagaaggtcagtcatcatccaatgatagtagcatgtcactgtgagggtacaggttggaaattttggggagatagcaacttaaagagtaaattttggggtcggtcaattcagcttgatcctgttggcattttgactttggaatttgatgatggtgaagtattccagtggagaaaggttactacatcaatatacaatctcatattggggaagctgtattgtgatcattatggtacaatgcgtatacagggaaaccaagactactcttgtaatctgaaattcaaggagcaatctataattgaccggaatcctcaccaggttcatggtattgttcaggataaaaatgggaaaatattgtctacattactcggaaaatgggatgacagcatgtattatattaatggagactacagtgggaaagggaagggttatgaatctatgtcagatgcccatctactatggaagcggagcaagcctcccaagtttcccactagatataactttactcggtttgccatcacattaaatgaacttacccctggattaaaggaaaagctgccacctactgattccaggttaagaccagatcagaggcatttggaaaatggggaatatgatatggcaaattcagaaaagttgcggctagaacagcggcaacgccagttgattgttgattcttcccttcgtcgtaaaaagggattagaaagatgctatttagctcaaggatatcagcatcctaattccttgtctatggaacggttagctcggaaaatgcaagagagcggttgggaaccacggtggtttggtagggataaagaaagtggcacctaccgctacttaggagggtattgggaggcccgaaaacaaggaaattggaactcttgtcctgacatttttggccatattccttctgatcatgtttcagacgaaggtcaataa

SEQ ID NO: 85639 - DNA, 1239 bp, Glycine max
  Peptide Sequence Number=SeqID_177324
atggtgttggtcaaaggttcgtcatcgagggagtcgattggaggcgagtttaacattcatgggtacaacaatgtggtttatgaagtgtcattcgactttcactccttaaggtcggatttttctagcttgattgacttctcggcattcaaggggtctagcaaccttttggcaaatatggccaaaaaagtgcccaatgctaaaggagaagcgtctgcctccaccaatcacgcttatggacacgataatggatcggagacgtgccctgtcactctacacatggtccgattagatgctacaccacccacagagtttgtgttcatgaaccgagaagggatgaacaaagatttcttttatatgtacaattttttgttttgtgatctgcgtgtaaaggtcttattcgacgattttattatgagtatgttctggatacttgacattgcttcgatgcaattgcatccgaataggtgggcggctatacagtctctgaatcctatctgggaccttgagggaatcatgactcaggccgatgacaacatgaatgtttttcgccaggcttggctaaatcaaatcgttgctgctggtgaaccttcgttgaatcctgctactaatcaaacatcggggccttgtgatgagcactggagcggctcgggggaacactccgggcaccaggaagacacctcttgggagaagaggcttaagcagccaataattggatttcaacctgatgttgccacctctttgggcaacatctcggcccctaacgaatcaaggcttcttcaaccattccttctggctggaccgccttatcctgacggaaattgtttcgaagcaagggggtcgtccaaagccgatgctttgaaggaccagttcctaaaggtcgaggattccttgaactcagcgcttcaggccaacatgaagctggtcgaagacaacaaaaatcttaaggaccaggaaacaaaagaggttaatgctgagaaggaacaaattcaacagaaggcattcgataatgtgtacaatacacataaggccgacttcgaccactgccatcgacagatgttgcacatgtgcgatgtttctgaacccggggtctttgacattaaaaaggatgcctatgaaggggggctggttttaattgatgaaatcatgaaagaggatgttgctccttcacacccaaggattatgaccctagcaaaggagccacaggtcaagggagccgaggacagagcagacaaggcctag

SEQ ID NO: 85640 - DNA, 360 bp, Glycine max
  Peptide Sequence Number=SeqID_177325
atgtctctgcttttcccactccccattgatggcgtggatttgaccgagaacctaaaaggagtagaaacagcagaagcagcgacagcagcgtgtgacgaaggagcagcggaaagagcggcgtcgagtgttgggtgcggaagtggtagttgtctccatatggtgaaagagaagggtcgagggagaaagaaaagacaaagtgggttggtgagagtcaccaagggaataaggaaaggattattggagaagagtggaattgatgcttgccgtgcaattcacggcatatatgccaaatgccattttttcactttaatgcaccttctctcgggctttatttttaatatataccagtttaaaaactga

SEQ ID NO: 85641 - DNA, 285 bp, Glycine max
  Peptide Sequence Number=SeqID_177326
atggctgtagaaacgggaactggggtccctttgttgatgtgcaaggaagatgatgcactagatcctgttgggtacaaacatgaagaaagggagtggagagtggagctagtagtattgatcttatttaggcttcacaaaaacgggttaggaaggtgtatgtatgaaaaagcagaacctccaccaagggtggcgcgcctccccggcacggccggggggacggcggcagtgccacggaggcacggcggtggcggcgcgaggcttctccctcaacctcatctttcttaa

SEQ ID NO: 85642 - DNA, 339 bp, Glycine max
  Peptide Sequence Number=SeqID_177327
atgaagagtgacaaggttgacaacaacaacaaaaatagggattgcatttatccatcatgtccatactacaaaaagagtgataactcgagactagtcaaacggtcactatacaggcaatcaaacatgagcaatgagactacaaagtgtagtgagatgttaggatccaattctaaggcacaatcacaagatattctacccaatgctttcccatattgcgagaactttgaggtgaagtgctttgtgaggagcattgatagggaaccaatgattaaacatttttatgtcagaaggaaaggagatgagtcacaggttggcagaaaccaaactgacctcttatag

SEQ ID NO: 85643 - DNA, 1584 bp, Glycine max
  Peptide Sequence Number=SeqID_177328
atgtaccatggtgcatctgaagtgaatgaggcccaggggttgtcaccagattcagggaaaattggaacacctactcatgcttctccatccttgggcaattcattgaaccaggtcaatgtgtgttcttctaatgagcaaggattatccaaagcatcaaatgttgcttttatttcgatacctcccatgcatatcaatgagcaagtggaacctggtgatttgcgaattttgccaatgtgtggtggaggtattgattcaaattcattttctgagcccactggttgcagagggtcatctggaattaataaaaacaaggactcagtaccttgtggtcaaattgggctttgtggccaggaaaaatattttagtccacactggtctgtagaggctgttgagaaggaattagaggagggtgatgtttttaaagctctctttcatgtcaatgctcacaatagactcgaggcatactgcaaaattgatggaatgccaactgatgttttcattggtgggattccagcccagaatagagctgtggaaggtgatgtcgttgcagtcaagtttgatcccttgccattgtggacaaaaatgaaaggaccaaacgggtcttgtaacaacactgcaacaccagaaggttgcaaccttacagaagataaagaagtgggcggtaatatttgtaaagggaaagctaaagtagatgctgagtatgagtctgctcatggcagaagctatcctggtcaaaacaaggaggatgctgatcaaaactccttgtataaaagttatccttttactgaaacaacaatggtctatgatgatattacctcccggggttctactaatcatttagatctacatggaatggccaaccatgacagcattaatggtcatcactgtgctgctcctaattccttaaagatcaattcttgtagtgggcagagcaatgcagtggaaaagatgtgtttgttggttaactctttcccttctaaaagaccaactggcagggtggttgctattattgagagatctccacgtcgagagggtattgttggtcacattaatgtgaagcagtgggtttctttcagggacacaagcaaaaaggatgtgaagaagaataagaatttgatttctgagcatgaatacatccaactgataccaactgatccaaagtttccaaatatgatgcttcttgttagaaagttaccaaagtgcattaagaaaagaatgaaaagtggtgatgtgacaatccaaatggatctggtagctgtacaaattgatgattgggttgaagaaagtccttttcccgaggctcacattttgcgtgtttttggacaaggtggtgaagttcagacccagttagatgcaattttgtttcagaatgctatctgtttgtctgaattttcacctgaagctctgtcctgtctgccatgtgttccttgggagattccactgaaggaaattcaaagtagaatagatctgagaaatttgtgcatatttactatcgatccttcgactgccactgatctggatgatgcactgtcaattgagaagttgcctaatggaaattatagagtaggtgtccacattgctgat

SEQ ID NO: 85644 - DNA, 285 bp, Glycine max
  Peptide Sequence Number=SeqID_177329
atgggagttctagctgccgcacacaaccctaggtttatgccccccatttgtgcgctaggcacttgggtattctcagttgcaggagctttgctggctattccagtggggataaagcgcaaatctctggcaccccttgtattttttggcaccactggtactatgttggatattattatgggaattagtgcttgcgaaagggaacatgcagagcgccaaatgaagctacttgaagcacaaaatgctgctgctgagactcctttgggtgaaactgaaattgattcataa

SEQ ID NO: 85645 - DNA, 1107 bp, Glycine max
  Peptide Sequence Number=SeqID_177330
atggccctttatttctctgaatggttatgcgtgggtctggatgtggacgccctcgacagcgtcaacaaggaggagggcattgttgttgagtcgagcgacaatgaagacctcactgtagaagttgatgtggtccgacaatggggaaccttcttgctcttcttgcccttcggcggtgccttcgtggcccacgcctgcgacatcataggtgacgcgaagggcaggaacgacaattcgtggatggcaatcggcttcgccttcgacgtacgacacaccggaatccccgattatgacggcactgtccatgtcgtcgaaggagggtatttggggattgggattggtggttatgaagtggcagagacagtggtggtgggatctaggggtggcgatgtttgttctggagggtggtatttagggtttggacttggaaggagaatgttcaagaaaaagacaatgtcgaagacaaagaagaagatgaagatgaagcagaagagaaagagaaagagaaggatgaaggatattgctacgcagaactttcagcaaatatgcaaagcatatgagattctctcagatccaaacaaaaggagaatatatgatatctacgacatggaagggttaacctctaatttggaacttggtccaaatcttaatggagctgaaaagatcaaggcaaagctcgagagattgaagaggatgaaggaacgagagaaagtggcagcgcattttctaccctttggtacaattctggccaatatgtctttgccacactatgtagatggaaatggcctactcattgggtattgctcccgtaatgctgttacgattggaggtaatttagcagtgaatggagaggaaggtggtggagctgctattgctatgtttaggcatgaactttcagaagtttcgtcagtagaggttgtggcctcaactggtttgcatgcactaatcggggtgcaaacaacttggtgggaacagaatcagcaaaagcttcgaaaggctgtcttggacgtgtcaaacgaaattggaagatattataatgagttggagttagaaaagatacttggtgctattgaagaggtggaacaagctaaatgccaatctttattctag

SEQ ID NO: 85646 - DNA, 807 bp, Glycine max
  Peptide Sequence Number=SeqID_177331
atggttaggttcggtgaaggtgaaggtaccggtgttcagtgttgcggaggtcggcggcggcatacgatgtacgcaatgttgggtttgcgttgtggtgtaccgcagatcgcgcggatcaagttgatccgtaagaagtttatggatcaacttgatctacatatggacgaagatcagtggatgtatgaaagtataatgtttgaagaagtgaatatagattatgaaaatgaagaagaatgtggtgtgaatgaaccacatgttgattattcggatgcgtttaatacttctcagataataatgttcatgattccgagaggatgttgtaggtgtataggtaaccttcttcgttttcaatgtatgcaacgtaaaaatgatgatgatgttaacacaatgttaatgtgtaatcatcaattttcaagtgttggtctgattgagttattatgcaccattggtagaacaccagatgatatattaaacatacttgaagccactatgatccctactcatgatgccctgctatattacaataggaggtggaacatgtcacgccaaaatgagtttgttggttactcattcacagcaaaagatcccaaaaagtttgacattcctttcggatgtaccatgaatgaactgaaggatttgatcaagcaagttgcgccttatgggattcccccttatggtatttatgaaacacaaacggtgttagtgcattctaactactggaaaaaattcgggtcaatagaagttttagctgtttttagtaagcgtgtaatcgaaatggaagataatatgtccttgtggcaaaattag

SEQ ID NO: 85647 - DNA, 795 bp, Glycine max
  Peptide Sequence Number=SeqID_177332
atggttaagtcagagaacaagatccagagagaacaaccatcatcatcaaagctaatgagaccattatcatcatcatcatcatcatcatcatcatcaagtgacaacaacaacaagaacaagaagaagtacaagggagtgagaatgagaagctgggggtcatgggtgtcggagattagagcaccaaaccaaaaaacaagaatatggttgggatcttattcaactgctgaagcagcagcaagagcctatgatgctgcacttctatgcctcaaaggctcctcagccaccaatctcaacttcccttcttcaagctcctccttacaacactacatcatccctcaagacacttccatgatgtccccaaaatcaatccaaagagttgctgctgctgctgccaacaatttcttggacaacaatgccattgctattaataataatgttaccaccccaccttctccaatttctccacattctcctcctcttgcttcaaccccttcttcttcttcatttgtatcatcaccatcaatgtcatcatcatctccctcagaccaaattgatgatgatgtctctcttctgacaccatttggggcttatactactgctgttgctactactactatttgtgatcaagaaaatgaatcaatggctatgatggaatcatggtatggcttggagggcttgcaatctccaaagtatgttgatcaaatgctaagtggggcattctttgacattgattcaacacagctgcttgatgatctgtatgaagaaagtgatattcgcttgtggagtttctgctga

SEQ ID NO: 85648 - DNA, 1104 bp, Glycine max
  Peptide Sequence Number=SeqID_177333
atggccactccacagtcccacttccgttttctcgctttctcactctctatcatccatatctctctcttcctctccacaaccgcaacccaacaaccgctcctcgaagaacaagacactcccatcacgcacttccagcgctacctccgcattaacacagcccacccaacgcctgactacacctccgcggtctccttcctcaaagcccaggcccaaagcctgggcctcaaaacccaaaccctcgagttcgtccaaggcaagcccgtcctcctcctcacgtggccgggctcaaacccctccctcccctccctccttctcaactcccacctcgactccgtccccgccgagcccgagaaatggctccacaatcccttctccgcccaccgcaccgcctccggcgccatcttcgcccgcggcgcccaggacgacaaatgtatcgctattcagtacctggaagccatccgcaacctcaaatcccaatccttcactccacaccgcacaatccacatctccctcgtccccgacgaggaaatcggcggcatcgacggggccgccaagttcgtggagtccgaggaattcaacggactcaacgttggattcgcgctcgacgaggggcaggcctcgccgggcgatgaatttagggttttctactccgatagggttccgtggaacgtgaagattagggctaaggggaggcccgggcatgggtcgaggatgtatgatgggagtgcggtggagaatttgatggagagcgtggaggtagtgagtaggttcagggagagccagtttgatgtggtgaaggccgggaaagctttgaatggtgaggttgtgtcggtgaatccggtttatgtcaaggctggggttgtttctgaagatgggtttgcaatgaacgtccagccttcggaggcggaagctgggttcgatctgaggctgacaccaacaacagacccagaggaaatgagaaggcgaattgcagaggaatgggcgccggctgttaggaatatgtcatacgaggtgagatttttaatgggaaatgttgctgttagtttcaggcatttatctagtatgttgtcattggctgcattttttgttcaagtaggattttag

SEQ ID NO: 85649 - DNA, 402 bp, Glycine max
  Peptide Sequence Number=SeqID_177334
atggacgaagatcaatggacgtatgactatatgatgtcacaagaagttcatatggattatgataatgaagaagaatgtggtgtgaatgaaccacatgttgattgttcgaatgcttttaatacctgtccggtaatcatgtttattagtttgagtcatttggttgaactgattatgaggtctgacacagatactggtagcagaggaagaagttcatttgtgttaattgggtgtgaaaggagtggtctgtacaagtgtaggaataaagaattcgttagaagagacactgggagtaggaaatgtggttgtcccttcaggcttcctgggaaaccagtgcatggaagggaaggttggatggtgaagttgatctgtgggattcacaatcatgaattggccaagtcctta

SEQ ID NO: 85650 - DNA, 549 bp, Glycine max
  Peptide Sequence Number=SeqID_177335
atggatcgattattcacaatgatagtggggtttacttccaaacttccactccggtgcccattcaagtaccaaatagctgtgattttaataccaaatgaagtaataaacttacttgaacgcactacgacccctactcatgatgcgctcttgtattacaacgggagatggaacatgccaccacagaacaaatttgtaggatacacgttcacaggaaaaaatccaaagaaatttgaaattccttcaggatgtaccctcgatgaactcaaggatttgataaagcaagttgcacctaaagggattccccctcatggaattcatgaatcacaagcggtaagacgattgctttttcgacaactaggacgttttgagtattcagataaaattataaaatatgaaattaatgagctgaaaaccgatgatgaagtgctgaaggtgttagtacagtctaactactggaaaaaatatgggccaatagaaattttagctgtttttactaaacatggtatggaattcgaagacgatgtggatgccacatcactaaacgactga

SEQ ID NO: 85651 - DNA, 195 bp, Glycine max
  Peptide Sequence Number=SeqID_177336
atggaaaggatccaaaagtccacttctagtgataattcccaagggtggtttcatggactatcagcgacaatgcatcaccaaaagaaaaaaactctagatgagatttcactatcatcaagcgagtcagagacccagcatgaccacatatcaacctccacaccttatggctcacatagacccgggtatagggcctaa

SEQ ID NO: 85652 - DNA, 676 bp, Glycine max
  Peptide Sequence Number=SeqID_177337
ggaccaacgttccttgggttcattgcaagaagcaggatttgcttcttggttgatcactggacacaaaagaccaacgtcttttgggttcattgcaagaagtgcgtataacttcttggttgttatcactggacacaagggaccaaagttccttggggatagtggaaatctcaagcgggttgcttggggactggacgtaggcacaagttgtggccgaaccaacaaggagattgagggcaatcccactgtaggaaactccccctctagaaggcacatcccttcccaatcaagaagatgcagactgcaatcaactgaggggaattcgtcttcccctaagccaagaaactatgcttctcccagtcagccagtcattaactcagaagtggcagggaatactgattgtcgtaagatcatttatgaggtctggaagacaaccataatgggcttccctatgttgattcaatctcaaaagctgaagattctgaagaggcctacagatgatcttgtcctccaagagaagcaagcttatattcttcttcaacaagcccttgctaatcagaaggaattctggaaagaaaaagctagaattaattggctcctccaaggaaaccgcaacactgccttcttccacttggctgaaaaaatcaaaagaaccacaaacataattacaatgtggtga

SEQ ID NO: 85653 - DNA, 567 bp, Glycine max
  Peptide Sequence Number=SeqID_177338
atggttattgatgaatcccttttctttcaattaacccaattgtctagtgatggtgtaccatttgagggcaccattgatgaggactggaagtttgatttctccaatcatgatgcccgcaggttggtttgcaccaatcaattggatatgaccgttagattatttgtcggatcattggcatttgaatgtcgcatcatgcactatctgattgtgtgtatccttcttcctcggtcatctaaccttgctcaggtttctgaggaagacatggttgtcatatgggttttacttatcggtcgtcaaatcaactgggcccaccttatcagatatcgcatgcaaaaggcattgcgatcaaatgcaccccttccttatcctcatctaattactctattcttgcgtcatttcgatgtccctcttgactctaagacatttgttcaagtcaagaaatcattttctattagggcgggagtagttacttcctttggataccgcaaagagcgtgatggctcttgggtgaagaaggacgttcttgcacaggcagcagagaactgctctccatcaccacttccttag

SEQ ID NO: 85654 - DNA, 282 bp, Glycine max
  Peptide Sequence Number=SeqID_177339
atgaaggttgagcaaccctttgcttgccatcatacaagtgaggaagggaaggttcctttggctgcccttagcttccaaaggtatgccctctattggtggacttccctagttagggaaataaggattcaaggggattctccagtggtgagttataatcgctcggtccaaaaaagctgcttagcgcaagaagccacactagaaggcaactatcacgatcaagcgtgcatattgcggcttagcgtgtggtcacttgatccagttggacatatgcgctcaacatga

SEQ ID NO: 85655 - DNA, 811 bp, Glycine max
  Peptide Sequence Number=SeqID_177340
atggctattgatcgcactgttccgcatcacgcaccgagcccacacggattattgagaatcgcattaatgcggttgtcggtgcattatgcagctgcgtacattacagatgaaagtttgtccgttacatcatggttgttgaccgcactgttcagcatcacgtaccaagcccaacgaattactgagaaccacattaaagcagttctcgatgcatgccttcagggtgagtgcactatcagacttgaagatgttacactacatctaggcattagggtcaatggtcatgttgtgactgaatctagcttcttacattgggatgagttatgtgacgagttactaggcaaagtccctctaaatattacacataagggagctgcattgaagttgacatggttgcttagcatcttgcgtgcaccattacctgaagaaccaacaatacaccaactacaatgcaagtgtagagcttacataatgtacatgattgatgaaaacctgtacagagaactgtgtcgggcatcatcggaggttggtagagttataggtggttatgccatactattgcagtcatgggcttggtatcacatgccttttattgcaccaaaagtcttaggacctgaaacaacttattcactcgctaaaagatggagtggtggtcgattagaacataggagcacacctcatggtgacttggtcgggtatagatctcgtatagatcatatggagagtcatcaggatttgaagagcacttaccgagacatacatacagagacagggagatttgttggacaaatggcctcagttatcttaaaagggg

SEQ ID NO: 85656 - DNA, 138 bp, Glycine max
  Peptide Sequence Number=SeqID_177341
atgtccatggcagtgaaaaagtacccagcggaactatcactgtcaacgttgatatgcatggcgggtgctttgcaaagtgccgtggttgcggtgattgcagatcataaccctcggacatcggctatcggtttcgactaa

SEQ ID NO: 85657 - DNA, 238 bp, Glycine max
  Peptide Sequence Number=SeqID_177342
gcactcagcccgcttagcgagttgggagaatctggaggataatctgagaagcatctatgtgctcagcatgtcatcagtttgctcaacgaggcgtttgtctcttcctgcgctaagcgtgcccagctcgctcagcggatattcactaactcgtgctaagcgtgccttcgaggacagaaagccctttttaaggatgaagttggaaaaatcaagcattcggctgaaagagagcatggattag

SEQ ID NO: 85658 - DNA, 591 bp, Glycine max
  Peptide Sequence Number=SeqID_177343
atggtgacaacaattgtaatgatgatgatgtcaactgcaatggtgacaatagagatatcagtagcggtggtggtggaggtgacattggtggcgatggcagtcaatgataacgatgttggtggtggtggtggtggcgatgctagtggtggtgataaaggtggtattagtggtggtggtagttgtagcaatctcggtggttttggtaggggtgacaaaggtggtattgttgatagtggtggtggtagtgacaatgacaatggtgatgacagtgacattgatggtggtgtggtgttgggggtggcaccaagtggtggcggtgatggtggttgtgaaaacattggtggtggggataatgacggtggcactaatggtgtggtggtggtagtagcaatgttggtggtaacagtgatgtcgatcacgatggtggtagtggtagtagtgcttgtggtggtggtggtggtgacaactagttataacggtgagaacgacactgatggtggtggtggtggtgtcgtggtggcgatgacaaaggtggtattggtgatggtggcaccagaaagtgttattgtcaaatgtgtaaaagtgtcttga

SEQ ID NO: 85659 - DNA, 643 bp, Glycine max
  Peptide Sequence Number=SeqID_177344
ggacaatccaccatctacttcatttgaaggtaaggctgtacaaatcgtcaaacttgcatcggtgtccatcattgttgtagtagtttcattgaaagacaaagagcccaaggttcacattgaacacttcttcaacattgagtcattggaaaatgttggctacattatcaaggcacacattatgttgtgtggcatccaccacttcttcgaggaccccaaggtggtggttcctaaactcatctgcaagttttggagaatagccaacgtctgccgtaatgtggtcattggaggatacttcgcgagtaaggttcttggtatacctatgaagttgactactgaatcgattgcccaagccattggttgctttgcaactgaagtgatgaaggacaagagcaccagaaaggacatctaccatagtgtagtcccgacgaagactgctcaagtggatgattccattctttctgaacttcatcagaattttggactcaacattggacaagatgaccaattggatgcagtgtgcgaaaaagatattgaggaagaagacatggtggatgcaaacgcctctcaagttgagaatagaaccaaaaagacgatgggcacaccctctaccaaggttgcccatgtaccacaatgtccaatatga

SEQ ID NO: 85660 - DNA, 1203 bp, Glycine max
  Peptide Sequence Number=SeqID_177345
atgaagattcgtagctctaagaagatctcagcaaaatgggttcctgttttctctgtattttccttccttattggaatgctcataacaaccaggatatgggaaccacctgaatctaacggggtatttctgtcaaatcaccgacatgagcaagaactgcaagtggtgtcaggggattgtgctcctaaaaagcctgtgcaggataatgatgtaatgaataaagtgtacaaaacccatggagccattcagggtgtcagatctctagacaagcaagtttccatgcttcagatggagctggcagcagcaaggagtactcgagaacacaagatttcggatggttcagctaacaccttggcctcgggggtctccactgaaggccctcccaggaagaaggtgtttgtagtgattggcataaacactgctttcagtagcaggaagcggcgtgattcggttagagagacttggatgcctcaaggtgaacagcttcttcaattagaacgcgagaaaggaattgtcatcagattcatgattggtcacagtgctacttctaacagcattctagatcgagctattgattcagaagaagcccagcacaaagacttccttcgcctggaacatgttgaagggtatcatgaattgtctgcaaagacaaaaatattcttttccacagcagttgcaaaatgggatgcggatttctatgtcaaagtggatgatgatgtccatgtcaatttaggtgtacttgcaacaacccttgctcgtcaccgttcaaaaccaaggatctacattggatgtatgaaatctggacctgttctttctcgaagggatgtcaagtatcatgaacctgagttttggaaatttggagaagaggggaacaaatacttccgacatgcaactgggcagatatatgcaatctctaaggatctggccacctacatttccatcaaccagccaatattgcacaaatatgccaatgaagatgtgtcacttggtgcatggttcataggtctggaagttgagcatatagatgaccgcagtatgtgctgtgggactcctccagattgtgagtggaaggcacaagcaggtaacatatgtgttgcatcctttgactggagctgcagtggaatctgcaagtcagtagagaagatcaaatatgtgcactcaaagtgtggtgaaggggatggagctgtttggagtgccttagtttag

SEQ ID NO: 85661 - DNA, 924 bp, Glycine max
  Peptide Sequence Number=SeqID_177346
atgggggagcgaagaggaagcaagatgaagacaggggcagacaggttgggagatctgagcatcaggggactagaagagtggcccaagggcgatgaggtgaagacacttatacaaagggacttaacgttgcttgaaaggctccaagattttttcgtatcagatgttgctgggaatgtaaaactgaagtatgtgggagatgatattgtgattatggaaggaatttcagatgagagaatcgttgaagagacgaaaaatgaggaggacagtctgctgagtatatttcatagtgttcataagtggaatgatgaagagtattctggaaatagattggcatgggtccagtgcttggggataccgctaaaggcatggaacgaagtatgcttctcaaaattagtatcggagtttgggaagttcatattcgtggataaggtcactgctagtagggagaagattgatgttgcaagggtgatggtccaaatagctacgccatcaacgattatattttgtgtcaatctgaggataaatggaatcatttgtaatgtgagtggtggaggagaccctacaacaggtggagtcatgggggaagaggtgatgtttgatgagggatttggtgggggtgacatcggcgaaatggtggaaggtctagaacgaagcagggttgaaacagtgggatgttcaaattataaaccaatggatataacacaacaggcaaatactttgcacaatagtcatagtactagctgtcttggtggtacaataaagttaaatgagggggataacagagaaagcaaaaaggaaataacaagggagacaaagggatgtgaagtgataaagacacagcatggaaccataaagggggtagggaaatgcatggagcattctagtggacaaataggagcaaaagagaatatgagtgctagatag

SEQ ID NO: 85662 - DNA, 225 bp, Glycine max
  Peptide Sequence Number=SeqID_177347
atgaaaacatttaccaaggatagtggtagattcggcaatatcataattggtaaacatctaagcaataagggttgttgtaaggctgccaaaggggtcgacaacgctgagggtggtgggttgttgaaacagttggtgttgactgaggagttgcaaagagaaagacaagggtgccaaaaggcttttgggttccaacaacagaaaatgtgttacatgaggagtgcataa

SEQ ID NO: 85663 - DNA, 477 bp, Glycine max
  Peptide Sequence Number=SeqID_177348
atggcctctaggaaatgtaagagtatcggttcaagacccacaactcaatatgatacaaggagatttcactccttagatccatggaaccggtacacggataatgtattggggagaaacatcttgccagagaagaaggtgaagctttaccacactgagtttgatgtttttaaaactgagttggagaggcataatctccataaacgcctcaccaatttggttgatgggagcatagatgtggctttggtgaaagagttctatgcaaacctatacagctctgagggtccttcaccaaagcaagccaggttcagaggccatctagtgaagattgacgctgacagcctcaacacattcctagagacacctgtggtgtggcacaaggtgagactttgcctacatactccagatattgcaggctgccttcagatcctagggagattgaggttgccctatgcataccaggtcgagggttcatcttga

SEQ ID NO: 85664 - DNA, 464 bp, Glycine max
  Peptide Sequence Number=SeqID_177349
atggcgactacaacggttgaagatccacctctcctagtggtagacgtggccgatgtgggctctaagatctcggacgtcagaccgagagttccctttgttaagatggcaaaagggggaacctatgaaataaaggacttcgatgctaaaagatggaaggctaatgtatgtatcagagtgccacatagcttgccatatgtatttggtggaccttggatagtacataagcccccaagctctgagtcagtttgcgggcgaaagaggttatcaagtgtcgagggtagtagccttgacaaccctccaaccaagacaagtgttgttcgagctgcttctatcaagttgtccaaggtggacatgccttttggttttgcaggggaaatcagacatgttagatgtcgtacaggatgtcacgacatcacgcttcagaacatgcagattgtatgtgtccgtatgaacagattaaacaa

SEQ ID NO: 85665 - DNA, 597 bp, Glycine max
  Peptide Sequence Number=SeqID_177350
atggctagcttgcagaaatcttccgaattggccaatttcacatggcgctgtagagtggcgacactcactgcaaaagtaagggaaggccgatattttagaacatcgtcctccacccattcaaaagccagcaacaactggatggaggatggcaacctagcattatggctacgccgcacatggagggacgccttaacgtccccaccatcactcctccttgctcccccaggaacaaaagggggaagaatcatggtaaccaaaaatgattccctagccagagaagcagtggaaggctacgccttcctccaaaggagagaagtgcctccaccagcatggtgtgagatcgtcaaactttctgaggaggaggactcgctatcggaagccccatggagagtctccgaggagggggaaccatcgatggagatgacctattggtccatcagggttgttgaatcgaactcccagagtcactactacccatgcccacggaggaatcataaattaaagacattgtcaaagaataataccttgaaagtgaagaaggcaaatgaagaagaaggggaatcacaaatcgtgaatagcaaagcaaggaagattcgg

SEQ ID NO: 85666 - DNA, 69 bp, Glycine max
  Peptide Sequence Number=SeqID_177351
atggctgccacgcgaacaggatttgggcctctttcagtagtgttgtcgcacagatcgacatcagtttaa

SEQ ID NO: 85667 - DNA, 676 bp, Glycine max
  Peptide Sequence Number=SeqID_177352
tgaagcgcttgagagattctatagcttgctgcggaagacaccaactcatggattctctgagccgattcagctgaacattttcattgatggagcgcatgaatctggttgttgtattcccttggatgatgctgcaaaggaaattaactatatggggaatcagaacagacaaggattcaatctaggtggttttttaggttaccaacaaggtgcaaattttaatcagaatcaagggcaatggtggatgtctcatcctaggaatcaattcaataaaaaccaaggaggaccatccaataggcctcagaatcatgggcctagcttgtacgaaaggaccaccaagctgaaagagactttggctcagttcatgcaggtttcaatgtccaacctcaagagcacagagtcagctataaagaacctggaaattcaagtgggacaactagccaagcaaatagctgaaaattcttccggaggttttggggccaatactaagaaaaatgctaaagaagaatgcaaggctgtcataactagaagcaagaaggtaaccatggtggaggataagaggaggaatagtaatgagcaggagttggaggatgaaggagaaaaagaaaaagaagaagatcagacgagagagaagaaaataaatgatgaggagaaagaggaaaaagaagaaaaaaaatga

SEQ ID NO: 85668 - DNA, 432 bp, Glycine max
  Peptide Sequence Number=SeqID_177353
atgacaattatattttacaatgacatcaacttcggtgaaggtttccttcaatcgttgtgcaagaatgacgatttggggttccgaaacgacgaggtttatgctgcagcacaagataagatttctgattttgagatgaagctgatggacatcgacaatgagtaccttgggattctagaggagggtgtaaagttttccaccaaaggagacattggaactaccaatatagtttgcaagcagaatacttctatggacaagcctgaagaagcttctatcattgagatgaatgagccattgtccaacatagttatcattagtttatcaaatgagctatcagttgtagttgagtacaagattgttaagatgggttatgtgtgcttctacttggctcctaagatagaagagggtgaagaagatacaaaacctcaagtttaa

SEQ ID NO: 85669 - DNA, 669 bp, Glycine max
  Peptide Sequence Number=SeqID_177354
atggctgaggttgttgggaaaatgttttgctcgataaatgttaagttacaagtcttcgagtgcttaaaatatatttgttctgttggtcatcctgatatggaaatgcacttttttatatcttctgatttccactgtagagatggattcttttttgctgtcaaagaagtgtcactacttgatcaagggaatcatggaaggcaaagtgtatatcaactggaacaggaaattgcacttttgagtcaatttgaacatgaaaatatagttcaatacattggcactgaaatggatgcatcaaatctgtatatctttattgagcttgtaaccaaaggttcccttcgaaacctttaccagagatataatcttcgagattctcaagttaagcttgagaggctgaatgattcactaaatccaaaaggaaagatgagaattaccccaagaaaaataaaggatattaaatgtgcaaatatattggtggatgcaaacggatctgttaagcttgcagattttggattggcaaaggcaaccaaattgaatgatgttaagtcatgcaagggaacagcattctggatggccccagaggtttgccttcaatctcctcctgtaaagaaagttattgaaaaatgggttaacatatgtattaatggagtcaacatagctgtttgtaattaa

SEQ ID NO: 85670 - DNA, 276 bp, Glycine max
  Peptide Sequence Number=SeqID_177355
atggagaacaatgatgctacacgaaagcaaaggctgaaatgcttaaataagaaatgctctcgggaacggaatcttcgagcacactccagacatcttctgaaagatcccaacagtcaaatcatggacaagtgtcttgtgaagctgcagaccaaatttcaagaagatccaacgattaacgaaggctgggcagcatttttaccgaggcaacttcatgtagcttcctcaagaagcttcattgaaaggcttcttcaagaagcttccccgtggcttctttga

SEQ ID NO: 85671 - DNA, 315 bp, Glycine max
  Peptide Sequence Number=SeqID_177356
atgtcaacttccatgatgtggatgataaaagggtgtcaacgagtagtccgcccttcgagatggtggaggattcaaccctttgaaaggggtctcgcgtctgtggctagactgtgtgctaaccatgggttaaaaagagagtttacgaggtatttttactgtggccccacagccaaatgtacttaccaaaatttagagttatcccatgtcaaagtggccaatgtgggctccaagatctcgcacgtcagaccgagagtaccctatgttaagaggacaagagggaggcctgcaaaacaaaagactctgacgcccaagtaa

SEQ ID NO: 85672 - DNA, 159 bp, Glycine max
  Peptide Sequence Number=SeqID_177357
atggtggagaagaagatggatagagggagaatgctttgcatgccttgggaggcaacaatgcaaagacgacattggttctatgcccgacttagtgcgagtgtgacagagacaaatatagtcgactgccccggtagaacgacggtggttcaaggtggatga

SEQ ID NO: 85673 - DNA, 402 bp, Glycine max
  Peptide Sequence Number=SeqID_177358
atgagaacatcaccatggagtctcatattggagactaggaacactgttaaatcaaggttgttagcatttgagggtatgcttcagtacttggaagtaagggagaagcaatacgacaagaaggaataccttgatttttatactgaccttaccgctacatctccagccgtttctggagtgatggtatatatagcaactcccgacaagaaatctaatgtaaattatttgggccctgcatcgattgaagacattgcaaggcaaataattcaagctaaaggtcccgcaggacctaacagagattatcttttcaaccttgaaaaggctcttcatgaaataggatgcaaagacaaacatgtcattgatcttgcaaatgaagtcaggcgtattcttgcagaggaacactga

SEQ ID NO: 85674 - DNA, 1269 bp, Glycine max
  Peptide Sequence Number=SeqID_177359
atggtgggaaacattgtcttggctaagcacagcaggcatcttcctggaagcaccgagagtttcttcaaaactcctattgcaatatcgatggctcatatcagattagctgctgcaaaggcaattcttcgtcttgctaggaaatgggatttacatattactccagatatttttcgattcactatattgattgccaaggactcttctttctttgttaggagcacgtttctcagtaagacacaaaagttattgaaggagcataaactaccaatcagatttgcttgtgcttttgctttggcagtaacagatggcactgatgatctgcaatatcaggcattagttgacatcagtattgttgagggagcccaggacattgttaatgatgctgtcttacatgtaattagtatttttcgagcaatcagaaaggttgaggatgccattgatgcgcagataacacctaagctgcatatgctggctgaaattgggatatttattttaaatgagttcaatcatggtggaatttctgtattgcaaacacctggacaaattttattgccttcatcattatatagagtgagtctcattaagaacgatactagttcaaaatgtccgaagtccttttttgatgaaaaatttctaagtagagtctttcatgcacttaaggaatctactgtgcctcatggatatgctcaaaagcctgcaaaaacacttcctaagcatggtcataagggtcaacaggatgttaaaaagtctaatgttaatatttacggtgtactggactcggcatctagcaaaccggatgatttgtcaaggagagaaatagcaaatgctaaagctgtgaggccaaacatcccttcagtgaaaaggggaaaatgtgtgccttcgtctggttctggaactgttggtttgcatgaatgctctatgactgagaagcaacaaaaaatagcatcaaaacactgtgagaagacaatagagagaaacatgctttcatcaagtgattctgtgcgctttaagggttctctgactgaatcacatgtgccaacccgcaaatcaaaaagagctgctgcttgttcatcggagaatgctgtgacaagtagcaaacatactgttgaaccttccaaatgtcgtagaaccaaacggaaagatacatgtggctcaaaggttggtgggaaattctttcaaatatcgaaagttgaatacgagtttgatccttaccaccttgtctctctaaaaccttctagcataaaaggcttgagtaggcttgtgctttga

SEQ ID NO: 85675 - DNA, 513 bp, Glycine max
  Peptide Sequence Number=SeqID_177360
atggctcacaattacatcgccaccgattcacctctctctcgtcgcatagttcgtgctttcctccacttcctcaactccgttgaaccgggtcctggggttgatgctgaggggattgaggttgctagggagtgtttggcagaggcttttaagcttaatcaatctcctgtggctggtgatgatgtgaaatctgattcattgattgacatattcaagtctcttgaagctaaaaagcaatgtgaacctagcaagtcagacgttggtcctcagccggattccgtggatgcttccagttcattctcgggtgagaatcctgctcgtgggaagaatcattctgaggcgtcgaaatctacgagttcttctgagtgtttgctgtttttctccaattgggtcgaacatgtggtagtggtgatgagaccaagcgagattgctggtgaggagaggaaggatttaacatgccacataagccaatctgttaaagctactattcctcacttaatgcttggactaacatga

SEQ ID NO: 85676 - DNA, 759 bp, Glycine max
  Peptide Sequence Number=SeqID_177361
atgcaatctaagaaatactctgatgcaattgagttgtataattgtgccattgcagtccatgaaaagagtgctgtttactactgcaacagggtaagattgatattgattataagggcagctgcttacacccagattaacaaatatacagaagcgatccaagattgtcttagatccattgagattgatccaaactacagcaaggcatatagtcgtctgggtttggtttattatgcacaaggaaattacagagatgctattcataaagggttcagaaaaggttgtggaaatcatctggagaatgttgactttattgctgttatgtactgttactttatcaaggtggccgagcgtaaattgttagaagagcaacaccgtgcatatcaaaaccagaattcaagatcatctcaagaattcccaaaccaatctgcgcaaggaggatcaagaagccacagcgtgccacctccattttcctctatgtcatttaatccccgtgatattgcaagcatgttcatgaacatcacaaaccctacaaatgcacagccgcaggggtcacattctcatcaggaaaggcaagaagatagcaatggtagtggaactagtgagcctgaaataagaattgggggaaatattagtgtaaacatggaggatatgccagaggatataacaggggccttacaatcaatgatggaaatgttatctggggctgcaccccctgggcaaccgcaagatcaaacaaatggaagaacagcaccaaactaa

SEQ ID NO: 85677 - DNA, 2313 bp, Glycine max
  Peptide Sequence Number=SeqID_177362
atggcgctcggcgctgactcggacctcggtggtgggcctggacgcggagtggaagcccgtccgaagattgttcccgagggtggcggtgctccaaatcgcgtgcggcgactcggcggtgttcttgctcgacttgctgtcccttcccctctcttccctgatttggtctacttgtcatccactttcgcctcccatggcggtttcgataagccaccttctaagtcactttctactgcaccatctaaggaaacttttgagtcaccttctaagtcaccttctatggctgtcccaaagttaccagcttacaatttggaactgactgatcgtgttttggggagacaaaaggaaaaggatcaagttgtgaaatttttactagacttgtctgataacacaaacacaaatggaaacatgtctatacttggcatcgtgggcccaggtgggattgggaagacaacacttgctcatgttgtttacgaagatcacaaagtgaggacgtcatttcaactcagaatttggataacatttcctagttaccaacttgaagctaggactttagcaaagatcatgcttagaattctacaagttagttctggccaagatgatgagttgctagatccgatgcctcacttgcaagagagcttgaatggaaagaatttgcttcttgtgttggatggttgttggtccattcatgagtgggagaaacttcaaacttgctttgaatctgctgcaagaggaagtgccatcatcttaaccacaaggacaaccaagactgcattacaaatgcttgcagatctgcatctgagtttcttatccatggagtattgttggtccttgttttctaatcattgttttggaaaccagaggcatagttgttctcctgagctggaagtgatggggaaaaggattttgagaaaatctgggggtatgcctttagctgttaaaatgcttgggggtctcctgtatgagaaagactacgaggtatttgaaaagatgcataacctaccttgctatatggacggccaaaggtctaattcagcaggtaacatggattttaccagggaaaagctaggtagcgagtattttgattttcttgtagcaagatcatttctcataagatcaaatagtggtggtaacatggattttaccatgcatgacatggtccgtgatttagccttgtttgtatccgcaaaaagtcatcctatctttgacagaaatgatgagagcattgatacttctttcttgatctcaaatctacaaaatgttgaagaaagttcatctgagctttatggccctcaaatggaagaatatatccccttgaaggataagattgacattgccaacataactcatggccttgaccaagaatctccagaaattgaagttaattatttatcttctactgcaaatgatgctgtccaaactacatttgagtattggactcatttcgatacactcagaattttggatgcatcacaactagtggaattaccatccgaactgtacagcctcagaattgaagggtgtcactctttcaagtccctgcaagatgtcttgatagacagaagcaccaacctctttgaattgtttataattgattgttcttttctcgagtacttaactgatgcatcatgccccacttcctcaaaatgtccagaacttgattcattacaggggctaccttcttgtctgaagttgctttccattgccttcggtggcaaacttatacccaaaaaggactggaatctacaagcgcttcactgtcttcttcattttgttgagattgaaagagacttgattctcgagactacggtattgtctaatcctgatgcaagtcttgggttgaaagaacttttccaaaatcatgatatgagtgataaagtcctaagagcacatttttctgaagcgttagcaattgtccaagccactacttgttcagatactgctcagatgatacctttagcagggggaatgatccaaaaatcatcatgttgggttactgtaccaatggatgaagttttgttgaaagttgtgaaaaaatatagtgataagattttgctaaaggagtcagacagaaagcccaaaagctcaaaaaagaaagggaagaagcattcactatttaatgggattagcctagaaaaacattttgagaagtctgatgagtggcgaggtaccccgccttgggatcctttggtggggggaaatgcatatccaaagttcctttgtgatgtcatggttgaaggcttggccaaacatttacggtgtgttgggatagatgctgcaattccttattcaaagaagcctgaaccaaggttataa

SEQ ID NO: 85678 - DNA, 669 bp, Glycine max
  Peptide Sequence Number=SeqID_177363
atgaataaaggcaaggaacctttagaaggacttggaggacctatggcaagggctagaacaaagaaggccaaggaagctcttcaacaagtgttaaccatgctatttgaatttaggcccacgttacaagtggagaatcttcggattgtcaattgcaccatgttccaagaagagtgcatccctgatcgcagctctcacaggcttatcaaacccaaggtccgcccttggctcatcaaacccaaggtccaccttggtgagtctcatttctctaaaggcttgccaaatccaaggtccgccttggtgagtcttgcttttccaaaggcttatcaaacccaaggtccacctatggtgagtcttgcttctccaaaggctcgtcaaacccaaggtccatccttggtgagtctcgcttctccaaaggctcgtcaaaccctaggtccgcccttggtgattcttgcttctccaaagaatcatcaaacccaaggtttgccctttgtgagtctcctatctccaaaggctcacaaaacccaaggtcctcccttggtgagactcacaggtttgtcaaacctaaggtccgcccttggtgagtttcatttctccaaaggttcgttaaacccaaggcctgcccttagtaagtctcataggctcttcaaacctaaggttcgcccttggtaa

SEQ ID NO: 85679 - DNA, 852 bp, Glycine max
  Peptide Sequence Number=SeqID_177364
atgacttggaggacacttaataggggccatgacaagttatttgtttctcttagaacttgtatcaattacggaaagaaaaacagacatcgtactgcaaagcaagagttgaaattctatttttactcttcttacttactataccatgccctgttcgatattgttatgttatgccaattgctcggacactcactagtagtagtagtaattagtactgttttaagttttggagaacatgacctatgtgcaaaggatagaactattgaacttggagtagaaaatgcattggatgtaaatgatatcatgagcaaaggagaaaatgaagaggaagtagttcacagtgtgagtattgacttagagggatcaagttctgccataaggaaaaacactcgcccaagtaaaaatggagagaaacaagggatgatttcctcaataaaaaaagtagttgaatcaatgaaagaatttgttgaagtgactaagaagaagacggagaacaaaaagaagatggagataaaagaagctcaagaaatggtacatgaagtggtgaatgagctagataatatacctaattttaatggtgcacttcgacatagagtaatcgattggttgacagaaaattccattaagttttcgattataaaagctcttccattggattggatgagaaggaagattacgtctcgtcttttatgtcttgatgccaaattacaggtgtcctcttcctcatccttgtctgtaacaaatttaacagtttcagaattcaaagcaacgaagaacacaatgctgaacaacactagtggttcgatttcattaatggacacaccaatcccaaatctcaatgttgagctgagctag

SEQ ID NO: 85680 - DNA, 2538 bp, Glycine max
  Peptide Sequence Number=SeqID_177365
atgggttacttgaggactggacgtaagcacgggaagtggccaaatcagtataaatcgagccacttgtccaacaagagcctgactgctaagggcataacgtttgtgctcctgtgccaaggccgacatggagagctgacatatgtaatggagtgccacggtgaagagtttgttgagcccccaagcatgaacgagtgttatccggtgtcgagaggggtaacctcaacaagtgttgttcgggctgcttctgccaagttggccagggtggacatgcttttggttttgcaagtgaggcgagtgaagcataggtgcagtactcttgcttatgtgtcactcatggagtggacacgtactggagacgcggatcgtgggtatcctcttttgatcatgtctttcttcctttttgagtccaccataggcatggatggtattgactccgggggttcgattcagcaacccctagtggatctagaggcagttctcgtcttcatgggagggtgtagccttctgttgcttctccagtcaaggaacttgttccacatagctatagtgatgggtcgccaccgtccccctgccgttgctggctatgagtgggtgagggataatgttttaaagagtgacgatttcccttttctaacagtggcgctaagaagtccacccttcgtttttgtgtatcattgtttctttaacgttatgggtttggtcatccccttgaacacattccaatgtgctttggttgagcacttaaatgtgtccccttcttcactccaccttaatagttgggccatgatgatgttaacgagcaagatcaattgggtctccttgaacaacgtatccaagaagctattcaattttgactcgaacgtgtttcgtcgctccaaggaccatttcttcaagtctgatcccaccaagttcaagtcttttaatgtggatcttttgacccttgtggagagggtcgaaaaagctatattggagcaactgccggtcttgttggatgcgtgggcaattttgtctcttcctttaacggatgatcctttccctaccttggatgataaaactagatctgctggtgggactgtgccactatctactatcattcctcttactagagaaaggggtcaacttgtcgttgaggtcggccctactacaggtgttgctcaggtctccctcggcgttccttcctctattttggctaagaggaagcaagatgacaacacttggggcccacctttggctccgtcggctatccaggcttctgttgttgttcttgctcctccacttcctcttgctgctcctattcaggagttcactcctactgcttcaactagtcctatcgtggctccttcgtccatcatcattgcaccctacagagtgcctcatcaccttccaccttatttcaccccagcgtttctttggatcacatctacacttcctatgatgttgattcgttgtggggtatgggttacaagatcggttggcctggtgttaatctttgataaaaatcttgtccatttagcgatcttgaaagaaaatggtcaacgacaccaagaggcgctaagcaaggtggcgtccttggaggatgaggttgccaaatggagggctaatgcttgcatagcctggagaatggagtgtcctaaggtagttaatgccactatcgcctttgctgaagctataaagtcaaaccatcaactgtcttccaaggttggcagtgttcttgccaagttgtgcaccagcattatgactgagaaggatgagcttgctaagctggtggcaaacctcgaggtccagttgaaggagtcaaagtccaggctggaggagtttgagctacatgtgtccaaggagaaggaggccagcaagaagcttgaaaaggagttgttgatgtacaagagggaggtcgtggaacaacatgaaaagggctttcataacaccattaggcaggttgggttcattgccaaggaccgtgacttgagtcatttttaccttttcaaggacgtgaaggacagtgttatgcttgacgaggaagatattgttgttgagggagaggagtgcgtaccaagggtagaccttggcttttgtaccaagggtgaaccttgggtttctgaggcagaacttagcaacgaagggacttaccaagggcaaaacttgggtttaacgaaccttggaccaggagcacattcatcctgggttttggcgagtcttaccaaggacggaccttgggaccttgggttttgtgagcctttggagataggagactcacaaagggcaaaccttgggtttgatgattctttggagaagcaagaatcaccaagggcggacctagggtttgacgagcctttggagaagcgagactcaccaaggatggaccttggcaagactcaccaaggcggaccttggatttggcaagcctttagagaaatgagactcaccaaggtggaccttgggtttgatgagcctttggagaaggcggaccttgggtttgataagcctgtgagagctgcgatcagggatgcacctatgttgggttttttcaagacttactga

SEQ ID NO: 85681 - DNA, 174 bp, Glycine max
  Peptide Sequence Number=SeqID_177366
atggaaggacatgagccaactcttataataacagatcaagaccctgccatgaaggtaggattagcaccttctggaactagagtattggtacgtgcagatcacgagaaaattgcacgaaaaagactgaaaaatatgatgcgtgtgagtgtgaagttgaggcacggttcattctga

SEQ ID NO: 85682 - DNA, 357 bp, Glycine max
  Peptide Sequence Number=SeqID_177367
atgtctgtaaaggcaaacacagtacaagacaaaacgtttcataagaggtatgtcaacaaaaattatcacaataacaagaaaaagtacaaacataataacccacgtgttgctccttctaatcccatcccacgtgctactacttctaatccttctttcaagaaaaagggaacacgagatgacattgttgttgtggtcatttctcaagtgaatgttgtcaccaatgtgaacagatgggtggtagactttggggctactaggcacgtctatgctaataagattatgtttatctcctacactattgtgggggatggagaagaacaagtttatcttgaaaattcaagaactacttcggtttaa

SEQ ID NO: 85683 - DNA, 933 bp, Glycine max
  Peptide Sequence Number=SeqID_177368
atggtggtctcttcctccttgaaggtctcatgcaagaagaagaaaatgaaggctgaagttttggtttttggagaggaaatgcgtcctcccaccttctcattttcgaataaaccctacttcttgaaccttcctccctgctggcctccactctcgacgtctcttgaactttctcaactaaccctctcagtctcacgctctcatactcattcgctcagatcgttacaatcggaaccaagaggttgtagaagctggttgagttcattcgggagcaagcacgagaggccgaggaaggatcgcaaaggatggttcacgatctttccggttcgccggtggccgcagcttccatggtcatgcctttcaccgcttcgctcggtttggaccgatgaattcatcgggaagggtgcgatagggcaggtctgccaggtcattggtgtcgtcgtcgatgtcaaattcgacgagggtttgcctccgatcatgaccgcgctggaggttctggatcactcgttgaggcttgtgttggaggtggcgcaacatttggatactgagcattatttgcccattcatagagaagctcctgcttttgttgagcaagaaactgcacaacagattcttgttattggaatcaaggttgttgacctgcttgcaccatatcaaagaggaggaaagattgggttgtttggtggtgctggtgtaggaaaaattgtgcttattatggaacttattaacaatgttgcaaaagctcatggtatagtggtgtcattaagcttgatgcagactgaaagcaagtgtgctcttgtgtatggtcaaatgaatgagccccctggtgctcatgcccgtgttggtcttactgggcttactgtgggtgaacacttccgtgatataaaagatgcgatgacagtacctaagtgctatatttataaagctaattcttaa

SEQ ID NO: 85684 - DNA, 741 bp, Glycine max
  Peptide Sequence Number=SeqID_177369
atgataatgatgccccccaacgacaaaggcctaccgcatctgcccggttttccaaacggaccccatgacacatcagttttgagagattttgaaaatcacgttgctttgagagtttggaatggaaaggaacatcctgagcttaagttatcttcccatggaaggaagatggctaagttcgacaagcctgctccagagattgaaggccatgtggctgtcagtggactaagtccttcgatcgcatgttccctagatacgggcgatcgaggacttatgtctgctatcgtggaacgctggcataaggaaactagtagtttatatttgcccgtaatagaggtgactatcatcttggatgacgtggcgtcgttgttgcatttgtcgatcatagaggcattccatagcttcgagacgcttcatgtcgatgatgttgtctatatgttggtagaattacttgagtgttggatctatgagtatttcccatctattggttttgccatagctgtcgaggattatgacgagcgtagaccgtgtgcatgccgatggacctctggcaaggtgttacccgtgtggacgtatcgtaggcatctagacatgctgacccctgatgttccagaggatcctcctagagttctgccagttcagcaatatgacacatttgttgaaccagatgtgcctcagcaaccaaaggcgacaacgacacatgatgaaccagacattgatgtgcatcttcctcgacatgcagtg

SEQ ID NO: 85685 - DNA, 570 bp, Glycine max
  Peptide Sequence Number=SeqID_177370
atggaacaagaacaagaaagtctcaggtccagactattccatttcaaaggaatgcttgaaaatacaaggagtcatacaaagagtttgagcattaagagtgccggtgcattggatccttctcctttggaagaagagccagtgtcatcaagaagtcaaggatcaaaagctctaaatgatctggataaggttcctaggccaaggaaaagcaaggaggaaattgtagccaaagaagccaaagataagatatctggtggaggaaagagtgtttcttcagctttggcattgtcaaatgcattcacaagccttgctgatgccgagaatgcagatagaaataatgataccaagtggtggatgcctacacctaaggttctcatagactcttattatctgatgtggaaacaaggttctcatagactcttattatctaatgtggcaacaaggtttgtccagtatcagaaagatcgtgtgaaccatgttcttaaagcagcacaggagacgatagggcgggctacggttgatggagggcacgatctcagtaaggacacgaggcatggtcaggttagtgagtga

SEQ ID NO: 85686 - DNA, 513 bp, Glycine max
  Peptide Sequence Number=SeqID_177371
atggctgtcataggattaagtcctctgattgcatgttccttggaagctgatgacaggggacttatatttgcttttgtagagaggtggtataaggaaactagtagttttcatctttcggtaggagaggtcactatcacccaagatgatgtggcatcattgctacatctgctcattacaagcacctccatagctttgaggctcttcattgttgcatatacgagcattttttttactgttgcttcttctattgctgctgaagattatgatgagaggaaaccacatgcttgcagttggaagtctaggaaggcattaccaatgtcgacgtatcgtaaacaattggatagattgacgtctaatgttatttgtgttgctcctagaaagtgtgcagcaaactacatcaagtggttctgcttcacatctcatcccttcatgagtccaacacaaccagaggatcctcctagaaatccacctgtggtgcacgatgatacgtttattgaaccagatcctccttag

SEQ ID NO: 85687 - DNA, 408 bp, Glycine max
  Peptide Sequence Number=SeqID_177372
atggcaggcttcagtggcgacgaaaccgctcctttcttcggcttcctcggtgccgctgcggccctcgtcttctcctgtatgggagcggcgtatggaacggcgaagagtggggtgggggtggcgtcgatgggagtgatgaggccggagctggtgatgaagtcgatcgtgccggtggttatggcgggagtgttggggatttacgggttgattattgcggttattatcagcactgggataaacccaaaggctaagtcttactatctctttgatggatatgctcatttgtcctctggccttgcctgtggcctagctggcctctctgctggaatggccattgggattgttggtgatgctggtgtcagtgatatggcaatgcgaggggggagacaactctcagtctcgggttga

SEQ ID NO: 85688 - DNA, 1365 bp, Glycine max
  Peptide Sequence Number=SeqID_177373
atggaatgcaagaaacaaggagaagacattcatgttattcctgcgttctacaaaatagacccatctcaggtacgcaaacagagtggcagttatcatgcggcattcgcaaaacacgagaaggataggaaggtgagtgaagagaagatgcaaaagtggaagaacgctctctatgaagcaaccaatttatctggcttccattctaacgcatacaggactgaatctgacatgattgaagaaattgccagagttgttttgcaaaaactaaatcacaaaaactacccaaatgacttcagaggtcatttcatatcagatgaaaactgttcgaacattgaatctttactgaaaattgagtcagaggaagttcgagtcattggaatttggggcatagggggtattggtaaaacaactctagctgctgctatttttcataagaaagatcttcatattgacactcctaaggtgataccctatattgttaagagaagactcatgaataagaaagttcttgtcgtaacagatgatggtagcagagtcattgtgacaaccagagataagcatgtacttatgggtgaagttgttgacaaaattcatcaagttaagaaaatgaacttccaaaactcccttgaacttttcagcataaatgcctttggcaaaacctaccctaaaaaaggttatgaggagttatcaaaaagagcagtggagtatgcgggcaatttttctgcagatatagggacaagaagtcttttagacaaagctcttatctctattacttcagatggtgatcacgtagatatgcacgatctaatacagcagatgggtagagaagttgttcgtcaagaatcaatcgaaaatcctgggcaacgcagtagattgtggaatcctgaggaagtctatgatggaaatggtgcagttgaaggaatatgtttagatatgactcaaattacatatatgaatttaagctctaacgcattcagaaagatgtcaaaccttagattacttgctttcaaatcctatcaagactttgagataattaattcagtgtaccttccaaagggtctcgaatgcttacataaaagcttaagatattttgagtgggatggatatccattggaatctctaccgtcaactttttgctctgagaagcttgttgagttttccatgccctacagcaatgtgaaaaaactttggcatggagtacagggagaccagtcagggtcacagtgttttgcgagaatgctccaaccatatgggatcaacacaggcttaaaggagcactcaaaccgtgtgacccccaaggcctacactccgaagagtctgtcagggtctctccctcctgattcaggtccaacccagaaaacattttag

SEQ ID NO: 85689 - DNA, 531 bp, Glycine max
  Peptide Sequence Number=SeqID_177374
atgttggaaagttttaaacaacaagaccaaatgtcagttctggaattatacataaaaaaagatgtggctggtggttcaatgtttcattatgcaaattcgcttacatcatgtggaaattatttatctaatgatgagacacaaccgccaacaaatatgagcaatttacatattgacgaagaagatgatgatgatgattatcttgtgtctaactcatacgttgaagagtctttagacgaagatgatagtgttgacggtatatctgatacagatgatgaagtcaccgatattcctcaaccagtaagaaatgttcacccagcagaaggtgcacaacgaattgaaaatccattttgggatgatgctttacattataacaatatcaactggagttatcctgatgaggaggacatttgcggtttggagatgtcgtcaacctttaatgttggccaagaattatatgttggcatggaatttgatagtaaagatgcgatacgtggaaagtcacacaatggggtggactacacacatgtctga

SEQ ID NO: 85690 - DNA, 771 bp, Glycine max
  Peptide Sequence Number=SeqID_177375
tggtttgcaatcgaaactacaaccacactgggggctttcgaggaaattctcgatgtcaaaatcagtggaagtgattccgacagagaagtaaaaatcgttcccctgacgatagaccttgacgatgttgagccaaaggagcaatattttgacagtgacacctttgagattatagagcctgcccttggagatgacacccgtgatggttcatttgtacttgagcatgtaggcttctatgtcgaggctgcacactccttggaaatacactgtgaactcgtcgttgtctttgttaagcgaataccctatggctcccttgggaagaagacccaacgggaacccgagggcaagggtgaggtggagggtcacagggaggttgaaattgagagtgatggcgacgaagacgacgagcctggtggagacaatgacaacgagggcgagagggaacaaaagtcaagttgcaatgcaaccattgtggagagtccaaaaactaaggatgattgtggaaaacttagtaatgctactagggttttgaatagaaatcattttggtttttctgcttattgtgtggctaccattgagttttctagacggcagattccaattgctttccttcaacgaatcaacgaggattttaccaagaaatatgttggaggaaaagcagcaacaacagctgctcagagcctcaacagagagtttgggtatgagcagatgaagtattgtgttgatcatgcagaggaaattagcaagcttgcaaaagttaaggctcaagtttga

SEQ ID NO: 85691 - DNA, 129 bp, Glycine max
  Peptide Sequence Number=SeqID_177376
atgaagaaagtggaagaacaaaggagtgaggaaggagaaacaaacctaagtttggaggcacacttagttgttttcttcaccttggatgaatcaaaggagaaagagatgttattgatccctcttttctaa

SEQ ID NO: 85692 - DNA, 189 bp, Glycine max
  Peptide Sequence Number=SeqID_177377
atgattttcatatgtggcctaggatcttcttcatcaatggattcctttgcttcttggaagatgaatggtagcggaatggagaaggaagagagagaggagacgccacttcaaggagaagatgagtctagaagaagctcaccaccattggaggccatggataagagcttggaggaaaaaagagatgaatga

SEQ ID NO: 85693 - DNA, 237 bp, Glycine max
  Peptide Sequence Number=SeqID_177378
atgaagaatcagggagttctcgaggataagttgaaccctttgaagggtgttagtggcacttttaggcctggtgttctcacagctctaatgggttccactggtgctggcaaaacaacttcgatggattatatcaatccttgctctattcagcatggcttcgattatgagcagaaatcaattctgagaccaggaaggtcggtattggaatcccatgttgagtataaatatcttagttaa

SEQ ID NO: 85694 - DNA, 198 bp, Glycine max
  Peptide Sequence Number=SeqID_177379
atggaggataaggaagcattggttagcaactgcagccgtgcaggtgatgaagttccaccttcaacattttccatgatgaacattgatgaggatcggttatctttccacacttctaccgatggctatggctatctacttgccactctttgctccttcatcgcatatctgttcatcctatatacgggtatgactatttaa

SEQ ID NO: 85695 - DNA, 327 bp, Glycine max
  Peptide Sequence Number=SeqID_177380
atgccagtgaggatctcttctttcaccaatctcagatcaaatatgacgatttttgaagtctcgctgaaggagagtccattgagttcgccattgaatatgaatctgatggacgcgccaaggttgttgatgtccctggccccaatgacaccaacgtctagggaactagacacagcggtgatggtggaagaggaggcggtggcgtggaggaagctacaacagttgtggagagtctgggcattttgccagagattgcccatcaagtgctcgttgaatttactgttatggtgggattttaatggtttttgtcaaagctatggcttcttataa

SEQ ID NO: 85696 - DNA, 300 bp, Glycine max
  Peptide Sequence Number=SeqID_177381
atgaagaagaaaacaagtggccaccatggcttaggccatttctccaaacaagccttttttgttcaatgcaaagtccacacagatttccacaaaagtgaatgcaacacgtattgctcggattgtatgaatggagccctttgttcagcctgtcttgcttctcacagagaacacaaagctattcagacaaggagatcttcataccatgatgccatgagggtgtcggagatacagaaaattctggacataacaggggtccaaacttatactataacctgtgccaagattgtgttttatgaatga

SEQ ID NO: 85697 - DNA, 582 bp, Glycine max
  Peptide Sequence Number=SeqID_177382
atggcaaaaatcaacttcccggatttgaaggataagctagatgtcttgagtgaagaagaattgcaaaggaggagggtttgtttgggagagctttggaaagtctcgagacaccatgattctcttacccaacaaaaagctagagtgaagcgggggacattgtttctatatgatgatggagtttcgggagaatggataggttttggagagaggtggatcaaatggattataggatgtatggaatttgcgtttgtttttgtgcttgttaagggaagtcctactatggaattttcacctcacagaggattaaaacagtgtgatcctattgcatctattgtagcagaaggtttgagtgagcttatgaggcaggctttgcatagtagaatcttctcaagttacaaggtgaatttccacaaaatttgtgtgggagggcttggtgtggacggaaacattttgagtacatttgctgcttctgatttggaagtctacgtggggagcagtgacttggactttgtggtgccatggaaattgcatcattttcggggaggaagagctagaattggacctggtgatggaactgattaa

SEQ ID NO: 85698 - DNA, 321 bp, Glycine max
  Peptide Sequence Number=SeqID_177383
atgtgttcatctatccggggatgtgatgatgtagattggagagaagcatcggctattaataaaagtggaggattgctttgcttttggagaaaggatattttggaggtaaatcatacttttattggtagtggctttttaggtttaaaaggtacttgggaagtagatgtcccttgtactgttgtgttgaacgtgtatgctccttgtgagattgaaggagtaaaatcggttacagcttgggttgtgtgggtgtgggtgtttgacgcagtgcttgtggcttggccgatggtggtggttcacggaggaggagggtggcggttctga

SEQ ID NO: 85699 - DNA, 336 bp, Glycine max
  Peptide Sequence Number=SeqID_177384
atgggggaggtggttgccacccagctcgcccaggcgagctcagctcacccagacgagctagattgcttaacgatgggtgtcaagttcctcgaagcggtcaagcgaaggttgcatgccatcaaacaatggtccccggacgaaattagggaaccgattgggaaaataacaaaactgtattttccccttatcgggggctccgtacttgataacggaggacccatgaacagcgctaggcaatcaattcatgggactccggactcgatgatggagaatgcacgaacagcgctaggcaatcaattcgtggagctccagactcagatggtggaggacgcatga

SEQ ID NO: 85700 - DNA, 264 bp, Glycine max
  Peptide Sequence Number=SeqID_177385
atgcaccacaggccgcggacgcgcccccaccttatcaggctggtccagccggatcatttgatacagagcagtatttgcggcatttggttcgccagcaggcggccaaccaccgggcacatggcagaggtcgcatggcctggagattggcccgaggcccaggcaggagaagcaccagcagaggctcccgacgaggcagatgaggcccacgaggacgaagagatgatcgatttactttatttcttaggagggagcggtgccacatga

SEQ ID NO: 85701 - DNA, 822 bp, Glycine max
  misc_feature (180)..(180): n is a, c, g, or t
  Peptide Sequence Number=SeqID_177386
atgaagctggatctgttcgctaacgaaaagctgaaagcggcactgaaggcgcgcggtgtgttcgcgggattgctttccgaagaagaagatgagtttgtcatctttgaaggttcggagaacggtaagtacgtagtattaatggacccgctggatggttcttcgaacatcgacgttaacgtntccgtcggcaccattttctcgatttatcatcgtattagtgagccaggcacaccaatcactgaagccgatttcatgcagccgggccacaagcaggttgccgcaggttacgtggtgtacggttcctcaaccatgatggtatacaccaccggcgtgggcgttcatgcctttacatacgatccgtcgctcggtgtattctgcctgagccacgaacgcatgaccttcccggaaaaaggctacacctactcgatcaacgaagggaattacatccgcttcccgcagggcgtgaaaaagtacctgaagttctgccaggaagaagatgtttcaacgaagcgcccttacacctcgcgctacatcggttcactggtggcggatttccaccgcaacctgctgaaaggcggcatttatctctatcccagcaccgccagccacccgaaaggcaagctgcgcctgctgtatgagtgcaacccgatggccttcctcgccgaacaggcgggcggtaaagccagcgacggtaaaaaccgtatcctcgatattcagccggaaacgctgcaccagcgctgcccgttcttctgtggtaatgatgcgatggtcgacgacgttgaacgctttatgcgtgagttcccggacgaacatcaggcgtaa

SEQ ID NO: 85702 - DNA, 361 bp, Glycine max
  Peptide Sequence Number=SeqID_177387
ggatggtgaaagccccacagcccaggtacctcaacaggtacaagatgcttcctccaagaccaccattccagagtcattcactcttcatcctaaggcaggggaagaacaggccagaccagagacggatgctactcctgagagatcacttgagggcacatcggagcctcctactccagtggcagacctctcctcaccacagcctgcagctgacccttccactcttgtacttgacataccagaggaccagaccacaccagtcctggcaccgaacacctctcctccagctactccagtacttcacttgacagatgaggaggatgctcagactcaggatacccaggatctatctcaagacttttaa

SEQ ID NO: 85703 - DNA, 279 bp, Glycine max
  Peptide Sequence Number=SeqID_177388
atgaatgttgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcacggggaagggtgtttccctttgctcctacgtattcctcaattgggatgagaaaatcagacctacgtagttcttttggaacaaagtgtttggtttaa

SEQ ID NO: 85704 - DNA, 740 bp, Glycine max
  Peptide Sequence Number=SeqID_177389
tgcatgaggtagctacaaacttagctgcatcatctgaaagtaagaagcttgaaggcaaactggatgcattggttaacttggtaacccagctggccttgaaccagaaatctgtacctgttgcaagggtctgtggtttgtgctcctctgctgaccaccatacagacctttgcccttccatgcagcaacctggagcaattgagcagcccgaagcttatgctgctaatatttacaatagacctcctcaacctcagcagcaaaatcaacctcagcagaacaattatgacctctccaacaacagatacaaccctggatggaggaaccaccctaatctcagatggtctagccctcagcaacaacaacaacaacctgctccttccttccaaaatgctgctggcccaagcagaccatacattcctccaccaatccaacaacagcaacaaccccagaaaaaaccaacagttgaggctcctccacaatcttccctcgaagaacttgtgaggcaaatgactatgcagaacatgcagtttcaacaagagaccagagcctccattcagagcttaaccaatcagatgggacaattggctacacaattgaatcaacaacagtcccagaattctgacaagctgccttcccaagctaagcaacacattcctcctcttccattccctccaagagcagtttccaacaaaaaaatggaagaggcagagaaagagatcttggaaacattcagaaaagtagag

SEQ ID NO: 85705 - DNA, 147 bp, Glycine max
  Peptide Sequence Number=SeqID_177390
atggccacaatgatggaggccatgatgagcatgaagaagataatggaagccaatgtgattgcagttgcggctactggtgttgttgctaaggtgaacccgacacccccatctggccttaaccaaatgaatcatccaacctcagatatg

SEQ ID NO: 85706 - DNA, 426 bp, Glycine max
  Peptide Sequence Number=SeqID_177391
atgagtgatggattttgcggtactcatttgcagatcctggttaggattagaggattaggtcgtgccttaggtcagtgtcgacgacctactacatccgcacggaggcaacgagtcgctgtgactacggatcacgtcgataagccagtcatccctgcgccagatgttcaggatgacccggtggaggcaccagctgctgtagaggacattcttgcggacgcaggcgcagagcctgctgaggacgtgcatgagggattttcgagtggtccgagcgacccatccgtgttgaccctgtatgcggatcacgttgcttgcagcgtatggacgggagaggagcgtcctgaattgaagctatcctctcatgggaggaaggtccacaatttaggcaggcctgtccctaccattgagggacttgttgctggtacatga

SEQ ID NO: 85707 - DNA, 159 bp, Glycine max
  Peptide Sequence Number=SeqID_177392
ggcgaattggagctccaccgcggtggcggccgctctagaactagtggatcccccgggctgcaggaattcgatccttgtgtgtttagaacttgtaaaaggaatttacaagatagtggaactctcaagcgggttgcttggggactagacgtaggcacaagg

SEQ ID NO: 85708 - DNA, 138 bp, Glycine max
  Peptide Sequence Number=SeqID_177393
atggcacaagaatgcttcccaaatgaatatatgatgtggaattgctcctcaagtgtagatagatggcatgaaagttccttttcaaatgcaagaaatggccccgaggaaacttgcctcaaagagatccaggaaggataa

SEQ ID NO: 85709 - DNA, 378 bp, Glycine max
  Peptide Sequence Number=SeqID_177394
atgcccactaggaggaaggaagtcgtatttgttttctgggttataccccttcatggcaagagtagcgaaggtggtcaagatctcgatgcaagaattggaccgagggagtggacttcattcattgatgttttagcacttttggtgttaggggtcgtcctctttccagatatggatgcgctagtggatctagcggcgatcgatgcttttcttgcttatcaccacaccaaggaaaacccgtctgtcccctacaaggtcaccgcatgtgcaccgggaaagggaaagcaaattaggagcagctcttggctggaagagagcatcatgcctttcattgcacaaggtttcagtgatcccaatgcaagaatgcttcaaagagtctga

SEQ ID NO: 85710 - DNA, 820 bp, Glycine max
  Peptide Sequence Number=SeqID_177395
atgaggggagcacccattgaagaaagcatgtctcctttccttgtgagacatttcggcgcgcaaaatttcaaggctatacaaagaatccataaggcatgggaaaccccgttaaggaaagatcaagaacttaggggcattcgtaatggcatcattggtggttatcatgaatggctgaaagttcatatacgaggtttagattggctcgccaagttaaaagtcgtcagcgaagacagtttcgaagcaccggaagaagacgaagaggtccaagctctcaaaaacgagttaggaaaggcgaaacttgccaaggagaagttcaaaatgcaactaccgcaaagagcccttgaacaagagaccaagagggctcgcaaggaagagtatggccgtaacaaatttcgcggagctttgtggggtagcaacaatgaactcaagctgcgaagggaagagagggaccagtcgcgagcacatagcatggtcttgaaagaggagttagttgcctgttcaaggtccaaaaggagcttgtctcagcgtttatgcgagacggagaccaacatgctagctatcatcgccaagtaccaagaagagttaggtctagccacgacccacaagcatagggtcgcggacgagtatgcccaagtatacgcagaaaaagaggctagaggaagggtgatcgactctttacaccaagaggcaaccatgtggatggatcggtttgctcttaccttgaacgggagtcaagaacttccccgattgttagccaaggccaaggcgatggcggacacctactccgcccccgaagaaattcatgggcttctcggctatt

SEQ ID NO: 85711 - DNA, 760 bp, Glycine max
  Peptide Sequence Number=SeqID_177396
ggggagactgctgctgatgatgaagtgttgtaagctactagaagatgctgcagtaaattcccctgctgaagtacctgggcagacctactgggagaagatcactgccaaacgagtccagcattggccaaagaaagggaagctttcagcagggaaagctaagtgtgagagtatgcaattctacacgagaagacttgtgatgctgaaaactggtacccaccgaatcatacttccactgttgccacagggcaccagaaagctgcttcaggtgctgtgtccaagtaccttgattgctgaactcaaggaatgcaaggtgctggaagcaacctcattgccaacacaggtggcacctggattgcagaacggtgatacaaggctctcagaaagggaaaaacccccattgagagcgaaagaaatttcctcatctgattctgatgatgatgtcgaactagatgtctcgacatctaagagggccaagaaatctggaagaaaggtgcctgaaaatgttcctgatgcaccattggacaacatctctttccactccattggcaatgttgaaaagtggaaatatgtgtatcaacgtagacttgccttggaaagagaactgggaagagctgccatggattgcaaggagatcatggacctcatcaaggctgctggactgctgaagactgtcagcaagttgggagattgctatgaaggcttagtcagggaattcattgtcaacattccctctgacataactaacagaaagagtggatga

SEQ ID NO: 85712 - DNA, 1071 bp, Glycine max
  Peptide Sequence Number=SeqID_177397
atggagttcagtgtaaaaagcggtagcccggaaaaacagcgcagtgcctgtattgtagtcggcgttttcgaaccgcgccgcctgtcccctatcgcagaacaactcgacaaaatcagtgatggttatatcagcgcattgctgcgccgtggcgaactggaaggcaaggtcgggcagacgctgctactgcaccatgtgcccaacattctctccgagcgcatcctgctgatcggctgcggcaaagagcgcgagctcgatgaacgccaatacaagcaggtgatccagaaaaccatcaataccctcaacgacaccggctcgatggaagcggtctgcttcctgaccgagctgcacgtgaaaggccgcaatacctactggaaagtgcgtcaggcggtggaaaccgccaaagagacgctctacaccttcgatcagctgaaaagcaacaaggtggagccgcgtcgtccgctgcgcaaaatggtgttcaacgtgccgacccgccgtgagctcaccagcggcgagcgcgctattcagcacggcctggcggtggcttccggcatcaaggcggccaaagatctcggcaacatgccgccgaacatctgtaacgccggctacctggcctcgcaggcccgccagctggcggacgccttcagcacccacatcaccacccgtgtcatcggcgaacagcagatgaaagagctgggcatgaacgcctatctggcagtcggcgccggttcgcaaaacgagtcaaagatgtcggtgatggaatataagggcaacccaaatccggacgctaagccgatcgtgctggtaggcaaagggctgaccttcgactccggcggcatctcgatcaaaccggccgacggcatggacgagatgaaatacgacatgtgcggcgcggcgaccgtgtacggcgtgatgcgcgtggtggcggagctgaacctgccgctgaacgtgatcggcgtgctggccggctgtgaaaacatgccgggcggccgggcgtaccgtccgggcgacgtgctgaccaccatgtccggccagaccgtcgaggtgctgtacaccgacgccgaaggccgtctg

SEQ ID NO: 85713 - DNA, 459 bp, Glycine max
  Peptide Sequence Number=SeqID_177398
atgagagaaaaggaaagaaagcctcaagaggctaacattaacctcccatactttcatgggaaggacaatgtagaggctaacttagattgggaaataaggatagagcaacaacttaaaaggaagtctacttcaaaatcttatggctctcactcttatccaaagaaagaccaaggtcaaggcatcttaggggggaagacaatagaaaagcaaccccttaaggctagtagggaagagaagactagcttcatgaagtgctttaaatgtcttggaagaggacacattacttctcaatgccccaccaagaaaatcatgattatgaggggccaagacatttatagtagccaagatgaggctacttcttcaccttcctctagtgaaagtgaagaagcaaaaagggaagaatctagtgaagaaatttacccccaagaagaagaacaacctttaatggttaaggagtga

SEQ ID NO: 85714 - DNA, 222 bp, Glycine max
  Peptide Sequence Number=SeqID_177399
atggccaaaatacatcatcaagcatggccaacaaaaacatatcatccaatgaaacataccctccctcacacttattcccaaaacaattccaaagctccaaaattccttaagagtagggcttataagaacaaaatacctaaatcatctcccaacatgcatgtgaagcaagaagtatcaacaagagtcaagccaaggctattgtgcaagcaatcaatggggtaa

SEQ ID NO: 85715 - DNA, 175 bp, Glycine max
  Peptide Sequence Number=SeqID_177400
gtattgtcatcatcaaaaagagggagattgtagacaaatgatcaagctgtatacaaaggatcaagctgaaagttttgatgatgccaaaggattacatgaatcatatgcttctcaaagatttactcaagacaaagcaattagagatattcaagatgataatcaagacagtctatag

SEQ ID NO: 85716 - DNA, 567 bp, Glycine max
  Peptide Sequence Number=SeqID_177401
atggtcattgaccaatcctttttccatgacttaacccaattgtccagtgacggtgtaccatttgaaggtacactgaatgacgattggaagtttgatttttctgcacatgatgcccgccagttggtttgcaccaacaatgcggatatgaccggacgccttcttgtcggctcattggcttttgaaagccgtatccttcattatctgattgtgcggattttgcttccacgatcttccaatcttgcccagagatcttttttaattggtgctgctgtgattgcttcttttggttaccgcaaagagcatgatggctcttgggtcaaaaagggcgctcaacccgctgatgaagaaggaaacctaccagttgaagataattccactcttcttcgaaggcttatggacaagtttgatggacttcagacttttgttggtgacaagtttgatgccatggaattgcaagtcgacatgcggttcaatgccatggaatcaaggatcaccaaagttgaagaagatgtctccttcatccgtacttgctttgatccaccacccccgcctccatcatcatcttag

SEQ ID NO: 85717 - DNA, 192 bp, Glycine max
  Peptide Sequence Number=SeqID_177402
atgacaagacacaccacacaatggggagaccagtcaggatcacgctgttttgcgagaatgctccaaccatgtgggatcgacataggcttaaagaaacactcaaaccgggtgacccccaaggcctacactccgaagagtccgttagggcctctccctcctgattcaggtccaacccagacaaaaaacatttga

SEQ ID NO: 85718 - DNA, 891 bp, Glycine max
  Peptide Sequence Number=SeqID_177403
atggccatgtttgatccagaaatagtccttgagttttatgccaatgcttggccaacagaggagggcgtgcgtgacatgagatcctgggttaggggtcagtggatcccgttcgatgccgacgctatcagccagctcctgggatatccgatggtattggaagagggccaggaatgcgagtatggccagaggaggaaccggtctgatgggttcgatgaggaggccatcgcccagctgctatgtataccggggcaggattttgcccggactgctgcagggaggcgagtgcgaatcatgcgcaccaatatgaccaccctgacccagatatggatgacgttgctcctcagcaacatcctgcccaccgatcataattccgacctccccatgcctaagtgccagctaggtatggcgcccactaggcaccctttggacccagataagtccaacagggccctgggattccccgcactgatcacaggactctgccagtcgttcggagtccccgttgcacctaccaagagacaggctcagggtgatgctccacaggccgcaggcgcgccaccaccacctcatcaggctggccaggctggggcatttgacatagagcagtatttacggcatttggttcgccagcaggcggccaaccaccgagcacatgtacggacccatgactgtctgtaccaaatgagccttagcatgcagagccagggcttcgcttctttttcatgccctactccagaccagttcagggcagaggtagcatggcccggagattggcccgaggcccaagcaggagaggcacccccagaagctcccggcgatggagaagaagcccacgaggatgaggagatggctgatttgcttgacttcttgggagggagtggagacacgtga

SEQ ID NO: 85719 - DNA, 177 bp, Glycine max
  Peptide Sequence Number=SeqID_177404
atggggcgcttaggagtacatgacaagacacaccacaaaatgactatgtcaggcttaaaggagcactcaaatcgggtgacccccaaggcctacactccaaggagtctgccagggcctctccctcctgattcagatccaacccctaaaatcatttttgcaagcagacactgctcatga

SEQ ID NO: 85720 - DNA, 360 bp, Glycine max
  Peptide Sequence Number=SeqID_177405
atgttccaatcaagagatcattttataggcgcttcagtcatagcatcctttggttatattaaggagcatgatggatcatgggtaaagaagggtgctagaaatattggtgaagaaggacatgagggagaagattcatctcttctttcaaagattttggaaaggtttgatggtcttcaaacctttgttggtgagagtaatcatcaaaacgacacagtgagagatttttttggaagcaaatcttcccatgaccctgaatcaaaaatgttcaaaggtgttttgatgataacaatgatgacaacaaaagataatgacaaaggtgatgaacaaaaagctcaaaagatcaaagaacaactcaagtga

SEQ ID NO: 85721 - DNA, 300 bp, Glycine max
  Peptide Sequence Number=SeqID_177406
atgaccaactactatccatcagaccttcctccttctattggagttcctcgtggcagccaaggagcagtgctgaagaaagttctccataggattgttgtgcagagctctaacttccttgacccaggaataaaattcccaccacaaaggcattattttatgacaagagaaaaaaaggtgggatgcagattcaacttgactttggcagaaggggtagaggtcattttgaaggacaatctgcctcctaataaggttttccttagatggaagcctatcccagagaagtctccaagcaaaagctag

SEQ ID NO: 85722 - DNA, 330 bp, Glycine max
  Peptide Sequence Number=SeqID_177407
atgaatgaccccaatacccccaattgttctgaaatctacaacataataactgtggatgaacgaagtctttacctaaaaatgcacaattttggatttgacaagcttggtattgaagaagtcatagaaagtttcccccttttgcacttccaaacactcctgcgaaccaaaaatgagaaagaaagcctctcccacgagattagagggttaaggtttgcggcgggggcacgtggtggtagtgacaacaaaatggagggcacgatgggagtcgcggaggcgcacgatgaaggtatccctgccaacgccgctagggccactgatgacgatgattag

SEQ ID NO: 85723 - DNA, 189 bp, Glycine max
  Peptide Sequence Number=SeqID_177408
atggatgctttctacaccgatgcactggtgtctttcatatcccaacagaaaaacacacatccttctgaatcctcacaattcactagactgatggtgcagcagaggcactcactcatcatggtgccatgtaaggaatatcaagcaagtgctatagtccaatggcaaaaagctcgagtttggaatttgtaa

SEQ ID NO: 85724 - DNA, 252 bp, Glycine max
  Peptide Sequence Number=SeqID_177409
atggtagaggcttgtgtggaatcgacaagcaaggacaaaaaggaatcttcaagtgacgcgacaaggaatccgtgggggtctttggcactagcttttggccacgatcatacgtcgtatgaagtgtatgtcatggggaggggatgcttaggtgctttaattggtccatggtctttggcacttacttttgaccgtgatcatagctcatacgacacaggaaatagagtaactgtggccaagtgtactttgtactag

SEQ ID NO: 85725 - DNA, 111 bp, Glycine max
  Peptide Sequence Number=SeqID_177410
atgggtgcttggcattggcctggtgataaaatcaacaaccaatgtttggaagacgggatacatgccattgccaatgcaggcaatcctcccaaaagatctcttaacgcctaa

SEQ ID NO: 85726 - DNA, 615 bp, Glycine max
  Peptide Sequence Number=SeqID_177411
atggagagaagtatgatagatgctgccagtggtggagcccttggagacatgacccctgctgaagcgagaaatttaattgagaagatggcttcaaaatcccagcaatttagtgccaaaagtgatgctattgtcattagaggagtgcataaagtagccacaaattcatcttcatcagcggagactaagaagcttgaaggtaaacttgatgccttggttaacttggtaacccaattggccatgaatcaaaaatttgtacctgtcgccagactctgtggtttatgctcctttaccgaccaccacacagacctttgcccttctgtgcaacaatctgaagcgattgaacagcctgaagcttatgctgcaaacatctacaatagacctcctcaacctcagcagcaaaatcagccacaacagaacaattatgacctctccagcaatagaccatacgttcctccaccaatccagcaacaacaacaacaacaacaactaccccagaaacaacaaacaattgaggcccctccgcaaccttcccttgaagaacttgtgaggcaaatgactatgcaaaacatgcagtttcaacaagagacgaaagaaaagaatccagtaattgtttga

SEQ ID NO: 85727 - DNA, 375 bp, Glycine max
  Peptide Sequence Number=SeqID_177412
atggagaaaacattgcattggctggttttgattgctacaagcactgtcaaagcacatcatggttttggttgggtaggggagtgggcaagaattggttctgagctaaataagaagaccatgaaggctgatgtcatgcggattgaaacacttcaccatgccgataaagataaagtaaaaaattatattcttgaacttctcatatggcttcaccgcttggccatcaaaagtaaagatggcattgatactagagaaacgagggatgttcatgattatcaatgctttttggaatgtatgcagttcaatgacacccagagttgtaaattggggtcttgtaacaaagggagtaacctcaatgttttctctttacccttttaa

SEQ ID NO: 85728 - DNA, 312 bp, Glycine max
  Peptide Sequence Number=SeqID_177413
atgtggcaagaatatgaaagagatcagtggggtcctgatccaaggagaaagaggactacaaagggtcgtcccgtttcaactcgcattcctactgagatggacaaagacgaaaatgaacgagcaagtagaaaaaaatgtggactttgtcggcaacatgatcatagcagaaataattgtcctaatgaaggagggaagtcggggtgccagaacccgacttccgtgaacgctactaaaagtggtgtagtttggaaattaattcccaaagtagtgtatttcaagcaaattttgaagagagaaggtgcagtatggtaa

SEQ ID NO: 85729 - DNA, 387 bp, Glycine max
  Peptide Sequence Number=SeqID_177414
atggggcagatggctactcagttgaaccaagctcagtctcaaaattctgacaaattgccttcacaaacggtgcagaatctgaaaaatgtgagtgccatcaccttgaggtctggcaagcaaattgaagtgcctccaccaatagtagcacctgcacctaaacatgtaaagcttcattctacgcctaaaaaagaggatgagctagctgcacaaaagagaaagcttcctgatcatgagggagctaacaaaaattttcatccaggtggaccttcttctagtagttctgaattgcagcagcctcctatccctcttccatttccatctagagcaattctaaacaaaagatggaagaagtgggtaaggagatcttggagaccttcaggaaagtaa

SEQ ID NO: 85730 - DNA, 246 bp, Glycine max
  Peptide Sequence Number=SeqID_177415
atgtttttgaatgataccaagtctgaaaaggagcttatgaatggtttggtagaagatgatgcaaaagataaggagcttaaggttgctggtactgttgaagacgatgtaacatcagacaacaagcttgaggccactagctcaccatttgctaatgaacctaatgtcacccattcattggaaaatgatgctaatataaggtttttgatgaagaggacaacaaaagatgaatcggtttggtcggcttag

SEQ ID NO: 85731 - DNA, 102 bp, Glycine max
  Peptide Sequence Number=SeqID_177416
atggagaaaaatgaagaaacaacaatggaggagaaggtaaagctgaaaattaatgaagcggaagataaaggagaagaggtgagaggaggcgccatccactag

SEQ ID NO: 85732 - DNA, 330 bp, Glycine max
  Peptide Sequence Number=SeqID_177417
atggacaaaagtatgattggtgcagccagtggaggcactttaatggacaaaactcatgttgttgccaaacaattgatttccaacatggcaacaaactaccagcaatttggtactatagttgttgtactatccagagttgttgcaaatgaagtttctatttctatggttgttgataatcagaggctagagaataaacttatagagttggcatcccttatgagacaactagccattggtcaacatcagaatatgatgacaaccaatcaaccaaggttgtgtggtatctactgtgcttctgatcatccaacagatgcatgttccacactctaa

SEQ ID NO: 85733 - DNA, 348 bp, Glycine max
  Peptide Sequence Number=SeqID_177418
atggccattattgtcaatgcggaagcttgtggttacatgagcatgaactactaccaatatatagatgttgtttacacaaatgagcacatcttaaaagcatactccgcacagtggtggcctcttgggaatgaagcggcaattcctccttctgatgatgcatggacacttatccctgacccaactacaattcgtgcgaaaggtcggccaaaatcaacaaggataaggaatgagatggattggctggaaccatctgaccaccgacaaaaatgtagtagatgtggagtagaagggcacaataggcgccgatgtccaatgcaatctgaccgtgggagtaattcatttaattga

SEQ ID NO: 85734 - DNA, 303 bp, Glycine max
  Peptide Sequence Number=SeqID_177419
atgactcatcataattttcaagtgcaagccattggtctgtttgctcaagcgacctgtgctcttgagtttggacttccaagaccgttcaatcagagattactcgtcttgcacgttggtgggggtgccataaaacaacgaggacaacccttcccttgtgttcaggaatcctctactacaagagacccacggtctcttaatcccttttcagaaataagaagaagagaagaagagatctctcttaaaagagatagcttgtacaatgaagatcaatcaaaattccttattgaatatgcaagtggttga

SEQ ID NO: 85735 - DNA, 462 bp, Glycine max
  Peptide Sequence Number=SeqID_177420
atggccgagaagacaaagaaaagactggaagaagctgcccaatccagaagcactgaggacgtcattgacccttcgtctcccatcagacgccacgtgaagttgaagatggcccgcacgaaaaaaactgggcagatgatgtctgaggcagcaaaggaaataactgagaagattgatgtcctgactgctgccattgggcgaccagagcaccctggccgtgttcgtgctactggagccggtgtcaccataaagcaatattttggatcggctccacgaacgtcccgcagttcttcctccatgcctcctgaagacctacaacagctgacccaacaaatcagggaccaactggaggagttaatcacagaaaaagtgactcgacaactgatggtatccttcagccagatgcagtcccagtttcagtctcagatgcagtcacagggacttgcactgcctccggagccagag

SEQ ID NO: 85736 - DNA, 331 bp, Glycine max
  Peptide Sequence Number=SeqID_177421
atgggtaaagcagaggagatgcaagagaaggtgaaggccgacatggaggctatgaaagagcaaatggtcgcaatgatggaggccatgatgagcatgaagaagataatggaagccaatgcggttgcaattgccgctaccagcgttgttgctaaggtgaacctgatgtccccatccggcatcaaccaaatgaatcgtccaacctcagatatggtaggcaaagatttgggaagtacggacggcccccatgatgtgcaaaatcaaaacaagcacgccttcccgccatatggcttgcctctcaactatacaccacccaatgtagcgtacacaccca

SEQ ID NO: 85737 - DNA, 221 bp, Glycine max
  Peptide Sequence Number=SeqID_177422
gtggccttgttggttcttgcgtgcttagcacaactctggctcgcttagcgcacattagtgaatttcggcttagcgctcatcttttcgctcaacggatggactcaagcagtgcgcttagcgggattagccctcgctcagtgaacatgcacagctcatccttcttccagattcttcctcacgctcagccagaggagtgttgcgctcagcggatggctcgctaa

SEQ ID NO: 85738 - DNA, 263 bp, Glycine max
  Peptide Sequence Number=SeqID_177423
cacccaggcccacttgggccctccgagggaatattcctccagaaggcggttgcttctggaggaaagcaaccctgctcgcctgggcgagctgggcggcaaccacctccccctattttgctataaataggggaggaaggcaagaaggaagggccgaggcgcttccgaaacgtttccgtaacgttttccgtgaagaatttcgcaaaggtttcaaccgttcttcgacgttcttcattcgttcttcatcgttcttcgatcttcaacgg

SEQ ID NO: 85739 - DNA, 237 bp, Glycine max
  Peptide Sequence Number=SeqID_177424
atgaccataatttgtctctgcgtgccatcggacacgactgtgtctgaatggcaaaaggtgtgcggaatgaccataatttgtcgtatgtcacatgacctcagggtgcggataaccgtaaggtgtctccgcgggctaccagctcttggtcatggtaacaaaaagcggtgtggtcgacaaagcgaggcttttgctcctacgtatcctccaatgaggaactcagacctacgtagttcttga

SEQ ID NO: 85740 - DNA, 609 bp, Glycine max
  Peptide Sequence Number=SeqID_177425
atgactctgaaattgccttattaccctgaattggttcgagcgttttataacaacttggaaattcatgaaggagtgatattttctaaagtgaacaaaatacaaattgttgttgatcactccttgttttactccttaaccaaactaagcagtcaaggtgtgccttttgaaggaaccttagttgatgattggaaaccaatttattctagtcatgatgctcgtaaaatggtttgtgttgcaaatgctgatataactagccacttacttgttggttcctttacatttgaatgtcgtatcatgtattacattctctattgtgtgttgcttccgcgttctactaaccttgctcaatcctttgaggaatatttaattttgatgtgggcactacaaactggacaccaaattgactgggcacatcttgtttgttaccgtatgcataaggcattatggacaaatgcccctctaccatatctccatttggttactctgtttatgaagcacttaaaagtccttcttactaatgaaccatttgtcaaggttaagcattcatttgcaataggagccactacagttgcttcttttggttataagaaagatcttgatggacaatgg

SEQ ID NO: 85741 - DNA, 223 bp, Glycine max
  Peptide Sequence Number=SeqID_177426
gggagaagcttgccgcccagctcgcccaggcgagctcagctcgcccaagcgagcaaggttgcttcctccagaagcaacagccttctggaggaatcttctggagggcccaagtgggcctgctttcgaagaagttacggaaacttacggattgcgcaaaaacacctcttttcgacttccgccacattacggaatttcacggatcgcgcaagcctgcttcctttag

SEQ ID NO: 85742 - DNA, 165 bp, Glycine max
  Peptide Sequence Number=SeqID_177427
atgaagaaaaatagtgtagcattatccacagccgaagcagaatacatctctgctgataccaaaaatcaactctcagatatcttcacaaaaccactacccatagattccatctacgccattagaagagaattaggacttctagatgccagtgacttagacaaatga

SEQ ID NO: 85743 - DNA, 693 bp, Glycine max
  Peptide Sequence Number=SeqID_177428
atgttgaatcaccatttgacagggctcctggggttgggatctctttcttgggcaggacatcaaatacatgtatctttaccaattaaccaatttctaaatgctgcagtagatcccaaagagattccacttcctcatgaatttatcttgaatcgggatcttttggctcaactttatccgagttttgccgagggagcaactccctttttcaccttgaattggtcaaaatacgcagaatttcttacttttcgtggaggattagatccagtaactggaggtctatggctgaccgatattatacaccatcatttagctattgcaattcttttcttgatagcgggtcacatgtataggactaactggggtattggtcacagtataaaagacattttagaggcacataaaggtccatttacgggccagggtcataaaggtctatatgagatcctaacaacgtcatggcatgctcaattatctattaacctagctatgttaggttctttgaccattgttgtagctcaccatatgtattctatgcccccttatccatacctagctactgactatggtacacaactgtcattgtttacacatcatatgtggattggtggatttctcatagtcggtgctgctgcgcatgcagctatttttatggtaagagattatgatccgactattcgatacacgatctattag

SEQ ID NO: 85744 - DNA, 897 bp, Glycine max
  Peptide Sequence Number=SeqID_177429
gcgctgaacggcctcaagcgcgacgcggcggccgacccgcagggcaacctcaagcaggtggcccagcaggtggagggcatgttcgtgcagatgatgctgaaaagcatgcgttccgccttgccgcaggacggggtattgagcagcgatcaaacgcggctctatacctcgatgtacgaccagcaaatcgcccagcagatgtcgcaaaaagggctggggctggcggacatgatggtcaagcagatgagcaatgccaacgcggtgccgagtgaaacggcgggcctgtcgccgatggcgttggacaacgaggtgctgcaaacgctgccgaaccaggcgctggagcagatggtgcgccgcgcgatgccgaaagctccgccggccgccgcgccgctgtcgctcaacaacggcaacttcgtcgctcgtctgtcgataccagcgaaggtggccagccagcagagcggcattccgcatcagctgatcgtcgcgcaggcggcgctggagtccggctgggggcagcgcgagatcccgacctcagacggcacgccgagctacaacctgttcggcatcaaggccggcggcagctggaacgggccggtgacggagatcaccaccaccgagttcgaacagggcgcggcgaagaaggtgaaggcgaagttccgcgtttacggttcgtatgtcgaagcgatcgctgattacgtcaaactgctgaccaacaacccgcgctacgccgacgtggccgcagcgcgcagcccggagcaggcggcgcatgcgttgcagcgcgccggatacgccaccgatccgcagtacgccagcaaactggtcagcgtgatccagcagatgaagagcgcgggggaacaggcggtcaaagcctatacccacgatctgaacgagttgttctaa

SEQ ID NO: 85745 - DNA, 1236 bp, Glycine max
  Peptide Sequence Number=SeqID_177430
atgggcgacagcattctttcacaggcagagatcgacgccttgctcaacggcgacagcgcgggtgatgaacccgaagcgatagtcggcaaagagagcgaggtcaagccttacgatccgaccacccagcgccgcgtggtgcgcgagcgtctgcacgcgctggaaatcatcaacaaacgttttgcccggcagttccgcatggggttgttcaacctgctgcgccgcagcccggacattaccgtcggcccgatcaatatccagccgtatcacgagttcgcccgcaacctgccggtgccgaccaacctgaacctggtgcatctgaacccgctgcgcggcaccgccctgttcgtgttcgcgccgagcctggtgttcatcgccgtcgataacctgttcggcggcgacggccgcttcccgaccaaggtcgaaggccgcgagttcaccccgaccgaacagcgggtgatcaagcgcatgctgcgcctggcgctggacgcctacggcgatgcctggagcgccatctacaagatcgacgtggagtacgtgcgcgccgaaatgcaggtgaagttcaccaacatcaccacttcgccgaacgatatcgtggtcaccacgccgttccaggtggagatcggcgcgctgaccggcgagttcaacatctgcattccgttcgccatgattgagccgctgcgcgaactgttgaccaacccgccgctggaaaactcacggcaggaagacagccattggcgcgaaaccctggtgaagcaggtgcaacactccgaactggagcttatcgccaacttcgtcgatatcccgatgcggctgtcgaaagtcctgaagctgcagccgggcgatgtattaccgatagacaagccggaacgcctgattgcccatgtggacggcgtgccggtactgaccagccaatacggcacgttgaacgggcaatatgccctgcgtgttgaacatttgattaaccctattttgaatgctctgacagtcttcagagaagtccggcgcgagcaccgaaggggtgttcaagtcgctggaagctcaggatgcgctcggcagcctgcaggatatcgacctgatcctggatattccggtcaagctgaccgtggaactagggcgcaccaagatgaccatcaaagagctgctgcgcctgtcgcaaggctcggtggtggcgctggacggcctggccggcgagccgctggacatcctgatcaacggttacctgatcgcacaaggtga

SEQ ID NO: 85746 - DNA, 54 bp, Glycine max
  Peptide Sequence Number=SeqID_177431
atgggtaggagactccagaaagattggactagggatgcaggagaaggccctagg

SEQ ID NO: 85747 - DNA, 516 bp, Glycine max
  Peptide Sequence Number=SeqID_177432
atgaataaagaaaagcgcattgcgatcctgacccgtctgcgggacgagaacccgcacccgacgacggagctgaattttacctccccgtttgagctgctgatcgccgtgctgctctctgcccaggctaccgacgtgagcgtcaataaagccaccgccctgctctatccggtcgccaatacgccgaaggccatgctggagctgggcgtggaaggcgtgaagtcgtatatcaaaaccatcggcctgtttaacagcaaagccgagaatgtgattaagacctgccggatcctgctcgaacagcacggaggcgaagtgccggaagaccgcgccgcgctggaggccttaccgggcgtcggtcgtaaaacggcgaacgtggtgctgaacaccgcgtttggctggcctactatcgccgtggatacgcatattttccgcgtgtcgaaccggaccaactttgccccgggtaaaaacgtcgaacaggtcgaagagaaagctgttaaaagtggtacctgccgaatttaa

SEQ ID NO: 85748 - DNA, 540 bp, Glycine max
  Peptide Sequence Number=SeqID_177433
atgggtgaagtagaggaggtgcaagagcaaatgaaggccgacacggaggccttgaaagagcaaatggccataatgatggaggccatgatgagcataaaggagataatggaggtcaatgtggctgcaatagccgctaccagcaccattgtcgaggtggacctaacccccccatatggcctcaaccaaataaatcatccaaccttcgtcggcgaaaggatcaaagtgggtcaggaaaaaggcaaatctgatcatcctgctatgatgaatgcgaaaactagggcaaatgaagaggatgagaatgagggagaagcccttgctatgactgccattcctacacggtcaaatttatcatcgacccaacaatgtcattactcagccaataatagtccctctcacccaattatccacaaaagccatccccaaatcagccacaaggcctccataacccctgccagggtacctcagcctcatttttccgaggatacgactcgaacgcaacatgtgcatacccatggaggagttcctggacatttccattga

SEQ ID NO: 85749 - DNA, 105 bp, Glycine max
  Peptide Sequence Number=SeqID_177434
atgtcagtgaaaaacctcgtcgggcgcctaggagtacatgacaagacaaatcacacactagcctacactctaaaaagttcgtcaaggcctctccctcctgattga

SEQ ID NO: 85750 - DNA, 567 bp, Glycine max
  Peptide Sequence Number=SeqID_177435
atgaccaccttaacccagatgtggatgacattgctgctcagcaatgtcttgcctactgatcataactttgaccttcctctgccgaagtgtcagctagtgtatgccatcctgacacggatgagcgtccatgtggctcagttgattgctgacgccatctatttatttgcaggtatgccacccaccaggcaccttctagacccggataagtctaacagggccctggggtttccagcattgatcacgggcctctgccagttattcggggttcccgtcacacctagtaaatattgcacgcctaggcaggcgcaaggtgatggaccacaggccgcagacgcaccgccaccacctcatcaggctgatcctgctaggtcattaggcatggagcggtatctacaacacttggttcgccagcaggcggccaaccaccaggggcagatgcagatacatgagtctctctaccagcttagcctcagtcagcagggccagggtttcattccttttgggtgccctactccagatcagtttagggctgaggtcgcatggcccggatattggcccgaggcttag

SEQ ID NO: 85751 - DNA, 81 bp, Glycine max
  Peptide Sequence Number=SeqID_177436
gtgttgagggaaggagcccaaagtatgaagaaccaaggtggaaggaatgatgcaatcctaccccgcaagggcattggatag

SEQ ID NO: 85752 - DNA, 118 bp, Glycine max
  Peptide Sequence Number=SeqID_177437
atggaagcactactctcgtttgaggtggaagttccttctcagaggataatggcggagtcaggcctagaagagtcagaatgggctcaagcacgctacgaccaactcaacctcattgaag

SEQ ID NO: 85753 - DNA, 746 bp, Glycine max
  Peptide Sequence Number=SeqID_177438
ggttcccaagcgtccccttgatgggaatgatgggttgtatcaattataatctcgtactttccataagacagttaggttattccatgagaggagcgccatcagaagagagtaccacgtctttcatcgcacgaggcttcagtgaccccaatgcaaaaacacttcaaagagtccggaaggcatgtaacgcggtgcaaagaaaggataaggagctcagaggaagcagcaatgggatcatcagcagttattataagtggctaaaggctagaacgcaagagatgaattggctcttaaggctaaagatttcaagtaaggaagaggttgaaacccttgaggagagcgaagaggtgcaagccttgaaggcgaatcttgaaagaacccaagtggtcaaggaaaagttcaagacaaaagccatcaaggtcaggaaggaatgtgacgagctgagggatgggctttatggggcagcaacagcgaactcaagcttcgaagggccaaaagagaccagtcaagagttgaagtataaactgaagctaaatctagctacaacccatgagcaaagactagaggacgagtatgcaaaggtatcggtcctgcaagcggaaagggaagcaagggagagagtgatagattcattacacagagaagctatcatgtggatggataggtttgctttcactttgaatggaagtcaagagctcccaagattgttagccaaggcaatggcgaacgtgtactcggctcccaaggag

SEQ ID NO: 85754 - DNA, 222 bp, Glycine max
  Peptide Sequence Number=SeqID_177439
atggtgaaagttggaacctcttcgtgccgacaacgtctgcatttatccggccaaaagttgagccagggcttcccggtaaagatgcaaaacacgggacagccaggatttgatttagaggagttagtcttcgaagtcatgcgccggttacaggctaaactgaaaggacaagttttggtgactgcgctcctccaagccagttacctcggttcaaagagttggtag

SEQ ID NO: 85755 - DNA, 330 bp, Glycine max
  Peptide Sequence Number=SeqID_177440
atggtgtttttggtgggaaacttggctctgggcatttcggcctgttccttttctctgtttttgtttagtgcacggcaaaaaagtcgctggcgcacaagagtttggttgcacatttgtagcttaacagtgaatggatcttctttcttaaggagatccttctgttccttcttctgggggccagggcaaaatttcccttcctggatcaaggccggtggaagggttgagattttggctctaagggcatgtagaaaggctggacatgatgtatgtcagggcattggtttggccagcggttcagggataaggggatgtcccacatcatttccatga

SEQ ID NO: 85756 - DNA, 1125 bp, Glycine max
  Peptide Sequence Number=SeqID_177441
atggaaggatttagcggctcaggtagcacctcccatgatggaaagggagatgatcaccatgatagtggacacactccagtgttctactatgagaagttagtaggctacatgccctctagcattgtggatctagtattcgagggtgagaggattgagcacaagcaacagaagatccgggccgactggggcaaagaggaaagaaggggatgctcacgccgtaacctcggctcttgcttggccaacaccccaatcaacccctcacaatactcattagtatgtctagcaccatccgagcttttcggcccgggccgaaaaattctccaactcgacacctgtccagcaaaggacatctgccccaccataaagagcccccgttcaagccccgactcctgcaaggcctcatcctgccggcaatttcaatcctggcacaagttccaatttggagaggaaccctccagtgaagaagcttctggagttcaccctgattccgatacaaattcgctcgctaatcataggggaccggcggtaaatgtagtagaggcgagcgggttgcaaagacctaagcaaatgaaggacgtggtaacctcaagaaggtttatctttgaagcattacaagaggcgagcatcgtttcctttgacgagcacaaaggggactcttgtttgatgcatccgggtgcattacatgacatgaagacatgttcaacggcagaggagctattacagcaaatgatgtcggcagacaaagaaagccccgctagacccaagcctttggtgatacacttcaccagggatgtggcctcccaaaaaccccgagggcctcactcggtttcgggtagcaaacctgttccattcccttatagaagcaacaaggcggtctcgtggagatactcccctcagaagccaagcgaaacgaaagaggaggccaccgacactgatttaccttttgccaaagttaccaacattattggcctaagtggtgtgacctatagcgattgtgtcttcgtggcacctgaaccgtcggtgcgacccacggatgccaaaggaaaagagaaggtggtcacggaagagaccaacgaagcgagtcccattttggatgaggatgttccgaccgggagattcgcttag

SEQ ID NO: 85757 - DNA, 225 bp, Glycine max
  Peptide Sequence Number=SeqID_177442
atgcaaattgaagaacctagttcacaccaaacaactccacaaccttcacaccatcctactccaccgtcttcacaccaaccaactccagtagaaagttttatcggtacagttgaatgtcctaataatgaacctatgcaacaaccacctaacatagaggtggatgatcgtggtgcatcatcaacaaaaactggagaagggaggcttaaaagtattatgtggaactaa

SEQ ID NO: 85758 - DNA, 654 bp, Glycine max
  Peptide Sequence Number=SeqID_177443
atggatctattgttcacaacgacagtggtgtttcctttcaagcttccactccagttctcattcgagtacctaacgggtaatcaatttcggtttcaatgtatgcaactgaaagatgatgctgatgttaacacaatgttaatgtgtaatcatgaattttcgtttgttggtccgattgagttattatgtagcattgctagaaccccagatgatattttaaacttacttgaaactactatgacccctactcatgatgccctgctatattacaatgggaggtggaacatgtcacgccaaaatgagtttgttggttattcgttcacaggaaaaaatcccaaaaactttgacattcccaccggatgtaccctggatgaactgaaggatttgatcaagcaagttgcgcctcgtgggattcccccttatggtgttgatgaaacacaaatggtaaggcgattgttttttcggaaaccaagtcaccatgagtattcagaaaaagttataaaatttgaaataattgaactcaaaaccaacgaggacgtgatgaaggtgctcattgagtctaactactggaaaaagattggaccaatagaaattttagctgttttcagtaaacctatactacaaatggaagacgagttgtccttgttgcaaaattag

SEQ ID NO: 85759 - DNA, 590 bp, Glycine max
  Peptide Sequence Number=SeqID_177444
gggcgttgtggggcagcaacaacaagcttaagcttcaaagggccaagagagaccagtcgagagtcgaaggcatgatactagaagacaagttgaaagcttgtcaaaggctagaggacgagtatgcaaaggtatcagtcctgcaagtagaaagggaagcaagggagagagtgatcgattcattacatagagaagcaatgatgtggatggataggttcgctttcaccttgaatgggagtcaagagcttccaagactactagccaaagctaaggcgatggcggatgtgtactcggcccccgaggaagtgcaagaacaaatgaaggccgatatggaggccttgaaggatcaaatggcttctatgatggaagccatgttaagcatgaagagaatgatggaaagcaacgcgactacaattgtcaccgctgaggcagatcctacccatccatctgccataaatcaagcgcaccaacccatctcggacatggtaagacaaggaggagaagtgttggcagcgtcgacgatccacacatggggcataataggaacgcttacccctatggcttaccccccaattatacgccgcccaccatga

SEQ ID NO: 85760 - DNA, 195 bp, Glycine max
  Peptide Sequence Number=SeqID_177445
atgttcaagattgaatcaagaacacttcaaggatcaagaggaaatttgatttcaagaatcaagaatcaagaatcaaaattcaaggttcaagcttccaagaaacaagatcaagattcaagaatcaagagaagacttaatcaagataagtatgaaaaggtaatcgattaccagaatattgtaatcgattaccagtag

SEQ ID NO: 85761 - DNA, 352 bp, Glycine max
  Peptide Sequence Number=SeqID_177446
atggatctttgcggtctcgtaaatgatggggacaaatcaaaacggcaaaagatttatcaagtcaaggttaagggtctagatgtcaccagcctcaaggaattgggacggttgatgggacctctccaaaggcaagccttccgcaaagtgtacggaaagattctagatttgaccgcagcacaggtatttacggaagctgtcgtatccctcgcccaatactatgatcagccgttgaggtgcttcacgtttggggacttccaaatggtaccgactgttgaagagtttgaggagatattgggatgcccttttaggggaagaaaaccgtacctattctccgggtttcttccctccttga

SEQ ID NO: 85762 - DNA, 489 bp, Glycine max
  Peptide Sequence Number=SeqID_177447
atgaagaaaaagaaaactgaaagtagacgagatgaagatgaaaacatacaaagcaagaatggacccctaaggagggtacatctacttgggttgttgactgagaacaagagagggtacatctcttgtggatcagttctagtggagggtacatccactaggttgttcaaagagaacaagggaaggtacatcccttatggatctttgcttgtaaaggaattttacaaggttgaaaagaaatctcaaggaccgcaggtcgcttggggactggatgtaggcacgagttgttgccgaaccagtataaaaactcttggtgctgaaccccttctcctcaacctcccacgcccttttatagcaaaaataggggaggagcttgctgcccagctcgcccaggcaagctggtggcttagttcagaagcaacatgctcgccttggcgagctagttgcttcatgttgaagcttcctaatgggcctagatggccccatgactaa

SEQ ID NO: 85763 - DNA, 423 bp, Glycine max
  Peptide Sequence Number=SeqID_177448
atgaggagtcaggcctctggctttgatgaggaggctatcgcccaactgttatgcatactggggcaagacttcgcctggaccgccgcagggagatgggtgttgatcatgcgcaccaacatgaccaccctcacacagatatggatgacattgctacttagcaacatcctgcccagcgactacaactctaatctccccctgccgaagtgcctctgccaattctacggagtgccctttgcccctagcaagagtcaggaccctagtcctttcccttggcccacccctgagcagttcaaggccacagttgcctggcctggggacaagacctattttgagacgcgggtggggcctgcggaggcctccggaggtggagacgaagcccaggaggatgaggacatggctgacatgttggacttcctcctgtga

SEQ ID NO: 85764 - DNA, 171 bp, Glycine max
  Peptide Sequence Number=SeqID_177449
atgacgtgtccgcatgctatcgaacttgattgtctctggtggcggatggccatgattggtctccacccgtcatcgaacttgctgtctctggatgatgaaggtgcagataaccataaggtgtctctgcacactattggacttgattgtctcttgatagcaaagtgtgtgtga

SEQ ID NO: 85765 - DNA, 240 bp, Glycine max
  Peptide Sequence Number=SeqID_177450
gatgaataccacgatcaccagcagcgccgcggcgttgaggaaggctgccagggtggtcaggcgcaggtagccgaaggtgtggcgcgcgttgggcttgcgctgggagaagtgcaccgccatcagcgccaccagcagcgcggcggcatcggtcagcatgtggccggcgtcggccaacagcgccaacgagccggacaacaggccgccgaccacctcggccaccataaagacggcggtgactaa

SEQ ID NO: 85766 - DNA, 1225 bp, Glycine max
  Peptide Sequence Number=SeqID_177451
gtcgactctagaggatcccccaaacgctgccgtatatggggctgttgatcaccaataccctgatcaccctgttctcgctcggtttcgccgtgccggtggcggaagtgcgccacgcccgaaaccgccaacagcgcggtggccgaagaagcgttgcaggcgctggatctgggcggcagcttctgaggcgccgatgatcctcgagggcgcctatcagttgccggggcgggccgcgcgtgaggcggctcgcctgctggtgaacgaaagcggcgagggcgtgacgctgcagcggcaggatgagcaacgttacatccccttggcggacatcaccgtctctgcggcgctgggcaatattccgctgacgctgaccttcaaggacggcgcgcgctttgtgccggatgacgatgcggccttccgccgctggttctatcagcgccgttcgccgggctgggtgcatcgcctggagcgccacaaacgcggcgtcgccgtggcgctgctgatgacgctgctggcggtcgtagcctacgttaacgtcgtgctgccgtgggcgagcagcgagatcgccatgcgcatccctacctcggtggaacagacgctgggcgaacatacgcagacgtttttgagccaaagcggctttgaaccctccgcattgccggccgagcgtcagcaggcgttgcagcagctgttccggcaggtgatgccggccgagatgcgccaggagcgtacgccgctgtcgttgaagctgatggcggcgcccggtgcgccgaacgcctttatgttgccggacggcacgctggtgctcagcgatgggctggtcgccctgtcgaaaaacgacgatgctctggcggcggtgatgctgcatgagatggggcatcacgcttatcgccatccgatgcgcatgctggtgcgttcgtcactggtggcgttgacgctgatgtggatgaccggcgacgtcagcggcatcggcgacacgctgctgcagtctgcgtccttcgtgaatgagatgcagttttcccgcggcatggagcgtgaggcggatgcgtttgcgatagcggaaatgcagcgccaggggcgttcgctggcgcaaatggcggcgatctaccgcgcgttggcgcaggcgcctgaacgcgaaacggctgacggctgggcgctgccggcctggctcagcacccatccggcgatgcaggaacggctggacgcggtgaacgaggcgatggcgcagcagtaa

SEQ ID NO: 85767 - DNA, 450 bp, Glycine max
  Peptide Sequence Number=SeqID_177452
atgcgtggcgctgcgatagcggctccccggctgcagccagcagtccggctgcggccactcgggatggtgcgggctgtccggcaagaactcgctctccagcgccacgccggcatgagttgcagcgccggcgcgtcggtgaacacgctcatttgcacttgcccgtcggcggaccacaaatgggccgccgggctctccagcgccccgcaggaaatcctgcagcagcgttttcggctggcgaaaatccatgccgctgccgtccaccggcgtcagatcggcgcatggaatgccctcggcgtcgacgggcagatagcgatcggtgaacagctgcagccgctgggcgcgggcgtcggtgccggcgccgtccaggttgaaataggcgtggttggtcaagttgaccgggcagggtcaatcgacctgctcagatatctgatttccatgcgattgtcatga

SEQ ID NO: 85768 - DNA, 420 bp, Glycine max
  Peptide Sequence Number=SeqID_177453
atggcggcagtcggcgtgttggcgatggcggtcttcacctggcaagggcgcatggcgctcacccaatcggagcgcaccatgctggccaccatcgacagcatcgagcagatgccgccgccggccgcctggatctaccgggagcgcaaaacgttcgacgagcaatctcacgcgctgctggtctataaccaaacgcgtgatgatgccctgttgaccggctatcggcagtgggccaacgcctatctgcaacgccgcatcgatgccaacgtctacgccacgctaatcatgatcttgcgctatcagggggctcagggcggaagccgacgctcgcctgcgggaggccgctttcctgtttgcgcgggatgcgcgattcagataggaagaataaaggtgagagcgcatcgctctcacctgccgtcttga

SEQ ID NO: 85769 - DNA, 726 bp, Glycine max
  Peptide Sequence Number=SeqID_177454
atgagtcttcattcttcatctagtgttaatggtgagggttctactcctaaggaccccttgtataagatattagatgagttgagatcccttaagttgtggaaagaaaaacaagagagaaaagaaaaaggaaaaaaaagagcgaaagaaataagtcaagatgaaaaggagaaaataagggaagatgaaagaaggaaaatactaaaagagttaagaaaagaaaaacatgcctcctatagtagtcataactcttgcaagagcctaagtgaagaacttcgtgactattatgaaggaagacatagaggctactacttcattcttagattggaaagtaaggaagcaaaaggggaagaatctagtgaagaaatctacccccaagaagaaggaaaacctttaatggttaaggagagtgtaagggacacttgttcgcattgcgagagaataggtaggcttgagtttattcctcaagtaaaggagttgttggatgagggtttggttcgcaagagcttaaatccttgtgctttgttggtgcccaaaataggtattattaggcaccaaatccctaaaataggtggtatgatgaatgctttgggtggtgcaacactcatttgtaaaatcactcgtgcacccaacatcttcatgatttatgtacatagggactcattaggggttcccatgaaccctaagagattaaaagtcattcctgagtggccgctccaccaagtgtaa

SEQ ID NO: 85770 - DNA, 372 bp, Glycine max
  Peptide Sequence Number=SeqID_177455
atggagtttggtgatataactgttcattttaatattcttgatgctatgaaacacccatctgaagatctttttgtatttcgtgctgaaataattgaccatgttgttaatgaatacatgactgatctttattctaatctgcatgcctatcactcttcatgcattgagtctgaaattgtacttgatcatatgtctgaatttaatgctgagagtgaatctgaaattgatatttattacatgtctggtgatgttttacctcttgagattgattttatagagtcagatagaactaaccatgtttcaggaagtacacatacctttgactttctttatgaggtacaggctgagaaaccctctctttctaccactatctag

SEQ ID NO: 85771 - DNA, 473 bp, Glycine max
  Peptide Sequence Number=SeqID_177456
tccaaactcaggagcacaggtcgcttgagcaaacagaccaatggcttgcacccacttccggatttacacgcgattctcctcaaatttcagccagcccgcatcaattagaccttgcaccttacacttcagagccctacaatgctcaatggaatgccccggggcttctccgtgacaagcacatgttgcgttcgagtcgtattctcggagaaatggaggctttctcgctgcaaaattcatttcttggttggtgctcttggtttgtgctaaagggatgggcctttgtggataactgggcggtgggtaaggagaaggtttgttattggctgagtaatgacattgttgggttggtggggaaacttggcggtataggaatggcagtcacagcacgggcttctccttcatcctcaccctcttcatttgccccaacccacttcgatcatttcgccggcgaagaccaaatccgcaaagcttga

SEQ ID NO: 85772 - DNA, 411 bp, Glycine max
  Peptide Sequence Number=SeqID_177457
atggcggctaagtccaccaaaccgtccatgttcggaaagaggacaaccccaaaaatcaacaaagctagtatatccgcaaacgggccccacttctcttggctcgccatatcccttgccttgccttccaagtattttcgtggcaggcccactacgccgttgcaagtttgcttcatgcgatccaactctcttgccgaatccccgaccacagctgcaaccttgctcaaggagggaagaaacccggagaaaagatacggttttctccccccaagagggcatcctagtatctcctcaaactcttcaatagttgtaccatttggaagtcccaaacatgaagcacctcaacggtgggtcatagtattggacgagggatatgacagcctccgtaaatacctccaccgtggtcaaatctag

SEQ ID NO: 85773 - DNA, 849 bp, Glycine max
  Peptide Sequence Number=SeqID_177458
gtcgactctagaggatcccccgaggcgggtgctcgcgggaggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgtatcgccggggtttgtgtttgtcgcgaggacgaggaggccgggcgcacgggggcgccgtggtcatcccctccctcccgacggttcagtggacttctcacaacgtcgcgggcagcgaaccgctcacgtcgccgcaatccgaacactttcaccggaccattcaatcggtaggagcgacggcggggtaccgagctcgaatcgtaatcatggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggattagcagagcgaggtatgtaggcggtgctacagagttcttgaagtggtggcctaactacggctacactagaagaacagtatttggtatctgcgctctgctgaagccagttaccttcggaaaaagagttggtagctcttga

SEQ ID NO: 85774 - DNA, 573 bp, Glycine max
  Peptide Sequence Number=SeqID_177459
atgcccactgggaggaaggaagccatatcaccatctaggttctatccttccacgacaagagttgccaaggtagtgaaaatctcagcacaagagttggaccaggtaaagcaaaacaggaatggggtagtcggagtaccaaggaagtgttggaggaaagggcaaaggccttggaaaatcaaggcaaatgggctttcttttattgacatcttggagcttttgatctttggagttgtcctctttccgaatatggaagggttagtggacctagcagtgattgacgctttcctcgcctttcatcatggcaaggaaagcccggtcgtcgccattttggccatgtatgacacgttcgaccggggatgtgaaaagagtggcgcaagaattgtttgttgtgcactggctctctatgtgtggctggtttcacacctttttctccaacaaggtaggcccgtctatccgctacaacgtcaccgctcgcgcgtcgaacaaggaaaggcgaactgggaccaactcttggctagcatggaggggcgtctgttaatttgttccctcgctagaaggaaggaagaatcatga

SEQ ID NO: 85775 - DNA, 297 bp, Glycine max
  Peptide Sequence Number=SeqID_177460
atgactatgcaaaacatgcagtttcaacaagagaccagagcctctattcagagcttaactaatcagatgggacagttgactacacagttaaatcaacaacagtcccagaattctgatagattaccttctcaatctgtccagaatcccaaaaatgtgagtgacattacattgaggtcaagaaagcagtgtgaatctaaagagaagcagcatatccctcttccattccctccaagagtaattttaaacaaaaaaatggaagaggcagagaaggagatcttggaaacatttaggaagtag

SEQ ID NO: 85776 - DNA, 159 bp, Glycine max
  Peptide Sequence Number=SeqID_177461
atgtattgtcttagacggtgggacgcccagactaaagcacaacacgttctttcgaacagggggaagtcccacatcctcgtcctctttactctccgtatggcccgcttcatgcttgaaatcgatggtcgggtcccaggaacaaaagacataatgccttaa

SEQ ID NO: 85777 - DNA, 131 bp, Glycine max
  Peptide Sequence Number=SeqID_177462
atggaggttgaggaaccctggcaggggttatggctaccattgcattatcaagtagatatgggagcaagctttttgctgcaaaattcctttttggtttacgctaaaggtggtgtttgggcattgggtgtgtg

SEQ ID NO: 85778 - DNA, 153 bp, Glycine max
  Peptide Sequence Number=SeqID_177463
ggtgcggataaccgtaagggtgcggataaccgtaagggtgcggataaccgtaagggtcagtatgacaaagattatggggcggccgacaaaagcaaggctcttgctcctacgtatcctccaatgaggaacttagacctacgtagttctggataa

SEQ ID NO: 85779 - DNA, 529 bp, Glycine max
  Peptide Sequence Number=SeqID_177464
atgactaggggcaatccaggtgatttacaaccctttgatcctgaaatagatagaacctttcatagattagttaggcataatgtgcatcttgatcattttgagcattttgagcattctgttgctggtgattctaaacattctgattttgagcattcgactgctaattttcatactgagaacatggctcaatctccacctcgtgagaggactcttagggagatggttgcacctgacttcacttatgaaagcttgtgcattcaatatcttgatgaggatgtttcatatgttctcaagactggactaataaatttgctacccaagtttcatggtcttgcaggtgaagatcctcagaagcatcttaaggagttccatattgtatcttccaccatgaagccccctgatgtccaggaagatcatatctttctaaaggcttttcctcattctctagagggagtggcgaaagatttcctgtactacctgctcctaggtccattactagctgggatgaccttaagagggtgttctggag

SEQ ID NO: 85780 - DNA, 426 bp, Glycine max
  Peptide Sequence Number=SeqID_177465
atgcataaggcattacgggccaatgaacctctcccttatcctcaattagtcactctgtttctctgtcattttcaaattcctctttatgatgaaccttttgttcaagtcaagcgtccctttgctataggtgctggtgttgtaacttcatttggttaccataaagatcgtgatggtcaatggctgaagaaggacgcgctacctcaacaagacgagcatactccttctcctccacctcaacgagatgattcctcagcccttatgaatgaagttctttcagagttacggggcctctgcacatatgttggtgaacgattcgattccttggatggtcgctttgaaggcatggatacctgcatcacccagcttgaagaagatgtgacttatcttcgtcggtgcttcgatcttccaccgccttctaagtcttag

SEQ ID NO: 85781 - DNA, 1107 bp, Glycine max
  Peptide Sequence Number=SeqID_177466
atggcggaaccatcgaaaaagcggaaaggaacctcgagtcggagtcatcgacattcagggtcacaggaagccccaattccttcctccattccctctggatcattattctcatcagaggaacaaagtatacggtacacaaacctcttttcctctcattccattgtagacccaaaattcattgatatggagttcttctcaaatgagaattttgaatgcttccaagcatttggaaaatccaatcttattccattcatgtctctgagattacctgtctattctgaattagtcaaagctttctattctaatttagaaatccatgaaggtaccctaatgtttgaagtttatgggattaagatggtcattgaccaatccctattttatgacttaacaaaattgcctagtgaaggtgtaccttttgagggtgcactgattgatgaatggaaattcgatttctctgtgcatgatgcccgccggttggtttgcaccaaccaagcggatatgaccggaagacttcttgccggttcattggcttttgaatgtcgcatcctccattaccttatagtttgcattttgcttcctagatcttcaaaccttgcccaggtttctaaagaagatctcattgtcatgtgggcctttcataaaggtttacaaattgattgggcacatcttgttagatatcgcatgcataaggcattgggattgaatgccccattgccttatcctcaccttgttaccctctttcttcaacatttcaatatccctcttgattctgaaccttatgttccaatcaagagatcattccttataggcgcttcagtcatagcatcctttggttatattaaggagcatgatggatcatgggtaaagaagggtgctagaaatattagtgaagaaggacatgagggagaagattcatctcttctttcgaagattttggaaaggtttgatggtcttcaaacctttgttggtgagaggtttgatactttggaactgcaagtagatatgcgcttcaatgaaatggagtcaagaatgactagagttgaagaagatgtatcttatatccggtcaagctttgatcttccaccaccgtcgccaccatcatcttag

SEQ ID NO: 85782 - DNA, 399 bp, Glycine max
  Peptide Sequence Number=SeqID_177467
atgggtgaagtagaggagatacaagagaagataaaggccgacatggaggccatgaaagagcaaatggccacgatgatggccatgatgagcatgaggaagataatagaagccaatgcggttacaattgccgctaccagcattgttgctaaggtgaacccgatgcccccatctggcctcaaccaaatgaatcatccaaccttagatatggtaggcaaagatttgggaagtaggggcggcccccattatgcgcaaaacgagcacgccttcccgccatatggcttgcctctcaactatacgccacccaatgtggcgtacactcccaatgacgatgtcaataactccactcctatacccattgagagccaacaaccccaaaccgatcatgcatatgtctcttaa

SEQ ID NO: 85783 - DNA, 325 bp, Glycine max
  Peptide Sequence Number=SeqID_177468
atgttggtgcgcatgatccgcactcgtctctttgcagcggcacgggtgaaatcttgccccggtatgcatagtagctgtgtgatagcctccctctctggttgtgctcgcacagttggccctcctccaatatcagggggtgtggatgtcgagcacactgaaatgaggacacgtagccctctaaaggtgagggcgtgtagccctctcaaggcgaggatatgtagtcctctagaggtgagggcgtgcagccctctgatggtgaggacgtgtagtcctctcaaggtgagggcgtgtagccctctaacggtgagggtaactagtacccaag

SEQ ID NO: 85784 - DNA, 228 bp, Glycine max
  Peptide Sequence Number=SeqID_177469
atggaaaacggtgtaacaagggtgaacactatcccatatcaccagctcactgtctttcattgccatacgaaattccggatgagcattcatcaggcgggcaagaatattttgcattacaaattacataatgaccgttggaggaaacaagttcgccacaacaaacagtttggattacctcaccagtgtctgagctttattctctcaggcttccaggatgtggaattgtaa

SEQ ID NO: 85785 - DNA, 324 bp, Glycine max
  Peptide Sequence Number=SeqID_177470
atgaatacagttagaatcatcctttcttcacctctcgctttggtttggaaattatgtcaacttgatgtaaaaagttcccaaggagaattggggaagatgtatatggagatcctgcctggatatggttttgataatggagggaacaaagtgtgcaaattgaggaagaaaattctgaagaagtcagcagcacaatttgagatgaatgatcttggcaagctgaaatatttccttggggttgagagagagggccagctagcattggaggtgtatacagatgtggattatgtcagatcaattgttgataggagatccacctcaggataa

SEQ ID NO: 85786 - DNA, 558 bp, Glycine max
  Peptide Sequence Number=SeqID_177471
atgggatgttacaggagacaaacgattgacatggtgttgatggaccaaatgaacatcaaagttgtggacaatcagtatgaatacaaaacaacatctgtcaaggaggttgaaagacttgagattactgctaatgtacgcatcattactgaaattgttgatattatttctagcatcgcaccacggcatactttagtagatgttgtgggtgttgttgctgaagttattgaacgtaaaacagtgaatcctgcatatagagttatggtgaagttgagagataatagtgatgctgagatcatcatgacgctgtgggaggattatgttcttcaactagatgatgctattgaaaaaaaccattttgttagggagccgttggtgcttatgttaacattggctaagatcaaagatgccaaagacaagtatcccctgagtgtccaaaatatcaaaaatggttcaaagttgtatgtgaacgccgatattgccgaaatcaagaaattccgtaatagtttacgtgtgccattttatgttggtggagtaacagatgaagggagcggttcgtag

SEQ ID NO: 85787 - DNA, 360 bp, Glycine max
  Peptide Sequence Number=SeqID_177472
ctggttccgactcagcaacatgcgactcagcatggccaaattcccaaattcttctggaatctcaccgcaaaactgattattgctgaggtcgagtttgttgacgtcggcggggatctcgccagagagcttgttgccgatgaggtccaggatgcggagggagggaagcgttgtgactcaagcggggatctcctcgataatgtctttccaatcagcgacgacgagggtggtgaggtggaggttggtgtcggtgacgcagccggtggtggcgttgcagctgatgccgtacaaattgaggcagtagttggagcccgtccacgagttgaagaggccaatgtagggctcgttcaatgcttattttga

SEQ ID NO: 85788 - DNA, 363 bp, Glycine max
  Peptide Sequence Number=SeqID_177473
atgcggttgcaatccattccttttgaccaggccaacagtgatgaactcaaacagttttctgattggctactagacataggtgatggaaaacttggacaacctaatgatggatataacgaaatcaccatcccagaagagtttcttataatggactttgatgatcctatccaagaaatcgttgatgcaacatatccagatttattaaaaaactacaacaacgaacatttcttgcaaaaaagagctattctagcctctacaaaagatgttgttgacaaaataaatgactatgtcctatctttggttcccagtgaggagaaagagtattgtagtgtcgatagtgttgacaaatatgatgaactctag

SEQ ID NO: 85789 - DNA, 243 bp, Glycine max
  Peptide Sequence Number=SeqID_177474
atggacattgaagaggatgctgagattccactgattttaggccgtctattcatgctaacaaccaattttgtggttgatatggggaaagataacttggagatgagtgtggatgacctgaaggttaccattaatccgtttgatgtagtgaaacactcaattgaccaaaatgtctgttccaaaatggagaacattgagaatgagacaactcagattgccagagctaaggttttgcaagacccttag

SEQ ID NO: 85790 - DNA, 321 bp, Glycine max
  Peptide Sequence Number=SeqID_177475
atgcataaaataccaaaaataaggggcaaaagggtcttttcattgagtttcctagaccctagctcgcccaggctagcctctggctcgcgtgggccagcaaattacttcaaggtgaaggaaccagctcgcctaggcgagctagttacttcaggagtaagcatcaactcacctaggcgagctgccatttccccaagtgcccattttcctataaatagacgtgcttgggaggctgaggggaggttccaagggttagaagtggagagaattgagagaagaagaagaaagaagaggaaacgaagtggaggcgctgccgaatcatga

SEQ ID NO: 85791 - DNA, 48 bp, Glycine max
  Peptide Sequence Number=SeqID_177476
atggcagatatgacggttcaagtgaacacgtcctgggccttttgccag

SEQ ID NO: 85792 - DNA, 411 bp, Glycine max
  Peptide Sequence Number=SeqID_177477
atgctgaatataggcaatccatctgacttacaaccctttgatcctgagatagataagacatttcatagaccagttagacatcatttagtaccttttgagcatcctgagcattttgttattggtgattttgagcattattgttttgaacattctgattttgaacattttgagaacatggcacaacctccaccccgtgagaggactctaagggaaatggctgcacctgatttcacctacgaaagcttgtgcatccaataccctgatgaggatgtcccatatgttcttaaaactggactaatctatttgcttccaaagtttcatggccttgcaggtgaagacccacacaaacatctgaaagaattccatattgtctgctccaccatgaaacccccagatgcggggatcctctag

SEQ ID NO: 85793 - DNA, 864 bp, Glycine max
  Peptide Sequence Number=SeqID_177478
atgaaggctgatatggaggccatgaaggaacagatgacgacaatgatggaagcaatgatgaacatgaggaagatgatggaggataacactgctatagttgttgatgcgagtacttctattgagatggacctgattcacccgactggttttaatcaagtgaatcatccagtctcagatgtagtaggtcaaggagatgaggtaacaaaaaatgcatacgggcctcatcatgttcaggttcagagcaagcattccttcccaccatataggttgcctcctaattatacatcgcccactgtgttccccaagaccgatcacaccctggctgggttcggggtttatccaggatataccactgaagggcaggcattttctggcattcctgaaaggattgagcatatggaggagaggctacgcgccattgaaggaggaggaaattatgcctttgttgacatggcagagttgtgcttggtacccgacgtggttattcctccaaagttcaaggagagtcttgttggggcagctattacctggtacactaacctggaaccttcccgagtccattcttggaaggacctaatggatgtggagagatttggaaactcaagtagtgccccgatgatggagaaggagatgataacaatgatagtggacacgttgccagtgttttactatgagaagatggtaggttccatgcctttaagttttgcagatttagtttttgctggcgagaggattgaagtgggtctgagaagaaggaaatttgattatgatgctactgcgagttctagtaatagaagacctgagatgagtggagggaataaaaatgagggagaaacccatgttgtgactgtcgttcctacatag

SEQ ID NO: 85794 - DNA, 610 bp, Glycine max
  Peptide Sequence Number=SeqID_177479
gaggagatagctcgcaggcgttgggcacctttagtgactcctatggccaagttcgaccttgagatagtcctagagttctacgctaatgcttggcccacggaggagggagttcgggaaatgcgctcgtggaggaggagccaggcagacggtttcgatgaggaagccatcgcccagctgctgtgcataccggggcaggattttgcccggaccgctgcagggaggcgggtgcggatcatgcgcaccagcatgactactttgacccagatatggatgacactgctactcagcaatgtcttgcctagcgaccacaactccgacctccctctgcctaagtgccagttggtgtatgccatcctgacacagatgagcgttcacgtggcccagaagtccaatagggccctggggttttcggctttgatcacgggcctctgccagtcctatggagttcctgtcacccccagcaaggtaatccaaccgccgatcacccgagccttcatcgagaagtactgcacacctaggcaggcgcacatcaggccgcaggcacactgccaccacctcagcgggccaaccacccatggaacagggggcagatacatgagtgtctctaccg

SEQ ID NO: 85795 - DNA, 322 bp, Glycine max
  Peptide Sequence Number=SeqID_177480
gactacgggccgagggacagtatcaggtagacagtttctatggggcgtaggcctcccaaaggtaacggaggcgtgcaaaggtttcctcgggccagacggagattggccctcgagtgcaaaggcagaagggagcttgactgcaagacccacccgtcgagcagggacgaaagtcggccttagtgatccgacggtgccgagtggaagggccgtcgctcaacggataaaaggttgggctgttcgcccattaaagcggtacgtgagctgggttcagaacgtcgtgagacagttcggtccatatccggtgtgggcgttagagcattga

SEQ ID NO: 85796 - DNA, 543 bp, Glycine max
  Peptide Sequence Number=SeqID_177481
atgcaagaaaatggtgagctgtggaccagagttctgaaatcgaaatatggtggatggaggaacattgaagaaacaggaaactcagcaaagcaatctgtttcgtggagggatgtaaaacacacttttaatcaatcacaacagggaatggttattcaaaataacatgaggtggaaggtgggagatgaagagaaaattagattctggaaagacaagtggattaatcaacaggaatcactagcagaaagccaacaacaatggacttccaaaatcgcttcccaccctaatgttaaaacgaaaggacgaacctcagtcgataagtggcagacacgaactccacaaagaccaactccacaatgtggttgcagtcacggaaacgcaacccagtttgcgacaaagacgaacttagggcagaaggagaaagaagaagaacgccctgggagtcttaaggcaaaccacaatgcacttccaaaatcgattcccaccctttccgggactttttcctttcctagatttcttcgacctgcgaaagcgagcaaatgttaa

SEQ ID NO: 85797 - DNA, 521 bp, Glycine max
  Peptide Sequence Number=SeqID_177482
gatggatgtagatataagtcgtctcttggccaaggcattagcagagcagcttccactcctcccttcgataagcttccctttttgggcactggacctagttactgctccatgggaacatctatagattccgctatcgggaaagtcaggcatggaatcacgctaagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 85798 - DNA, 237 bp, Glycine max
  Peptide Sequence Number=SeqID_177483
atgggtgagtcccgtccaggtagtcccaaagaaaaccggcctcaccgtgataaaaatgagaaggaggagttgattcctactcgggtgcagaacagttggatagtatgcatcgactataggaggctgaaccaggttgacaaaagcggggcttttgctcctacgtaccctcctttggagaggaaatcagacctacgtagttctttcttaagcgtgaatcaagtgattctttttacttga

SEQ ID NO: 85799 - DNA, 534 bp, Glycine max
  misc_feature (467)..(467): n is a, c, g, or t
  Peptide Sequence Number=SeqID_177484
atggcctccaggaaacataagagcattggggcaaggccagctgctcagtatgatactagacggttccattcgcttgatgcgaggaaccgttatacagataatgccttgggaaggagcattttgccagagaagaaggttgagatataccacacggagtttgatgacttcaagacagagttggagaggtgtaatcttcacaaatgcctcaccaacttggctaatgggactattgatgttgctttgatgaaggaattttatgccaatctctacagctctgaggacccttcaccaaagcaagccagagttagaggccacctggtgaagatagatgctgacagcctcaacacatttctagagactcctgtagtcctagaggagggggagacattacccacctactctaggtactgcaggttgcccacagaccacagagagattgaggttgttctttacataccagggcaggngttcattttgaatgttgagggccatccagggatgattctcaagaaggatctaactaccttggcccag

SEQ ID NO: 85800 - DNA, 153 bp, Glycine max
  Peptide Sequence Number=SeqID_177485
atgttcaagatagaatcaagaacacttcaagattcaagaggaaagttgaagaacaattcaagattcaagaggaaagttgatttcaagattcaaggatcaagctttcaagattcaagactcaacagaaggcttaatcaagataagtatgaaaag

SEQ ID NO: 85801 - DNA, 333 bp, Glycine max
  Peptide Sequence Number=SeqID_177486
atggtaatcgattaccagagagtaaaaactctttgtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 85802 - DNA, 348 bp, Glycine max
  Peptide Sequence Number=SeqID_177487
atgggtgaagtagaggaggtgcaagagcagatgaaggccgacatagaggccatgaatgagcaaatggccacaatgatggaggccatgatgagcatgaagaagataatggaagccaatgcggttgcagttgctgctactagggctattgctaagacaaagatttgggaagtatggacggccccctattatgtgcaaattcaaaacgagcacgccttcccgccatatggcttgcctcccaactatacgtcacccaatgtggcatacattcccaatgagaatgtcgataactccactcctatacccattaagagccaacaaccccacactgttcatgcacatgtctcttaa

SEQ ID NO: 85803 - DNA, 168 bp, Glycine max
  Peptide Sequence Number=SeqID_177488
atgacggaagggtgtggtgaagggtttttgccttgcaaaccttcccgggtcggcggtgctgggttatggccccgtgctaagtttcggattggttggccccctcctcccccccgtgatcagttttgttgccaggattttgccaactttggcttgcgccccgttggctaa

SEQ ID NO: 85804 - DNA, 366 bp, Glycine max
  Peptide Sequence Number=SeqID_177489
gcaccctctacacctacccaagccagattcgataaatccagattcacttcccaagaagcttgggaaagatacaccgacattgtggtgcctcgtaagctgttaccagagaggaatgtggtggtctactatacagagtttgatgagttcaaggaggaactcgagagacgccaatgggatgaggagttgactgattttgctgacagcaacatcgatgttgccattatgaaggaattctgtgcaagcctctatgacccagaggacaaatcacctaaatttgcactcctgaggtctgaccctcaggagttagctgctaagctctgtatccccgggagggattcgagcttaatgttgatggttatctgttga

SEQ ID NO: 85805 - DNA, 324 bp, Glycine max
  Peptide Sequence Number=SeqID_177490
atgtcaaattccaaactgactcttatgtccgcatttaagctcagtacaagtcaagcacctaagacatatgatgatataatttacatgaaagatattccatatgctaatgttgtagggtcactgatgtatgctatgattcaaggaaatccctcacaggatttgtgttcacttctcttggcactgcaattagttggaaagactagccttcaaaaggtagtggttttatcaatcactgaagctgaatatactgctcttacagaagctgtaaaagaatctctgtggcttgaaggcagcaaaggagctgaagaacaaaatgaagcttga

SEQ ID NO: 85806 - DNA, 269 bp, Glycine max
  Peptide Sequence Number=SeqID_177491
gccgatccaactggatcactaggcatggagcgttatctacagcacttggttcaccggcaggcggccaaacaccgtggggacagggttccgctccttttgcatgccctactccggagcagtttgggactgaggtcgcatggcctggagactggcccgaggcccaggcaagggaggagcctacaggatcccccggtgaagcagaggaggctcgtatggatgaagatatgactaacttgctcggtttcttgggaggaagcgaagccacgtga

SEQ ID NO: 85807 - DNA, 618 bp, Glycine max
  Peptide Sequence Number=SeqID_177492
atgggtgatcaagaggagacacaggaacagatgaaagccgacatgtcggctctaaaagaacaaatggcctccatgatggaggccatgttaggtatgaggcagctcatggaaaagaacgcggccaccgctgccgctgtcagttcggctgccgaagcagacccaactctcttggcaactgcgcaccatcctccctcaaacatagtaaaacggggaagggacacactggggcacgatggcagccctcacttgggatacaaccgagcggctaacccttatggattgccgcccaactactcaccacccgtcttgcaagacgatgcaggccatattgcttctcccgtccttgaaagagagcctcctcaacagcccgaagaaggccacaaagaccctcaagactacgctcgaagggatgtcgagttctatcccccgatccccgaagggccggcacccagtacgttgcctcaacccaacatcgcgacacaaccaatagttttgtccacagaaggaccgtccccggcaactgaagaaaggaggaagctcgatctccttgaggaaagattgagggccgtggaaggatttggggactatccgttcgcagacatgacggatctttgctag

SEQ ID NO: 85808 - DNA, 612 bp, Glycine max
  Peptide Sequence Number=SeqID_177493
gatagtcatgcctatgcgcatgatctgcacccgcctccccgtagcagtctaggcgaaatcctgccccggtatgcacaacatccgggcgatggcctcctcatcgaagccatctgcctggttcctcctctggctggactcacactgctggttctcctccaaaatcaacgggtcacccaaaaactggctgagggcatctgcatcgaaggggatctagtgacccctcacccacgagtgcatgtcccgaaccccctcctcagagggccaggcgttggcatagaattctatgactatctccgggtcaaatttagccataggggtcacttgtcgttcccaacgcttgcgagctatctcttcctggaagtcaggctactcgtcctccctgagctggacacgcctctccctatggaacgaccatcccttgatggcctcgaagcgttgctggtgttcggcactctagaatcggtgactgtcaaactccatgggggcgctggagccttccccatgggcgtccctcctggacctcttcgtggaaagcttcttcggagccatctcttgttggggacgatcaacaatgcaaatcgggcttggaaacgcaaaagaatggtgacctag

SEQ ID NO: 85809 - DNA, 636 bp, Glycine max
  Peptide Sequence Number=SeqID_177494
atgtgcaagctgacggaaaacagtttccgcgatgtgaacatcgcctttgccaatgaactgtcgctgatctgcgccgaacaggggatcaacgtgtgggaactgattgcgctggcgaaccgccatccgcgcgtcaatatcctgcagccgggaccgggcgttggcggccactgcattgcggtcgacccgtggtttatcgtggcgcaaaacccgcagcaggcacggctgatccggaccgcgcgtgaggttaacgatgccaagccgggctgggtgctggatcaggttaaacgggcgctggccgagtgtctgacggccagcggcaagcgtgccacggacgtgaccattgcctgcttcggtctggcattcaaacctaatatcgatgacctgcgtgaaagcccggcgatgtcggtggcgcagcgtattgcgggctggcacagcggccgcacctgggtggtcgagccgcatgtggcggatattccgccgcagctcgccgaacgcgctacgctggtgtcgctggctgatgccctgcaacacgccgacatcctggtgatgctggtcgatcatgcgcagttccgcgccgtcacccctgaacaggtgacgcagccgtggattgtggataccaaaggagtctggcgatga

SEQ ID NO: 85810 - DNA, 486 bp, Glycine max
  Peptide Sequence Number=SeqID_177495
atggctcacaaattttgctttcaagcacttgatcaaacaaaaacttgcgtttacaaggcaatcccccaatcaattgatgatcaagaaactactaaatttgcaaagtggattctagatattggagatgaagtttttgggaatcaaaatgatggatatgctacggttgaaattcctgagtacctactgattactgaatataatgaccccattgatgctatagtcaaatcaacatttccagatttatatgaacatcacagtaatcctgaattcttcaaatgtagagcaatattagcttccaccaatgaaacagttgaagaggtcaatgattatatactttccttgattccaggtgaacaaatggaatacttaagctctgattatatagagaagtcagaaaccattgacagttggcatttccaatcaattacaactgaatttctcaattcactaaacacatttggtctgccaaaagctaaaaattggtag

SEQ ID NO: 85811 - DNA, 171 bp, Glycine max
  Peptide Sequence Number=SeqID_177496
atgaggattcctttttttacaggccaaggttcaaaaaggtccgaggttgtgtttcaatggggtcttttatcgtgggaacccaatcttgatatctggggcgaaacaaatccgggtgacaagtcatggctacagccaggtgggcactcaagcatcccttttatggcatcgtga

SEQ ID NO: 85812 - DNA, 204 bp, Glycine max
  Peptide Sequence Number=SeqID_177497
atgcagcaatctaaagcaattaaacagcctgaagtttatgctgcaaacatcttcaatagacctcctcaacctcagcagcaaaatcagccacaacagaacaattatgacctctccagcaacagaccatacgttcctccaccaatccaacaacaacaacaacaacaacagccccagaaacaacatacagttgaggcccctccgtaa

SEQ ID NO: 85813 - DNA, 501 bp, Glycine max
  Peptide Sequence Number=SeqID_177498
gctggtgagtcaggaagagctgcaacttcattatctgagtcatcgggaatgagtatcaaaggtggtgccggtggagctagtggaggtggtagaatctcaaccttcggggaagccggtgggtctactattggtggttgcagctcagctggtgcaggctctatccttgttggtatgggactgggggcacaacctcgggagatcttcctaacggcagctgagcttcaggccaggccactttatctaaaaattgctccatggatactattggcctattatgagccaactgctgctggaggtgggttggataatgaagggatgtctttagctcttgctctctttcttgaggccatctatctcgctaagcctaaaacttgtcgtaatgatgtgcgcttagctctccctgagccacgcttagcggtattacacagtaaaattttcacaaattctactgagttatgggaacttagcgaaatgggttgctcaactcagtcactgtcgtaa

SEQ ID NO: 85814 - DNA, 894 bp, Glycine max
  Peptide Sequence Number=SeqID_177499
atgtattctagtatttttggtgggataacaacagacccagctgctatggttattcctatggatgaccacatggtccacagaggccacggtgtctttgatactgcagcaataatggatggatacctatatgagctagatcaacaccttgatcgctttttaaggtcagcatccatgtctaaaatagatcccccatttgatcgaggaagcataagaagaatactcatacaaactgtaagtgcttccaagtgtagaaaaggatcactaagatattggctctcggcaggacctggcgactttcagttatctccctcttgttgccaccgatcaagtctgtatgcgatagtaatacaggatctgtcaccatcctcacctaatttcaggggcgttaaagttgtcacttcatctattcccattaaacaccccaagtttgctatcactaagagtgtgaactatcttccaaatgtgctctcaaaggtggaagctgaagaagctggtgcttttgtaggcatttggcttgatggtgaaggttttgttgctgaagggcctaatatgaatgtggcctttgtcactaaagataaggaacttataatgccacactttgacaaaattctaagtggctgcacagctaagagagttttaacccttgctgagagcttgttaagggagggtaagcttaaagggataagggtgaaaactgtgactgtcgaggaaggtaagcaagcagatgaaatgatgcttcttggcagcggagttcttgtttgccctgtagtgcaatgggatgagcaggttattggtgatggcaaagaaggccctataacgcaggctctcttaaatctaattgttgaggacatgaaatcaggtccctccactgttcgtatacctgttccttattga

SEQ ID NO: 85815 - DNA, 174 bp, Glycine max
  Peptide Sequence Number=SeqID_177500
atgaagttgcctcttctcaaggagactggaagaaacaagaggatggacaagaaaagttcattgagctctaataagggatgctacacattgttagagcaggattcattccaaagaagaagtgctttggacaagaaaaccgacaaaagaaaaggaaatacccataaagcaaggtag

SEQ ID NO: 85816 - DNA, 321 bp, Glycine max
  Peptide Sequence Number=SeqID_177501
gttcagggttcaattattgacaaaatcattcagctcacaaagggtgcaaatgatagaattataattcaagtttttcgtgagggaaaatacttgtacttgggggcatgtcactcggtttggaactcccttgtgactcgggcttatcaccattgggggtggggtggagttgcctgtgcacaacaggatgaccttgacacttgctacccagctttcttgggtgtgagtgtcgtgtgggaatgctcaggctatttcatgacgaatggtactacattgcatttgagagttaaggtcaagtgcatgcatcatactaagcatgattga

SEQ ID NO: 85817 - DNA, 339 bp, Glycine max
  Peptide Sequence Number=SeqID_177502
atgtgcgcggagtcgccaccaacgtttatttgtggaaaaagtcggaaaaaccgaaggaaaccggtcaaaatgaaaattctaagttcgggagttgtatttacgcttgaggaaggtattagcacctcttacgacgacaaaagcggggcttttgctcctacgtaccctcctttggagaggaaatcagacctacgtagttcttccttatgcatggatcaagtgattcttttttacttgaagggggagaagcttgccgcccagctcgcccaggcgagccaggttgcttcctccagaagcaacagccttctggaggaatcttctggagggcccaagtgggcctga

SEQ ID NO: 85818 - DNA, 432 bp, Glycine max
  Peptide Sequence Number=SeqID_177503
atggattacattaaactcttaagaaaagaaaaggaagaagaactaaccgactattgcacagggtacaaggctagcaagagaaacgatgtagggaatgatcctcggttgcgattcggtagcacctcaactttgcttttcttctttttccttcctctccctttgtttttcttcctccctcaactttatgacccccaaaacccttcccctgcatggctatttatagaaaaagccatttggggccagggcagctcaccccaggcgagctggttgcctatggctaaaggcttatcccacaaagtgatttggttcctggaagggaagacatctcgcaacaaaaccatcctggttcttaatatgcaaccttcacctctcattgagtgtccttccacaaaactctcctcactcttgggaagatacccatctcaaccataa

SEQ ID NO: 85819 - DNA, 285 bp, Glycine max
  Peptide Sequence Number=SeqID_177504
atgggtactcgcctcgtgcttgatagggaaaacttgctttctatgggttcgagttttgattttctcggacttggggaagtggggacgggagcggccttggaaaacagccattcctttctccttctttcttccaaaacccttccccaacgtcccaagcttcttcttcaccacctacaaccaccagtagccaccacgaaccgccgtaggtctccattgaaaccccacaccgagaggaacccttcaattggagcggaatcttctaaacttatctcgcagtttcgttag

SEQ ID NO: 85820 - DNA, 267 bp, Glycine max
  Peptide Sequence Number=SeqID_177505
atggcgaaaaccgcttcaccatcttccaaaccctcaccaatggaccctcaaattcaaaaccccgcaccctccaactccaactccaactccaaccctccaatctcttccccttccccttctcacaacatgacctctccctctctcccacccctcccccaagatcaacaacaacaacttcagcaacaactaagtcctcctcctcaacaacaacaacaacaacctttggtttcttcgaacaacatgtacccgaaaatatcatataaatga

SEQ ID NO: 85821 - DNA, 396 bp, Glycine max
  Peptide Sequence Number=SeqID_177506
atggtacttcgaactggaacgagtatgaagaaattaacgatacttctttaccttttgagttgttctgccggatcggtcgctcaagacctttggtctctacccggacctgatgaaaaaaatgggatcacatcttatggactcgttgagaataattctgatctagttcatggcctattagaagtagaaggcgctctggtgggatcctcacgtacagaaaaagattgcagcccaatgaattgggatttccctattgggccaggtcatttcgggacaagcggatcatttatgatgaagaggatgagcttcaagagaatgattcagagttcttgcagggtggaaccatgcagtaccagacacgagatagatcttccaaagaacagggcttttttcgaataa

SEQ ID NO: 85822 - DNA, 688 bp, Glycine max
  Peptide Sequence Number=SeqID_177507
atggatttcttttccaatgagagttttgaatgcattcaggcatttgaaaactccaatcttattcctttcatgtctttaaaatttctgtttactactgatttagttaaagccttctattcaaacctagaaatccaagaaggcactttaatttctgaagtttatgggattaaaatggtcattgaccaatccatattctatgatttgaccaaattatccagtaaaggtgtaccatttgaaggtacactgattgatgattggaaatatgatttctctgtgcatgatgcctgtcggttggtttgcaccaaccaagcggatatgaccggaaggcttcttgccggttcattggcttttgagagccgcatccttcattatctcattgtgcgtatcttgcttccaagatattcaaaccttgcacaggtttctaaagaatatcttattgttatgtgggcttttcataaaggccaacaaattgattgggcacacttagttcgatatcacatgcataaggcattgcgattaaatgctccattgccatatccacacctagtcaccctcttccttcaacacttcaacattcctcttgattttgaaccttatgttccaatcaagagatcctttctaataggcgctgatgtgattgcatcctttggttaccgtaaagagcatgatggctcttgggtgaaaaagg

SEQ ID NO: 85823 - DNA, 276 bp, Glycine max
  Peptide Sequence Number=SeqID_177508
atgtggcggaacattgacattgtccgcgtatgcctgacatttatgacatttcctggcatgagcgcagcaatcgctttctgtcataccctaatttcgtccgggaacctttgctcgatgacgtgcgaccattctttggtcctcgtgaggcccatttgggccctccagaaggttcctccagaaggcggttgcttctggaggaagcaaccctgctcgcctgggcgagctgagctcgcctggcgagctggcggcaagcatctccctatttgctataaatag

SEQ ID NO: 85824 - DNA, 102 bp, Glycine max
  Peptide Sequence Number=SeqID_177509
atgaaggattgtagttttactgagaccattctgggtttctgcgggaaaggaaaaggctacgatgcgaaaggtatttctctcagctcaaacatgatatcgtaa

SEQ ID NO: 85825 - DNA, 342 bp, Glycine max
  Peptide Sequence Number=SeqID_177510
atgttgctaagtagcaacatcatctatatctatgtaagagtggtcatgttggtgcgcatgatccgcactcgtctctttgcagcggcacaggtgaaatcttgccccggtatacatagtagctgtgtgatagcctccctctctggttgtgctcgcacagttggccctcctccaatatcagggggtggcccaggaaccgtgcggatgtcgagcacactgaaaatgaggacacgtagccctctaaaggtgagggcgtgcagccctctcaaggcgaggagtgtagtcctctggagtgagggcgtgcagccctctgctggcgaggacggtgtagtcctttcaaggtga

SEQ ID NO: 85826 - DNA, 114 bp, Glycine max
  Peptide Sequence Number=SeqID_177511
atgaagatgctcttgataccacatgatatgaatggcagcggaatggagaaggaagagagagaggagatgccacttcaaggagaagatgagtctagaagaagctcaccaccatag

SEQ ID NO: 85827 - DNA, 222 bp, Glycine max
  Peptide Sequence Number=SeqID_177512
atgatgacaaaggtgatgaacaaaaagctcaaaagatcaaagaacaactcaagtgaatcaagaacaagtcaagagttcaagaatcaagaagaattcaaaactcaagaagaaagactacaatccagcctcaagattcaagattcaagatctcaagaatcaagatcaagattcaagactcaagattcaagaatgaagataggactccatcaagataagtattaa

SEQ ID NO: 85828 - DNA, 316 bp, Glycine max
  Peptide Sequence Number=SeqID_177513
atggcagacacgactaataaatcacacattatcttgctttcaaatagtctcccaattgatacacaaagtatgacatttttaggagaaactagcagtcagacgattgtcaactcaaggttggctttcatttttccaaatggatcaattattcacaatgataatggcatttacttccaaacttcaactccggtgcccattcgagtaccaaatagctgtgatttcgcaagcctaaaaaccagaatacacaatacccttcagttatccgacaaacaatttttggatgacattcactaccggaaaccattcaccgatacag

SEQ ID NO: 85829 - DNA, 441 bp, Glycine max
  Peptide Sequence Number=SeqID_177514
atgggggtgcaaatagcaaccaggcccacttgggccctccagaagattcctccaaaaggcggttgcttctggaggaagccaccttgctcgcctgggcgagctggaacatccaagccgaggttcttctgtaacgtttccgtgggtgatttcatgaagactttcaaccgttcttcgacgttcttcattcgttcttcgtcattcttcggtcttgaaccggtgctagtaccttcctcaaacgtaaatacaactcccgaatctggaatattcttcatgaccggttttccttcggcttttctgacgttttccacaaataaacgttggtggcgactccgtgcattttcctcctttggaagatgcacccatgagcctcgcctcgctcgcccgcaaaagggtaggttgcgacagttggcgactccactggggactgtttttgtgagttag

SEQ ID NO: 85830 - DNA, 588 bp, Glycine max
  Peptide Sequence Number=SeqID_177515
atggagagactagtggttcatgtggatcccttcgctaggaaagttgatggtccccacaaaaagaaattaaggacgtatttggggattatctctcgatacaagattgaatttgatattccagaagcatccaaccaaaggacaaagaagaaaatccttaagacggatgttagaaagaaggctcaggccatccagaaagtaaacactgcccctcacgtgttgtctcatggagagcaagaagcccaatctaggagcacaggaacaatcattgatcctccatctcccattagacgacatgtgaaatggaagctggctcgcactaaaaaatctagagagatgacatctgaggtagcacaggaaattgtagataggatttcagcacagggcagctttgttgcccatggacatcaggatgtgctgactactgccattgggcaaccagagcactctggtcatatctgtactgttggagctagtctcacgattagacaatactttggaccagattcaaaaagctcccgcacatctacatccatcactcccaaagagctggagctgttggcacaaaaaattagggaccaactggagtag

SEQ ID NO: 85831 - DNA, 330 bp, Glycine max
  Peptide Sequence Number=SeqID_177516
atgaacctacccaacctcactctactccagaaaaagatgatgacaaaaatgtcaagagagttgtgcactaataagcggaagcttaaaggaagtgaaagaattagtatgggcagaaatgtctccgcattgattggtaaatctgttccccaaatccctgaaaaatgtaaagatccaggtcctttgcagtcaactgatgtggtaattcatttagctaatagaagtgtttcctatcctgttggtttcatagaggatgtcttagttagagttggtgaattgattttccctattgatttttatattttgaatatggaggatggattttctaaatga

SEQ ID NO: 85832 - DNA, 627 bp, Glycine max
  Peptide Sequence Number=SeqID_177517
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaatggtggcgaaacccgacaggactataaagataccaggcgtttccccctggcggctccctcgtgcgctctcctgttcctgcctttcggtttaccggtgtcattccgctggttatggccgcgtttgtctcattccacgcctgacactcagttccgggtaggcagttcgctccaagctggactgtatgcacgaaccccccgttcagtccgaccgctgcgccttatccgaggagttagtcttgaagtcatgccgcggttaagggctaaactgaaaggacaagttttggtgactgcgcttcttcgagccagttacctcg

SEQ ID NO: 85833 - DNA, 507 bp, Glycine max
  Peptide Sequence Number=SeqID_177518
atgactggctatggacgtaaagttgggtatatccggacggttcctaatgaagcgctgccagacggttcccagacgtggtataaaaaatgtccagaaggagttcccatgaccgatatccgacacatcctccagacttttcaccgcgcctcaggccttgagctgcgcagcacatggcagagcacgcaggcctacaaacgtcattgtcatccccaactctctattggcgcgattgtggaaggccagacctgctgcgtgtgccatgacagggagtacatccttcatcccggggatctgattgtgattccggcttatgcgccgcacagctgcaaccccatcgccgggcaagcgcgcagctaccatatgctctatatcgacaccgatcgtcctctggcgctccaggtgatccgtaacgctacgttctttaagcacttccttgatattgttgagacaatgtcgcctgcatccgtggacaggcctgctttctgcccttccccaccgtgcggataa

SEQ ID NO: 85834 - DNA, 546 bp, Glycine max
  Peptide Sequence Number=SeqID_177519
atggaaccgactaccaggatagcgatgataatcacggaagcaaaccagatgcaccagaatctgaaccaccgcggtcaccaggattgcacccagaataaccggcttggaggcagaaccgctcatcaccatccagaacgggatcaccgtcaggatgatcgacaggatgaaacctgtcatatagacaacagagaacacacagatccacaccacgtccaggaagtgccagaacaggctcaggcacaggatacgggtacggttagtactggtcaggccgcgacgggagatctggaacatcagtactgccatccagatcagaccggaggtcacgtgcagaccgtgggtgccgaccagcgcgaagaacgcggacaggaagccactgcgatccgggccgaagccttccatgatcaggtgatggaattcatagatttccatcccgataaatccagcaccaaacagccaggtcaacgccagccaggacacaacctggctcttgttgtttttgtacatggcgatagccgccatgccgtaggtgatggagctgaataa

SEQ ID NO: 85835 - DNA, 318 bp, Glycine max
  Peptide Sequence Number=SeqID_177520
atggcctctaggaaacacaagagtatcggttcaagacccacaactcaatatgatacaaggagatttcactccttagatgcatggaactggtacacggataatgtattggggagaaacatcttgccagagaggaaggtggagctctatcacaccaagtttgattattttaagactgagctggagaggcgtaatctccataaacgcctcaccaatttggttgatgggagcatagatttggctttggtgaaagagttctatgcaaacatgtacaactcagatgatccttcaccaaagcaagcctgggtcagaggccaccta

SEQ ID NO: 85836 - DNA, 751 bp, Glycine max
  Peptide Sequence Number=SeqID_177521
atggctatgggggatttcatcagcagactctccttccctgaaaacaccgagactttttcaagtctcacaagttatccagaactacgtaggtctgagttcctcattggaggatacgtaggagcaaaagccttgcttttgtcgaccgcgccgctttctgttaccatgagccaagagctggtagcccgcggagacaccttacggttatccgcacctcgtcattcagtgaccccaagtgtgattgatgagcagaggccaatgtggtcatctgcgccctttccggagatgtcagcatcttccggtggagactttttcaagtctcacaagttatctagaactacgtcatgtgacatgcatccttgtgtcatccagaggcggcggggcccgatgacacgcagagacaaaatttggtcattctgcacccttgtgtcatctagaggcggcgggcccgatgacacgcggagataccttacggttatccgcacccttgtgtcatctagaggcggcgggcccgatgaaacgcggagataccttacggttatccgcacccttgtgtcatccagaggcggcgggcccgatgacacgcggagataccttacggttatccgcacccttttgtcatccagaggcggcgggcccgatgacaagcaaagacaaaatttgaggcgcgggcccgatgacatgcagagacaaaatttggtcttctgcacccttgttctccagaggcggcgggccgatgacaagtatccttacg

SEQ ID NO: 85837 - DNA, 135 bp, Glycine max
  Peptide Sequence Number=SeqID_177522
atgcttgcgtatttatatagagagatatgcagcgccaccgattataaagttaaatcatttggaggtggctgcgacgtggaaatcaacatattggcaatgatgatcttagagtttttcgtcgcaaattggatctga

SEQ ID NO: 85838 - DNA, 423 bp, Glycine max
  Peptide Sequence Number=SeqID_177523
atgccctccagcttcgcagacttggtattcgccggggaaaggatcaaagtgggattgaagagagggaagttcaattacgtctcctccataggtaccaactctaggaggatcggagcaactggggcaaaaaggaaggaaggagatacccatgccgtcacttcaacgcctgcatggatcaagccgccgcagatctcccatggtacccaccaatatgcgcaacatcacccgagcttctcagctcgcgctgtagactcctccaactcagcacccgtacaacctagggtgcccgcgcctatccagagggagcccctccccccccccccccccgcgcgcttatccagagggaggccccccaagctctggctccaaccccgattcgcctggctggcaatgcccactttggcgtcggttccaacgcgataa

SEQ ID NO: 85839 - DNA, 318 bp, Glycine max
  Peptide Sequence Number=SeqID_177524
atcgagaagtattgcacgcctaggcaggcacagggtaatgcacctaaggccgcagacataccgccaccacctcatcaggttgatcccactggatcactaggcatggagtgttatctacagcacttggttcgccagcaggcagtcatccaccaggggcagcctcagtcagcaggggcagggtttggggctgaggtcgcatggcccgaggcccaggcaggggaggcgcctgcaagatcccccggcgatgcagaggaggcccgtatggatgaggagatgacggatttgctcggtttcttgggaggaagcggagccacgtga

SEQ ID NO: 85840 - DNA, 195 bp, Glycine max
  Peptide Sequence Number=SeqID_177525
atggtttctgaaagtgatagtgatccaccttctcctagttccgctaagataatggcttcattggctaagcaaatggataagttgcaaagaaatagaggaggaggcatcatcagtcaccttattcttctcaagggagtgatgatgaccatgaataagttagagggcataggcataggaggaataaggatggaatga

SEQ ID NO: 85841 - DNA, 702 bp, Glycine max
  Peptide Sequence Number=SeqID_177526
atggaagacctttttaagaggtggactaatcatcttgatagcacacgatcaaaggtcaaccaaccaccactgataaattgtaatttttgtggagagcattacaatgacaattgtcatctctactccatgaataactctaggtggggacaggagttaagcccttacaatcaatatgaagaagagagaactcctaatcttaaaagtgtgtttgaagaattcatggcatatcatgctaactctaaagccaatcaaaactcagtgcaaaatcaagaaattcaatttggaaagagctattccatggaaaattatcgagggggacaagagttacaaccctacaatcaaaatgaagaagaaagagaggttgaagctcaagaggaaagcttggtaaaagagcatgattcaagagaaaaagatgaagaggaatttgaggaggaagcacaacaacgggagaagtactcgacaatagaaaatcaacaagaaagtattctccaactcaagacctctcctcatcaactaattgtaaaggaagaaaggcatggagaacatgataaagccttaagtgtcattctttccttgatcactagcacctctcttgcaatgatttggaagatatttccaaaatacatgagtttcatagagtttctagcaaaaaggcgaaaatgcaaggaagacgtgttctatgtgacctttatgccaccttga

SEQ ID NO: 85842 - DNA, 387 bp, Glycine max
  Peptide Sequence Number=SeqID_177527
atgtggctactcagcagagaaatggcacccagtttttccaatgacaaaaaggaggatgtgattgtgggtgttattgaaattggtgtgtggctagagaatgaaggcttcaaagatcatggaatgaccaagaaaattccaaacaaatggaaagggggttgtgaggaagtacaggacttcaacactcatgtgaaaatgaggctaagtcatgaaatgctaaaacacgcatccaccgctaagcatagcttcagcgtgacagaagaatctggcagggcatcaatatcaaggtcgcgcgctaagcgcgagatcagtgcgttaagcgcagtagttgtcttcagcctggttcagcacatgaatgacgctaagctcaaatccacttatgtgcgctaa

SEQ ID NO: 85843 - DNA, 312 bp, Glycine max
  Peptide Sequence Number=SeqID_177528
atgtataatagtataataacctatattggtctccactacagggcacattggcaaatagtcttcattttgcctaaggaaaatgttgtcatccggttttgttcattgtataataggccagacaactacctcaaaggaataattaacagtgctttgaaaggacttggcaatactccacaaagtaaattcaaggctggtgctaggtggattgttgttaaatatttcaatgatgctagaccattggaaccagagagattgaaggcgcttcgcatccaatgggcaaagtattatttgaaagttaaaaatgatacttag

SEQ ID NO: 85844 - DNA, 222 bp, Glycine max
  Peptide Sequence Number=SeqID_177529
atgataacaaaagatgatgacaaaggtgatgacaaaaatctcaaaggtcaatcaaaggatgagttcaagatagaatcaagaacacttcaagattcaagaggaaagttgattttaagaatcaagaatcaagattcaagagatcaagatttcaagaatcaagattcaagagatcaagattcaagactccatattcaagaatcaagagaaggcttaatcaagtag

SEQ ID NO: 85845 - DNA, 162 bp, Glycine max
  Peptide Sequence Number=SeqID_177530
atgggtagagtagatggggaagatgaaggaaacttgaggggaaatacaaaatcagagagtggaagtggaagtgacaatgattatgtgcgtgagagtaacttctttttaaataaaggggggaaggctttgacttgttccttgtacaatcttgaagactcataa

SEQ ID NO: 85846 - DNA, 573 bp, Glycine max
  Peptide Sequence Number=SeqID_177531
atggagatgaagccatatttcctaagtttgattagtgcacatcagtttgcaggcatggatcatgaggatccatatactcatctatctactttctatgaactgtgtggcacaatgggcattcctgaagatgttgaacaagccataaggactattgatgcttttgtttcaaataattaccaagctcggcataacaaacagtcagttcaaattcacaaagtcttagatgtgatttttgtggaggcaaccatccaagtggtcaatgttctctccaataaatcttatacaaacaatttttcgcaaggttggagaaataatccaaatcagaactttggatggagacaagaagcaagttcttccaatagacaacctccaaatcaaaagcaagcaaatttttctcctatacatgaaaggatgcaaagcttgaagacaccttggagaagttcatgcaaggttggagaaataatccaaatcagaactttggatggagacaagaagcaagttcttccaatagacaacctccaaatcaaaagcaagcaaatttttctcctatacatgaaaggatgcaaagcttga

SEQ ID NO: 85847 - DNA, 261 bp, Glycine max
  Peptide Sequence Number=SeqID_177532
atgataacaaaagatgatgacaaaggagatgacaaaaatctcaaagatcaatcaaagaacaactcaaaatcaagaagaattcaagactcaagaagaaagtttagagtcaagaatcaagattcaaggttcaagatctcaagaatcaagattcaaggttcaagatctcaagaatcaagatcaagattcaagactcaagattcaagaatcaagaaaaggcttaatcaagataagtataaaaagtctttctcaaaaactgagtag

SEQ ID NO: 85848 - DNA, 414 bp, Glycine max
  Peptide Sequence Number=SeqID_177533
atgaagaaaaacaatggaagagaagcttgcttgtggggtttctatggaggctggatctttgagcttctatggggtcctctaatggtgattttccaccatggagattcagcggaagacaaaggaaaagaggattgcatcacttggcatatgcaattacgatcttctagccatcgtgccaatattcaaatagtttgtaggccaaagaagagaaggtgcaaaaagttgctgatgaactcgcttagcaaggtagattggctaagtgagcctcatccgcttagcgaggcagccagctcacttagtggatgggaaaccctagaagaggataagtcagagatatgcacgctcagcgcgcagtcagctcacccagcgaggacattgtctcttctcgcgcttagcgtgtccaagctcgcttag

SEQ ID NO: 85849 - DNA, 186 bp, Glycine max
  Peptide Sequence Number=SeqID_177534
atggaagcttgcttgtggggcttctacagaggctggatctttgagcttctatggggtcctttaatggtgattttccaccatggagattcagtagaagacaaaggaaaagaggtagcttccttgagaagttttcttgagaaaacttccttgagaagcttctttgagaaaacttccttgagaagctag

SEQ ID NO: 85850 - DNA, 560 bp, Glycine max
  Peptide Sequence Number=SeqID_177535
gacgcaagggataacttggctcccaaagctaaaaggcctaagtgggaaagaagttgaagtccctgaggaaagcaaagaagttcaagctttgaaagtagagctcgaaaaaatgagagtggtcaaggagaagctaaagacgacagtcactagggccaggaaagacaacaagctcaagcttagaagagccgagagggatgagtcaaggatggaaagcatggtgttagaagataagttgaaggcttgtcaaagtgcaaagagaagtttgatggagcagctgagcagaacgaaagagaatatgttgataattattgatcaatataaggagaaggtgaacctagttactagtcatgggcagaggctggaggatgaacatgtgaaggtattggctttgcatattgaaagggaagcaagagagagggtgataaaatcattacatggggaatctatgaaatggatggataggttcgctctcactctgaatgggagtcaagagcttccaaggttgttagctagagccaaggcaatggccgatacgtactcagatcccgatgaagttcatg

SEQ ID NO: 85851 - DNA, 576 bp, Glycine max
  Peptide Sequence Number=SeqID_177536
atgggtgaagtagaagaggtgcaaaagcagatgaaggccgacatggaggccatgaaagagcaaatggccacaatgatgaaggccatgatgagcatgaagaagataatgaaagccaatgcggttgcagttaccgctaccagtgctgttgctaaggtgaacccgaagcccccatctggccttaaccaaatgaatcatccaacctcagatatggtaggcgaagatttgggaagtatggacgacccttattatgtgcaaattcaaaacaagcacgccttcccgccatatggcttgcctcccaactatacaccacccaatgtggcgtacacttccagtgagaatgtcaataactccactcccatactcattgagagccgacaaccccaaactgatcatgcacatgtctctcaaaccatgagggagacacatgaaattccccaccacaatctagccgacttcgagccttgcctcggatatgccactgaagggcaagcagttggtggtatacccctccaaaaacactttggagggccctcagtatcacctacaaccacaccccttgcattctacatcgggtaa

SEQ ID NO: 85852 - DNA, 327 bp, Glycine max
  Peptide Sequence Number=SeqID_177537
atgcttcaaagcatacataaagggcatattattttactgcaaagcctacagctggtagcgcctccagactccatcccgacgacagagaaatttaatgaatgggtagcctggccagggactcagcctcctcttcacagggaagacgaagatcccaccgctcaggtaccctatcagccagaggatgagtcatcagagtcttccactcctgagcccttgatcaggaagaggagggtagctgtaacccaggaagctgcagccacctcagaaaagtctcttgaagccactccagcatctccgacacccgtggcagataccacttctccataa

SEQ ID NO: 85853 - DNA, 168 bp, Glycine max
  Peptide Sequence Number=SeqID_177538
atgactctcattcacttcccatccccggaaggtgcccaccacactctactaggaagtgagggtggaggagggagtgtacgggttgccttgagacagcagctcatcatggagtcgagagtcgtggctggggttgaggtggtcgctaccttggggttgttgcggaacgag

SEQ ID NO: 85854 - DNA, 192 bp, Glycine max
  Peptide Sequence Number=SeqID_177539
atgaatccaaacaacaatttagatgaagttttagatcaaatgatagatgaggaattggaagacaacactgatgaagaaatcattaggaagggaccagtcactagagccatgagcaagaggctccaagagaattgggttagagctgctgaagaaggccctaggattctcatgaaccttagggtagatttctga

SEQ ID NO: 85855 - DNA, 596 bp, Glycine max
  Peptide Sequence Number=SeqID_177540
ccgaggagccgagtgacgcgccagcgctactaattgagcgccagcacgtagctgtgctgtcagtaagaagggagccggcgcctttcgaattcgaagcactttctagtgtgcgctgttttttgattgcagctagcgagcaagaaaacggatgcgcgaacgcggctttctttcgccttgcttgtgacgacgacgtcgagttggcggcggagaaagactcggcattcagtgatatactggaggaaggtggggatgacgtcaagtccgcatggcccttatgggctgggccacacacgtgctacaatggcaattacaatgggaagcaaggctgtaaggcggagcgaatccggaaagattgcctcagttcggattgttctctgcaactcgggaacatgaagttggaatcgctagtaatcgcggatcagcatgccgcggtgaatatgtacccgggccctgtacacaccgcccgtcacaccctgggaattggtttcgcccgaagcatcggaccaatgatcacccatgacttctgtgtaccactagtgccacaaaggcttttggtggtcttattggcgcataccacggtggggtcttcgactggg

SEQ ID NO: 85856 - DNA, 299 bp, Glycine max
  Peptide Sequence Number=SeqID_177541
aaaacaccgagactttttcaagtctcacaagttatccagaactacgtagatctgagttcctcattggagggtacgtaggagcaagagccttgcttttgtcgaccacaccaccttttgctgtcatgacccaagagctggtaacccgcggagacaccttacggttatccgcacctcgtcattcagtgaccccaaatgtgattgatgagcaaaggccagtgcggtctgagttcctcattggaggatacgtaggagcaagagcattgcttttgtcggccgccccacaagatctgtcatattga

SEQ ID NO: 85857 - DNA, 288 bp, Glycine max
  Peptide Sequence Number=SeqID_177542
atggcgataaggtgtacggataaccataatttgtctccgcatgtcatcaggctcgccgctctggatgacaaaaggtgcataatgaccataatttgtctctacgtgccttcggactcgatcgtctctggatggcgaaaagttatgcggattaccataatttgtctccgcatgtcatcgggctcgccgcctctggatgacaaaagactcgatcgtcactggatggcgaaaaggtatgtggattaccataatttgtctccgcatgtcattgggctcgccgcctctggatga

SEQ ID NO: 85858 - DNA, 115 bp, Glycine max
  Peptide Sequence Number=SeqID_177543
gatcacatcagataccctccaacaaatggtagcagacatacttagcaaggcccaagtggagaaggacgaagcccctgagtgtagaaggatgaagtcctcgagtggagaaggatga

SEQ ID NO: 85859 - DNA, 600 bp, Glycine max
  Peptide Sequence Number=SeqID_177544
atgccgcactcacgagggactgccagtgatatactggaggaaggtggggatgacgtcaagtccgcatggcccttatgggctgggccacacacgtgctacaatggcaattacaatgggaagcaaggctgtaaggcggagcgaatccggaaagattgcctcagttcggattgttctctgcaactcgggaacatgaagttggaatcgctagtaatcgcggatcagcatgccgcggtgaatatgtacccgggccctgtacacaccgcccgtcacaccctgggaattggtttcgcccgaagcatcggaccaatgatcacccatgacttctgtgtaccactagtgccacaaaggcttttggtggtcttattggcgcataccacggtgggtattcatgactggggtgaagtcgtaacaaggttaacgaggcgaaccgggggaactgaaacatctaagtaccccgaggaaaagaaatcaaccgagattcccccagtagcggcgagcgaacggggagcagcccaggacctgaatcagcttgtgcatcagtggaagcgtctggaaagtcgcgcgataccgggtgacagccccgtacacgaagatgcatga

SEQ ID NO: 85860 - DNA, 630 bp, Glycine max
  Peptide Sequence Number=SeqID_177545
atgcctgggaccgctatgcagataatgtccttggctggaagatcctttctgaaaggaataatttatgctaacctctatgaccctgaagacaaatcgcctaagcaggtgagggtgcgagggcacctaattaaatttgatattggcaccctcaacaccttctcgaagacaccagtggtcatagaggaaggggaaagcttgtctgcctactctaggttttctaatttgaggcctgttcctcaagagcttgtagcccgtctatgtatccttgggaggggatttgagctgaatgcaaacgggctgcgtctgaagatcttgaggaagaatttgacaactctagcccagagcttgagtgttctatctttttctaacttagtcccgacatctcacacttcagatattactttggatagggctaagataatctacgggcttgtaatgcagatggatatgaacttgggatccctcatctcaggtcagatttctctcatcgcacaacatgactcctcgaggctaggttttccatccttgattactgccatgtgcaaggctcgaggagtcacatctgattctctgacctttgaatctctaagcccaaccattaattttggttatattaaaaagaattgctag

SEQ ID NO: 85861 - DNA, 426 bp, Glycine max
  Peptide Sequence Number=SeqID_177546
atggcagaagatcaaccacaaagggttactcttgaggactattctagctctaccatgccgcaatttttcacaagcattgcgcggccagaagctggagaagcaaagaggtggtttcattctttcaaagggaatagcttaaagatatgggaagatgtagtagaaatttttttgaggaaatacttcccagaatcaaagacaattgaaggcaaggcatccaagcaattgttagacgcttctgctgggggaaagattaagttgaagactccagaagaagcaatggaacttattgagaatatggctgctagtgatcatatacccaccaagagaaacctgttagagctttcttcagtggatgcattgttggcaccgaacaagctactagctaagttggaggttgcagtatatgtggaggagcgcataaatctg

SEQ ID NO: 85862 - DNA, 240 bp, Glycine max
  Peptide Sequence Number=SeqID_177547
atgccggccaacattgcagacctcgtcttcgccggagaaagaatcgagtccggattgaagaaaggcaagtttgaatatgcctccaacgctggccccaacagcaatagaagagccccagtggtgggcacacggaaaaaggaaggggatacccatgcagtcaccaccgccccaacgtggatgaaaacgccccaaaatgctcaaaactcataccaacacaaccacccgaacttttcgatctga

SEQ ID NO: 85863 - DNA, 333 bp, Glycine max
  Peptide Sequence Number=SeqID_177548
atgggatcgagtcaagcgccttcgcttaaaaagaggttctatcaagtgaaggtcaagagcctaggaaccaccaatctaaaagaattggggcagttgatgggtcagctccagcgacaagcatttcgcaaagcttacggaagaaccggggttcttatttcgtgcgaaggatttccaaatgttcccttgatggggacaaggggttgcatcagttacaatcatgttcttgctataagacaacttggctaccccatgagaggggcaccactagaggaagagctcgcgcctattattgcacgaggtttcaataagaccaacgtggaggcgcttcagaag

SEQ ID NO: 85864 - DNA, 446 bp, Glycine max
  Peptide Sequence Number=SeqID_177549
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccaggcgtttccccctggcggctccctcgtgcgctctcctgttcctgcctttcggtttaccggtgtcattccgctgtatggccgcgttgtctcattccaccgcctgacactcagttccgg

SEQ ID NO: 85865 - DNA, 243 bp, Glycine max
  Peptide Sequence Number=SeqID_177550
atgcagagttcgtcaagaccacccggttgtgcacgtaactgcccccctcccataggtgatcagcctgggagcccaaaggagttccctaaggtgacaagccccctcagtacaaagtacactctgccacaactactctatttcctgtgtcgtataagctatgaacatggccaaaatgtatatgcatatatgttcttggtagaagtaggaatagcgggggcaagatacgcgggtttgactaattaa

SEQ ID NO: 85866 - DNA, 267 bp, Glycine max
  Peptide Sequence Number=SeqID_177551
atggcttacactcacattccggattcaacaagcgattctcctcaaatttcagccagcccgcatcaattagaccttgcaccttacgcttcagagccctacaatgctcaatggaacgccccggggcttctccgtgacaagcacacgttgcgttcgagtcgtattctcggagaaatggaggttgatgaaccttggttggggttatggctaccattgaattatcaagtagacatgggagcaagtcaacataacacaccggaattggggtga

SEQ ID NO: 85867 - DNA, 213 bp, Glycine max
  Peptide Sequence Number=SeqID_177552
atgaatgttgaagaacggtcgagaatcttcaccaatttcgagagaatgagaagtgccaagaaggctgaaccccttttcttcttcactcctccccctatttatagcaaaataggggaggagcttgccacccagcttgcccaggcgagcaaggttgcttcctccagaagcaacagacttctggaggaagaatctggaaggcccaagtgggcctga

SEQ ID NO: 85868 - DNA, 708 bp, Glycine max
  Peptide Sequence Number=SeqID_177553
gcatgggaaaccccgttaaggaaagatcaagagcttagaggcattcgtaatggcatcattggtgggtaccacgaatggctgaaagttcgcatacgaggtttagattggctcgccaagttaaaagtcgtcagcgaagagaattttgaagcaccggaagaggacgaagaagtccaagctctcaaaagcgagttaggaaaggcaaaactcgccaaggaaaagttcaagttggctgctacacacgttcggaaggagtgcgccgggttacgggaagagaatgcaattaccgcaaaagcccttgaacaagagaccaagagggctcgcaaggaagagtatggccggaacaaatttcgcggagctctatggggtagcaataatgaactcaagttgcgaagggaagaaagggaccagtcgcgagcacatagcatggttctgaaagaggagttgattgcttgttcaaggtccaaaagaagcttgtctcagcgtctatgcgagatagaaaccaacatgttagctatcatcgccaagtaccaagaagagttgggtctagccacggcccacgagcatagaatcgcggatgagtatgcccaagtatatgcggaaaaagaggctagaggaagggtgatcgactctttacaccaagaggcaaccgtgtggatggatcggtttgctcttaccttgaacgggagtcaagacttccccgattgttag

SEQ ID NO: 85869 - DNA, 159 bp, Glycine max
  Peptide Sequence Number=SeqID_177554
atgggggtgcaaatagcaaccaggcccacttgggccctcccagaagccgaggcgcttccgaaacgtttccgtaacgttttccgtgaagaatttcgcaaaggtttcaaccgttcttcgacgttcttcattcgttctttatcgttcttcgatcttcaacgg

SEQ ID NO: 85870 - DNA, 354 bp, Glycine max
  Peptide Sequence Number=SeqID_177555
atggccttcaagcacaaggtgcaaagcttgattgccgcaggatggctgacgtttcaagaggacagtccaaatgtgaggactaatccactcaccagtcatggaggctcggtggttaatgcagtagaaaagtgggagccttggggacggaagcagatgagagacatgctaacctctaggaggttcattttggaagctctgcgtgaagctgggatgatggataaaggccaaattgaagtctgcaacacgagaaaaggggaatgggatgtgtgcatgcagttggatgataaaagcctgagaaaacccaagccattagtgatccacttcactagggatgtcgccactcagaagacctaa

SEQ ID NO: 85871 - DNA, 309 bp, Glycine max
  Peptide Sequence Number=SeqID_177556
atgtctccttcacctctaagatctcacaatcactcacaactcatctcaagctctcagaatggcattcgctttgaactcgcgtctctgcaaatcttcacacagcaaagcggccttgttcgtgcttgtgcgcttagcgcggatttggatcgcttagcgcgcaaagtggattttggcttagcgcgtttgtttcacttagcggatgagctgaagcggtgcgccttatcacctggagcggtgtgcttagcgaacttgacagctcatcttcttctggattcttcctcgcgcttagccattgaaggttctgcttag

SEQ ID NO: 85872 - DNA, 390 bp, Glycine max
  Peptide Sequence Number=SeqID_177557
atgaagcttcgttcctcatcggataatccttcgcggaggctgaatcacaacgacgctaggattttggatgaatgtgttgtttttgctgagagtggtggcggaggaggaggaggttgtagtattaagggtttttggcctctaatgttgacatcgttgccgttgggggttaaggtttgggtggtggacaatatcacatgggattcgttgttggatttagggccaaaaagggaaggagggaaggagaactacatggagttcagtgcttctgatgatggtggtgtcttcattatattcaccgggaaatgcaacaggaggaaaatcaattggagacaaagaacctacaaaggcaaggcaaaacctactgacaaagtggctgagaaagagaatgaa

SEQ ID NO: 85873 - DNA, 197 bp, Glycine max
  Peptide Sequence Number=SeqID_177558
atggttgagcttcaagctgaaaaggatgttggagagcttcaaagggttggggaagcgtgggtggtaggcttggatgaggcgaatgacgaggtggtaggggatgacattgatgttctctatgctgggagggaggtcgtgagtgaaaggggatttcgacgagggagatggtggaccagatttgtgttggaagaggatga

SEQ ID NO: 85874 - DNA, 153 bp, Glycine max
  Peptide Sequence Number=SeqID_177559
atgagtgttgagatcaaaagtgaatccacatataagagcttcaaggtcaatggacaccagctgaaaccattcctcacaaatccttctttagtggatgtcgtagtggaagagacctccttactccacctgactttctcttccgccatgacttag

SEQ ID NO: 85875 - DNA, 1323 bp, Glycine max
  Peptide Sequence Number=SeqID_177560
atggttagaactagaggttttggtcgggctttaggccgagcaataggaaaagtcttggggaggaaagatgtgagtgacgatgatgccccccaacggcgaaggcctattgcattagcccgtagacagcgacaacaacagcgtgttgtcaaggaccctcctacggccgcggaggaattgatcgacgagcagccagaagcacctactgaagaagttgttactaatgttgagggttttccaagcggaccccatgacacatcaattctcacagattttgaaaataacattgctttgagagtttggaatggagatgaatgttctgagttgaagctatcttcccatggaaggaagatggctaagttcgagaggcctgctccacagattgaaggcattgtggcagtcagtggactaagtcctttgatcgcctattccctagatacgggtgattggggactaatgtctgcttttatggaatgccgacataaggaaactagcagtttccatttgcctgtcagagagatgactatcaccttggatgtcgttgcgtcgttgctacatctgcctattgtaagggtgttccatagcttcaagctacttcatgtcgacgacgttgtcgaaatgttggtggaattactcgaggtcagcgctgcagagtgttggatctacgatcatttttcgtccgttggttccgctgttcctgccgagaattatgatgagaggagccgcgtgcatgtcgatggacctttggcaagacactgcccgtttccacgtatcagaggcgtctggatagaccgacccttgatgcgatggggcctcttgacagtcattcaccgaccggagagggttgtacgacagtttggctacatccagactattccgccacatcctgctgcatcttcgctctctgttgaagaaattaatgatagatggatgcagtttggtgagtacattgcacctgtagggcaattatgtgcagtgtctgaccactgttcgccagattacatggattggttttacatgatctcgcacccattcatgagttcggcacagtcaggggatcctcctagagttccatcgattcaacaatatgaagaatttgttgaaccagatatgtatcagcaaccgatggcgacagtggcacctaatgaggatgactttgtagcaattgctgataagttggacaggctactgaacctgaggatcttgatcgaaggaatagaagccaatactattgttgaagaatgtgtgagcatcacaagacgctacattggccagcctactgtaggtcacagattgaggcgtaggcgacatacggatggtcattga

SEQ ID NO: 85876 - DNA, 144 bp, Glycine max
  Peptide Sequence Number=SeqID_177561
atggaaatcttccggaagaagcttcttccgaaaacattccggatgacgttcttccgaaagttgtttgttcttccggaaaagttccggaaagaggttttccggaaagtttccggaaaaatcttcttccggaagaagaattgctga

SEQ ID NO: 85877 - DNA, 501 bp, Glycine max
  Peptide Sequence Number=SeqID_177562
atggctactatctattggggtcgatggagaactcaagtaatggctgctgtcctacagccaagagaatctgatattgtaagcgaaagtgccagatttgaacataggctcctattgatttatacttcactcttcttgcttggagtaagcttatctccaaatgtttgctgtattctcagcaaataccatcctcagttccactttggcattataacacagaccgtgtcttctctattcagaatttcagattatttcaatagtgtcaggcagttcaactctgtagagtccactgttcttggtagtctgaacgatagagatgacaaagattgggagtttggtggacaaacattttgtgtagttaaggaatatcttcagaaggggaataacataggattggttaaatattattgtatgttgcaaacttgcaacatttgtaagcttgtacagttaaacattgtgcatgctctcactcattttactcttggagagcattataaggcctaa

SEQ ID NO: 85878 - DNA, 228 bp, Glycine max
  Peptide Sequence Number=SeqID_177563
atgccaaaaaagttcatattctgcaatctatattccattaacgcattactgagtaagttgatgaaaatgccaaaaaattcgcattactcaccggagaaggaagagaatctcgtcggagaaccacgatcatcagtcaatggagaacgatggtcaccggagaaggaagagagtctcgccggagaacagtggtcaccagagaacgagtgtggcttctctcttcagagttga

SEQ ID NO: 85879 - DNA, 255 bp, Glycine max
  Peptide Sequence Number=SeqID_177564
atgaaaggaatggacaacatccaacacgtaaagagttcaagaatcaagacagtcatgaaaatcatccaagcacctcaaacatggcaagatagaacctttcatagattagttaggcatagtgtgcatcctgatcattttgagcattttgtgcattttgtgcattctgagcattctgttgctggtgattctgaacattctgattttgagcattcggctgctaattttcatactgagaacatggctcaacctccatga

SEQ ID NO: 85880 - DNA, 300 bp, Glycine max
  Peptide Sequence Number=SeqID_177565
atgctaggttacagtgtctacaacgttggcttagctggcaagaagcctgctaagccaatgggccgctcaactcagcagatgccgcaagaaatttcgcttggtgcaggagatcctggcttagcgcgcggccaatcaataaaaaattttactaagttacctgggcttagcgaatcagcctcgcttagccacaggtactgtaccaggcggaagagtgttcatcctcaagatataaactcgcttaacgtggtaggcgcgcttagcgagttcttcagtaaaactcctatatttaacgaatattga

SEQ ID NO: 85881 - DNA, 1167 bp, Glycine max
  Peptide Sequence Number=SeqID_177566
atggtgttgatggaccatacgggttcaaaaattggggctactctctggcaagaactgttcactgaattgcgggacaagttacagtatggttcttcatatttgattcagaacctgaggattgttgacaaccaatctgaatacagagtcagcccagttccatatttggtttatttcctaaaaactacatctgtcaaggaaatccatcgtccaaaaattccttctaatatttatctcattactccttttactgatataatctctggcctggcaccccgccatactttagtggatgttaagatagttaatccccctcacaggatgatagtcaggctcagggataacagtaagtgcaacattctaataactgtttgggaggactatgctattaagctacatgatgctattgacaaaaaccttctgcttcaggaaccattggttgttatgttgaccctaggtaaaatcaaggatgttacagatttattcactttgggtgataaatataatgctcaggtggtcagtataggtgaaatcaacaatctcagacaggattgttactgcttgactgttggaacagttgacgaaatcatcattgatgctccatggagttatgacagttgtcctaactgtacaaccacatttgatccatcaaaaggtggctcagcttgccgttctttccataccagtgtgattgatacagttccacagttagccatgatcattttttgtactaattatttacttacacgttttcctgttttaccaaatttccctgaaacttctatggatgtcaaggttggggatgacataaaagtgtttccaacatgtgttgatgaaatcctgtgcaaaacttgggttgtcagatttaagttccgttcacaattgcgccaatcatctgtgttggatgtgagtgaagaactccatcatattcaatcattgatagccacccttgggttgaaggaacaatcaagtaagggaaaaacaatagctgttgagccagaaagttcaccaccaatttttgctcccacgtcttctgattacgatcccgaaaactccacctgtttaactccaaccaaaaggattagttgtcagcaaactagttctgatttcgattatgatgagcatacacagtatcagttatcaactaacaaacatatcaaagctgagtaa

SEQ ID NO: 85882 - DNA, 1554 bp, Glycine max
  Peptide Sequence Number=SeqID_177567
atgtacacagtggaattccaaaaacgagggcttcctcatgttcatttattgttatttttacacgccaacaacaaatattcatctccaaacaatattgataatattatatctgcagaaataccttcacagaaagatgatccagaactctataaattagtccaaaatcacatgattcatggtctatgtggaattttgaggcatgcatctccatgcatgaaggaaggaaaatgtagtcgattttatccaaaaaagtttcagcccacaactcttatagatggagatggttatcctatatatcgtagaagaaatactggttggacaataaccaagaatggtattataattgataatagatgtattgtaccctacaatccaaaattgctgaaaaattaccaagcacatataaatattgaatggtgcaaccaaagcacttctatcaaatatttattcaagtacatcaataaaggatacgatagagttacggctgtgatggtacatgatgacaatgaaacagttccgcttgcaaacactccaaatgatgaaatcaaggaatatctggattgcagaaaaccttctgtagagaggctacagttccatcctccaggccaacatagcgttctctaccaagaccaagatgatattgatgatctcctctctaacccaagcatttctgaatcaaaatttatagcttggatgaatacaaaccaagcttttgttgaagatatcagaacagttgatggtgctgaatattctacttgtaaagaagcatgttttgctatgggttttttacaggatgatagagaattcattgctgcaatccaggaagcaaaagactggggctcagcaccttatctaaggaatctttttgtattattacttttgacaggattacatattgatgactccaatctgatgaatctggtattgtttgaagttgaaaatttgttactagccaatcaaagatcacttaaagactatccttccatgccatatcctgagaacgcaaatttactaacacatgcagacaaccacctcattttgtttgagctgaatttcaacaatgaagaacttagattcgaattccttaaccttttttctcaaatgacagaccaacaagcacaaatttataaccaaattattcaggttgtcaataaaaatgaaggtggaatgtttttcttatatggatatggaggaacaacaaaaacatttatttggaagacacttgcagcctcattgagagctgacaataaaattgttattatggttgcttctagcagcatagcttctttgttattgcctggaggaaaaacaacacattcaaaattaaaaattcttgttcctatatttgaagactcgacatgcaatattcatcaaggaacacaattggctgaattattgaatgaagcaagtcttatcatctgggatgaagcccctatggctcacaaattctgttttgaagcacttgatcaaagtctaagagatgttattaaggcgaaatcaagttctgataaaatctttggtggcaaagttatgctatttggtggagatttctag

SEQ ID NO: 85883 - DNA, 483 bp, Glycine max
  Peptide Sequence Number=SeqID_177568
atgttatctgattgtttagccaccatcagattcactgcaccatttcgtgttcaaaagaaccttctgcaagtcccattctcttttcataggcaatgggtgtacagatacccaaagtatgttttattccactatgatggcaacaaatatttcattcgagtaaggaggcacagtggcaaatgtttttttgctgatggcctaaaggaattcagaagggcacacgatctaaatgagagtgtcattcttcattgtgttgcttctaacaaaaatactactttctcggtttatgtcatcgaacctacacagaggcaattgcgtgtaaagcctcttatatcaaaaaggagatatatttttacagctgatgtcacaaaggacatgatacagcgcaccctccccttgatacttccagcagcagcttcaagatttgtccatgcttcaaagaaatttatcacccttcaacgcggactggcaaaacgcacccactag

SEQ ID NO: 85884 - DNA, 442 bp, Glycine max
  Peptide Sequence Number=SeqID_177569
ggagtccggagacgtcgcgggggccccggaaagagtatcttttctgtttaacaagcctgcccaccctggaaacggctcagccggaaggaccgagtgcctcccacgcccggtcgtactcataaccgcatcaggtctccaaggtgaacagcctctggtcgatggaacaattcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgtgctctgaatgtcaaagtgaagaaattcaaccaagcgcgggtaaacggcgggagtaactatgactctcttaagcgaaaccacagccaagggaacgggcttggcggaatcagcggggaaagaagaccctgttga

SEQ ID NO: 85885 - DNA, 261 bp, Glycine max
  Peptide Sequence Number=SeqID_177570
atggtgaaagttggaacctcttacgtgccgatcaaacgtctcattttcgccaaaagttggcccagggcttcccggtatcaaacagggacaccaggatttatttatttttgcgaagtgatcttccgtcacaggtgctccagtggcttctgttttctatcagctgtccctcctgttcagctactgacgggggtggtgcgtaacggcaaaaagcaccgcccggacatcagcgctggcaagtgtagcggtccccgctgcgcgtaa

SEQ ID NO: 85886 - DNA, 385 bp, Glycine max
  Peptide Sequence Number=SeqID_177571
atggaggggcaaccaacgcagacatctgtcagtaatgccaatataaattctggcataagagcaattcctgaccaaactgttggcacgataaagttcaaccgcttcgacggttatgaatcagacaggggtgacttctcccatgactccaacatgacgttggcaaggctgcaaaactctcaaccaaatgtagagaatcttaatatgttctctccatcagggtctgtagcgggcaatcaaggtaggcaaccaccaattcgacagatccaaatacaggcgcctgtccaagagatacagatgcctaacaatccagggatgcaaatggctcaagcaccacaaccagtggcacgcatagagccaccagcccaacaggtcgaaccaaaccctg

SEQ ID NO: 85887 - DNA, 375 bp, Glycine max
  Peptide Sequence Number=SeqID_177572
atggcttctatcacggaggccatgctaaaacttcagaaaactatagaagataatgccacggcagccgcctccaatacaacaagggaagcggaaccggtgctacaacccgcattaaacttgggccaagacagaaacacgaaagtgttaggtcggaggtatagtcctcaagcctacccttatggtttgcctccggacttcactccccgtaccgctccggaagatttgagccaagcccctactttcggggggcaactccctccttatcccgactatcccctgcaagaagatgatgaaggagatgcccatctaggccctctacttcccctcaaagatccggccccccatgaattgccccaaccaaacatagtccgccat

SEQ ID NO: 85888 - DNA, 447 bp, Glycine max
  Peptide Sequence Number=SeqID_177573
atgaacgctggctgccacaagccagttatcctgtggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggatcgaccggccgaagccgaccttgggtccaaaaagaggggcagtgccccgcttccgattcacggaataactcccacttatcctacacctctcaagtcatttcacaaagtcggactagagtcaagctcaacagggtcttctttccccgctgattccgccaagcccgttcccttggctgtggtttcgctggatagtagacagggacagtgggaatctcgttaa

SEQ ID NO: 85889 - DNA, 495 bp, Glycine max
  Peptide Sequence Number=SeqID_177574
atggaagaagtggataaggagatcttggagaccttcaggaaagtagaggtgaacatacctctgctaaatgccatcaagcaaactccaagacatgccaagtttctaaaggagttatgcacccacaaaaggaggctcaaaggcaatgaaaagattagcatgggcagaaatggattttcccatggttcaggtccaattattttaggcataccatttatgaaaatagcccgaaccaagatagatgtttatgctggcacattgtctacagaatttggtgatattgttgttcattttaacatttttgatgccatgaaacatccatctgaggatcattctatttctcgtgctgagatacttgatcagattgttgatgattatatgtttgatttcgattctcttcatggtgatgacaaaaacctcaaaggtcaatcaaaggatgagttcaagatgttcaagaagaaatcaagaacaaattcaagactcaagaggaaaagttga

SEQ ID NO: 85890 - DNA, 1146 bp, Glycine max
  Peptide Sequence Number=SeqID_177575
atgacgaaaaaaaaacacaaaaggctgatggtctcatttatctttatatccctattcaacgtaaaaggccaggtaaaaataataacccggcagtcaggagggtcatctcctgaaaattcgggtgatacatggtctgcctacgtaaaaggctttattcaaaccgatgccatgctcgattttcaggaaatgggatttaaagacggattcatagctccttctatagcaataccccaaaacaattcggtaaacagtaacttcagcattaaacaatcgcaaataggctttggaataaaacagatggatgaaaatggaaattcggatctgtcggcttacacagaaatcgatttcctgggtcctaacggaactactgccccaaggtttcgccagggctatatcaaatggaagaaattattgatcggacaaacctggaggcctaacggaaccatgttcatcagaacggttcagatccgttattctacacctttatcgaaaaaagaaagtctttccctttctctggaagatcctgatgcggcgagcatatttcttcctaataacgctccgaactggaagaagaaatctatccttcccatcttcacagctgtatacagatatggcaatacaagggactactgtaagctgggaacaatggtttcacccataagctatgaaataaaaaatgatgaacaaaagcacacggatgccaatacaattctcggatacagcggaatggtttctgcccggctttatagtgggacattaagtaatttcagattccagtcttcatacggaaaaggatattccagctataatgtagttttaaacggtgaaaaatatgatgcgatcccggatatggccaacaacaggctggtggctttgaatttattcaatattgtaggcatctatgaacattggtggaatccaaaactgagctcggtcatttattacagcttctctcaattgggaagaaaggattttgttccggatacgatgatccataattttcagaattcaggaattaacctggcctttcaaccgcgtaagaaactaagaatgggtatcgaaggaacttacggaatgctgaaaaactttggccggcaaaaagcaaatatattccggatccagctttcatcttctctatctttttaa

SEQ ID NO: 85891 - DNA, 276 bp, Glycine max
  Peptide Sequence Number=SeqID_177576
ggatcgcgcctgcaagacacccggtggacccgaagaagtccaacaaggtctggagtgtcaagctctaattacgggtctctgtcagttctacagagtacctataacccccagcaagttcatcaggccccttttaatcaggctttcatcaagaagtactgcgtctccaggcaggcgcagggcgaaacaccacagcagcctggggatggccggcagcgggcaacagacgcaccgccatcacctctagagttcacctcagctcatccacaaaaaggttag

SEQ ID NO: 85892 - DNA, 453 bp, Glycine max
  Peptide Sequence Number=SeqID_177577
atgggaggacaacaacgatcgtataataacttcaaacaaagaggtttccaaaacatacatggatactacaaccgagcaggagacaacaaaactacaacaaagagaaaatttgtgggaccacaccgcaaagttggtagaagccttgaccaaattcaccgaagtggtcatcgccaaccacaaaaacaccaaagccacgatcaaaagcatgggaacccaaagtgccattgcaaggctattatctccaccatagagtgtgatgtggaagatgaagaagaaaaacaggtacaagaaagcacaatgctagaggaagagatgaaagcacaactcaacccttcaacccaagttactttttggtccaattttcctttatacaaatatgttcaagggaaattcgattcgccagaaagcgcaccgggtcgtcgacctaatgtactaaacctcgatccctcataa

SEQ ID NO: 85893 - DNA, 630 bp, Glycine max
  Peptide Sequence Number=SeqID_177578
atggaaacgtgtttgggagtagaggaattgttacagcggatgatagatcaaggtcgactagaagttggaagtgaaggaagagaggagcaacacatatgcatgcaatccacggatgggagcactgttgcgaagcccaaacccttggtgatatacttcaccaagggcacagcttcgcaaaagcccggacaccccttggcagctaaacctgttcctttcccgtaccaaaatagccacgtagtcccatggagatatacacctccgagggggaaggaagaagaagccaccgacgtcagctcgttgtcggctaagcggtcgtgtgtttgcacccgcggacctaccagtccaacccgcaaacgtcaagggggaaagcaaaagttggtggagggaacaaggatggcgaagcacccctcacttcgaataaaagatattccgggggaaaggtcttccgggagaaaaagggatgagcgaattcaaggttatcgaacagctcaacaaaaccccggccagggtctcgctgttggagttactcatgagctccgagcctcatcgggctctgctagtgaaggttttgaacgaggcccacgtggcccaagatatctcggtagaaggtttcggagggctggtcaataa

SEQ ID NO: 85894 - DNA, 375 bp, Glycine max
  Peptide Sequence Number=SeqID_177579
atgggtggaatggatgaatgcatgaagaaaatgcatatggcacagatgcattttacgaatataggagcctgggagattgtccccttcttagatacaacattcgggcagcatgacgcccgatgtatgcatttaagaaggcgacacggaccctccgtcgcgtgtttgcttcgtgctcctattttagggaccttaatgggaggaactaaaaggcttttagtgataattcccaaggtggtcatatctctcttgatggtttctagaggtattatccccttcgaaaaacatattgcggtagtagggactaccagcaacaatatgttatcaaagagaaaaactctagatgaggaactgttatcaagcaagtcggagacctag

SEQ ID NO: 85895 - DNA, 427 bp, Glycine max
  Peptide Sequence Number=SeqID_177580
atggcagcgcgcgcccttggcgtgcctcggcacctgcgcgctcctggcgtcggcctgtgggctccccattcggcccgtcttgaaacacggaccaaggagtctgacatgtgtgcgagtcaacgggcgagtaaacccgtaaggcgcaaggaagctgattggtgggatcccctcggggcgaagccagaggaaactctggtggaggcccgcagcgatactgacgtgcaaatccccgcgggcgagttctatcggccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaagga

SEQ ID NO: 85896 - DNA, 222 bp, Glycine max
  Peptide Sequence Number=SeqID_177581
atgtgggatgctaccgtgtttagggtgtttaatgaagacttcccattgtacataaagcatgaagatctctctgaaattgcacacggtggtcaatgtcttagcatatttgttatacagttgtggattatgcatctaactgagacagtgcacactggcaaatggtcatcattttgcttaaggaaaatcttgttgtccggttttgttcctcgcataacaggctag

SEQ ID NO: 85897 - DNA, 234 bp, Glycine max
  Peptide Sequence Number=SeqID_177582
atgcgtaactgcccgacatgtggggtatcactctacaaagtcaatgatggcaaatgcagtgatggtgcagccacaaccaatagtcgtccagcaaaggatcccagcaacctaaggcttggtcttgctttagacggaatgaatcatttcgcgggggttcaaatagcaatcaggcccacttgggccttccaggaagttcccccagaaaggcggtgccttctagaggaagcaacctag

SEQ ID NO: 85898 - DNA, 321 bp, Glycine max
  Peptide Sequence Number=SeqID_177583
atgtcggctttgaaagagcaaatggcttccatgatggaggccatgttagggatgagacaactcatggagaataacgtggccaccgctgccgctgttagttcggctgccgaagcagacccaactctcccaactaccgcacaccatcctcccccaaacgcggtaggacgagaaaggagcacactagggcacatcagcaacccccatttgggatacaatcgggtggcttacccttatggactaccacctaattacacaccaccagtcatgcgtgatgacgcgggtcatgtcccttcccccgtccttgaaggggagcctccttga

SEQ ID NO: 85899 - DNA, 414 bp, Glycine max
  Peptide Sequence Number=SeqID_177584
atggtgaccaccattctgccacatctcgctgtgccttcagcttctattgaagaaatggatgctaaatggatgcagttcgattacatgaagtggttctatatgatttcgcatccatttatgactccgacacagccaggagatactcctagagttttgccggttcaacaatatgacacaattgttgaaacaaatgtgcctcagcaaccggtggcggtagcggcagcggcacctgatgaactagacgttgatgtgcatcgtcttggacatgcaatggaaatatcaattgctaataaattggagagactactaaacttgaggatcctgaccgaatgtttgagcatcgtcagaagctacattagccaaccaactggaggtcatagatcgaagcgtaggcggtgtatgaacgatcattga

SEQ ID NO: 85900 - DNA, 180 bp, Glycine max
  Peptide Sequence Number=SeqID_177585
atggcttctgtggatatctctgctatggtcaaatctaagatctttccgtacgccttgcggaaggcttgcatttggagaggtcccatcaactgccccaactccttaatgctgtgcgaaaaatggcacgcagcgtgtccgctccgtgcccctattcaagggacctatatgggagagagctaa

SEQ ID NO: 85901 - DNA, 204 bp, Glycine max
  Peptide Sequence Number=SeqID_177586
atgtgtgcgaattaccgtatagggcatctccgcatgctacctgacttctcacaggtcggggtagcagaactatgtgtatggataaccacttgggcaaatgagactttttcgcagtctcagccggaagacgctgacatctccaaggaaggtgcagatgacgatgttagtcactgcatgttatcgggctcgattgtccctgcctag

SEQ ID NO: 85902 - DNA, 524 bp, Glycine max
  Peptide Sequence Number=SeqID_177587
atgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccaggcgtttccccctggcggctccctcgtgcgctctcctttcgctccaagctggactgtatgcacgaaccccccgttcagtccgaccgctgcgccttatccggtaactatcgtcttgagtccaacccggaaagacatgcaaaagcaccactggcagcagccactgccagtacctcggttcaagagttggtagctcagagaaccttcgaaaaccgccctgcaaggcg

SEQ ID NO: 85903 - DNA, 333 bp, Glycine max
  Peptide Sequence Number=SeqID_177588
atggggacaaatcaaaacggaaaaagattttatcaagtcaaggttaagggtctagatgtcaccagcctcaaggaattgggacgattgatgggacctctccaaaggcaagccttccgcaaagtgtacaaaaagattctagatttgaccgcagcggaggtatttacggaagctgttgtgtccctcgcccaatactatgaccagccgttgagatgcttcacgtttggagacttccaaatggtgccgactgttgaagagtttaaggagatattacaatgccctcttgggggaagaaaaccgtaccttttctccggttttcttccctccttcaagtaa

SEQ ID NO: 85904 - DNA, 465 bp, Glycine max
  Peptide Sequence Number=SeqID_177589
atggctactttacctgcctcgcctcctcctcctcctccttcagacacatcagcatcttcgtctaccgtgaagtggacacgcaaagcgacacggctaagatcgttagccactagaccacctggtgtagagaaatcagtggtcaacgttgatcctgctaccggcaaggctgatggtccccacgagaagaaattaagaacatatttggggattctcgtgcgtgataaggtcgacgtgacatacgagacctggaaggaagtccttgctgctcagaaggaattgatatcggaggatattcaggcggaatttgaaatccctgaagcttctaataccgaccaggacggtgtagacgacactgtctgtcaaaaatacgacattagcaaggagaaatgggtccagttttgtcagacacgcagagacccttcttgggaggatatgcggaaaaaggcacagaccatccagaagtaa

SEQ ID NO: 85905 - DNA, 99 bp, Glycine max
  Peptide Sequence Number=SeqID_177590
atggctgatggaaaactgatagagatgaagggtagagttaacctagggtttaaaagactgtgggaaagcttgggctgtgcaaaggaggaaaatgagtga

SEQ ID NO: 85906 - DNA, 621 bp, Glycine max
  Peptide Sequence Number=SeqID_177591
atgggaagaccttggtatcagaagctggaaagtttgaacttggggttttcagccctggtagttcccagaaacaagacagttgtttgggttgctaaaaccccatcaagattcctcaggcatcttaacactcaacaacacaggcaatcttgtcccaacaactctcacaaacaagcacagaatcctgtggtagtgctcttggacagtggcaatcttgtgataaaaatcaagggacaagcagacccagaagcgtatttgtggcaaagttttgacaattcatctgacacactcttgccaggaatgaagttaggttcgaacctccgaactggtctgaatcggagatacacttcttggaagagtcctgatgatccatccccgggagatacaattgcaactgccactaatgatttctccaccgaaaataagatcggagaaggtggttttggacctgtatacaagggtgggtatatagcaccggagtatgccgttgatgggtcattttctgtaaaatctgatgcctttagcttcggcattttagcgttggagattgtatgtggcaagagaaacaggggacttaatcagacagataagagtcttaacgtcgttggctgtgtaagagcttga

SEQ ID NO: 85907 - DNA, 570 bp, Glycine max
  Peptide Sequence Number=SeqID_177592
atgtcggtgcatttcgtagactctctagcaatgtttgcaagaaggaatgccgaggaaaaatttaaactcggagacttaaaaggcgccataatttctgccaccatggccaaaaccctagaccccgatgtagttggcattgatgaaaccctcgttgcatacaaaatccaccttgcggcatcaaaaaatcgtgtcaacggtgcaacaaactggtacaaagttcttggcatctgtgaaggctttgaagacattgacagcatcaaaagacaacacaacaaattggtggagatggtgaacccaaccaagaaagcttcggtggcaacttggggtgctcttagactcatttacaaggcttcgagtaacctatgcgacccgaataaacgaaatgtggctcttttgcatcggcaagcacttgggtcttatttgggtcatgaagattttagaacaaagaagagatcgtgtggaatcaaagttaccaaaagggcatgtcctcggtgtagaaagtggtgcaagtgcaagtttgatccaatatctggcaagactccaaattcaaggttttcccgcggcaaataa

SEQ ID NO: 85908 - DNA, 1929 bp, Glycine max
  Peptide Sequence Number=SeqID_177593
atggcttctacttctaatgccatcatccaatgcacctcttcttcttcttcttcttcgtttgagtatgacgtgtttgtgagcttccgcggtgaagacacacgcaacagcttcaccggttttctttttgaagctctgaaaaaacaaggcatcgaggccttcaaagatgataaagatatcaggaaaggcgaatccatagcaccagagctaatacgagccattgaagggtctcatgttttccttgttgtcttttccaaggactatgcttcctcaacttggtgcctgcgtgaactagcacatatctgggattgcattcaaaaatcacccagacatcttctgcctattttctatgatgttgatccatcacaagtgcgaaaacagagtggagactatgagaaagcctttgcccaacaccaacaaagttccaggttcgaagacaaggaaattaaaacatggagagaagttctgaacgatgtaggcaatctctctggttgggatataaaaaataagcaacaacatgcagtgattgaagaaattgttcagcagataaaaaatatcttgggttgcaaattttctactcttccatatgataatctagttgggatggaatctcattttgctacattatcaaagctaatatgtctggggctggttaatgatgatgttcgagttgttggaattactgggatgggtggaataggaaagtccactcttggtcaagctttatatgaaagaatctctcatcaatttaattctcgttgttatattgatgatgtaagtaaactttatcaaggttatggtacattaggtgtacaaaaagagttactttctcagtctctaaatgaaaaaaatctaaagatttgcaatgtatctaatggaacacttctggtatgggagaggctatccaatgcaaaggcacttataattcttgacaatgttgatcaagataaacagcttgatatgtttacagggggtagaaatgatctgttacgtaaatgcttaggtaaagggagcatagtcattataatttctagggatcaacaaatattgaaggcacatggagtagatgttatttaccgagtggagccattgaatgacaatgatgctcttggattgttttgcaaaaaagcatttaaaaataattatatgatgagtgattttgaaaagttgacttctgatgtattatcacattgtcaaggtcatcccttagcaattgaagtgctaggctcatctttatttgataaagatgtcttacattggaggagtgcattggctttgttaagagaaaataaaagtaaaagtattatgaatgtgttgcgaataagttttgatcaattagaggatacacacaaggaaatatttctagatattgcatgtttcttcaaccattatcctgtgaaatatgtgaaggaagttctagattttcgtggatttaatcccgaatatggcctacaagttctcgttgataaatcactcataaccatggattcgaggcagattcaaatgcatgacttgttgtgcgatttgggcaagtatattgttagagaaaaatcacctaggaaaccatggaagtggagcaggttgtgggatgttaaagatatccttaaagttatgtcagataataaggcagcagacaatgtggaggccatatttcttatagaaaaatctgacattcttcgaacaatttcaacaatgagggtcgatgttctatcaacaatgagttgccttaagcttctcaaacttgaccatttggactttaacgtcaaaatcaattttttttcaggaacacttgttaagctttccaatgaattaggatatcttggttgggaaaagtatccttttgagtgtttgccaccaagttttgagcccgacaaacttgttgagttgattctacctaaaagcaacatcaaacaactttgggaaggcacaaag

SEQ ID NO: 85909 - DNA, 264 bp, Glycine max
  Peptide Sequence Number=SeqID_177594
atggaatcactgatgaagatgtgtgtccttgttgtggagataattcggagaccattcatcatgctcttcttagatgtgatcacaggcaagaagagtagaggcaacaaactacattttctgtctcctatgggccatttggcaaagaagaacatatgggtttttgagaacaaaaagcaaattttgcggcaaactctggcagtagcagactctatgtattaccaggccaacacaagcactggtcacaatcacactctcaagaggtaa

SEQ ID NO: 85910 - DNA, 492 bp, Glycine max
  Peptide Sequence Number=SeqID_177595
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccaggcgtttccccctggcggctccctcgtgcgctctcctttcgctccaagctggactgtatgcacgaaaccccccgttcagtccggaccgctgcgccttatccggtaactatcgtcttgagtccacccggaaagacatgcaaaagcaccactggcagcagcactg

SEQ ID NO: 85911 - DNA, 476 bp, Glycine max
  Peptide Sequence Number=SeqID_177596
atggagatgagtatgattgatgcttccggtggtggagctcttggtgatatgactcatgttgaggctaggaatttgattgagaaaatggcttccaactcccaacaattcagtgcaagagatgatgctattgtccttagaggagtccatgaggtggccacggattcatcttcatctgctaaaaataaaaagcttgagggaaaacttgatgccttggtcaacctaatcaccatacaggtctctgtccttctttgcagcaatctggagtcaatgagtaacctgaagcttatgctacaaacatgttggaggaatcatccaaatctaagatgggcaagtcctccacaacaacaacagcatgtccctcctttccaaaatgttgctggtccaagcaggccatatgttcctcctccaatgcagcagcagcaacaacaacaaagacaacaagcaactgaggccccttctcaaccttctttggagga

SEQ ID NO: 85912 - DNA, 717 bp, Glycine max
  Peptide Sequence Number=SeqID_177597
atgattatgaggggccaaggcatttatagtagccaagatgaggctactacttcaccttcctctagtgaaagtgaaaaagcaaaaggggaagaatctagtgaagaaatctacccccaagaagaaggacaaccattagtggttaaagagaagtgtaaggaggtaagtttctcctccaagagtttagctaagaaggaaactcattttacaataaagacaaacattaaagaaactttccgtcttagacaacctcttgggcttgaggttattcctcaagtaaaggagttgttggatgaaggtttggttcgtaagagcttaaatccttgtgctttgttggtgcccaaaataggtattattaggcaccaaatccctacaataagtgatatgatgaatttgttgagtgttgcaaccctcttttgtaaaatcagtcatgcacccaacgtcttcatgattcatgtacatagggactcattaggtaggaataatcaacataaaaatacagaaaaaggtacgctttattgcattactttccttaattttttaaatagtgatcaaggggttcccaaggaccctaagagaataaagatcattcctgattggcccactccaccaagtgtcaagggaaggagcccagagtatgaagaacctcaggatttgaggtcaaatccattccaaggtggaggggatgatgcaatcataccccccaagggtattggatag

SEQ ID NO: 85913 - DNA, 446 bp, Glycine max
  Peptide Sequence Number=SeqID_177598
gagcctgcttttgtcggccaccccacaatccctgtcatattgaccctggggtcatgtgacgcacagagacaaattatggtcattctgcgtcttttgtcatccagaggcggcgggcccgatgacatgtggagacaaattatggtcattccgctcaccttattgccattcagacacagtcgtgttcgatggttccactggcagggagattcacaggccaaatgggatcatccgttgtcgggatgcgaccctcgtttgaccactttgaggtacttggcacccatcgttaggcaattcgtgaagttccgagacatgccgaaagtcaaaagaaagcattgtagcacaatccggggtgcaaatagcaaccaggcccacttgggccttccaggaagttctgcagaagatagtgccttctggaggaagcaacctagctcgcctgggcgagctgg

SEQ ID NO: 85914 - DNA, 543 bp, Glycine max
  Peptide Sequence Number=SeqID_177599
atgactcttttaactgaggaagaggataaaattattgaggcacgtgaagaagctccttctttggttccacaatttgaacgtcaacagtttgatatgttgggtaggagtgtggagacccaaggtttagggcaacgtagggaaagtgtggatgcagaagcacatgttattcctgcgatgccagagcgccaacatggaatgtattacacacctgatcagttcacccaagagccgtctcaaatgtcatccctgtatccgtacccatatcaaagcggaacttcatcagatgcatatttcattggaacgcaacctccgctacaaccaggatatgttatggctgacttatttgggtctctttctcctgcgggaaccccttcatttgcacatggttgtcagatatcaacgcctaacgccccaatgggccctccatggactgtgtcgggaaacattcctaacattactgatttattaggaatagattttggtaatcaattttctgttaaggctgatgaaagaaaaggcgataggagaaggaatccagattga

SEQ ID NO: 85915 - DNA, 378 bp, Glycine max
  Peptide Sequence Number=SeqID_177600
atgcataccggggcaagatttcgcttagaccactacagggagacgagcgcagatcattcgcaccaccacaactctgatctccccttgccgaagtttcagttgggatcgcgcccacaagacacccattggaccaagagaagtccaacagggccctggggtttccaactctggttacgggcctctatcagtcctacagggtgcccgtcccccccagcaaggtcatgccatcgtgacataggtaaggatcgtgcccgcaagacacccagtggacacggagaagtccaacagggtcctggggtttccagctctgattacgggcctctgccagttctatggagtgcccattgcccccagcaaggtcatcaggccccctactaa

SEQ ID NO: 85916 - DNA, 594 bp, Glycine max
  Peptide Sequence Number=SeqID_177601
atgaccgaccctctcgatgagtcgatctcttgctttctcataagggtgaacccttgggtactagtaccctcacctccagaggattacatgtcctcgccttcaaaggactacacgtcctcgccttcagaggacttcacgtcctcgccttcagaagactacacgtcctcgccttcagaggactacacgtcctcgccttcagaggacttcacgtcctcacctttagaggactacacgtcctcacctttagaggactacacgtactcgccttcaaagggtcatgtaccttcaccttcagaggactacacgtcctcgccttcaaagggtcatggctacacgccctcaccttcagaggactacacgtcctcgcctttagagaactacacgtcctcgccatcagaggactacatgtccctcattttcaaagggcgacatgccctcacctttagaggactgcacgtcctcgccatcataggactacactcctttgccttcaaaaggcagcacgtcctgaacttcagagggctgcacaccctcgcctttagagggctacgcgtcctcactttcagtggactccatatccacaccttaagataa

SEQ ID NO: 85917 - DNA, 261 bp, Glycine max
  Peptide Sequence Number=SeqID_177602
gctaataaggaagtttgtgaagtgctgatttttagcttctcgctaagccaatctgccggcttagcgagccatccgctgagcgcatcactcttgcgactgagcgcgaggaagaatctggaaaaggataagttgtacacacgcgctaagcgagggctcatccagctaagcacaccacttgcatactggcagagaactgagcttgaagaggaagccatcgtgagagtatgggatgagtctgtgagtgattgtgaggttctagag

SEQ ID NO: 85918 - DNA, 522 bp, Glycine max
  Peptide Sequence Number=SeqID_177603
atggctctcactccttatccaaagaaataccaaggtcaaggcatcttaggggtgacaccttctaagcccaaagatgataaggggaagacaatagaaaagcaaccccttaaggctcgtatgcaagagaagactagctccatgaagtactttaaatgtcttggaagaggacacattacttctcaatgcccccccaagaaaaccatgattatgaggggccaagacatttatagtagccaagatgaggctactacttcaccttcctcttctgaaagtgaaaaagcaaaaggggaagaatctagtaaagagatttacccccaagaagaaggacaacctttaatggttaaggaggagtgtaaggaggtaagtgtctcctctaagaggttagctaagaaggaaagacattttgaaataaagacaaatattaaagaaatttcccctcttagacaatctccacactttctcctttgtaaaaagacacttgttagcattgccacacctcctaggcttgagtttattcctcaa

SEQ ID NO: 85919 - DNA, 835 bp, Glycine max
  Peptide Sequence Number=SeqID_177604
tcctctcgatgagtcgatctcttgctcttctcataagggtggacccttgggactacatgtcctcaccatcagagggctgcacgccctcacctccagaggactacatgtcctcgccttgagagggctacacgccctcaccttggggctgcacgccctcacctccagaggactacacctcctcgccttgagagggctacacgccctcaccttgggtattacttaccctcaccgtcagaggactacacgtcctcgccttgagaggactacacgtcctcaccaccagagggctgcacgccctcacctccagaggactataagtcctcgccttgagagggctacacgccctcaccttggaggactacacgtcctcgccgtcaaagggtcatgtaccttcacctttgtagggctacacgccctcaccttcagaggactacacgtcctcacctttagaggactacacgtcctcgccatcagaggactgcttgtcctcaccttcgtagggctacacgccctcacctttagaggactacacgtcctcgccaacagagggctgcacgccctcaccttgagaggactgcacgccctcacctccaaaggactacacatcctcgccttgagagggctacgtgtcctcattttcagggccagtagtttccttttaacggttcctgggccaccccctgatattgcaggagggccaactgtgcgagcacaaccagagagggaggctattacacagctactatgcataccggggcaagatttcatccgtgccgctgtaaagagacgagtgcggatcatgcgcaccaacatgaccactcttacacagatatag

SEQ ID NO: 85920 - DNA, 513 bp, Glycine max
  Peptide Sequence Number=SeqID_177605
atgggaggatattcaggatgtgtgaaaaaaggcacaggtcattcagaaacaaaacactgcccctcacatgttgtctcgtggggttatgagtttcttgaaaagaagttgatggataaaaggaaaaagaaacaactggaggaagctactcaatcccgaagcactgacatcgtgattgatccttcatctcccattagacaacacatgaaatggaagatgacccacaccaagaaaagtggtcaaatgacgtctaaggcagtaaaggaaattgctgacaagattgatgtatcgactgctaccattgggcgaccaggacaccctggtcgtgtgcgtactgctggagtcggtgtcacgatcaaacaatactttggatcagctccaaggacatcccgcagttcttcgttcatggctctcaaagacctggagcagctaacgcaaaaaatcagggaccagctggaggagtcgatcacaaaaaaagtgactcggcaactaatgttgtccttcagccagatgtag

SEQ ID NO: 85921 - DNA, 345 bp, Glycine max
  Peptide Sequence Number=SeqID_177606
atgaattttgcagcgaaaaaacctgtagaattcaccccaattccggtgtcctatgttgacttgctcccatatctacttgataattcaatggtagccataaccatcgaattcctgcagcccgggggatccactagttctagagcggccgccaccgcgggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 85922 - DNA, 414 bp, Glycine max
  Peptide Sequence Number=SeqID_177607
atgttgcggaactttatggattacgtaatcatcccttctttgccttccggaacgttatggaactttacggattgcgcactaacacttccttttaatttccggcatgtcacggaacttcacggtttgtgctacgacgcttttcttttagcttccggcatgtctcggaacttcacaaatttcgtaacgatgggagccaaatacctcgaagtggtcaaacgagggtcgcatcccaacaacggatggtccctagatgaaattaggaaaaaagaacatggatatcgatattcaaatgcaaagacaaatagaaaactaaaaatggtagaaagcacaaaggcacacattaaatcggtattgtgcataagccatcctttacaaaggatggactctatgagaacacaacaagagtgcaactga

SEQ ID NO: 85923 - DNA, 267 bp, Glycine max
  Peptide Sequence Number=SeqID_177608
atggagaattggcgaagagcgctacgcaataacttcgcggggctccagactcgttggtggaggatgcatgaacagcgccaggcaatgacattcatggggctccgtaaaaaacgccaggcaatgacattcatggggctccgtaaaaaagtggagaatggagaattgactcgttggtggaggatgcatgaacagcgacaggcaatgacattcatggggctccgtaaaaaagtggagaatggagaattggcgaacagcgctacgcaataa

SEQ ID NO: 85924 - DNA, 345 bp, Glycine max
  Peptide Sequence Number=SeqID_177609
atgggaacaaatcaaaccgaaacaagattctatcaagtcaagattaagggcctagatgtcaccagccttaaggagttggggcggttgatgggacctctccaaatgcaagccttccgcaaggcgtacggaaagattttagatttgaccatagcggagatattcatagaggccgttgtatcactcacccaatactatgaccagcctttgagatgcttcacgtttggagacttccaattaggattcggcaagagagttggatcgtgtaaagcaaactcgaaacgacgtagtgggccacagaagtacttggaaggcaaggcaagggatatggcgaatcacgaggagtga

SEQ ID NO: 85925 - DNA, 252 bp, Glycine max
  Peptide Sequence Number=SeqID_177610
atggatgccaagcacctcacaaggaccaaagaaaggtcgcatgtcatcaagcaaaggtccccggacgaaattaggtatatgtatgaaggggtagagggtgtcacatcgagtgcatctgagtttgtaggacacggttgggctactagacaagcacaattggacgcgacccaccatccaggcatggacatacgtagagcatgtcatcttcatgtgcagatcatcgggcgtagagcatgtcgtcattgcgcatag

SEQ ID NO: 85926 - DNA, 390 bp, Glycine max
  Peptide Sequence Number=SeqID_177611
atgtattctttaaatggatctcagtacctcaagagatcagtatctgactctccccaggaagatattttgagcaagttcggtggaaaacaaggcggattctatgtttcaacacaattggggagcaagattaaccaaaaccgaaaagtgaaagtgaaagctctgagagttggagggttaagcgcaaggatgagcaccaactacggggcaaaatcagcattcgtcagagagagagagacggagaaggatggtgatatatctctttatattactgcaaataattcctatgaagacttgagttggtctaacaattcaagaatgatatgcattagcaaagagctcaacatggacctggtggagcatgaattgtgtccaagatgtcatccacattag

SEQ ID NO: 85927 - DNA, 279 bp, Glycine max
  Peptide Sequence Number=SeqID_177612
atggagaagatgagtgtgcacataataacaagggagacccctaagagaaaaatgcatgttggggcggttgaagatcacccaggtgagctcaaccttaaccctgaagtaatgagctcacccaggcgagctgattgcttagccatgaagccatttcatggcccaggcaagctagatgctagcctgggtgagctagggtctaggaaaatccataaaagacccttttgcccccttctttggtatccttttgtattcttgatcaaaacattgagtgatccctag

SEQ ID NO: 85928 - DNA, 138 bp, Glycine max
  Peptide Sequence Number=SeqID_177613
atggatcctaccaagtacatcttcggaaagcccacttttactaggagaatagctcggtggcaggttctattgtcagaatttgatattgtctacgtcactcagaaggaggaggttgaagatgaagatagagataagtag

SEQ ID NO: 85929 - DNA, 351 bp, Glycine max
  Peptide Sequence Number=SeqID_177614
atggatgagtttgacacacaggtggcctggccaggagcccaaccttcttcttctagagggggtgggacctccgcagcccaggagcctgcagcagcagctgaggagccagcagagggggaggatgagctcactcctcctgaggccttttattatgatacaaatgtacacatggctcaggaggaggagacttctacagatcagatgctagagccacctcctgtaccagcctctaaggaaaccttgacatcagtaccagccttggagccagagcagcccattcttcaggatgtaccagctgctccagtgctggatttaaacgaagatcagccacaggatgagcaggatgtttaa

SEQ ID NO: 85930 - DNA, 585 bp, Glycine max
  Peptide Sequence Number=SeqID_177615
atgatagatgttcgaaaagaaacaatagcgaattgctttcaacactgtaaaattcgttcagctagtgacgttgcaagaaatttggatgaatccacttttgatgaagaaactcaagaccttgagactatgatcaatcaatgtggctatcgtaataagatggatatcgataatctaatgaactaccaaggtgaaaatgaagcatgttcggaggttcagagtttagaagatattttgggtactatcattgagaacaatgcagaggatgacagcgaagatgatatggaggaattagaaagaaaaaaatgggatgaggagttgacaagcttcattgaaggtagtattgatgtagctattgtcaaggaattctacgcaaacctctatgacctagaagacaagtcacctaagcaggtgagggtcagtggtcatctgatcaaatttgatgaagatactttgaacacttttctgaagaccccagtgattctggaagagggggaaaatctttgtgcttattcccggtttgcactcctgaggcttgatcctcaggagttggctgctaagctttgcatcccagggaggggattttag

SEQ ID NO: 85931 - DNA, 141 bp, Glycine max
  Peptide Sequence Number=SeqID_177616
atggaagaagaattctctcttcaagagaagaatattacaatgaagatcatctatttctcaaccctgtcttctggtaatcgattacacttcctggtaatcgattaccagagccttgaatgtcttgaaaacactttgttttaa

SEQ ID NO: 85932 - DNA, 195 bp, Glycine max
  Peptide Sequence Number=SeqID_177617
atgtggggtttcattttgttgtggcacttgattgtgctttacgtggttttcaagcttgacgagagttacatgccgagcaaagtttccatccgtgccggtgatggttttcacaacttgaaggagattaagactgtggaactcgtgaagccaactgggtggatttatctatccttgtctggagctgatcctaggtaa

SEQ ID NO: 85933 - DNA, 996 bp, Glycine max
  Peptide Sequence Number=SeqID_177618
atggaaagattcgatttcaagaacttaccggttgaagatcgaagaacgacgaagaacaaacgaagaacggtgatgaacgacgaagaacttccacggaatcgcttacagaaacgtctaggaaataatgttgtgaaactttacggattacgcaacaatgttcgctttgacttccggagtgttgcgaagcttcatggattatgcaacaaagcttattttgacttccggagagaccacacaaagttcacaagtcgaccgccagtgtccccgaacgaaattagggtttcacgggttgggctattggtaggtcaggtgaggttcaactcgaatgccttgttaaaccggatgcccaagacgtccccgcatgctatcaaacttgatcgtctctgggtgtgggcaacgatatgttgtctccgcgtgtcatcgaacttgctgtctctggatgacaaaggtgcggataaccatgagtctcggctggaagacgttgacatctccgggaaaggtgttgatgaccacattggtaaggataaccataaggtatctatgaatgctaccggaccctcgagtcgcgatagcagaagtgagactttttcgcggtctcggccggaagacgctgacatctccgggaagggtgcggataaccataaggtatatccgcatgctatcggaccctcgagttgcgatagcaaaagtgagactttttcacggtctcggtcggaagacgctgacatctccaagaagggtgcaaatgaccatattggtgcggataaccataaggtatctctacatgctaccggaccctcgagtcgtgatagcagaagagagacttttttgcagtctctgctggaagatgttgacatctctgagaagggtgcagatgaccacatttgtctctgtgtgtcaacgggttcgcttgcctctagttgccggatacggacgaacggtgcgggtaaccataagatgtctccgcgtgtcaacagacttgacatctctggatga

SEQ ID NO: 85934 - DNA, 177 bp, Glycine max
  Peptide Sequence Number=SeqID_177619
atgacaaaagttaatgttgcaaaggttgtggaagcaatgtcttccaaggttattttgatgatgccaaagaatcaagagttaagcaaagtttcaagcaaagattcaagaatcaagtttcaagattcaagactcaagaatcaagattcaagaataatcaagatcaagattcaagaataa

SEQ ID NO: 85935 - DNA, 178 bp, Glycine max
  Peptide Sequence Number=SeqID_177620
attgtgcactacttcaagcagtgaagtaaagcttttgtcactccacccatatctggccttgacattaaccaggcttaacaccaccgacaacagcgtcaaggaattcttgcaccccggatacaaaggcttctttgagtcactctacaatctttcctacacaggggcatgggcttgctga

SEQ ID NO: 85936 - DNA, 357 bp, Glycine max
  Peptide Sequence Number=SeqID_177621
atgaccccaagactagatatgagactaaatgaagagtacaatttgaaggagttaatgacattgattaatcataggagagaacatggagagcaaggaagattggagagaaagaaatacttgttctttgtcactggagtgaagcagcacagacactcagtggatgagaaatctgatgaccttgacctcttagagacagaatcacttgtaggctttatgctaatattggaatcagaccctataaaagagacatatcttcagccaattggttcaacacttgctgtacaagagaactatgttgcaagtcctttggtagataatccaacagtggctcagattacaaactggaacgaaacataa

SEQ ID NO: 85937 - DNA, 1123 bp, Glycine max
  Peptide Sequence Number=SeqID_177622
ggtggacccttgggtactagtaccctcaccttccgaggactacacatcttcacctttagagggctacacgccatcacctttagagggctgcaccccctcgcctttagaggactacacatcctcgccttcagaagactgcacgtcctcaccttcagagggctacacgccctcaccttcagagggctgcacgccctcaccttcagagggctgcacgccctcaccttcagagggctgcacgccctcaccttcagagggctacacgccctcaccttcagaggactacacgtcctagccatcagaggacaacatgtcctcgccttcagagggctacacgccctcgccttcagaggactacacgtcctcgccatcagaggactacacgtcctcgccatcagaggactacacgtcctcaccatcagaagactacatgtctttagagggctgcacgctctcagaggactgcacctcctcgccatcagaggactacacttccttgccatcagaggactacatgccttcagaggactgcacgtcctcgccatcaaagtgctgcacgccctcaccttccgaggactacacgtcctcgccttcagaggactacacgtcctcgccatcagagggctgcacgcccttgccttcagagggctacgcgtcctcaccttcaaagtggggctacatgccctctccttcagaggattacacgccctcacctttagaggactacacgtcctcacctttagagggatgcacgtcatcgccttcagagggctgcacaccctctcctttagagggctgcacgccctcgctttcagaggactacacgtcctcaccatcagaggactacacgtcctcaccttcagagggctacacgccctcaccttcagagaactacacatcctcacctttagagggttgcacgtcctcaccttcagagggttgcacgccctctcctttagtgggctgcatgcccttgctttcagagggctggacgccctcgccttcaaaggggattgcgcccgcaagacacctagtggacccggagaagtccaacagggtcttgaggtttccagctctaattacgggcctttgtcaattttacggagtgcccgtcacccccagcaag

SEQ ID NO: 85938 - DNA, 267 bp, Glycine max
  Peptide Sequence Number=SeqID_177623
atggagaacaacagccttcgatgtttacagtgcaatggagaagagagcgcaaaagggttcacagaaaagaagaaagcgagagaggctagggacccagaggagttacctcctgagcctgctgtggatgctcttgactttccagaggatgatgaggacccactccctgatgtggattctccagaggatgtcatgtcagcatctgagacagactctacggaggagagcagccctggagggacggcgaatagtggagactcttcatcatag

SEQ ID NO: 85939 - DNA, 483 bp, Glycine max
  Peptide Sequence Number=SeqID_177624
atgaataacaacacctcacaccctgccctgctgtccgagctgcgccgtctggtcggcgcatcacagctgctgaccgacgcggagcagaccgcgcgctatcgtaagggtttccgttccggcgagggcgatgcgctggcggtggttttccccggctcgctgctggagctatggcgcgtgctgcaggcgctggtacaggccgatgccatcgtgctgatgcaggccgccaataccggcctgaccgaaggttcaacgcccaacggcaacgattacgatcgcccggtggtgatcatcagtaccctgcgtctcgacaaactgcagctaatcgacggcggcaggcaaattctcgccttccccggcagcacgctgtatcagctggagaaaacccttaaaccgctcgggcgcgagccgcactcggtgattggctcctcgtgcatcggcgcctcggtgctgggcggcatctgcataactccggcggctcgctga

SEQ ID NO: 85940 - DNA, 267 bp, Glycine max
  Peptide Sequence Number=SeqID_177625
atgcatttacggacacgagagcccggaaaattatctcttcttacttgcacacttgggggtgcagtgccccatggacctacacgagaggaactaaaaggccttttagtgataattcccaaggtggtcatatctctcttgatggtttctagaggtatcatccccttcgaagaacatattgcggcagaagggactaccaacaacaatatgttatcaaagagaaaaactctagatgagggttcattgttatcaagaaagttggagacctag

SEQ ID NO: 85941 - DNA, 167 bp, Glycine max
  Peptide Sequence Number=SeqID_177626
gatggatttcggatggcgtcaggcagtatgtagagcttgttggacctcagagttgtgccagagggcttcgaggttgggtgcaacttagagagacaaaggaggagggctatcaagggcgacaagaggtgaatgttataacatgtaagttttacattgatttgagttaa

SEQ ID NO: 85942 - DNA, 384 bp, Glycine max
  Peptide Sequence Number=SeqID_177627
atggctactcagttgaaccaagctcagtcccaaaattctgacaaattgccttcacaaactgtgcagaatccaaaaaatgtgagtgtcgtcaccttgaggtctggcaaccaaattcaagcgcctccaccagtagcagcacctgcacctgaacctgtcaagcttccttctacacctgacaaagaggatgagatagttgcacaaaaggaaagcttcctaacaagaaattgtaggtgcaagctgtcctcaccccagatttctgagcaactccttcttccatatttctatgagggacaattagcaacatggaagaggagtatgattgatgctgccaatggtagagctcttggtgatataactcctactgaggctaggaatttgatatga

SEQ ID NO: 85943 - DNA, 312 bp, Glycine max
  Peptide Sequence Number=SeqID_177628
atgagtgtggaggagtttcttgcacagatggcttggccaggagcctccgcagccctagagcctatgccagatgtaaaggatgatcttgttcctcctgagccatttatttttgagaatgatccagtcgctcagaaggaagcaacagctcaggagcctacttctccagttcatatctctccagaacccattcctgaggattcccagccatctgcaccagcatcggagccagagcagcctattattcagaatccaccagctgctccggtgttggatcttaatgagcatgcagaggatcacccgcaggaggattga

SEQ ID NO: 85944 - DNA, 837 bp, Glycine max
  Peptide Sequence Number=SeqID_177629
cataagggtggacccttgggtacttgtacctatcaccttgagaggactacacgtcctcgccttgagaggactacatgtcctaaccatcagagggctgcacgccctcacctccagaggactacacgtcctcaccttgagagggctacccgccctcgccatggagggctacacgccctcgccatcagaggactgcatgtcctcaccttcgtagggctacacgccctcacctttagaggactacacgtcctcgccaacagagggttgcacgccctcaccttgagaagactacatgtcctcgccttgagaggactacacgtcctcaccatcagagggcttcacaccctcacctccagaggactacacgtcctcaccaacatagggctgcacgccctccccttgagaggactacacgtcctcgccaacagagggctgcacgccctcaccttgagaggactacacgtcctcgccttgagaggactacacgtcctcaccatcagagggctgcacgccctcacctccagaggactacacgtcctcgccttgagagggctacccgccctcgccttgggtactagttaccctcaccttcagaggactacatgtcctcactttcagagggctacacgccctttccatttgaggactgcatgtcctcaccttcggctacacgccgtcaccttcagaggactgcgcatcctcatcttcgtagggctacacgccctcacctttagagggctacatgccctcgccatcagaggacttcacgtcctcacctttgtagggctacacgccctcaccttcagaggactacacgtcctcgcctttagaggactacac

SEQ ID NO: 85945 - DNA, 614 bp, Glycine max
  Peptide Sequence Number=SeqID_177630
atgtctagctccggacaagcgagaagcggtactgggaggaagcctaagtttgatagtcatcgtttccggagtgccgagcaccagcagtgcttcgagggcatcaggggatggtcgttccacaaggagaggcatgtccagctcagggaggatgagtatacggactttcatgaggagatagctcgcagacgttggacaccgctggtgactcccatagccaagtttgaccctgaaatagccctggagttctatgctaatgcttggcccacggaggagggagttcaggatatgcgctcatgggtgaggggtcagtggattcccttcgatgcagatgccctcagccagttcttgggcgacccgcttgttttggaggaaagccagcagtgtgagttcagccagaggaggaacagggccgacgggaggcgggtgcggatcatgcacactagcatgaccaccttgacccagacatggatgacactgctgctcagcaatgtcatgcctagcgatcacaactccgatctccctctgcctaagttccagttggtgtatgccatcctgacacggatgagcgtccacgtggcccaagtgattgctaacgtcatttatttgtttgcagg

SEQ ID NO: 85946 - DNA, 611 bp, Glycine max
  Peptide Sequence Number=SeqID_177631
atggggacaaatcaaaacggcaaaaggttttatcaagtcaaggttaaaagtctagatgtcactagcctcaaggaattgggacgattgatgggaccccgccaaaggcaagccttccgcaaagtgcacgggaagatcctagatttggccgcagcggaggtatttacggaagctgtcgtatccctcgcccaatactatgaccagccgttgaggtgtttcacgtttggggacttccaaatggtaccaactattgaagagtttgaggaaatactaggatgccctcttgagggtagaaaaccgtatcttttctccggctttcttccttccttgagcaagattgcagctgtggttagagattcaacaaaagagttggatcgcatgaagcaaactcggaacggcgtagtgggcctgcctcggaagtacttggaagacaaggcaagggatatggcaagccaagagaagtggggcttgtttgtagatattttagctttgctgatttttggggttgtcctcttcccgaacgtcgacggtttggtagatttagccgccattgatgctttcctcgcatatcaccatagcaaggaaagtccagtggtggctatcttggcagattt

SEQ ID NO: 85947 - DNA, 405 bp, Glycine max
  Peptide Sequence Number=SeqID_177632
atggagacttttcaagtctcacaagttatcaagaactacgtaggtctgaattcctcattcgcggagataccttacggttatcgcacccttttgtcatccagaggcggcggccccgatgacaagcagagaccaaaggcggcgggcccgatgatacgcggagataccttacggttatccgcacccttttgtcatccagaggcggcgggcccgatgacaagcagagaccaagtttggtcattctgcacccttgtatcatccagaggcggcgggcccgatgatacgcggagataccttacggttatccgcacccttttgtcatccagaggcggcgggcccgatgacaagcagagaccaagtttggtcattctgcacccttgtatcatccagaggcggcgggcccgatga

SEQ ID NO: 85948 - DNA, 984 bp, Glycine max
  Peptide Sequence Number=SeqID_177633
atggaagagctggcggtaatgggcatcgttgaggtgcttggccgcctgcgccgtttgctgcacatccgcaaggatttaacccagcgctttaccgagctgcggccggatgtcttcgtcggcatcgatgccccggatttcaatatcacgctggaaggcaacctcaagcgtgccggcattcgcaccattcattacgtcagcccctccgtatgggcctggcgacaaaagcgcgtgttcaaaattggccgcaacaccgatctggtgctggcgtttctgccttttgaaaaagcgttttacgatcgctacaacgtgccgtgccgctttatcgggcataccatggccgatgcgatgccgctgcagccggacaaactggccgcgcggcgtgaattaggtatcgctgacgatgcgctgtgcctcggcctgctgccgggcagccgcggcgcggaagtggagatgctcagcgccgatttcctgcgcgctgcacagctgctgcgccagcgctatccggcgctggagatcgtagtgccgctggttaacgcgaagcggcgcactcagttcgaacagattaaagccagcgtcgcgccggaattgccgatgcatctgctggatggcaaagggcgtcaggcgatgatcgccagcgacgcagcgattctggcttccggcactgcagcgctggagtgcatgctggcgaaatgcccgatggtggtgggctatcgtatgaagccgttcaccttctggctggcgaagcggctggtgaaaaccccgtacgtttcgctgcctaacctgctggccggccgtgagctggtgcaggagctgctgcaggaggagtgccagcctgcagcgttagccgcggcgctggagccgctgctgcatgccggtccggagcgtgatgcgctgctggccactttcacccaattgcatcagcagattcgctggaacgccgacgaacaggcggcggatgcggtactggagattgccaatggctga

SEQ ID NO: 85949 - DNA, 150 bp, Glycine max
  Peptide Sequence Number=SeqID_177634
atggctgaagaacatcaacatagggttacccttgaagattactccagtagttttgtgctgcaattctttacaagaaaagccaagaagtggctccatttattcaaaggcaacagtctgaagacgtgggaggaagttgttgagaatttctga

SEQ ID NO: 85950 - DNA, 474 bp, Glycine max
  Peptide Sequence Number=SeqID_177635
atgagggagacacatgaaattccccaccacaatctagccgacttcgagccttgcctcggatatgccactgaaaggcaagcagctggtggtatacccttgcaaaacactttggaggggcctcaatttcgcccccaaccacaacccttctatggaaaaatggtgggttacacaccttcaagctttgcggatttggtcttcaccggcgaaaggatcaaagtgggtctggaaaaaggcaaatctgatcatcctgctttgatgaatgcgaaaactggggcaaatgaaaagaatgagaatgagggagaaacccttgctatgactgccattcctacacagtcaaatttcccatcatcccaacaatgtcattacttagccaataacagtccctctcacccaatcatccacaaaggcatccccaatcatcacaaagcctgcccgtcacacattcgtgtgaaaacattgacaaaatggaatttt

SEQ ID NO: 85951 - DNA, 449 bp, Glycine max
  Peptide Sequence Number=SeqID_177636
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccaggcgtttccccctggcggctccctcgtgcgctctcctgttcctgcctttcggtttaccggtgtcattccgctgttatgggccgcggtttgtctcattccacgcctgacactcagttccgg

SEQ ID NO: 85952 - DNA, 138 bp, Glycine max
  Peptide Sequence Number=SeqID_177637
atgctcatgcatacgcatgcacgtgcatatttgttatcttgtgaccgggacaggatcgttttaagcaatggtcaaataccgcgccaaatccaagacggagatgaatcgaggtacttggggatgagcgcgaacggatga

SEQ ID NO: 85953 - DNA, 299 bp, Glycine max
  Peptide Sequence Number=SeqID_177638
ttaaaaagctcgtagttggaccttgggttgggtcgatcggtccgcctccggtgtgcaccggtcggctcgtcccttctgccggcgatgcgctcctgtccttaactggccgggtcgtgcctccggattctgatcctattgtgttggccttcgggatcggagtaatgattaacagggacagtcggggggcattcgtatttcatagtcagagacgatcagataccgtcctagtctcaaccataaacgatgccgaccagggatcagcggatgttgcttttaggactccgctggcatctttatga

SEQ ID NO: 85954 - DNA, 387 bp, Glycine max
  Peptide Sequence Number=SeqID_177639
cattgatcacgggtctctgccagtcattcggggttcccgtcacccctagtaagggtgatgcatcgcaggccgtagatgcaccgccaccacctcatcaggctgatccagctgggtcatttggcatggagcggtatttacagcacttggttcgccagcaggcggccaaccacaaggatcaggtgcagatacatgagtgtctttaccagctcagcatcagtcaacagagccagggttttgctccctttgcgtgccctactccagatcagttcagggctgaggttgcatggcccagagattggcctgaggcccaggcagggaaggcgcccgcagaggctcccggagatgcagaggaggcccgcatggatgaggagatgatagatttactcg

SEQ ID NO: 85955 - DNA, 96 bp, Glycine max
  Peptide Sequence Number=SeqID_177640
atggttagagcattgcctatgacacatggccgaccaataggtgaccatagtccaaagccaaaggtagaaagataccttagatatgcatgtatgtaa

SEQ ID NO: 85956 - DNA, 492 bp, Glycine max
  Peptide Sequence Number=SeqID_177641
atgtcgccacacgggggcgacatggatgggggtgaaaaaaggaaagagagggatggggtttctcttgcttttggcatagcgggccccggcgggaggcccgcacgacgggctatagctcagtgggctctcagccacatggatagtttaatgtgctcatcggcgcctgaccctgagatgtggatcatccaaggcacattagcatggcgtacttctcctgtgagatccaatgtagatccaactttctcttcactcgtgggatccgggcgatccgggggggaccaccacggctcctctcttctcgagaattcatacatcccttatcagtatatggacagttatctctcgagcacaggtttaggtttggcctcaatggaaaaaaacggagcacctaacaacgtatcttcacagaccaagaactacgagatcgcccctttcattctgggggaccaggagattggatctagccataagaagaatagaatgcttggctga

SEQ ID NO: 85957 - DNA, 144 bp, Glycine max
  Peptide Sequence Number=SeqID_177642
atgaaaataagcgctggcactaagcgaggaagaggcgcgctaagcgtgaatactggcacccacgctaagccagcagcacgcgctaagcacgaatacaggcacccgcgcgcgagcagagcgtgctcaacagagggtaatccttaa

SEQ ID NO: 85958 - DNA, 543 bp, Glycine max
  Peptide Sequence Number=SeqID_177643
atggaaatatcctcattcctccaattccccaatgaatcactctgtgaggcgctcgaccgttttcacggactactcagaaagatgcctacacatgggtacagcgagctggtgcaactaaacatcttcatagatggcttcatacacaccaacaaagagaagccttctggagctcacagcccaagatgcaatgctgacccaaaacaagctactggccttgacggagaccctcagcaagcttcctcaataactacaagcggccaaatctgtggtggagcacacgagccagggaaatgcatagcccaagaagattcttccagggaagtgaactacatgggagttcagaatcaccatggattccaaggctacaaccaaggaggaccaccgcgattcaaccaagggatgaatttgacacaaggctcaagttggaggaatcatccagggaaccagttcaacaaggagcaaagaagtcaaccggcccagaattctaaccaagggattgatctttatgagaagactagcaagcttgaggagacgctaaattag

SEQ ID NO: 85959 - DNA, 366 bp, Glycine max
  Peptide Sequence Number=SeqID_177644
atgtctaaattgggtggagtcttaaatgagggatctgcagatgaagcttggatattcagcctgacgagggatcaaggggtgttccaacagaaggtgttgccttctggtggaagcaacccagctgatgcaagctccattagagcttgtaggcctaggatcttcttcatcaatggattcctttgcttcttggaagatgaatggcagcggaatggagaaagggagagagagaggagacgccacatcaaggaaaagatgagtctagaagaagctcaccaccataggaggccatggataagagcttggaggaagaatgagatgaatgaagggagagggagagaagagcacgaaattttgtgctctaaatga

SEQ ID NO: 85960 - DNA, 162 bp, Glycine max
  Peptide Sequence Number=SeqID_177645
atggtgatttttcaccatggagaagcagcgaaagataaaggagaagaggagcttcaccaccaagaatgtgccttggataagaagcttgtagaggatgcttcaatggaggaaaagaaaaagagagagaaagagagaggggggagcacgaaattgaaggagtaa

SEQ ID NO: 85961 - DNA, 144 bp, Glycine max
  Peptide Sequence Number=SeqID_177646
atggaagtgtttcactcaaaatttggtcagactttggttacttcaaatccaatggtgctcctagaatggttatcctccaagactcaaaaatctccctttaagcaattgttcggtcgcggcaagtgcaccgaatcgcgcaagtag

SEQ ID NO: 85962 - DNA, 600 bp, Glycine max
  Peptide Sequence Number=SeqID_177647
atgtctacctctactgtgccatttgaatctaccttgggtactagaggatgggtgcttgaccagtatctcaattacttatcacctaaaatagtggaagcacttgtgtgcttagaagattggttgaaaggatcacctacaacatttccatcaaaagaggatcttgaagagattgaaaaaattgagcaaggtgtcttgtatgaaaagatatgtgtggactatgaacaggattcagcaagaggtttggaccgcgtaaaacaaactcgaaacggcatagcgggcctaccacggaagtacctagaagacaaggcgagggatatggcaaatcaagaagagtgggtcccgtttatggatgtgttagcattgctaatctttggggtcgtcctctttccaaacgtggatggttttgtgaacctagccgcaatcgacgctttccttgcataccaccatagcaaggagagcccggtggtagctgtcttggcagatttatttgatacatttgaccgaagtgcgagaagagtagcgcacggatcatctgttgcttgcccgctctctgtgtttggttggtttcacacctgttccagcaagacacgaggcatccat

SEQ ID NO: 85963 - DNA, 210 bp, Glycine max
  Peptide Sequence Number=SeqID_177648
atgactgatgcacatattaagttacctgatagaggactatccaaggaggaagagtttggcttaggtgggctcaacatggatggaccaatgatgcaatcctaccccgcaagggcattggatagaaaactccaagtagattgggccagagatgcaagagaaggccctagggttcttatgagccttagggtagatttcgggcccatgggctaa

SEQ ID NO: 85964 - DNA, 177 bp, Glycine max
  Peptide Sequence Number=SeqID_177649
atgaggactttaaaagtgattgagttaggaacttggtggtacaaggagtgccatttaggtgagcccattgtggaagcaatgtcttccaaggttattttgatgatgccaaagaatcaagagttaagcaaattccaaagattcaagaatcaagtttcaagaatcaagattcaagaataa

SEQ ID NO: 85965 - DNA, 216 bp, Glycine max
  Peptide Sequence Number=SeqID_177650
atgaccagaggcagacttaaacgggccaaacacgtcatagagacaaggctgacttatcaaggtaatccttgtggcgtctaccctgacttatcttccttcactggaagtgacgtcatccaaatctccgtagcctgtatcaaacgatccgctcctactcaggttcacatcaagggacctgtcaagactcatttaatctacaatccttccagaccctaa

SEQ ID NO: 85966 - DNA, 741 bp, Glycine max
  Peptide Sequence Number=SeqID_177651
atggtgatgttctcagtttacacggttgtgaagtactgtagtggaagtgtttggcgtgtgtcttattgcccatccacggttcattttagttgttgtatgagaatgcaatccattggtcttccatgtgatcacatattggctgttttgatttgtttaaattttacggagttgccaagttctttggttctaaataggtggtcaaaatctgccacagaaaatatcaaagaaaaatatcccgattctgcaatgtattgggattcctatttgatcggcaggtatgccactctggttcaagtttctagagaagtttgcgaagttgcatactgtgataaagaggagtatgacaaaatgttacatttcctatcaaatgagcttagaaggctaaagtccaagaaaaatagccaaccatgtttcgatgagaatgatgaccagcagggtgataattgtgatggtattttagaccctgttgttgttcgaactaaaggatgcagacaagttggaatagatgaatctggaaaacgaaggagaatccaaaagtgtggccaatgtggtggaagtggccacaataagcgttcttgcactaaccctcctcgaaatgcaaatgttcttgttggtggttcatttatttcatccagtgaacaaactaacactatatgtcaacctacagatgaaaataactatgaactgttcatgcaacacccacacacatttgttgctggtagtagctgtgctggtcgataa

SEQ ID NO: 85967 - DNA, 366 bp, Glycine max
  Peptide Sequence Number=SeqID_177652
atgaggcaccaaatccctatgataggtggtatgatgaatgtgttgagtggtgaaaccctcttttgtaaaatcactcatgcacccaacatcttcatgatttttgtacatagggactcattaggtaggaataatcaacatgaaaataaagaaaaaggtatgttttattccatgactttccttaactttttaaatagtgatcaagggcttcccagggaccctaagagaataaaggtcattcctgagtggcctactccaccatgtgctgaggaaagaatccctgagttacaagaacctatggatttgaggtcaaatacttttcaagggggagggaatgatgcaatcctaccctccaagggcattggatag

SEQ ID NO: 85968 - DNA, 99 bp, Glycine max
  Peptide Sequence Number=SeqID_177653
atggttgttgtcgcaacctacccttcaacgagagggcgaggcgaaaaacaaaaggtattagcaccccacgcacccgtcacaagggacaacatcctttaa

SEQ ID NO: 85969 - DNA, 888 bp, Glycine max
  Peptide Sequence Number=SeqID_177654
atgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggatcgaccggccgaagccgaccttgggtccaaaaagaggggcagtgccccgcttccgattcacggaataactcccacttatcctacacctctcaagtcatttcacaaagtcggactagagtcaagctcaacagggtcttctttccccgctgattccgccaagccgttcccttggctgtgtcggattccccttgtccgtaccagttctgagttgactgttcgacgcccggggaagaggccccgaagggcccgttcccaatccgtcccccgaccggcacgcgacgacccgctctcgccgcggaagcagctcgagcagtccaccgacagccgacgggttcgggactgggacccccgtgcccagccctcagagccaatccttttcccgagaggctgttcaccttggagacctgatgcggttatgagtacgaccgggcgtgggaggcactcggtcctccggattttcaagggccgccgggggcgcaccggacaccacgcgacgtgcggtgctcttccagccgctggaccctacctccggctgagccgtttccagggtgggcaggctgttaaacagaaaagataa

SEQ ID NO: 85970 - DNA, 303 bp, Glycine max
  Peptide Sequence Number=SeqID_177655
atgggaggatattcaaccgacaaggaaagtgtcgacgatactgtatgcaaaaagtacgacattagcaaggagaagtgggcccaatttcgtcagactcgcagagacccttcgcgggaggatgtgcgaaaaaaggcacagtccatccagaaacaaaacactgcccctcacgtgttgtctcgtgggggttatgaatatctagaaaaaaagatgatggaggagaagaaaaagaaaaaattggaggaagttgctcaatctagaagcacttacactatgattgatcatccatcttccatcagacaacac

SEQ ID NO: 85971 - DNA, 498 bp, Glycine max
  Peptide Sequence Number=SeqID_177656
gttgttgtgactgagaacaagagagggtacatctcttgtggatcagttctagtggagggtacatccactaggttgttcaaagagaacaagggagggtacatcccttgtggatctttgcttgcatttgaaaactccaatcttattcctttcatgtctttaaaattgcctgtttactctgatttagtcaaagccttctattcaaaccttgaaatccaagaaggcactttaatttttaaagcttatgggattaaaatggtcattgaccaatccctattctatgatttaactcaattatccactgaaggtgtaccatttgaaggtacactaattgatgattggaaatatgaattctctgtgcatgatgcccgccggttggtttgcaccaaccaagcggatatgaccggaaggcttcttgccggttcattggcttttgagagccgcatccttcattatctcattatgcgtatcttgcttctaagatcttcaaaccttgcatag

SEQ ID NO: 85972 - DNA, 462 bp, Glycine max
  Peptide Sequence Number=SeqID_177657
atgcaatcacagggacttgcactgcctccagagcctaaggttggtccctcagctgctcgtgtcagcacaaaggagagttgtgttgatcccttagggaacgatccaaacacgggtgactcgaacaaatgcgggttgtacatcgaagaaaatcctccccgcccggttgccctaggaagagtttataagggatccacaaatgttcataacatccctttgttgcatgatcaagtgaaggtcggtgttgaggaggttaaagatgcagatgctcctgttcctgtacccactgacgaggttaacttagtggggcagacacttaacaccttccttgcttggccgacacatctcgtaaagcatttatcagaaaaggttatgtcggatgctaccatgttcggggtgtttaatccagacttccccttgtacataaagcatgaagatctgtctgaaatagcacacggtggttaa

SEQ ID NO: 85973 - DNA, 317 bp, Glycine max
  Peptide Sequence Number=SeqID_177658
ggtacatcctttgtggtacaagtagagggtacatctacttgggtttgactgagaacaagagaggttacatctcttgtggatcagttctagtagagggtacatccactaggttcaaaaagaacaagggagggtacatcccttgtggatcattgcttatgtatgtaattgattactgtcataccctaatttcgtccggggaccattgtttggtagcatgcaaccttcgctttgttggaccttgtggccttaataatcttaagagggataggcttagaatgcagaagaagcaacaacaattcatttacaatgttctttaa

SEQ ID NO: 85974 - DNA, 324 bp, Glycine max
  Peptide Sequence Number=SeqID_177659
atgtcgggacgacacagaccaactgatacttccgcagggggagattggcattgcggtcgctgggcagaatgtttgctaagtagcaatgtcatctatatctgtgtaagagtggtcatgttggtgcgcatggtccgcacttgtctctttgcagcgggccccctgagagtgaggacgcgtagtcctctaaaggcgagggcgtgtagccctctgaagttcaggacgtgtcgccttttgaaggcgagggagtgtagtcctatgatggcaaggacgtgcaatcctctaaaggtgagggcatgtccccctttgaaaatggggaacatgtag

SEQ ID NO: 85975 - DNA, 362 bp, Glycine max
  Peptide Sequence Number=SeqID_177660
atgggtgatcaagaggagacacaggaacagatgaaagccgacatgtcggctttgaaagaacaaatggcttctatgatggagggcatgctaggaatgaggcaactcatggagaagaacgtggccaccgctaccctgaacacactggggcacaacagcaacccccatttgggatacaaccgagcggcttacccttatggattgccgccaaactacacgccgccagtcatgcaagatgatgcgggtcatatctcttctcccatccttgaaggggagcctcctccacaacccgacgaggtccacgaagatcatcaagagtatgcacaaagggatgtcgagttctaccccccgattcccatcgaggg

SEQ ID NO: 85976 - DNA, 540 bp, Glycine max
  Peptide Sequence Number=SeqID_177661
atggtgcctactactcaccctctggacccagataagtccaacagggccctggtgtttccggggctgatcacaggcctctgtcagtcctacggggttcccgtcacccccagtaaggtaatccaaccgccgatcaccggagccttcatcgagaagtactacacgccttggcaggcgcagggtgatgcacatcaggacgcaggtgcacctccaccacctcggcaggccgatccagctgggtcgctgggcgtagagcattatttacaacatttgattcgccagcaggcggccaaccatcgcggacaggtgcagatacatgagtgtctctaccggttcaacctcagtcaacaagggcagggttccgccccttttgtatgccctaccccggaacagtttggggctgaggtcgcatggcctggagactggcccgatgcccaggcaggagaggagcctgcaggggcccccggtgaggaggacgaatcccatatggatgaggatatgattgacctactcggtttcttgggagggagcggagccacatga

SEQ ID NO: 85977 - DNA, 474 bp, Glycine max
  Peptide Sequence Number=SeqID_177662
atgagtatggatcatgcataccaccacaatgtcgatctccccctgcggaagtatcagttgggatcgcacccacaagacccccaatggacccggagaagtccaacagggccttggggtttccagctctggttatgggcctttgtcagtcctaccgggtgcccgtcccccccagcaaagtcacgccattgtgacataggtaaggatcacgcccgcaagacacccagtggacctggagaagtccaacagggtcctggggtttccaactcagattacgggcctttgtcagttctacggagtgtccgtcgctcccaacaaggtcatcaggccccctatgaaccgggctttcttcaagaagtactgcgcccccaggcaggcgcagggcgagacaccatagtagcatggggatggccgactgtgggtaatagatgcaccaccgccacctccaaagcccctcagctcatctacaaatattga

SEQ ID NO: 85978 - DNA, 870 bp, Glycine max
  Peptide Sequence Number=SeqID_177663
atgggtttaccttggtatcgtgttcatactgttgtattaaatgatccaggccgtttgctttctgttcatataatgcacacagctctggttgctggttgggccggttcgatggctctatatgaattagcagtttttgatccctctgaccctgttcttgacccaatgtggagacagggtatgttcgttatacctttcatgactcgtttaggaataaccaattcgtggggcggttggaatatcacaggagggactataacgaatccgggtatttggagttacgaaggattgtatggtcctggaatatgggtgtccgatccttatggactaactggaaggatacaatccgtaaatcccgcgtggggcgtggaaggttttgatccttttgttccggggggggtagcttctcatcatattgcagcaggaacgttgggcatattagcaggtcttttccatcttagtgtgcgtccaccccaacgtctatataaaggattacggatgggaaatattgaaactgtcctttccagcagtattgctgctgtcttttttgcagcttttgtcgttgctggaactatgtggtatggttcagcaacaacccctattgaattattcggtcctactcgttatcaatgggatcagggatactttcagcaagaaatatatcgaagagttggtgctggactagccgaaaatcaaagtttatcagaagcttggtctaaaattcccgaaaaattagctttttatgattatatcggaaataatccagcaaaaggggggttatttagagcaggttcaatggacaatggagatggaatagccgtcggttggttaggacatcctgtctttagagataaagaggggcatgaacttttt

SEQ ID NO: 85979 - DNA, 108 bp, Glycine max
  Peptide Sequence Number=SeqID_177664
atggatgaggatatgactaacctgctcggtttctgggaggaagcagagccacatgaccaaggcagtgtgtgccctcatccgcacgaccttttcagaaaaaggaaataa

SEQ ID NO: 85980 - DNA, 327 bp, Glycine max
  Peptide Sequence Number=SeqID_177665
atgtcaggacttacacgcgattctcctcaaatttcagccagcccgcatcaattagaccttgcaccttacgcttcagggccctacaatgctcaatggaacgccccggggcttctccatgacaagcacacgttgcgttcgagtcgtattctcggagaaatggaggttgatgaaccttggctggggttatggctaccattgaattatcaagtggattttgtggttgattcagggatggcctttgtggataattgggtggtgggtaaggagaagggttgttattggctgagtaacgacattgttgggctggtgggaagtttggccatgtag

SEQ ID NO: 85981 - DNA, 105 bp, Glycine max
  Peptide Sequence Number=SeqID_177666
atggccgaccggcaggcaatcaaatccaaagccaaagctaaagacgttaaagaagcgctactaggaggcaacctagtaccttttggatctatgcttgttatttga

SEQ ID NO: 85982 - DNA, 231 bp, Glycine max
  Peptide Sequence Number=SeqID_177667
atgcctatttatcgaaatagcttgctagataacacaagttatgtagaagtagagcttcatggtgaatcaaaggtgattcaaaggtgttttgatgataacaatgatgataaaaaaaagatgatgacaaaggtgatgacaaaaagctcaaagaaacaactcaagggaatcaagaacaattcaagagttcaagataagaatcaagaagattcaagactcaagaagaaagtttag

SEQ ID NO: 85983 - DNA, 576 bp, Glycine max
  Peptide Sequence Number=SeqID_177668
atgaactcgctaagcgagcatgctgcgctaagcgagttcatcagtactcattgtatgacttccagaaagagaaagagtattggaagacatatactgcctgagaggaaggtagaaatacaccatactgaactgaacgagtttaaggatgaattggagaggcgtaacttccataaacgcctcaccaatttagttggcagcaacatagatttagctttggtgaaggagttttatgccaacctttacagctccgaaggaccttcaccaaagcaagtcagggtcagaggccacgtggtgaagattaatgcagacaacctcaacacctttatggagacacctgtggtactagctgagggtgaaaccttacccacatattccagatactactggttgcccactgatattagagaaattgaggctgccttatgtatcccaggtcgggggtttgttttgaatgctgaaggccaccctgggaagattctcaggaaagatttaacaactcttgctcaggtgtggagtgttctctcgtactcaaacctggcccctactttccacacctcggacatgacagtagattga

SEQ ID NO: 85984 - DNA, 1191 bp, Glycine max
  Peptide Sequence Number=SeqID_177669
atggtggcgagcttcttcttgactcatcttctccttgaagtggcgtctcctctctttcttccttctccattccgctgccatttatcttccaagaagcaaaggaatccattgatgaagaagatcttaggcctacaagctccaatggagcttacatcactattgaaaccctcaaaatcgtggtctgatcgaaaattggttgatgttgagtttattctctttatggagggtaatgtagtgatggagcaaagttttggtgtccctaaagtaaccgaagatggagtaaatactgcagagagcattgaattcaaggataaagttaagaaggttagtttcagacttgtagtgcatgttgctaatgctactaatgatgttgcacaataccagattgcagggttctgtggaaccacatgtgctatagtccttacgcgagcaatatttactgaaggctgcaaatcagttgtggctggaatgaattcactggaccagaggtgtggtctgagtatggctgtaggtgatgcggtggcaaacttgaaaagtaaagcaaggatgattagcacctctgaagaaatagcacagggtgaaaagaagatgataatgctgatgagtatggctatatttctgaatttgaaaaaggggacaactcaagctttgggatctgcaatattggagcaggttgatagaaacattgatggtggtgagtttgataaagagtgcattgccggagaatatgcagagttgcagtttgagaaggaaaaatcagaaatgaattcggtttcatctgatccaaagatagaagaagaaatactggaagcagaagaaaaactgcagtttcccgacaacgagccagctcaggaggaagctgatccattggcagatgtgtccaagaaggaggatggatctcaacatggctccaacaaagatggttctgtgtgcataaaggttattggtgagaagagtgcgaagatggtgaccgacgaaggtgcaatatatgttattgcaaacagaggttacaactggagggctattgtccaggaaactgtgtcagctactcttaacaggacgagtgtcaatgatgttattcatgaagaaggtgctgccagggaaggtgggaaaggacccagtatatgggatactttcgctcataaatacccaggtgctgcaagggaaggtggaaaaggaccaagtatatga

SEQ ID NO: 85985 - DNA, 231 bp, Glycine max
  Peptide Sequence Number=SeqID_177670
atggcagcggaatggagaaggaagaaagagaggagacgccacttcaaggagaagatgagtcaagaagaagctcgccaccataggaggccatggataagagcttggaggaagaaggagatgaatgaagggagagggagaaaagagcacagaattttgtgctctaaaagagctctgaaatctgaacccactaatccaagatcaattccaagattctccactaagtgtgcttag

SEQ ID NO: 85986 - DNA, 1002 bp, Glycine max
  Peptide Sequence Number=SeqID_177671
atgatttgcattagttcaatatttcatgaagttgaggatataaatgtgagcatttcacatgcagctgattctattggtttgaaggagataccaagatatgaagttaaaattgatgacgaggaggactggatgaaaagatctcaggaatcacttcatccagttcaagttactgaagggctatgggtggtgcccaagtggtgtactccaccggatgttcaagcaacaaatataattgtcaatcctggactagcctttggaacgggggaacatgccactaccaaactctgtctattactcttacatggttgtataaaaggaggggagcacattctggactatggaacgggaactggaattcttgcaattgcggctcttaagctgactcttaattccaattttgacatcctgttgccttataagtttggagctgcctttgctgttggagttgatgtagattcagaagcaattgcatcagcatctcaaaacgcttacctgaacaacattggacaagacaaaatgcaactgcacctggttgctagcaaaacctcttcatcgtccaaaaatgacttgacatttggagttatggagggagaaaatacttgtgagatacatccagtcactgatgaggaaaagtttgatgtggtcgttgcaaatatactcttaaatcctttattggatcttgctgatcaaattatctctcatgcaaagcccggagcagttgttggtctctccggtatcttatcggagcaggtccagtacattattgaaagatattcaccattcttagaaggcatagaagtgtccaaaatggatgactgggcctgtaggtttggtagttcgcagccaatccctcactgcagcttgatgccacccagtaaattttgtgtggggcagcttctaacctgccacttgacaatgcattttggaatggtcaatgttgtctttggttgtaattcatttgccaagcagaaaattagactgaaggggcaatgcagagcataa

SEQ ID NO: 85987 - DNA, 489 bp, Glycine max
  Peptide Sequence Number=SeqID_177672
atgttatttcggtctcctgcgctgggagaccgttgctgtgtattaccaaccagagagggtcatgcggcagtttggatacacccagaccattcctgctccgcctgtcaattcatagcaggtgaggtgtgcgttgtgccaggtcagtgtgtcagcgactacgtagactggttcttccgcattttgcatcctttcatgacaccaggccaggcatcagatcctttaccagatgagacagatatccctcacgtgccggagccaagagaaccatcgacatctgcaaggcccgctgtggacgagcctagacatgcagtggaagtttgctatgggattgttgagaggttggagcaccatctaagcctaggggtggtcacgccaggctcatcgacacatgaggttatcgaagaatgcctcaggatggtcaggagtgtcacacaggaccagctagtatatgttaggtctcaacgtaggaggtacacagatcaggcgtag

SEQ ID NO: 85988 - DNA, 714 bp, Glycine max
  Peptide Sequence Number=SeqID_177673
atgccggcaatcgaagacgaacaactacttacctcgacaatgccgacgcggagggagaacaccaccctcaaaatgcctggcctactcaacactaacgagcaccacgatcgcagaacacagactcccgacgtggatgaagaagacgacactcacggggagaacgcggcgcggaggacctcaacggtgggtcaagcttttctgaaaccagcaaccacttcacgcaaacaaaacgaaaggaagaagaacgcgactgaggtgaggtcacgggtgaggaaggggaccaaaaccacttcacgccagcaagaagaagaaaaaatggtgagggatcacaaggaagaagaaggccaactcagtcctccaccttacatgatacaaattccacaggaaatatcaaaattctggagacgacttagcggagaagagagaagtggaggtggcagtggtggagtagacgtaactggctttaaggaaatttttaatctcaaaaacgatgcggggtcgtatgcatattgtgtcgccttcgcggggtcctgcagaagcggggtcatcggtgctggtcgctgctgggtgtggggtcgtcgccgctggtcgctgctgggtgcggggtcgtcgccgctggtcgctgctggttgcggggtggtgcgtgcaggtcatgctgctgtgttctgtgctgtgcgtcctcccactgtgcttttgcacttcaatttcgggtag

SEQ ID NO: 85989 - DNA, 309 bp, Glycine max
  Peptide Sequence Number=SeqID_177674
atgtatttccatttgtgttcaaatgagatacaacaaaaaagaaagttctattgtattctctactcagatgtaggaaatatatttacatggtgcggtgaaggtgaaggtaccagtgttgagcattgcggtagtcatcgacaacaaacaaagtatgcagaaggtggtgcctctgtcagggacatggacgaagatgagtggatgtatgaaagtataatgtctgaagaagcggatatggattatcaagatgaagaagcatgtggtgcgaatgaaccacatgttgattgtttcgatgcgttcaatacttcttag

SEQ ID NO: 85990 - DNA, 285 bp, Glycine max
  Peptide Sequence Number=SeqID_177675
atggattggttcttctgcatttcgcatccattcatgacaccaggtcaggcatcagatcctctgccagatcgtcatgctacgcagcccagagtcatccctcaggtcccagagacagatatccctcaggtgctagagccggcagcaccatcgacatttgcaaggtccaatgtggatgagccgagacatgcaatggaagcttgctatgggactgcagagaggttggagcgccatctcaacctagggatggtcacgccaggcacatcgacacatgaggtgatcgaataa

SEQ ID NO: 85991 - DNA, 939 bp, Glycine max
  Peptide Sequence Number=SeqID_177676
atggcagaatcatcaaagaagagaaagggcatttcgacttcatctgcagccaccgaaactcgaagccacggggcatccaaagcacaaacaacacaaattcctccctccatatcatctacgctgttctcctcggaagaacaatgtatccggtacaattctcttttctcttctcgttccattatagaccctaagtatgtagacttggctttctttgatgatgaactatttgattgttttcaagcatttcaaaattctgggttaatcctatttatttccatgaaacttcctttctatcctgaattagttagaactttttattctaacttagaaattcaagaagattccttgatttccgaggtatatgggattaagatggtcatagaccagtcacttctctttgaactcacccatttatccagtgatggtgtaccgtttgaaggtacacttgatgatgagtggaagtttgatttttctatttttgatgcctgccagttggtttgcaccaaccaagcagatatgaccggaaggctacttgccggatcattggcatttgaatgtcgcatcatgcactatttgattgtgcgtatcctacttcctagatcatctaaccttgcacagatttctgaggaagagttgataattatgtgggttttcttaatcggtcgtcaaatcgactgggcccatcttgttagatatcgcatgcataaggcattgcgatcaaatgctcctcttccatatccccatctgatcaccttgtttttgcatcattttaatgtccctcttgactctgatccctttgttaaagtcaagagatctttctctatcggtgcaaatgtggtttcctcttttggataccacaaagagagggatggttcttgggtgaagaaggacgctcccacacaggcagcagaatgtaacatcccaatttttataatctag

SEQ ID NO: 85992 - DNA, 318 bp, Glycine max
  Peptide Sequence Number=SeqID_177677
atggcggaagacacccggggaatgagcttccttacagtgcctacacatcctaagtgcatagtctacgcagaacacattcatcttattagatcgaaggtcatggttgggtacatagtagcagttgcggctttctgtgtgctggagcttcccttccgctccgacgccgatgtggcagtggaggaggcccctaacttcttccggttcgtggcggagactgacgaaattggcgacgtgagggcgcacacgatggaaattcaccccagcgtgacgaagatcgtggtgaaggagggtggctcggtagagctctcgctcgactag

SEQ ID NO: 85993 - DNA, 279 bp, Glycine max
  Peptide Sequence Number=SeqID_177678
atgtcatgccctagcctgcaaatgagcagaaccctagcctgctgcatgtcacccttacctgcaaatagtgccctaagctgctgtgtgaagaagggtccacattggtctcgttggtgctactggcgggatgcccagtcagcacctgtctcgctggtgctactggcgggttgccctataatgctgttggtgctggcggcacccagccacgtcagcaccattctcgccagagctagtggcgacatcaatggagtcgctgatgcagctggcggcatcaaatga

SEQ ID NO: 85994 - DNA, 180 bp, Glycine max
  Peptide Sequence Number=SeqID_177679
atgcatgctgaatcttcatctcccagtcaaggtgaaaaagaggctaagcgcacatccaccgctaagcgcagcttcagtgcacttaacgcgatagaagaatctggcagagcatcagcatcaaggccacgcgctaagcgtagcatgtgtcttcagccaggcttagcgcacaactggagctaa

SEQ ID NO: 85995 - DNA, 186 bp, Glycine max
  Peptide Sequence Number=SeqID_177680
atgggcttagcgcagaggtctgccctcagccttattactaaagattcaatcacaatggggaagttgggcttagcgcaacaaggcttagcgcagcaggcgcacttagcgcgttcgtcgtgtagaagcaagcgtcatgatgatgaatcaagttcaagattgagtcaacaagttcaagatcaagattaa

SEQ ID NO: 85996 - DNA, 451 bp, Glycine max
  Peptide Sequence Number=SeqID_177681
cttgcttctacaaatcactgctttgtgcaaggtctggggagttcactctgattccttgacccatgagagattgagccccgccattgatttggcgacattcaaatatttcatttacaccacagatactgcactccatgctccagagcttataccgggggtagtccatcatcatgtggcctggccaggaaaccagccttcttcttctggagggggtgatgcctacgcagcccaggagcctgatccagaggagccaccagcaacagcagcagagggtgaggatgagctcaccccttctgagccctttgattttgatgcaagtgtacctatggctcaggaggaggagacttctcaagacatcataccagagccatctccagcctctgcacctattcctgatgatgccataccatctgcaccagtcatggagcctgagcagcttatccaagattga

SEQ ID NO: 85997 - DNA, 189 bp, Glycine max
  Peptide Sequence Number=SeqID_177682
atgaagcctgattgtgcgctaagcctgacttcgtgggctaagcgcattttccaggatcaatcagagctactgacagcgctaagcacgtgtcctcgcgctaagccagggcttagcgcgaagggccaggctaagcgcttgagctttaaactcaaacatcatgagggcacgataagcgcagagctacgctaa

SEQ ID NO: 85998 - DNA, 906 bp, Glycine max
  Peptide Sequence Number=SeqID_177683
atggctggtgcaaaaggatcttcatgtgcaattcctggttgtgattctaaggtgatgagagatgaacgtggtgctgatattcttccatgtgagtgtcattttaagatatgcaaagattgttatatagatgcagtaaaaacaggaggtgggatatgcccaggatgcaaggagccatataagaacacagaactagatgaagtggctgtagataatgggcgtccccttccacttcctccaccaagtggaatgtctaaaatggagaggagattgtccatgatgaagtcaacaaagtcagcactggtgaggagccaaactggagattttgatcataataggtggctctttgaaacaaagggaacctatggctatggcaatgctatatggccaaaggaagatggttttggaaatgaaaaagaggatgattttgttcagccaactgaattgatgaacagaccttggagaccacttactcggaaactgaagatacttgctgccgttttgagcccatatcgtcttatcatttttattcgtttggttgtcttggcactgttcttggcgtggaggatcaaacaccaaaatactgatgcagtctggctatggggcatgtctgttgtttgtgagatatggtttgccttttcctggctgctggatcaactgcccaaactatgcccagtgaatcgttccactgatcttaatgtccttggggatttcaatagcattagaagccaggatgaaagaacaggctcatctcaaaggagtgtgggcacatatgatagttttggtttcaatgattggatatcagacatggaaattcaggaaattaaaagctttggtagcagatttacttggtgtaggccaaatggatctgtgaggagtaggctccatagatgcttggtttcagaatag

SEQ ID NO: 85999 - DNA, 279 bp, Glycine max
  Peptide Sequence Number=SeqID_177684
atggactgtcttcaggcaggaagtcttgcttcattgaaggctactttagaagaattgtctgggcaagctacattaagctcctcaaatgaagaggagacatctgtgaatatagaagcaactcaatttcatgtatttgatgaagttagggatggagagtggcttgttattgccacaaatgttgttgaaatatctttaacaatcccacggataaagtatgtggttgatactgggagagaaaaggtgaaaaattatgacccctctaatagcatggagacatag

SEQ ID NO: 86000 - DNA, 267 bp, Glycine max
  Peptide Sequence Number=SeqID_177685
atggggtgcttggctgagcattcttttttttttatcttggctctgaaagtggagtctgcttcctctggaaaagtaacagtagaagttcaaatggaaaataaaattcataaagttaagcaaaagaaaggaacacaactgcggaatggggaaacccctgaagttgtaccgtcacatgcaaaggagttccatacactatctattggaaaaatgagaatgctttttccaggaaattctagtgcttgggaagccaacaaattttaccagtga

SEQ ID NO: 86001 - DNA, 750 bp, Glycine max
  Peptide Sequence Number=SeqID_177686
atgactataccaccgagctcccctcctcttcctcctgagttagcaccttcgtcgtcttcgttgaagaagactagaaaagcaacatggctcagatcactggctgctaggcccgtcaggatggagagaccagtggttcatgtggatcctgccactagaaaagttgattgtccccacaaaaagcaattaaggacgcagtttaagtcagatttaacctccaactgggctctggctcaaggcaatgaggaggaggatgacactgtctatgagaagtatgatattagcaaagaaaaggggcaacatttttgtcagagtcgtagaaaccactcaagggaggatgctagaaaggaggcttacgccatccagaaactaaacattgcccctcatgtgttgtctcatgagggttatctgaacacaaaggaagggttgtccttgtgtggttcagacattgtaaaagagattttacaagatagtgaaactctcaagcgggttgcttggggactggacgtaggcacaaggggatctgtattgcctcctgagcccaaggttggtccttctgtttctcgtgttagtacaaagggaagctgtgtcgatccctcgggggataaacaaggagtcgagggatccaaaaaacctgtagataggccagaacctgatgacgatcccctaggccagatgacattgacgatctcggggcttttcctcatgcctatgcaagtgtcgtgggattcaactgtgtttgggtgtgtataa

SEQ ID NO: 86002 - DNA, 657 bp, Glycine max
  Peptide Sequence Number=SeqID_177687
atgcattatctttacatagtacttgcttcctcggatcttccacaccagtatctcaagtccaacaatgttctcgttggaccagacaatgaaccaatgcttgtagattacagggcaccagaggcaacacaacaaggccaggtttcgcgcagttgcgctgtttactatcttggtgttgtcataattgagatactgatagcaagagctgttgcttatgaggatcagagggctagaagggagaccggacatgtcagtgtcagcgggagcgtaggatggggagaagctgatgaactggagcttaaaccccaaggaacacttagagcgattgtaattaaagcaaatgacctaaagaatatggaaatgattgggaagtctgatccttatgcagtgttgtatattcgaccactgtttaaggttaaaacaaaggttatcgataacaacttgaatcctgtttggaatgaggtatttgacttgattgcagaggacaaggagacccagtcactcattgtcgaggtttttgataaagacattgggcaagataagcgattgggaatagtaaaattgccacttaatgacttggaaccaaaaattgaaaaggagtttgaattgaggctgctgtcatcacttgatacactgaaagtgaaagacaagaaggattga

SEQ ID NO: 86003 - DNA, 162 bp, Glycine max
  Peptide Sequence Number=SeqID_177688
atgtgggtgtcgacggagtggtttccggcagatttcgggcgggaggagaaagagaacaacgatttcaggcaggaggatgacaaagagaagagaaatgatcacggtgacattgaggaagtcattcatatttttgaacttgctattcaagttgacaagtggtaa

SEQ ID NO: 86004 - DNA, 150 bp, Glycine max
  Peptide Sequence Number=SeqID_177689
tttagggctgaggtcgcgtggcccggagattggcccgaggcccaggcaagagaggcgcctacagaggctctcggtgatgcagaggaggcccgcaaggatgaggagatgatggatttgctcgatttcttgggtgggagcggagccacatga

SEQ ID NO: 86005 - DNA, 405 bp, Glycine max
  Peptide Sequence Number=SeqID_177690
tgcgcgtcttccggaattcttctggatgaaccacttcttccggaaagttcccggaagaggtttttccggtccggaagacgtttggttacttccggaagaacccttcttccggaaactttccggaagaacccttcttccggaaactttccggaaaatgttcttccggaacttccggaagaacccctaacgggtcttccggaagtctccgccgtcagcctcctttccccattttttccggcgtcctctcctctcgtcttctaccctaaggttactatcctaagcaaaggggagttagggagactaacctcgttcgcggagaagaagaagacgaggttcgcgcttgccttgccggagaagaagaagcagttcgcggagaagggagaacaagcttcgcggaaggaatga

SEQ ID NO: 86006 - DNA, 1356 bp, Glycine max
  Peptide Sequence Number=SeqID_177691
atggcatatcactggaaaaggtacattgacattgttgtacctaggaagctgcttcctgagcggaatatggtaatctaccacactgagtttgatgagttcaaggaagaattggagagaagaaaatgggacgaggagttgactagttttgatgaaggcagcattgatgttgccattgtgaaagagttttatgctaacctctatgatcccgaggataaatcacctaagcaggtgagggtgagaggccatttggtgaagtttgatgaggacacgctgaataccttcctgaagacccctgtaatcatcgaggagggggagacattattagcttactctagatttgcactcttggggcctgatcctcaagagttggctgctaagctctgcatcctagggaggggatttgagcttaatgttgatggtcaacttctgaagatccttaggaagaacatgaccatactcgctcagacatggagtgttctttcttactccaacttgatccctacctcccacacttctgacatcacactggatcgggctaagttgatttatggcattattatgaagatggacatgaatctgggctacctcatatccaaccagatttctattattgcccagcatgactcctctaggcttggatttccagccttaatcacagctttgtgtaaagctagaggagtcacatcagatttcagatctttggagagccttagccctgccattaacttggtgtatataaagaagaactattggaatctagatgatccaacaatgacattcaaagggccaaggaaggccatgggtaagagatctgaggctccccttacttcaacagcaccagatacttctgctccttctttaccagatccttctacagctccttccattactgttccatcttcttctactgcagctcccttatcagctccatcagttccagctcctcttataggaccttcctcattcacctctgagacattatttgctatgctacagagcctgcacagaggccagatcatcatcatacataggttgcagagctctagccaacaaccatctatgagtatggaggagttccttacacaggtggcttggccaggagtccagccttctccttctagagggggtgaggcctccgcagcccatgagtttgtgccagatgtagaggatgagcctgttcctcctaagccatttatctttgagacaaatccagtcactcaggaggaagcaacagctcatgatcctatttctccaattcatatctctccagcacccatttcagaggacaccggccatggagccagggcagcccatttttcaggatgtaccaactgcttcaatgctggatttaaatga

SEQ ID NO: 86007 - DNA, 564 bp, Glycine max
  Peptide Sequence Number=SeqID_177692
atggatttatcagtccttgcaccagagatttctttttcctctttgtctgattcacttgtttcttgggcagaaacaacatgggtagtgaacatgacatgtttcgcagaagacaaatttgacattcttaagcacaacaatctgaattctgccaaagaagtgattcaagagatgggggatgctggccttaagccaattgcttttgcttatagacaaagagatggagaacaacttcagcaaaaagaactaatcttgttaggactgatagaggatgacatcatggaagtgaaagacatagctcctggactaggactagaacatgctattatgcacgaaggaagaaaaattaaagatttgaatgaggaagctattaaacaaagtggatcagcccatgccaactaccttgttgatgaggacatgaccaagagcaagggaaaggatccactagaaggacttggaggacctatgacaaggactagagcaaggaaggaaaaggaagctcttcaacaagtgttgtccatactatttgaatacaagtccaagtttcaaggagaaaagtccaaggat

SEQ ID NO: 86008 - DNA, 432 bp, Glycine max
  Peptide Sequence Number=SeqID_177693
atgtcggtgatgacagcaagtcagagtcgtaagggagaggatcgtcatgaggccaaaggattcagggggagtgtaagggttgtgtcagtagtggccttgagaatacttgatgtcatagaacatggaaactatattccattggacaatcaactaagtcaagttcccaaaacctctaggacatatgctcaaagacaaaggtttatgctaaactctaaagctcgaaacactctgttgtgcatcctctctgagaaagaatatacaaaggaacttcaacaagatgaaggactcgaaaagggcaaatcattggctttaaaaccacaaaaatccaaagcatcttcaacatgcaaggaatcttcatccaaatttgtcaacattgatacaccttctaatgatgagtccaatgacgaaggctcaaatgaagataaacagtaa

SEQ ID NO: 86009 - DNA, 222 bp, Glycine max
  Peptide Sequence Number=SeqID_177694
atgaagaacaaagcagagaagaaaaaccttcttccgaaagaaaatgaaaatcttccggaagaagcttcttccggaaacattccggatgacgttcttccggaagtagtttctgagtacttctggaagtcacaaattcttcttccggaagaaggttcttccggaaaagttccggaaagaggttttccgaaaagttttcggaaaaaatcttctttcggaagatga

SEQ ID NO: 86010 - DNA, 969 bp, Glycine max
  Peptide Sequence Number=SeqID_177695
atggacatcgatgaagacctcgacctcagtgacttcgatctcgacccggccaatgccgaaatcctagaagagctcagcgaagacattccaccgaggaaagctctgatgccgccaccatttgcgtcatccatgcgttcctcatcccctagcaaaaagcagctctacgagctagcttcgagcttcaagcttcattatgctgccaaggaggtaaccatggcatttggtgaaggacatataaaaaggtttttggctcagtttttgtctaccttaactctgttccaaacaaatcccagtttcgatctctctaatcaagttcctccatttccatcagagactcctatagctattgttgaagaagaatttggaagtcctttagctagcgtctttgatcattttgagtatgaaccaatagctgctgctgcaagtcctaaaggctgtgatagcttctcctatttgaggagagtttctgatagattgcttgatgaaaattttggaaggcaaaggtattgcacggtgaaccgcgccattgggaatccccccaaggtttatgaacttgacattgacacaggtagttatctcacttggactcagtgtgatgcatcatgcaaaggttgcaccctaccttgtaatcgacaatacaaaccacatggcaaccttgtgaaatgtgtggatcccttgtgtggtgcaatccaatcagcactaagccttccccatgttaccacaaatgtgcaatgtgactatcaggttcagtatgctgaccaaggatcttctcttggtgtcttaggtacatcctttgtggtacaagtagaaggtacatctacttgggttgttgtgactaagaacaagagagggtacatctcttgtggatcagttctagtggagggtacatccactaggttgttcaaagagaacaagggagggtacatcccttgtggatctttgcttgtaaaaggatttttacaaggttga

SEQ ID NO: 86011 - DNA, 489 bp, Glycine max
  Peptide Sequence Number=SeqID_177696
atggtccttgagatttcttttcaaccttgtaaaaatccttttacaagcaaagatccacaagggatgtaccctcccttgttctctttgaacaacctagtggatgtaccctccactagaactgatccacaagagatgtaccctctcttgttcttagtcacaacaacccaagtagatgtaccttctacttgtaccacaaaggatgtaccctccaatgtgttaaaacaaagttctcaggcggttagtcctttaaaactttgtgaatggggaaacaaaagaattctcaagcgggagaagggagacacaaaagaattcaggcggttagtcctttgttcttttggaaaagggagaagggagacacaaaaagaattcaggcggttagtccttggcgaattctttttggcaaagaaagaagagagacataaaagaattcaggctgttagtcctttgttcttttggaaaagggagaagagagacacaaaaagaatttag

SEQ ID NO: 86012 - DNA, 423 bp, Glycine max
  Peptide Sequence Number=SeqID_177697
atggcagatataaaagatgtacatgggaatgatttgtcagaaaagaaaaatctagaccatccaattctatcttcaatcttggattctaacttcatgaaccttgtcaaaagtctagaggcagatattagagaacaaattgtggatgtttatagtcgtccaaaaatgaaggtggcagtagtgccggcaaaattagagcaaaggagtggtgaaagtgatgctaatatatactattgtttacttacatcttcaatttgttcggatcttgttcttcgaaatgcttctatggccgaggacctggctaagacaagtagtactttgcagcctgagcaaagagtgagtggaggcttagatagagtcccaattgacacactccgtagagatctccaagaagcatctcaaagattgaatatgagaaaattataa

SEQ ID NO: 86013 - DNA, 525 bp, Glycine max
  Peptide Sequence Number=SeqID_177698
atgtctgaagtgaatgcaacccctgaaatccctcaaaacaaagccatctacatcaacaacctcaacgaaaagattaagattgatggcatgctacttaagtctttgaacactgttttcactcagtttagggagatacttgaggtgttagctttcaaaaccctaaagcacaaaggtcaagcttgggtgttctttgaagatgcctcttctgcttccaatgttgtgaggcaaatgcaaggtttccccttttatgacaagctcatgccccgaagtctagatcacggtgttccacactgtcgtcgacatcatccgcttgttcttcaagccctcaatgtttcacgagctcctccgtgcaatcgtgattggcatcttgacactcctgtctggcttcaaatgaagccgtacatcaacgacatgtttctcgacatgcttcagattgccgagagtggtggcttgaaccatgaaggaagcaatattgactatccctcgtggtataactcgactaatggacatccttatggatcgtga

SEQ ID NO: 86014 - DNA, 1047 bp, Glycine max
  Peptide Sequence Number=SeqID_177699
atgggtgaagagaagggactgtggctgggttggatcacgccagcgcggtgtggggaagaagatggatatggtgttgaatattacgtgggggtggtagtgtggaaggttctgcaaagatggcggggtatcggttcaggatggaggcaattagagggggtatgggctcaggtgtgggtatggggtggtgcatgtggaggaggagggagggctggcgggggagaaggaaaggggtgcatctgcacaaagggtgatgttacgacccaaatgagagaagccaccgtctaccagtataaccacctgatggcagcgcagatacccgaggaggcgaaacgtttgaggggctggagtgccgtccatcgcattcaaactgatttacggagtaattgcatgttccgccatgggagaagctggattgtcgatgggattgaggtccgctgggggctcgagttcatcattagcgatgaagagatggcagacgttggccgtggtgacggtccaacagcttatcttcttggaggcgtgcgagctccgtggcgtgaggaagggacaaaggccgtagtgcttgtacctcacggcaaagttttggaatcaagcctaaaacaaaacagctcaacaagcatgaagggggtaggcctagggtgcggtttgccaaacgctcgaattccggcgaatccgattccagagcttgcagcatcgctggccatgaagggaaaaagccgttgcgacacatccattgataccaggataacgcgggtccctccatgtaaaatgaggcaactcgcgggacctccaatttcatgtggtggcggtgaggggaagaggaagtatgtaatggtgtcagaggaggtggcagagagtgaaattgtcttgggggagggttttgacggcctcctccagcttgtcggtggtgacctggcatgtgtgatgctcaggcatggcggagaacggcgaggcaggaatagttgcgtgaggaagaagacccgggtcctcggggtcaatggcgcacgcaacggagagggaggaggtaggtggcggcgtgtggcgtag

SEQ ID NO: 86015 - DNA, 135 bp, Glycine max
  Peptide Sequence Number=SeqID_177700
atggtgcttgtggttgtggaaacaacatggcttcaagaaaggtatgtctatttaggatttggcatattgctgagtccaatcactagggagggtggcatccttatgttgagaaaaataccttttcaaattgagtga

SEQ ID NO: 86016 - DNA, 243 bp, Glycine max
  Peptide Sequence Number=SeqID_177701
atggtgtgcaacggagcaataagggatccaggaattgaaagcgtaatcatcgtcgattttgaggcctttctttctgatagcgtcacagagctgaagaggaggttgttggggtcgttggggaaagtggcgagggaagagaaagtgagagggagaggatcgtgcttcgattcgaaggctttcaggagagattcaagcttcgaaggttctagaaatggtgccgagaatagggttatgtgtggctga

SEQ ID NO: 86017 - DNA, 492 bp, Glycine max
  Peptide Sequence Number=SeqID_177702
atggttagaacacgaggtttgggtcgagctttaggaagggttataggaagagccctagggagagaagtcagtcatgatacagatgatgctccccagcggcgaaggcccatagcatctgcacgtaggcaacgaaaagttgcacctgttgctgaggatgttgacgatacggatcatgcggatgaggaggtccatgaacaacctgaacaagcagttggtgttgatgtgtcaactgatgctgagggttttccaggcggaccccacgacacatcagtgttgcaagactatgtttatcatgtggccgtgaaagtttggagtggagaggaacgtcctgagctgaagttatgctcccatggaagaaaggtcgagaagtttggcaagcctacccctaagatcgaaggcttagtggctgtcacaaaattaagtcctttaatcacatgttcgctagacactggtgattggggacttatgtctgctttcatggagatgtcatga

SEQ ID NO: 86018 - DNA, 375 bp, Glycine max
  Peptide Sequence Number=SeqID_177703
atggtggtgttggtgttttcgacgtggtggctgaaggagcgggtgcgtacggttcccttggtggcagcgttgttgtcgtcaagcaacatggcagtgacgaggggggagagcaccctcttggcgcggtggacctggccgtcaccaacaagggtttgtttgaggggccgtgacggcaatcttggtgaggcgatggagatccttgatggcgtcactgtcgagggtgttggcattgcagacctctacaacgcggttgagagagaagttcaaagatggagtgaggggagtccacaaaggctagggcgcaagctgagcaatcacaataaaaataaaaactcacctcattcaaagacggtttttgaaaacgaccgtctttga

SEQ ID NO: 86019 - DNA, 186 bp, Glycine max
  Peptide Sequence Number=SeqID_177704
atgtgggtgtcgacggagcggtttccggcagattttgggcgggaggagaaagagaacagcgatttcaggcgggaggagaaagagaagagataccaagctgcagtgaaagaaaaagaaaaagaagcacctacatcatataataataataataataataataataataataatggcaatgcaatgtga

SEQ ID NO: 86020 - DNA, 471 bp, Glycine max
  Peptide Sequence Number=SeqID_177705
atgaacgacgaagaacggttgaaaatcttcgcgaaatcacccacgaaaacgaaaataggggaggagcttgccacccagctcgcccaggcgagccaagttgcttcctccagaagcaaccaccttgtggaggaacatcctggaaggcccaacatgttacggaatctcacgaattgtgtaacaatgcttccttttgatctccggcatgtcacggaacttcacgtaatgtgcaacaaagggtgccaagtacctcgaagcggtcaaaaaaaggttgcatgccatcaaacaatggactactgcataggcaaactggtaaacaaatcgaacttgcccaaaaacaaagcagtgaaagaaaaagaaaaacaaaaaggaagaaggaaatacctaaagaaagagaaatgtgaatccgaaaaagaagaggtaaatgtggcaatggaggctgagatataccctacaggaacgaccgcgatatag

SEQ ID NO: 86021 - DNA, 291 bp, Glycine max
  Peptide Sequence Number=SeqID_177706
atggagttgaaaacactttggcgggagatgagtcggttggagacacgtggagcaacattgttccaactatctcggtggagtatctcggatagactgagcctgagatacatccgtaacagaaacttagttgagggcatttcgaaggctaacatggattttgacggtctcctcggttcttctttacgggataaccattccttgggaccgcagcctactcctgaaggtggttttattcagtcaggtgccaaaaggctgcttgtggagggagtgaaattaacttgtaggttttga

SEQ ID NO: 86022 - DNA, 642 bp, Glycine max
  Peptide Sequence Number=SeqID_177707
atggttgttttgtataaacttccttggaatcctaatttcgagtgttttatccttgcccttttttttccatggacaagttttgattaccaatccgtggagaaggatcaggccgagaaggcagctaaggccaaggatgagaaggcaaaggccgagaagtctcaagttgacaaagcacgggccgagaaggctcaggttgagaagattgctattgttcggggaaagcgaaaggagaatcatttggatgattgggttccttcaccttacactagggtcatcataagggactcctctactcttcaggccctcattcaaaattccatgcttggtcctactgaaattgatatgctaaggacgaccaaatctcgaaaggaggctttaaaggcctctgctgcagactcgacaaagaccttgcaagaggaggttgaacatctcaataaggagttcgctcttttcaagattgatgcagttgcagcagaggagaaggtgaagactaatctcggtgatgcaaaagctgagatcttgaagctcatgaagttgggtttcagaaggcctgtcgataggtcaaataaagatgtaaatggccaaggggagttggtcaataaggcggatatttctgccaatgtgatgcttgagtcagcctaa

SEQ ID NO: 86023 - DNA, 405 bp, Glycine max
  Peptide Sequence Number=SeqID_177708
atgtcggcgctagcgatcctaatcccaatcctcgtcgccaccgccgacgcggacgcgatcgtcagcggcggcgttcccaagggacttccagtaggaattgactcggttggcgacctcggagaactggtgcagcacggagtcccagccgctgcgtttggcgtcggcactgcggtcgttggaggaggaagaggcgaggcagcgataggggggttacgatgggaacgagaggagcaagggcgtccgttgttcggggaacggaacggcaagcttctgcgtcgggaaggtgagagttggtgcggaaatcgaagaagaagccatgagagagagaataaaagagtggatatgcgtgttgttgaagaagaaggagattgggaatatactgtgtgtgttgaaaatgtgaagtga

SEQ ID NO: 86024 - DNA, 549 bp, Glycine max
  Peptide Sequence Number=SeqID_177709
atgcaagaaagagttcagagggaaacactcaagaggattttggaggataacgcatcagcagagtacttgcagagtttgggtctcaatggaagaactgaccctgagagtttcaaggcctgtgttccaatggtcacccacaaagaattggaaccttatatctacagaattattgatggtgatgcttctcctattctcactggaaaacccatcacaaccatgtccttaagtttttggatgatattcttgcagttctggcactacccaggggaaaccaaaggagtttcctataatgttgtggtgacagtgaagcaggatgagattgaaattagtggtttgatcactggttttggtgatgctatgcataaaggattcgtgcttgattggatgagagctcaggattgtgtagtgtgcgaggagtctaatggctattgcaaattcgaccaagccactaagcaatcgagggcctgttgccaccccttgatgctccacaccatttgcgcaaacatgaatggggtccttatcgagaagggattggttgagcttctttaa

SEQ ID NO: 86025 - DNA, 446 bp, Glycine max
  Peptide Sequence Number=SeqID_177710
atgggtgttggagatgacaatgttgatgctggttggctaggtaggcaacgaatagctttagcattacatgctgctgctgatattttgaggataaaagacttacttgctgtcatgacatttctaatatcgagaccactgattcttgatgctttctcaagaatgccaagaatgctgctagctgagacttttgatttagaaacaatgatgtttccggatcagcaggtcttaaaaattccggttgatgactcaggtttgattgttagttgggttaatgacccttcaagttttgatttctgggtagatgacccagcgtgggtaggtgtcccagaagatgttgaggatgcctttttggtggttggctctggtagagccagtattgttcctttgctagaccttcctcctctaccagaggagctcgtcgccttaggcggcatcagtgtttctct

SEQ ID NO: 86026 - DNA, 165 bp, Glycine max
  Peptide Sequence Number=SeqID_177711
atggcatattcagatcaaacaacggaaattaaatattacgagcgtacctccagccattgcaaattgaacacgaagcggcgcatacatgaacttgaaggtggttgcaaatatgttgcaaagatatgggttgaatgtggatggaaaatggaccagattcagaaataa

SEQ ID NO: 86027 - DNA, 612 bp, Glycine max
  Peptide Sequence Number=SeqID_177712
atgcctagtgttgtcgatgaggaagattcccaaaagggttcttctgggctttggatgtggaacatggtaaaaggtatcagaattgctaaaattattagaggtctgcttggacagaaggatgcattggatgacatgcccttttgtggttgtgcttttggagctattgatggatgtctttatgttctaggtggattttctaaatcttcgactatgaaattgaatggtgaattatatgcttttgatccttcaaattatgtggatagtggaaggatcaaggtatatgatcaaggagaggatgaatggaaagttgttattggaaaagtccctgtatatgattttactgaatcggagtctccatatctactagctggtttccgtggaaagcttcatttcatcacaaaagatgccaatcatgatatttctgttctgcaggctgatcactgcagtaatgtggattcttcaccatcaacctcagcacctcaatcacccaaatacatggaagatgaattgttgcgagaatcagccgaaacaaatgaagttgtttggaaactagttgcatgtaagggttttgagcaggctgaactgatcaattgccaagttattgatatctag

SEQ ID NO: 86028 - DNA, 408 bp, Glycine max
  Peptide Sequence Number=SeqID_177713
atggctcctgagtatgctatgcatggatatttgacagacaaagcagatgtttatagcttcggagttgttgccttggaaattgttagtgggcggagcaatatgattcaacggcagaaagaagaagcattccatcttcttgattgggttacagcgaggatcaacgtgtctcttttatgcaccaatgtcacagcctccctcaggccaacaatgtccttggtggtaagcatgcttgaaggtagatctgtggttcaggaggtgttttcagagtcaagtgaggcattggatgagaagaagttggaggcgatgcgacagcgttaccaagagataatagaagaaaataagttaactgagattcaatggatgacacattggctgcttcatcatctgcaacagatctctatcctgtaa

SEQ ID NO: 86029 - DNA, 437 bp, Glycine max
  Peptide Sequence Number=SeqID_177714
atgaaggttacagcccttaagcaaaccagcaatgacatgattgctcatgtgggtaaggctcgggctgccgtggaagagctgagaaagtttcttgtggctgattcattagaagaagtgaacaggaaactggacaagttttacatggtccttattctgagaagcttacactcagactttgatcatgttcgtgatcaagtactcgttggggatcaggttccatccatggattctctcatcactaggcttctccgtgtgcctcacttatcgaaggatgaaaatcctactgatagtgtggagacgtcagcaatggttgcatcacgtggtagaggaggcggtcgcaacagcagaggaggccgcaatggaaggggtggacgtcctcattgcacctactgcaagaggatgggtcacacccaagagaattgttattcgttgcatgg

SEQ ID NO: 86030 - DNA, 671 bp, Glycine max
  Peptide Sequence Number=SeqID_177715
atgggaggagaggaagcgtttttcgcttacggaagaaccttcttccgtatgcgtgattgtttgaaaatgcttcgtatggaagaaggatcttccgtaagttcctatggaagaaccttcttccataagaatttacgaaagaagatcatggttagaacaagaggtttaggtcgtgccttagctagtgttagaggcagagacatgggtcaggatgagcatcatgttgatgttcgacgacagtgtaggcctatcgcttctgcccataggcaacaggttcatgttgatgttactaaggatgttcctcaggtgactgaggatgctcctcatatggacgaggatattcctgagaggactgcgaacgtagatgctgcagacgtagaaggcatagctattgatggtgctgaggggtcacctgctgatcatgctgagggattccttggtggatcatatgacccatcggtcctgacttcgtttgccgaccatgtggcacatagcatctggagtggagaggaacaacttgagttgaagttggcctcccacggtatgaaggttgataaatttgggaggccagcgcctgagataaaaggcctagtggcggccactggattaagtccattgatcaggtgttctgtagtcaccggcgatcctggacttatattcgcatttgtcaagag

SEQ ID NO: 86031 - DNA, 180 bp, Glycine max
  Peptide Sequence Number=SeqID_177716
atgtggtgtgaacaagaagtttatatggattatgaaaatgaacaagaatgtggtgtgaatgaaccgtatgttgattgttcggatgcttttaatacttctcaggtctttggtacccgagatgatgttttgcagtgggctcgattagttgcccataaaaacggatttgttcaatcattatga

SEQ ID NO: 86032 - DNA, 625 bp, Glycine max
  Peptide Sequence Number=SeqID_177717
atgactctcatagggattttcgcagtcatcttggtatatgattcattccctgatgcaccttgtgacttgtgtaatggattccatggacaacaccacctcttttccaagaaccttagacatgatggtctcctagtccttgagttaagcatttttccaaaacatcctaatgagttctgggtcgagtccctccaacatttcaatatcgaaaaagtgttcaatatgaacaatgggttcaccttcagggtagatggtggtggcatttatggtgatgatggacatggcaggaacaatgttttagttggagtttatcaagaaatcatgagaatacttgcaaagatagtgaagatagaccattgccctaatttgaaggagtttataaaggaatatggtggatggattgatgaggacatgttcaagagcaagggcaaggatccacttgaaggacttggaggacctatgacaagggctagagcaaggaaagccaaggaagctcttcaacaagtgctgtccatactatttgaatacaagcccaagtttcaaggagaaaagtccaagggcccaattggcaacctaggcatcagccttttgggagaccaaatggtggctgacttgttggctgttgggg

SEQ ID NO: 86033 - DNA, 789 bp, Glycine max
  Peptide Sequence Number=SeqID_177718
atgaagagtctagaccttctcttccagtccagtctaaagaaggcttgtccacagaccactctaatgaggagaagtcaacaacaaatctctgagcaagcctctaaggctcaaaagctgagggatttgaaggaaacaaaggatgtgggacctctaataatcctaaggaagcacaaagtgaagcaagaaaggaagaaaaaatttggacgcaagttcatgcctccaaaggaatccatcaagataccatcatctaacggctctagctcgtccgaaagtgaggctatgcctccaggtggcatagtggctttagatactccctcatggatgaggctaatgtattccaacccaaagctgaaggaagttatcacttccaaggaccctttaccaaaacaccatgattcactccacctgctacaacaatcagactggaccccacttctcaatccaatggtctatggaggaggcattctgaagcagatgtacatacctgaccaggccactgcttatccctctaaactccacattagtagatgcattgacatcaagatggtgcgtgacagaacctacccaaggctacctatctatgatgaggggaagaagggcttcaagctctacttcaacaaagaaattcctaacaaaggtcagaaggtcaaaagctcatcaaagagcttgatgttgatgatgttgactttatggaatcaaaccatgtggaataacaccaagggtgcaagctcgtccaactctgagcacatgcctactacaaaccaagtataccactttgatgatgcatag

SEQ ID NO: 86034 - DNA, 291 bp, Glycine max
  Peptide Sequence Number=SeqID_177719
atgaagaacggtggaaaaccttcgcgaaatcgcccacggaaacgtctcgaaagcgttaaggaaggaaaaagagggaggtggttgccgcccagctcgcccaggcgagctggattgctttcaccagaaggcaccgccttctgttggaacatcctggaaggcccaagaaaccttatggattatgcaatcgtcccctttttgacttctagaatgtcacggaacttcacggattgcctaatgatggatatcaagtacctcgaagtggtcaagcgagggtcacatcccaacaaatag

SEQ ID NO: 86035 - DNA, 192 bp, Glycine max
  Peptide Sequence Number=SeqID_177720
atgaagcaacatattgggttggaaactaaatatcctataagaggaatcagaactcaacaatttgctagaaggtatatgataatcagccagcacttgaacttctggccctgcttcaagaattgtaggggcatgaataaaaattcctcaaaatgtttcaggacctccttccttggagacaagctctggcactga

SEQ ID NO: 86036 - DNA, 435 bp, Glycine max
  Peptide Sequence Number=SeqID_177721
atgtggtttgtcaggctaagcgagggtgtctctcttagccagagttataaggcctccaaaaagaggaaagcatcagcctcccgacctcgagaaccatacgacactacaggatttgtttctaaggtcgcttgggaacgatacgcacagaacgttcactccaggaacatcattccaaagaggaacatcaccctgtacatctccgagtatgatgagttcaattgggaactcgagcagcggcaatggcatagagccttgaccaggcagcctgacaatcacattgatgtggccctggtaaaagagttctatgccaatctttatgatctagaggagaagtcccagagacatgtcagagtttggagcaaattgattaagtttgatgttgcttccctcaatgttttcctgaagacaccgccagtcatccagctaggggagtag

SEQ ID NO: 86037 - DNA, 921 bp, Glycine max
  Peptide Sequence Number=SeqID_177722
atggataacagcggcgcttggtggccgaaaattgcctcacggtggcagagactaaaatcaaaggggttttgttgcggacatggagatgaagtgatttatggtggtggtttcttgcattttgctgtcgtagccattagaggcgacggcgaagcagcagaagaaggagagggtgatggaggttggacaaggtcagcattgaatgctgcagccacagtgttgtctacaagcttcaatgttaatatcacatcagataatgtcaaaaaccgtatcaaattatggatatcgtggtatggtattgtaagtgacatccttggccagagtgggtttgattgggatggcactaagcacatgatcacagttgagaatgaaaatgcttggagtgaatattgcacttcgcataaatcggctaaaccgtttcgattcgaggtgcttcaaaactgggatgatatagtggatttgtgtgctaaagatagagccactagtcataaagctgaaatggctatggatgctgatgaagcgatgagtagagaaacaaatgaagtggaattcatggggttaggtgctactactaccatagacttagaagaaccaagctctaatccaaaaggaaaaggacaaggttcaacttcttcgggcacacattctcacacgagaaggatgggagaaaaggaaggaatagcagcttctttggataaaatggtcaactcttttaatcgaatggtagaaaaaatggatggtaaagtcaatgatgaagatattcaagaagtgttacatgaggcagctttgataccaaatcttaatagacaacaatgggctaaagctattaaatggttagctgacgatccaaagcagttagctatcgtgaaagctcttccaattcacaagaagacaaattatgttttaacacatcttgcagaatga

SEQ ID NO: 86038 - DNA, 1065 bp, Glycine max
  Peptide Sequence Number=SeqID_177723
atgggattaggttctgaccaggctccagagaagaggattgatgtcgctctggtgaaggagttctactcaacttatatgatccagagaaccgaagtccaaagttttgcagggttcgaggacaagtggtcagattcgatgcagagacaattaatgatttcgtcaacacctcggtcatcctggcagatggggaggagtacccagcttactcccagtacctccgcactcctccagaccacgaggccatcattgctaccttgtggcccgactcatatatggctttgtgatgaagagggacctgaacttaggcagcttcatttctctgcagatcagttagatcgcccagtccagcaattccaggcttgggtttccaacgttgatcacaatgttgtgggtccgtcgcacacgcaccagagccccaacatcagcatcagaggctcatcttcctccataacctccttctcagccttcctctcagacacctattcttccaccgtcatccactttagcaccgctggatatgcatggacagatgttgagcttgttctgaaaagtccaacacttgagatgctactgatcactggagaaacattggttctggaagcaaaagtcagctatttagccaaaaagccaacccaacataattctaccccttgcacccatgttgagccaatagattattttgaattgacccttgagcgaaatattgatagtcctgacctttttaggattctaagagagcaaaagggttgtaaagggcagaaaaaaggaggtgtcaaaggaaaagtgttgtggagaaataaaagggctaagtgtaacaagcaaaaagcaagaaaaaaaactgaagaaaagaagaaaattggaagcaggcccagtccagtacgcgcgcttagcacatgtcatgcgctaagcgggccaggaagcacagacactaagcggggcgttaaacacgaagacgtagaattcattactcgcgctaagcgtgtgattcaacagaagcacatgctaagcctgcaacacacattaagcacacgatctaaatgcgctaagtgcggggtgtcgtgctaa

SEQ ID NO: 86039 - DNA, 499 bp, Glycine max
  Peptide Sequence Number=SeqID_177724
atggatcatgaggatccatacacacatttgtctaccttcatggaactatgcaatactatgggagtttctgatgaagatgctgaatttgtctaccttatagcttttccattttcattagcatatgtgggagagatctttgttgtggaggtgccaaaccataactttgatgatgctgcacagttgtatatcttctatagtggtttgaaacctcaaaccaagataattcttgatgcctcaactggaagcactatgatgtccaagagtccggaggaagctattgtaatcattgactccatagcaaccagtgattatcaaagtcatcgtgatagagctccgactcaaagaaaagccaaacctcaacaaaactttcaaggaagataccaaggctatagaggtggttcaggttcaagtcagccttatggttggagaccacacaataatgcatattctggtccaaataacacttcttttgcaagtccttctaacaactcgtatggag

SEQ ID NO: 86040 - DNA, 591 bp, Glycine max
  Peptide Sequence Number=SeqID_177725
atgagagaagtcaacaaggtcgaggtagaggttgaggtcgcggatgaggacaggttggatgtggcaatagaagatgaggttcaaatttcatcaatagcaattacgagaaagaaaaaagctcaacaagagaacgtggaagaggctatagaagcacaagttgaggaggagactaactatgtggagcaaaaagatgggaagtttgaaacagttctcctagcacatggaggtaataaaggtaaccaagaaaacacatggtacctggagactggtgcaagcaaccatatgtgtggaaaaagaagcatgttcgtggatcttgatgagtcatttatctatccaactgatcttcaacaagaaatgtatggggaaagagaccacaagaagcatggagtagaagaaagcctgaaacaaagccaaaaggaagggaaaaatggtcttttcacaaagatttttaaccccaatttctcccaggctagcaaccagctcgcctgggctaaagatcttacttcatccctaagcaagcaacttgcctgggcgagctacagctcacctgggcaagtggatgccttcaacagtaagcaacaaattccctag

SEQ ID NO: 86041 - DNA, 789 bp, Glycine max
  Peptide Sequence Number=SeqID_177726
atggccaacaacccctctagagctcagaagaaagccaaatcctcgaaaatgaagcaaggagagtgttctcaaacaactctcaacaggctggatatgtggttcactaatgaaatcaataagactgatttcaagatgatctatctcatgaagagcgtgaaaatactcaagtttctggacttggaatggttctctcagcagggatttaactttcccagagttgacaaattgtactctactgtcaatagtgtagagatgatcattgatgctacagtttggaaagtagtagcaggactagacatgggtggagtctgcaagtttgaggaatctacggatggcccaacaaggaatctaagaaatcttctaagagttggtggtttaacagctgaagatagaatgttagtgcatctcattacctacattcttgcaccaaggtcacgcaatcatgaacaagttaccaacgacgacttacaaattgtacatggattgaaatcaggtattcaaatgaattgggtacttatgattgaagatattatgttaaaaagtcgtcgactagtggattatgaattaccatatgctgtcttagcctctagattcatcgattacttcaatattgatgtttctaatgagataattgatttcacaaaagccttaaatgagataatcaaaaggcatctcaagaagcttgggatgagatatgttgatcatgaatggattatggcgggagagccacaagcaacatcaaacatcaaccaaatggaagaagaagcacaacaagagcatgcacaatag

SEQ ID NO: 86042 - DNA, 471 bp, Glycine max
  Peptide Sequence Number=SeqID_177727
atgaatttttctagccaagcctcactagaagttgagaaagtccttctgcgagcattcgctaagtgcgacactcagtggctaagcgcgaggaagaatccaaaagaagatgagctgtcaggttcactgagtgcaccgctccaggtcatcaagcgcaccgcttcagctcatccactaagcgagagaagcgtgctgagccaaaaatcactaacgtgcgctaagcgcacgagcacgaacaaggccacctatttaagcctgaaatcagatttgcaaagggagtttggagtttttcttgaaaaagcctctacatgcactcgaatctggccctggcttgaagcttttgcatgtttaggaagttctagagagagaaaggtccaagttccaaagagttctgagagattttgctgtgtgaagatctgtaaagatgcgagtacgaagcggaagccgttctgtgaacttgagatgagtttatga

SEQ ID NO: 86043 - DNA, 532 bp, Glycine max
  Peptide Sequence Number=SeqID_177728
atgtctatttggcaaacctcagtccacgtgagcatcccaatgtggcaatttgctcttccctccactacattccctttgtcggtgattgttcatattcgggcttggcagtcagggttttcatttgcattgtcttcgcgtttcgcagagagaatgaatgacaatataactttaatattgcaccatggaggaagattcactccacgtgccagtgatggaaaggttgaatatataggcgaagaatttgacgtttgggaggatatatctgcagatttcctggatgcatttatcttatatgatctggtgaaagcttgtaagaagtatagcaatatgggagattgtttttggttgattgataaggacttagtgatgcaatcctaccccgcaagggcattggctagaagactccaagtagattgggctagagatccaaggaaaggccctagggttctcatgagccttaggctaagctctagcttctttaggaatcttcttaaggaagcttctcaaggaggtgagcttagttatgagaggg

SEQ ID NO: 86044 - DNA, 772 bp, Glycine max
  Peptide Sequence Number=SeqID_177729
atgggatcaagtcaaatgccttcacttaaaaagaggttctatcaagtcaaggacctagccatggtagaagtctccacagaggccattgcttccctcgcccagtattatgatcagccgttgaggtgcttcacctttggggacttccagctatcatccatggtggaagaatttgaagagatcctaggatgtcctctagggggagggagaccatacctcttctcagggttttatccatcattagctagaatttctaagatagtccaaatctcggcgcaggaattagaccacagaaagaaagctgaaaatggggtggttggaataccgagaaaatatttagaggcaaaagcaagaatcttggcaagatttccgaatgttcccttgatggggacgaggggttgcatcagttacaatcccgttcttgctataagacaacttggctaccctatgagaggggcaccactagaggaagagatcgcgcccgtccgcaaggcatgggaggtggtgcgaaagaaggacaaagaactcaggggcagtaacaatgggcccatcggtggctaccgtaagtggttaaaagcccacttgcaaggtttggattggcttccaagtttgagaaccgctaaaagagaggaagttgaggcatcagaggaagacgaagaggagaatgccaaactgagggatgtaaatatagctaccaccaaggccttggaacaagagaccaagagggctcgtagggaagagcacggccggaacaagttccaaggggctctgtggg

SEQ ID NO: 86045 - DNA, 123 bp, Glycine max
  Peptide Sequence Number=SeqID_177730
atgatgatgatgagtttgggtgtggcgcgatgtgatcgacagtggtggcacgacgtggtcgacggtggtggcacggtggtggtggtttccattgaagaaggggataaagggaaaaaggtataa

SEQ ID NO: 86046 - DNA, 792 bp, Glycine max
  Peptide Sequence Number=SeqID_177731
atgtggcattggggtatagggttttatagatggccttgtttgagccgaagtgaatttattatttatttagaaaagttttatgatgatgttataaagtacatatatgtgtggggtagagggtgtcacagattggatttggaccagttcaagtcctttggatatgaagacttagcaatctccacaaaaagtctattggactatggatgtttggaatcaatcttgattccttcattagatagatttgaaggatttaacccctcaattaatgaggccataaacctaatacaggcagaaatgatggattacattgccatcaaaagaataatttgcttgagcaatttctttgctcaaaattatccctaccatgttatgaaactcctactagaggatcatagagactttccctgcctgttcaatgatgaatacaagacttgggatgtacaaggtaacacacagtaccaatacaacctcatgaggccacaaatacaagggaaccaatggttcttctcagaatcagacaaacgagagtttgacctgataagagaaacctatgatacaaagttgttccaaccatcatacaatgggaagttcttcattcctttcccaattgaccacaacaacaaattggttcatttcttccaaaaagagaagaaagataaagagatttacgaagccagtggatgtcatggacaacaaactcctccttttccatccactgatctctcaatggaggactcatcagacatttctgctctggaaatatccaagacgaagaagaaagcgttactataa

SEQ ID NO: 86047 - DNA, 462 bp, Glycine max
  Peptide Sequence Number=SeqID_177732
atgcagtctcagtttcagccgcagatgcagtctcagtttcagtcacagatgcaatcacaaggactcacactgcctcctaagcctgaggttggtccttctgctactcgtgtcagcacaaatgagatttgtgttaatccctcagggaatgatcaagaaacgggtgactcagaaaaatacgggttgtgcgtcgaagaaaatcctccccgcctagttgccctaggaagactttatgagggatccacaatcgttcacaatattcctttgctgcatgatcaagtcaaggtttgtgttgaggaggttagagatgcagatgctcccattcttgtacccactgaagaggttaagttagtggggcagacacttaacacctttcttgcttggccgacacatcttgtcaagcgtttattagaacaggcatatgacttagacaagtatgcgagcggggaataccgatgtgtatag

SEQ ID NO: 86048 - DNA, 198 bp, Glycine max
  Peptide Sequence Number=SeqID_177733
atgataggagatgaagatgacagaggaagaggaagacgaagaagcggcgtaggaggagaagtaacaagcacgggaacaggaagaggaagcaacaagtggcgtaggagaagaataggaacaagcaacaagcaccaacagaggaagcggaagaggaagacgaagatggcaaaggaagaggaagacgaagaagcgacgtag

SEQ ID NO: 86049 - DNA, 177 bp, Glycine max
  Peptide Sequence Number=SeqID_177734
agggtacatctacttgagttgttgactgagaacaagagagggtacatctcttgtggatcagttctagtggagggtacatccactaggttgttcaaagagaacaagggatggtacatcccttgtggacctttgcttgtaaaaggatttttaacaggaaaatgcaaggatcatgcatga

SEQ ID NO: 86050 - DNA, 249 bp, Glycine max
  Peptide Sequence Number=SeqID_177735
atgaaagagatattccaagagaacttcattgccaaatgctctctcaaaagaaactcttgggcaaacacttgcaaatccattaagagttcatccatggacttgaattgcctaaaaagaggcaaatttgattatgctgctttgatgaattctggtgatatgaggcccggggaaaatggagggaataagaaggagggagaaacccatgttgtggctgccattcttgcatggccgaatttcccattagcctaa

SEQ ID NO: 86051 - DNA, 255 bp, Glycine max
  Peptide Sequence Number=SeqID_177736
atgtctgctaaaggtgctaccaatgctttgagaaagctgctagatcaatctgtgcatattttcagtaatcaaaatagtcataaggagagtgcctctgttggtcatcatgttcgtgttggtcatctgcctgcgggtcatctacatggtcttgctagtgttggtgttgttgttggtcttgttgctaccggtgaagttgttgttgttgttgttgttgttgttgttgttgttgatgatgatgatgatgatgatgaataa

SEQ ID NO: 86052 - DNA, 531 bp, Glycine max
  Peptide Sequence Number=SeqID_177737
atgaagaaggaatctggaagagcacctgaatcgaagcagcgcgttaagcgcgagatcagcttgctaagagcatctagtccagatgatgtagagcctccatcatggccatcgcctcgtcatctagaacttgcatcaactatccattcacctttctatggagcctccactgatgatgccaaaggcttttctacaaaccgcatcaactacactgtcattgaggttctcaaactcaaggcccaaaagcccagtcatgctgacgaacatgccctggttcaagttcctgcagccgatggcggtgttccggatcacgatttttcacagcatgattgtttcaagagcaagctagcctctggtgcaagagttatcgctgcaagggatctagtagtggtagcggccctggtggcagacgacgtcatcgagctggtcgcagacggtggaggagtaggggatggtggcaaaggaagtggagagggtagggttgaagatggggtcgggattacccatgcctacaagtggattacccgtgtctaa

SEQ ID NO: 86053 - DNA, 540 bp, Glycine max
  Peptide Sequence Number=SeqID_177738
atggcttcccgcaaaagaaaggcatcaacctcagcatctcaggcccactatgatagatcgagattcacatcccaagaggcctgggatcgctattctgacattgtgattggcaggaagattcttcctgagaggaatgtaatgatatatcatacaaaatttgatgaatttaagactgagttggaaagaaggaattggcacaaggagttgaccaattttctagacgagagcatcgatgttgctatagtgaaggagttttatgctaatttgtatgaccctgaagataaatctcctaagcaagtaagggttagggatcacttgataaagtttgatgaggatgccctcaacactttcctcaagatgcctgtgattattgaggagggggagagcctatctacctactccaggttttgtagactgaggccagatccccaagaattggcagcccgattatgcatccctgggaggggatttgagctaaatacagatgggctgcctttgaagattttgcggaagaatttgaccacactggctcagacctag

SEQ ID NO: 86054 - DNA, 459 bp, Glycine max
  Peptide Sequence Number=SeqID_177739
atgatgacaacaaaagatgatgacaaaggtgatgacccaaaaagctcaaagatcaaagaacaactcaaagggtacatctacttgggtttgactgagaacaagagagggtacatctcttgtggatcagttctagtggagggtacatccactaggttcaaagagaacaagggagggccactcgatccaacagatgatccttgggctaatctaatcagagctagggtgctcaaaggaaataatcttcctagaatctacattaagtcttctatttggcctgggataaaaaccttttggggcatgccttctaattttggaacttcatccttcggacaagcaatggatttcctcattcctctaggaaatgtggttccttgggctaagctaatctggaataattgcatcccaccaactaaaactggttttatggtgatacattctcaacaagattcctacaaatga

SEQ ID NO: 86055 - DNA, 183 bp, Glycine max
  Peptide Sequence Number=SeqID_177740
atgcagaagaaggccgaagaacttggtccttgttctccaaccgaatgtggtgcatcaaactattgtaaagaagctaaatatgatgccactgaatttggtgtattcaaatcgacgccaaataaattggtcatccattcatggctggttacgctgactgactcaccagtctggccaaaagtttga

SEQ ID NO: 86056 - DNA, 414 bp, Glycine max
  Peptide Sequence Number=SeqID_177741
atggctgaaattcttggatggaatcatccatctttgaagatccctgaggcacctataccttgcatgatgttttctttcacatcatatgaacaagagtttccatctcttgacagaaagacatacccaatgacaaggactgataatgctagaatccagaatcatctcttgaagaagatagatgataagattgacaagatctacacccaacaacaccggatgaaactcatatcatcttcaagccgagtgatacgagtatccatcgcatcaaagtgctcaccaacaaatgctcgaagatcacagagctctgtgagaacttcagtcaagagagaagaagaagcatcttgctacggtggtggaaacggtgtacactcatctggaatgggaggcggcaggtcttgcttatggacccactga

SEQ ID NO: 86057 - DNA, 459 bp, Glycine max
  Peptide Sequence Number=SeqID_177742
atgcctcacgcgtcgtgcaattctggataccatcatgtgcgctcatcgaaacctcactcgccgcctcacacgtcgctgcaactacacatacattcgcttcactcaccttcttgcagaatgcgggttgacagaatcaacgggatccgattcatcttcagcggaggggctttaggaagcatcttcttcgtggtttttgaattggttgttgttggcgtgccggaggcggtagaggtagacggttccgatgtcgccgacgccgatgtggcggaggaggtggaagtcgcggaaggagagggcgaccttgtggaggaaggtggcagagcggatggcggagtaggcgaagttggaggagtagtgaggcttgatggagagactctccggcgaaggaggcacgatgatgacgaattgaggagcagaggagttgtcacatggcagaggtttctttggagcattgcttaa

SEQ ID NO: 86058 - DNA, 255 bp, Glycine max
  Peptide Sequence Number=SeqID_177743
atggatacctttaggtcattcatgagtgcagaaacgtgcaaaatggtgttggtctgttttttgatgggtaccgccattgaaattggcgagaagcttggtgctgccattgaagatggcgagaagcttggtatcgccattgaagatggcgagatagcagcttacgtggaggtgccgcccgtgctactggcgagacacatccacgaccttgtctcgctggagccactggttgcacaaggccgtggcgagaaagcttag

SEQ ID NO: 86059 - DNA, 273 bp, Glycine max
  Peptide Sequence Number=SeqID_177744
atgacagcacaaaaagaaacagctattctcctgtcctctaacatcaaggatgtttattctataagaaaaagaacagaaaaaaaggatgtgacaacaccgaatactctcccttatgttgctagagaggctgatctctacccatgtttacagcatgaactccgcatagcccctcttcagtcactaggaagtttctttaacaacacagaggaactggtagaggagaaatggggcaattacaagcctgagcaattgtactattctggtttttcttga

SEQ ID NO: 86060 - DNA, 486 bp, Glycine max
  Peptide Sequence Number=SeqID_177745
atgccacacattaccaacactgctacacaagaagaagagatgatagaaattgtcctcactagaattacatcttcggcaaagcaccgccctgtcaaggcggaagctgcgggttcgagcctcggaagaagaagacaaacacaagagttttatactggttcgacaacaacccgtgcctacatccagtccccaagcgacctgcggtgcttgagatttcttttcaaccttgtaaaatcctttacaagcaaagatccacaagggatgtaccctcccttgttctctttgaacaacctagtggatgtaccctccactagaactgatccacaagagatataccctctcttgttctcagttacaacaacccaagtagatgtaccctttacttgtaccacaaaggatgtaccctccaatgtgttaagacaaagttctcaagcgattagtcctttgaaactttgtgaaggggatacaaaagatatctcaggcagttag

SEQ ID NO: 86061 - DNA, 171 bp, Glycine max
  Peptide Sequence Number=SeqID_177746
atgaggaagttgagttctatgaaaaataaaggcaaggacgttgagtcctatggaaacataaaagtgaggacgttgagccctatggaagataaaggcaaggatgttgagtcctatggaatcataaatgtgaggacgttgagtcctatgaaagataaagacaaaggactttaa

SEQ ID NO: 86062 - DNA, 1053 bp, Glycine max
  Peptide Sequence Number=SeqID_177747
atggaggatattggtgagatggtggaggttgatgaatacgtggaggaacgtaaaaggatggacgtagctcgaactctcatccggacaaatcggagattgggcttccaggagaatgtacgggccaccattgatggggaggagcatgaactcactgtcgtggaggacatgagtagcatgggcgccaaactgaaaagctatcagaataatagctggttccctccatcaccaatgtcgacgcagccaaacaccccagtacccctcgccgacaacactcctgggcgtgactccgacaacgacgacagtgacgctgactttgatgacgtggatgccggcgttcctaatcactggaacaatttccgttcgtccaaacaacgttcgtccaaaccgcgccgcgaccactgggtaaaatcccttggtcgttccccttcggtctggtccatcagggacgcggatgacctggaccactccaaggtggtcaatgccgggggatatccaacattaccgtgtggtgtggattccgaactccacaacggtcatattacccagagtgtagtacaggaggggaggacaggacagacttataaggagaaaaaagaaagttcagacatagatgcagaaggggacagggaggaggttcggcctcttgaggaagactacccacatagggctgacacccttaaactgaagaaatgtggagccaattttccttttggtcaacatgatgtaaacgaagctataggggaaatgggccagaagttaaaaggcccaattaagtcagccacaaaggtatatgttagaagaaaagaggtgctgttaaggcatggaaaggcccaacactttcaaggaccagatgcggaattagatttggtcccaggagcagattgcatgcctgcaattcaaggagataaaactgaacaggagcttgctttagtaagagaactgggcctcacttacgggggagatgacaaggagatcaaggaaactttgctagatatggataacagagacactatgaaggcagctgagacgggaattaaaaaacagatattatga

SEQ ID NO: 86063 - DNA, 153 bp, Glycine max
  Peptide Sequence Number=SeqID_177748
atggagatactggtggatggcgaatttgatgctaacagattgtttgatgaagctgttttcttgacctggacttggcttagacattttgagaaacatttctcaacccatctaaaccaatgggcaagcaatattagtcaaggttttcttatgtaa

SEQ ID NO: 86064 - DNA, 969 bp, Glycine max
  Peptide Sequence Number=SeqID_177749
atggcatctacatgccctatttctcccttctctgcaactcccagtatcacaattgagaaactcaactggaaaaactatcagtcttggtctgattcagttgagttgtggttccatggtcaaggatactatgaccatctagagaaggatgtgaatgaagttcctgatgtcttcgctaatgacattcaatgtctgtttaattcaacccaaaaggttgtttgtctccaacagacccatcatgatatggtttcacacatggctaaagctagagctgcagtcaaagaattgaaagtattccttgtatgtgattctgcagaggaaatgaagaagaggcttgataaattgtttctggttttgatcttgcggagcttacgttcagattatgatcatgtgcatgatcaaattctgtctggtgatcaaaatccttcaatgaacagcctagtcactagacttctccacattcctactttggtgaaaggtgaaaatgcagctgcagctgttgggacttcagccatggttgcctctcatggtataggtagagggggttgtggtaatagaggaggaggacatggtggtagaggtggtcatggtaagctgcagaaatctagcagccaagctcaatcctcttcagtgccaagtgtttcaacagcctgtctttctcaatctatggaaggtcaaggtccatggatagttgattcaggtgcctctaatcacaattcttgtaataattctgatgaagaatatcaggagtacctgaggctgaaatctagcagccaagctcaatcctctcttcagtaccaagtgtttcaacagcatgcatttctcaatctgtggaagttcaagtttttgcatgatcgtcttggtcacccaagtctagcaaagttgaagataatggttccaaatctcaacaaggtaccaatgttgttaatggcggatggcggttcatggcggaaagccaaaaatccgccataa

SEQ ID NO: 86065 - DNA, 234 bp, Glycine max
  Peptide Sequence Number=SeqID_177750
atgggctcaaaatctatcctgaggctcatgagaaccctagggccttctcttgcatctctgggtcaatcttcttggagtcttctatccaatacccttgcgggagatattaatagtggtagtgatgggaactatgaaggtgacaataacaatagtagcgatgatggtggccataacgacaatgtagtaatggcggcgatgactattatgattgtgaggagtcatttttcagagtag

SEQ ID NO: 86066 - DNA, 198 bp, Glycine max
  Peptide Sequence Number=SeqID_177751
atgattgagcttgatgacgtgctactctgtctatcacacggaaaacaactaacgacagggaaaagagggttagtacaacatcaattggcaaaaggatttccaaagagtgaatttggaaatggattccctgcattcatgaaccagaacccttggatggttcacgtctccgaatgcgtcatgaatgtgggaattccctga

SEQ ID NO: 86067 - DNA, 672 bp, Glycine max
  Peptide Sequence Number=SeqID_177752
atgccttctataaatgagtctcccgacgttgatgaggtacaagcaactcgtaatgatcgcgatgaaggactatgggagaacattgtgacggtcatgggaacaccaccaccgtcacccccgcagtcagatgttcggtcagaggcaattagtccaaataaagtgactgaagctgttaaaccggtgaatgatgttgatgtagatgaccccttgcgtgacttgataaagagcctggttgtcatttatgagaagcttgttcagttgctgtgggatgctagtaaatttggaattccagatgttgatgcatccttgttcgtaacatgtgttgatgtcaatgaaatcatatcaagcgtacaatgtttgaacatagctattctacagttgtggaccatgtatatggatgaatggagtaatagcttggatcatggatcggtgtatggattccttgagccacaatcaatactcaatgcaaaggatggacgtggcccatgtcaagaatacatcgagaaatggcttagggaatcacacggagaggcagagctagcagtttccgatttttctggaaatggtgatgggatactatcagctgctaccacagttgctagtacttttctcttggattttgttgttgaatggggcgataagtcatttttctccacaattggtgagttctaa

SEQ ID NO: 86068 - DNA, 204 bp, Glycine max
  Peptide Sequence Number=SeqID_177753
atggtcatattgcaatcgacctcgaagcgcgcatccaccgctaagcgcagcttcaatgtgcttagcacgacagaagaatctggcaaggcatcaatatcaaggccacgtgctaagcgcaagatcaatgcgctaagcgcaacagttctcttcagccaggctcagtgcacgactgacgctaagctcaaatccacttactcgcgctga

SEQ ID NO: 86069 - DNA, 390 bp, Glycine max
  Peptide Sequence Number=SeqID_177754
atggctgtgtcgccagccgtgtgggcgagtcccacgtgggctataccgccagtcggactggcggctccagctgggtgtgtcgccgttcccattggcgacaccctcctctctccatcctacgtggccatatcgccactgctagtgacaatacacccttctctccacctttgccgccactggcaatggcgggttgagccatgccgccagtggcaatggcggtttcctccacaaaacaaaccccctccgttatttcttttgaaacagaccccatcccgtaaatactttggatgcaaaattctagttttcatagtaaaaagtaacaacttagcttatgttaaaagaagtgacaacgtatttgaaaccaagttcacaatgcataacacaaattaa

SEQ ID NO: 86070 - DNA, 768 bp, Glycine max
  Peptide Sequence Number=SeqID_177755
atgtccttacattacaataagactaatggtatgcaatttatgatagatttctttggtgcactcagggctagagtatatgatgatgaggtgaggaagtggatttctgttgttggtgttgacttcattgggaagaagcttgtgaacttgatgactttgagcaagctcttggagtatggtaacatgcttgtccaagaacaaaagaattttcccaggttcttccgcgagaaggataggaagcctgcggaagaaggttccgcaggttcttccacgggatccgcggaagacaatgttcttccgctggctcccgcggaagaacccgcagaagcttcttccgctggatccacggaagacaacgttctttcgctggcgcccgcggaagaacctgcagaagcttcttccgctggatcaagcggaagaatcttcttccgctggaacccacagaagaaccttttcacctttcttccgcaggagcccgcggaagaacaccttcttccgctacaatacccaatgtccactttcacacgcgcggaagaaggttcttctcacggaagaaccttcgtcttcaacctcaagcaccaaacatcactaatgtcgtctatcctacgaccatttacgcgattcaaacagagacgaggcgaagaagggaaccaaaatggagaacgaacgccggtgagaatgaaagcctgtggaggagaagaagggaaccaaaatggagaagcaaatgaccaacaaagcttgcgcgaaggaagaatggaagaagacgaatga

SEQ ID NO: 86071 - DNA, 339 bp, Glycine max
  Peptide Sequence Number=SeqID_177756
atgacgaacaaggccaaaggaaaaggcaaggaggtcgccggaaaaggttctaccggcaagcgcaagggtgccttcgacgatgacaagaccggtggcggtcgcaagagaaacaagcgaggacctgttcgaatgaaccagtctctactgttattatttttggattcgttgacgtgcaaacatgacacaggccacctttggagagtctcacacctttcccagataatttttaaaaaactccgaacaggggctcgttgtatcttacctctgctgactcttccacgcaaggttactgacatgacacgacacgacagtgaacgatgtgacaggaggttgctttag

SEQ ID NO: 86072 - DNA, 1950 bp, Glycine max
  Peptide Sequence Number=SeqID_177757
atggacaaggatagtccagtgtctagtctggtagctaggacaggcgtgggattgtcgagcttgtcgagccccccaaccaagatagaaaatgttcgagttactttatcttgggcgctttgtttcccacttacgctagcgggtgcgaggcacatgcagtacctcttcatgcgtggcactcgtggagtggccatgtttatggaacatatggaccgagaagtcatctccattagtggttcctcctcggaggagactcaccatggagtttctgacagtgagtcctcttcctcagagaggatgagggctttgtgctattctaacggtggcatttctcgtcttccaaagaagaatgttggtgaggattttagggtgtcccccagtgttaatgttgggtcgccgttgtcccaccctgttgtcgttggctttgaatgggtgaaggacgatgtcttgaaggcgacaatgggtagtccgcccttctttttcatgtataggcgtctctttgaagttctaggttttgccctccctttgacctcattccaatgtgctctgcttgagtacttaaatgtggctccctctcaacttcaccccaatattgataggcaagattggttgggtctccttgaacgcgtcatggctgatggtttgccactgatgttcagtcgggacggggagccccacttctcattttactggaaatctagccctaccatgtttaattcctttgataaggatttgttaacccttgtggagagggttgaaaaagtaatcttggatcatttgtcggcctcgttggatgcgcggaccattttgtcccttcttttggcgagtgatcccatcgccacattggacggtaattttgcttggagaaaactagtgaagcaggccggacctggtgatgggtatatgccttcatttgttgtcgttcctcctactgaagaaatgggtcaacttgctattgaggttgaccctgttgttggtgtcgaggtgtcgagtaaaaagaaatcaagggcttatctgagtcttcgagacttgagggatgttgtagggttgatgcccagtctgggtcactctttaagtttgcatagtccgcctctatctccatcaactattgaggctcctacccccgccgtcgctattgttgctctggctgctgatattaatgtaccagttgttatggctagtgcaactacgacttctttgtcccttgctgctacaccttcgctgagtgctagcgtggcagctgtgagttttcttcaaatgttgcctccttctgcaattcctttggctcccccttcaactgtatcgacatcgcctgccagcacttctcgcccccgcgtttacttggaccacatctacactaccaatgactctgattccttgtggagtgtgggttacaagccagagcagaaaacctcagttggctttgtgtcaaccttcaataaaaatctcattcgggggttggcgatcttagaggaaaatggacaccgccaccaagaggctctgaacaaggtggcatccttggaaactgaggttgccaagtggagggctactgctcgcacggtttggagagtggagtgtccaaagatggtgatgagttgtatgatagcacttgcatgtgaaaaggctgacttgggtggcaagatagagggtgttgcggtcaagaaggatgagcttttgaagatggtgtctgaactcgaggctaggctaaaggaatttgagttggaggcgtctaaagagaggaggccaacaaagggcttggaggagctattgttattcaagaaagagattgtcgagcagcatgagaaagattttcacaaagcagttatgcagggcaggtactttgtgaagagccttgacttgggtctttttgatcctttcaaggatgtgaaggatggtgtcctacttgacaaggatgatgtcgctgttggggaggaggacattggcagagaatag

SEQ ID NO: 86073 - DNA, 936 bp, Glycine max
  Peptide Sequence Number=SeqID_177758
atgaaaagagaaaaatatgcctcctatagtagtcataactcttgcaagagcctaagtgaagaacttcgtgactattacgaaggaaggcataggtcacatcttagacctcactcccataggagagaaaaggaaagaaagcctcaagaggctaacattaacctctcatacttccataggaaggacaatgtagaggctaacttagattgggaaataagggtagagcaacaacttaaaaaaaagtctacgtcaaaatcttatggctctcactcttatccaaagaaagaccaaggtcaaggcatcttaggggtgacaccttctaagcccaaagatgataaggggaatacaatagaaaagcaagcccctaaggctaaagcaaaaggggaagaatctagtgaagaaatctacccccaagaagaaggacaaccattagtggttaaagagaagtgtaacgaggtaagtgtctcctccaagaggttagctaagaaggaaactcattttacaataaagacaaacattaaagaaactttccctcttagacaacctccacattttcttttgtgtaaaacgacacttgttagcactgccacacttcttgggcttgaggttattcctcaagtaaaggagttgttggatgagggtttggttcgtaagagcttaaatccttgtgctttgttggtgcccaaaataggggttcccacggaccctaagagaataaaggtcattcctgattggcccactccaccaacaccactcattgagttggtgaggaaccatgttccctcatgggaagatgtccatgaaaggggtgtcgagggaaggagcccagagtatgaagaacctcgggatttgaggttaaatcatttccaaggtggaggggatgatgcaatcctaccccccaagggtattggatggaagactccaagaggcttgggctag

SEQ ID NO: 86074 - DNA, 474 bp, Glycine max
  Peptide Sequence Number=SeqID_177759
atgaagcctatggtacatatccacaagtatgtgtttgaagggttgtatgccccgtgggaagatactttagttgtgaagcttctcggcaaaaaggtgggctttaatgttacgaatgttcgattgccaaagatttggaagctatcagcggataagtttcctaggtttgaacttaattttttttatgatgaaagcattttgatggctttggctaccattgttggtaggcctatttgggttgatgcaactactcgtgacattcgtcgtggtaaattcatgaaagtttgtatggagactgatctaaataaacttgttaccgacgtgttttgtttcgtgaccattggtatcgagttgaacatgaaggcatgcatagaatatgctcatcatgtggctgctatggccacttgtcaagggagctttcaacagaaccagttccagcaacggtggagaaacaataatcgtcgagcaaaaaggtaa

SEQ ID NO: 86075 - DNA, 1386 bp, Glycine max
  Peptide Sequence Number=SeqID_177760
atgggaattcacaatgacatgggctgggagtggaaattttcatggagaagactggtattcgacaatgaaattgatgcaaccatctttcttagggaggtagaaggacaaagcatacaacaacaacaacaacaaaatgacatttgggagtggctaggagatccatcaggcaattactcgactcgcagcgcttacaatctgatgtgggaggaaattgctggtggtcagaaggaggattggagtgtggaactgtggaagacaaagatacctagcaaaattatggggcagattgcttacaaaagagctatggaggatatgctttgccctttctgcaatggagctgtggaggataaatctcacctatttatccattgcaccaaaatccaaccaatttggtgggaatcgatgtcatggatgaatatcaaaggcgctttcccttttagcctgaaacaacacttcattcagcacatctctatccagatcgaaggattaagggctaagcggtggagggtagtgcacataaatcagcaatacttgtacaccacacaagtagatatattttgctcaaagacaactcaaagaatcaaaattggagcaagagctggaggtttacaccaaagagaagatgctttcaagaagatagctttcatggatgacattactgctattactattcagcaccagatgcaggacaccatggtttggaaaactgatcctagtgctggagggatctcaaattatcaggactatgtgacaagaaatgcccttgttaagcatcttaggactcatggtattggaggcagtcctggaacatcatttagaataccagattctgagatattgttgtacacaggcattgagaattcatgtgatgacaattatgatcaggcaagtgtagaatcaaattcatggtcaattgaaataaacaattatgactcggccaattcgccatgtaacagcaagtccagttctgtcaattatggggcaaggcacctaaagtttctgctccaaagttctagaagaagagacacaaaagaggcagcctcagatttagaagatgatgtttctgtgaattctttcagctcaaggaacaacttgaaagagctttacttccaagaacagtgtagggggttctgtgggttcgagcgaggacaatgtgggttttctggcagtgtagggggttgtgtgggtttgagcgaggacaatgtgggtgtcgagggagcggtttccggcagttttcaggtgggaggagaaagagaagagcgatttcacggtgacaaagagaagagggagggcaaggttttcgagcgcgcgcggcttgtgaaatctcaatttttaacttataaacataacaacatcggttttttatggataaccgatgttaactga

SEQ ID NO: 86076 - DNA, 237 bp, Glycine max
  Peptide Sequence Number=SeqID_177761
atggacatgcaagcttaccttgaagaacagtatgttgcacgacgcgtcaacagtcaaaagggcacgatgacccaaggttgcggtggtgccgcgaacaacacgcgacgcagaggtagtggagccgcgacaatgtacccttccttttgcggagttgacggtgtgtatgttaacattggttttcaaaaaatcgatgttaacattgataatgttaacgtcggtggtttcaacatcgattaa

SEQ ID NO: 86077 - DNA, 387 bp, Glycine max
  Peptide Sequence Number=SeqID_177762
atgtccacactcagtaacgaaggtgttcatcaaaccaaaaaaaggattgccacaacagcgtggttgttggaggttggacaactagggttgtacaatgagggaaatgggttgctaaccataaagaagagaaattttgtccttattatcacggaggtgcaaaaaaaagaacttgatttaattatttgttcttatggagatgacgaagagagagcaaaagagagtgttgcttcgagtcaaaaggagaacattgtaggcagagtttctagaagctttgggaaggagataagcattgttggaaagcgagaccttgatccaatgaagtatggttctgacatcgtcaagttctgggaagataatggcagagacaataccattaaggacctttga

SEQ ID NO: 86078 - DNA, 1170 bp, Glycine max
  Peptide Sequence Number=SeqID_177763
atgggatcgaatcaagcaccctcttttaagaaaaggttatatcatgtcaaaatcaagagcctagaagtaactagtttgcatgagctagggcagcgaatggatcaactccaacgtcaagccttccgcaagactatggaaaaaatctgggatttgactatgataaaagtgtttgttgaagccattgcatccctcgctcaatattacaaccagccgctaaggtgcttcacatttggggactttcagttagtaccgaccgttgaagagtttgaagggatcttgggatgcccgctagaaggaaggaagttgtatctgttttctgggttatacccctccatggcaagagtagcaaagcacttggaagagaaagcgaaagctttggcgaatcaaggagagtgtaattcattcattgatgttttagctctattggtgttcggggttgtcctctttccaaatgtggatgggctagtggatctagcggcaatcgacacttttcttgcttatcaccacaacaaggaaagttcggtcgttgctgttttggtagatgcctatgacacgttcgactggagatgcgagaagagcagcacgagaattgtttgttgtacacctgctctttatgtatggctgggttgtccgttaattggttccctcgatggaaggaaggaggggccggggttctgtgctcatgtgaaaggggtgccatcggaagatagtatcgcgtctttcatcgcacgaggcttcagtgaccccaatgcaaaaatgcttcaaagagtccgaaaagcatggaatacggtgcaaagaaaggataaggagcttagaggaagcaacaacggtgttattggcagatatcataaatggttgaaggctcgaatgcaagggataacttggctcccgaagctaaagagttcaggtggggaagaggctgatgtccctgaggagagcgaagaagtgcaagccttgaaagcggaacttgaaagaacacaagtggtcaaggaaaagttcaagacaatagacatcagggtcaggaaagagtgtgacgagctaagggatcaacaacgaactcaagctttgaagggccgaaagggacgagtcaagggtggaaagtatgatattagaggacaagttgaaggcttgtcaaaggttgaagaggagcttgaccgaacagttgagtag

SEQ ID NO: 86079 - DNA, 882 bp, Glycine max
  Peptide Sequence Number=SeqID_177764
atgcaatctccttcttccctttacctcaacaagaacttcttcaccacacaccatcaccaccttggcttccaccacaccctctcttccacccacaattcccttacctctcttggcttctcgcccaagccatcatgttccacgaggcttataacagctcaagcttacaggcccaacaatcacaagaggaatggttcccccaaagagggtgcgagggtgaggggcagcaaggacaacatgtggagtattgacaatgagcttgccaaggcgtcttcttctcagaaggagaaaaggaggaggcagagagggaggagtgtggtgaggaggaagggcccaaagggtggaagggttattgtctctggggctatgctgctggaggttgagactgttcttcagactctggtacacttttcctcacttggcttgttgggcctatgtgtcaaatgggcccttggtggacttcaggttgggtccatgtctcaaatggcaaagaagaatctttttgagagttatcttgtgggcgaacataagggattcctattggtgctaatcctagtgaggaaagtggaaaagggtgataaagtccttttttggtgcaatcgttgggtgggacaacaatccttagctaatgagttccctagattatatctaaactcattacaaaaggaggagtgcatcataaatatgggggagtgggctgagggggtttggaggtggaattttaggtggcatagggactggtttgtgtgggagagggaggtggtggagaggctgagtttgatgctaagtgaagctacgttggtagagggtggggaggattcttggatatggaagcaagatcgaaccaggaactatcttgttaaatcttcatatttggctctatga

SEQ ID NO: 86080 - DNA, 1029 bp, Glycine max
  Peptide Sequence Number=SeqID_177765
atggctgctgctactgctactgcggacagcgtgtcctcgcaggcataccttgaaggaaacgcagtgaaggaaacgagaattctgatatcagaactctgtcgccacttctattctctcggatgggtctctggaactggtggcagcatcaccatcaaagtccacgatgactctatttccaaaccccaccaactcatactcatgtccccttcaggtgttcagaaggaaagaatggaaccagaggacatgtatgtgttatctcacactggatcagtcttgtctgctccatctcccaaaccttaccctcataaacctcccaagtgttctgattgtggtccacttttcatgaaggcatatgaaatgtgtgatgctggggcagttatccacagtcatggaatagaatcttgtcttgtaacaatgctcaatcctttagcaaaggaatttaaaataactcacatggaaatgataaaaggaatcaaggggcatggttattatgatgaacttgtgatccccataatagagaacacagcctacgaatatgagcttacagaatctctagctaaagctattgaagcctaccctaaaacaacagcagtgcttgtacgcaatcatggaatatatatttggggagactcgtggatcagtgctaaaactcaggctgagtgttatcattacctgtttgatgctgctatcaaacttcaccaattaggattggactggtctactcctaatcatggtccaataaaaagtcttagaagtctaatgattgctggggagtcaaatgcatccgataagacaaggaaggctagtggtgaaattgatccatttccacgttgcattgtccttgacattgaaggaactactactcccatatcatttgttactgaggttctcttcccatatgcacgtcaaaatgttgggaggcatctatctgtgacatatgatactcctgataccgaagctgatattaagttgctttgctcacaagaatcttctacactctctcaccctcacacactcaccacagagtag

SEQ ID NO: 86081 - DNA, 252 bp, Glycine max
  Peptide Sequence Number=SeqID_177766
atgaccataggtgctgtgcctattccctctgatggtgcttgtaaaagagcagtcattgatgcattggtaactaatgtcgaagctatgattaaagcagatagaaagatcactgccttgaaagaattgcagggtcatatgtggcgcactggttatgagaataatgaattgaagggaatagtttttgatgatgttccagaagctctagaaaagtggcataccttgggcataaaggttgcaatttctttttcatag

SEQ ID NO: 86082 - DNA, 861 bp, Glycine max
  Peptide Sequence Number=SeqID_177767
atgactgggttgtatcagttcggcattgagcatcaaggaaacttgttgttcgatttcgggtttctggaaatgtgggtagcgggagggagatgggttggttcacagaagatttctagaaattgggtgatgatggagggcacctgctgggaagtggtggtgcagtccaacgtgttgtcgtcacctaccataatgcgtagggtatttgaaggggacacaggtcaaggtctaggtctggatctggagggtcaaggtgatctgagggcaagaaagggtcatcagggctcgatgcgaagggttcgatgtcctcgtcggcaatcaaaagaagtgaggcgtttgaaagggatttttggggctaaggttgtgttttgtttgggtaaaggagaaattgggtttgagggtattgggatgaaggttgaagggcccgcacctcgcgacgcaagtccgggccttactgttggagttgaacaggatgtcggaaggatcatcgtaatatgccggggcaaaacacgacttgaaggcttcgagcataccagtccaggatttggtatcggagatgaaggaggagaaggagggacaatggtcatagcagctaaatgttcgaggatagaatcaaacttagcgttcgtggaggcttggatttgcgcaaggttttgtgctagggaggactggccctgggttaagcgagtgaccgcctcttccaagcggtcaatggtggcctgcctggtattatggtttgatggtgacataggggcagcctctaatgaagtcattgaagcgtgtgggttttctggtattccttgtgggcttgctatggtccaattccttgctgctcttgtgctcctcttgttcatggatgtctaa

SEQ ID NO: 86083 - DNA, 1866 bp, Glycine max
  Peptide Sequence Number=SeqID_177768
atggcagttgaggttgtgggatttgagatggttcaagggccagtggagaatggtgctaaagaagacaaatctatttcagaaaaaactgaaaatgggaaattggaacaagacacaggagttgctgagccaacaaaatttgggtcacatggagatgaatctgctaaaccagaagcaaatgttgtttcagatgccaatgtccccaaagatgcagttgacgattggcctgcgccaaggcagatacattctttttattttgttaggttccggccttatgatgatcccaacattaaagcaaaacttgagaagtatgataaagagattagccaggaaaatcaagcacgaattcaggtcactgatgctttaagggcaaaaaggacagaacgagcagggtgtatttctcagattaagtctctaaaaggtgacaataggcaatttcagagcattgttgatgaaaaaattaaagagattgaacctctgcagcaggcactgggcaagctgcgtactgcaaataatgctggtcggggtgttggattatgctcatctgaggaggagcttaacaatcttattaatagcttgcactaccgcatacaacatgaaagcattccgtttgctgaagaaaaacaaatccttcgagaaattaaacagctagaggggacaagggagaaggttattgctaatgctgccatgagagccaaagtacaagattctatggggcagaaagaagccattcaagatcaggttaagcttataggtggtgatttggatggagtcaaaaaggagaggcaagcaatccggtccaaaatcaagcaacttgaagatacagtaaaagccttagacaaggatattcagtctttacaggatgaactaggagctgttactgaaaagagggaaaaagcttatgagagcattcagcagcaaagaaaacaacgcgatcaggggaactcctacttctaccaaagtcgtacaattttgaacaaagcacgggagcttgctgcaaagaaagatattaatgcgattgaggaactggcacaaactgaggttgagaaagctatgtcactctggaacagtgacaaatcctttagggatgactatgagaaaagacttttgccatcactggacatgcgacaattatgtagggatggacggatgaggaacccagatgaaaagccactgctggaagaaccgaaacctgccgaaactgatacattgccgaaaagcagtgtaaaacagccaaaggaggaggagcctaaatcatctccaccagaaactgtgcctgagcagaagattcagaaagaaaccaaaaagaaaggaaaagatttgaaatccaatctgaacaaggttttagaagacactgatgaatatgaatttgaattgccaaaggtgaataaggagcctccgattgatccagaaaagctgaaggagatgaaaagagaagaggaaatcgcgaaagcgaagcaggctttggaaaggaagaaaaaacaagcggagaaagctgcagccaaagcagctaccagagcacaaaaggaagctgagaagaagctcaaggtacgtgagaagaaagcgaagaaggtggctggtggcactggagctgttccaagtcctgaggaaccagcaaatgaagctgtggaggttgctgaacagaagaccgatgatagcatggaagcctcagctccggcgaaggagaaggtcccaaaggagagcagtgttaagttcaggaatcgagccaaagcactgaaaggccccgacactatcccaaaagctattatgaagaggaaaagcttggatcttgaaggagctgtgaaccaattttctgtgggtggcttggctaggttctgcagactaatcatcagggaaatggcgcggtga

SEQ ID NO: 86084 - DNA, 339 bp, Glycine max
  Peptide Sequence Number=SeqID_177769
atggagataaccaaatcacttgtctccaacaacaataataaaaagaacaaatgcacaccttccaggttagtagggcctgatggtgttggactgttggtactgcctcgcaaagttgaacttaaggatgacacaagcttgctagttgcaacctatcaaccactaccagcagcattcacaaagagcaaagtgcagagagtgagaaacaggcatatgcggcttcacgatgcaaaaaacaagggtgaagtagtggcaatatgctgtagcaggggatgggctatgcaatttccttgtgtttatgagaagagtaggcttgaaattcctatggctcacaatgtgtga

SEQ ID NO: 86085 - DNA, 933 bp, Glycine max
  Peptide Sequence Number=SeqID_177770
atgctacatgggggagtgagggagaaacaaacaacgaggagaagagtgaatctagttggtggtggtggtattagaggtagaatcgatgttcttgatcaaaatgaggtagtgacgacgatgatggagtatccacagagcaaggaagacacggaagagaacagtctacgagggctaggaacctccataagagagaaggataaggaagaaaaattgtattatttttctgctgtcctctattacatactaagcatcccttatatagaggcactagccaagggtgccactatgaaaacagaaggtgctagaattatcctcctgacagctcagcaccttctaacaaattctgttaaagggaatccaccaagggtttgtgcccgtagtggtgcttttgctggtcgcttggtacttctcttgggccttccatcgtgggtctcgggtctgtcttcatccatagcttgggcctcagtgaataagttcaaggaaacaagaaaggatatgagagcagaagatgcggaggggcacggagccgccagtgaagaagcggatggagagcgcccgtacgagaaacctatggatgtggaagattatcacgggaacccacaacgagagcctcgtctcctgcgtgtgaacctgcaacgacaaacgcgatggcaaccaaggttcggattcgtggattcacaacgtgctgagggggaaaagcggatggcgatgctgctgagaaccacggttggcacagtgaagggaatgacggggtgttgcgtggtgactggttctgagaaagtgggaaatggagacaatgatttttttaagaccaaaatggaaaataggtcagatatgggttcttcaactccacaagatcctcatggaagtgatgaagttagttcaaattctgctaatgagacgaatgatgaatgcaacgatgcttctcaataa

SEQ ID NO: 86086 - DNA, 345 bp, Glycine max
  Peptide Sequence Number=SeqID_177771
atgtctgtccctgtctctgtttctgtctctggttcagggttacttagttttccttcaattcagcgaccacattccaaccctccacccaaacacgccgtacttccttccacttcccgtgaacccgacactgatactaaatacttgtgtctattgagcccatttcaaatcatagctagccaagagctaccttaccaaactttccctttccgaggcttaggtcaccgactcaccggacagcaccgcaccgttgtcggatggattgcaatatttgatgaaatgcctaataaggatttgaatccctctacatggtttaaaggggcttttgtgattgagaaaacagtgtaa

SEQ ID NO: 86087 - DNA, 273 bp, Glycine max
  Peptide Sequence Number=SeqID_177772
atgaaaatccaacggaaaaggctacaatgcgaaaggtatttctctcagctcaaacaagatatcaaaattcccaacggtgagacttctcggaattggactgcgaacgtagtgctcaaatttcacaacgatccaacggtgaacgagtctgagatcgtcatttttctgagacatgttaggtggcctgtgggaaaaagagagggttttgggagaagagagaagaaacgaaattgtgaggcagaggagactgaggagtcagtctggaaactgacctag

SEQ ID NO: 86088 - DNA, 603 bp, Glycine max
  Peptide Sequence Number=SeqID_177773
atgacacggatgagcgtccatgtggctcagttgatcgctgacgccatttatttatttgcaggtatgccacctaccaggcaccctctagacccagataagtctaacagggccttggggtttccagtgttgatcacgggcctctaccagtcattcggggttcccgtcacacctagcaaggtgattcgactaccgatcacccgggccttcattgagaagtattgcacgcctagacaggcgcagggtgatgcaccgcaggccgctgacgcaccgccaccacctcatcaggctgatccagctgggtcattcggcatggggcggtatttccagcacttggttcgccagcaggcggccaaccacagggggcaggtgcagatccatgagtgtctctaccagctcaacctcagtcagcagagcctggatttcgctccttttgcgtgccgtactccagatcagtttagggctgaggtcgcatggcccagagattggcccgaggaccaaacagaggaggcacctgcaggagctctcgacggtgcagaagacgcccgtatggatgaggagatgatagatttactcgatttcttgggaggatgcggagccacgtga

SEQ ID NO: 86089 - DNA, 256 bp, Glycine max
  Peptide Sequence Number=SeqID_177774
tcagcactcaggagcgcttgtcactcgagcaaacaaaccaatggcttgcacccatattccagtggaagcaaagatggataaacttgaagatcctgatgagtcattagagacatctaacaacagctttcaaaattgccccatgtgtggtgtcgcttggccctacaatgctcaatggaacgccccggggctcctccatgatatgcacatgttgcgttcaagtcgtatcctcggaaaaatggagattgaggaaacctag

SEQ ID NO: 86090 - DNA, 552 bp, Glycine max
  Peptide Sequence Number=SeqID_177775
atgcttgccaggaacattctaccagagagaaatgtcaagctgtatatcactgagttcgatgatttcagaagagaattaattagaagaaactggcataaaaaactgacaaacttgactgagggaagcattgatgtggcaattgtgaaggaattctatgcaaatctttatgtaccagacgacaagtttcccaagcaagttagagttcgagggcacttgataaaatttgatgttgattccctcaacaccttcttggagactccagtggttgtggagcaaggagagagcttaccttgttactccaggtttgctagactgaggcctgatcctcaggagcttgcagcccgactatgtatccctgggaggggatttgttcttaatgccgagggtctgctgtggaagctcttgaggaaagatcttaccactctagcccaaacctggagtgttttatcttattctaacttggccccgacatcccatacttctgatcttaatctggatagggccaaatttcacttattgctcagtctaactcctcgcggcttggatttctag

SEQ ID NO: 86091 - DNA, 174 bp, Glycine max
  Peptide Sequence Number=SeqID_177776
atggcgctggaggatatggaaaagactaccttcgtcaccctgtggggaacgttctgttacaagattttcaggaaaatgatagatctcatccagcacaagcagttgcagcccagaaacgcacattgctatataatcatggaggctgcacgagttctgtaccaagtccgggattga

SEQ ID NO: 86092 - DNA, 363 bp, Glycine max
  Peptide Sequence Number=SeqID_177777
atggaggaaccatcaaagaagcacaaaggttcttcgagtagaagccaagggcactccgaggctcaggatattccaattccttcctccatttcctcctcctcattgttctcatcggaagaaaaatgtatacggtacacaaacctcttctcctctcgttctatcattgaccctaagttcatagatatggatttattttctgatgagagtttcgaatgcattcaagcatttcaaaactcaaatctcattccctttatgtctttgaaattgcctgtgtattctgaattggtaaaagctttttattctaaccttgaaattcagaagtaccttgatttcataagtttatgggataaagatggtcattga

SEQ ID NO: 86093 - DNA, 702 bp, Glycine max
  Peptide Sequence Number=SeqID_177778
atgaatttgtcaaaacatttcattgctaatgaaaatctgtatagggaaagtatttataagagttttgaacagtttatcggaaaacctgaggattttatatttcttggccttcttccgagctacctggaaaagaaaaattcttctctgatttatatggtggattacttaatgaatgtttctgcccagtctgaaaacggatattttttatacaatcatgctgatttatttgaacttttaaaaattctgaaggattttctggatttttgtgcctcccaaagaggtgatgagccgattggtttttctaaaaatcttataataattgagacaggaggaatgaagggacgtaaagaagaaatgacaaaagatgaattgttggtgattttacaaaaaggttttaacaccaatgccatatattccgagtattctatgacagaacttttatcacaggcgtactctttaggaaataacgagtatgaatgtccgaaatggatgcgtgtgctggtgagaaatgctgaagatcctttaacctatgaaaaagaaggaagaacaggtgctgtgaatattatcgatttggcgaattttcattcctgctcctttattgcgactcaggatctgggtaagatgcttccgaaaaataaatttcagatcctcggaaggatagatcattcagatatcaggggatgcagtttattggtgagctga

SEQ ID NO: 86094 - DNA, 123 bp, Glycine max
  Peptide Sequence Number=SeqID_177779
atgggacaccttagttatcaaggggttcccatgaaccctaagagaataaaggtcattcctgagtggcccactccaccaagtgttgaggaaaaaagccagagtttcaaaaacctcgggatttaa

SEQ ID NO: 86095 - DNA, 486 bp, Glycine max
  Peptide Sequence Number=SeqID_177780
atgggtcattttaaggtccaatgccttaaaaggacctccttccaatttccttcggtttttccgacgttttccacaaataaacgttggtggcgactccgcgcattttcctcctttggaaaacgcacccgtgagcctcgcctcgctcgcccgcaaaagggtaggttgcaacagttggcgacttcactggggattgtttttgtctccgacttgcttgataatagtgaaacctcgtctagagctttctctctttataatgtgtcgtcgctggtattccataccgccgcaaatattattatcttgagtgatgatacctctagaaaacagccatactgtgtgcatccccgtgttatgtttttgcgcgtctgcatcatgtcgtcacacacgcgttgtatgttggtctcgtctttttggcatgggatgccggaagatccatatcatcttcttaactacacacatggggcactgcacccccaagtgtgcaagtag

SEQ ID NO: 86096 - DNA, 1709 bp, Glycine max
  Peptide Sequence Number=SeqID_177781
acggcggcatcttctatacccgcaacggccagttcaagctggacgagaaccgtaacctgaccaacatgcagggcctgcagctgaccggttatccggcggccggttccccgccgaccatccagcagggcgccaacccggtgccgctgagcattcctgaaggcatgatgaacgccaaggcatccacttccggcgagatggtgaccaacctgaagtccacccataaggtaccggagaacaagaccttcgatccgaccaaacaggacagctacaactacgtcaacaccatcaccgcttacgactcgctgggcaacgcgcacaacatcaacgcctacttcgtcaagaccgatgataacaagtggcaggtctatacccaggacggcagcgccgcgccagtgaacgccggcaccatggagttcagcaccagcggcaacctggtgaaaaccaccagcaccaacggcgcgccgggcgagttcagcatggtgatcccgatgactgccaaagacggcgcaccggcgcaaaacttcaccctgagcttcgccggcagcatgcagcagaacgtgggcagcgactcggtgagcaaagtggcgcaagacggctatgccgccggtgaatacaccaacttccaaatcaacaacgacggcaccgtcgtgggcatctactccaaccagcagacccaggtgctgggccagatcgtcatggccaacttctccaacccggaagggctggcgtcgcagggcgataacgtttggcaggaaaccggcgcgtccggtcagccgcgcgtcggtctgtcgggcggtggcggcttcggtaagctgaccagcggcgcgctggaatcttccaacgtcgatctgagccaggaactggtgaacatgatcgtcgcgcagcgtaactaccagtccaacgcccagaccatcaagacgcaggactccatcctgcagacgctgggccgagttatggatcacgcgatttataccgcgatgggcgcggcgcgccaaacgctggagcagcagtccatcaccgccaacaacctggccaacgcgtcgacgccgggctttcgcgcccagctcgccgcattgcgcgcggtgccggtagacgggccgagcctggcgacgcgcacgttggtgaccgcgtcgacgccgggcgccgacatgagccagggggcgctgaactacaccgcgcgtccgctggacgtggcgctgcagcaggacggtttcctggcggtgagcctgccgggcggcggtgaggcctatacccgcaacggcaacattcagatctcctccaccgggcagttgacggtgcaggggctgccggtgatgggcgacggcggcccgatcgaggtgccgccgtcggcggagatcaccattgcggccgacggcaccatttcggcgctgaacgccggcgatccgccgaacaccatcgcgcagatcggccgcctgaagctggtgaaggccgatgcgcgcgaagtgatgcgcggtgacgacgggctgttccgcctgacgccggaaacccaacagcagcgcggcaatcagttgcaaaacgatccgcaggtgcgggtgatgccgggcgtgctggagggcagcaacgtcaagccgatggagaccatggtcgacatgatcgccaacgcccgccgttttgaaatgcaaatgaaggtcatccacagcgtggatgaaaacgaacagcgtgccaactcactgctctcattgagttaa

SEQ ID NO: 86097 - DNA, 990 bp, Glycine max
  Peptide Sequence Number=SeqID_177782
atgaccggccctctcgatgagtcgatctcttgctttctcataaggttggacccttgggtactagtacctatcaccttcagaggactgtacgccctcaccgtcagaggactacacgtcctcgccttcagaggacttcacgtcctcaccttcagagggctacacgcctttgccttcataggactagacgtcctcaaattcagaggactacacgtccttgccatcagaggactgcacgtcctcgcctttaaagggctatatgccctcaccttcagaggactacacgtcctcaccttcagagggcttcacgccctcacctttagagggctacaccccctcatcttcagaggactacacgtcctcaccttaagagggctgcacgccctcgccttcagaggaccaaacatcctcatcttcagaggaccaaacatcctcatcttcagaggactacacgtcctcatcttcacagggctacgtgtcctcgccatcagaggactccatatccacaccatcagagaactcaagggcgacaactgtgcagcacagccagagagggaggctatcacgcaactactatgcataccggggcaaagattacaaccgtgccgcctgcaaagagacgaagtgcggatcatgcgcacccaacatgaccactcttacacagatatagatgacaattgctacttagcaacattctgcccagcgaccgcaaatgccaatctccccctgcaaaaagtatcagttggtctgtgtcgtccccgacatggggattgcaccccacaaagacacctagtggacctgaagaagtccaacagggcccctagggtttccagctctggttacgggcctctgtcggcccctaccgagcgcccggatcgtgcccgcaagacacctagtggacccgaagaaggccaacagggtcttggagttgccagctctaaatacggggcgaaacaccacatcagcattgggatggccgatagcgggcaatag

SEQ ID NO: 86098 - DNA, 522 bp, Glycine max
  Peptide Sequence Number=SeqID_177783
atgggtatgatagccacaccatctattccccgaccactcgaccatgaacaaataaacaagataactccggcaagcattgataaggaaacccttaggaaagacttttattctccagagaatgaacctcaaaggagatggttttttcaacattataagggtacaaacagaaaacaagtccaagacgagttctatgaatttgtcaaaagagtcaaaattaatgtccttttcttcgactggttccattcttataccattagaaaggatatagattacccttggaaacaagacatcataggtaatccaacaacaaatgtgataacaaattggcaaactaaggatggtgagttaatccaatcggagttacctcccacaactcaataccaactaccaaagattaaagacagtaacgatagacctgttatggctagtccgttcaaaacaaaagatgtcatagaggaagtaaccattaaagacattaaaagcctaatggaacaggcaaattataccaacaaatattcataa

SEQ ID NO: 86099 - DNA, 979 bp, Glycine max
  Peptide Sequence Number=SeqID_177784
gatcgaaggcggaggagcgcttgttgaattaggttatgatgaaatttatgcgattcagtattttaaaaataatctaagaccctggtggaacaattccggccaggaaacgattgaaaatcagttgacgctggcggcagacgagtatcgcagtgtgctcgataaatgtgtggcattcgataaagctgtctatgctgatgcactaaaatcgggcggaaaagaatatgcacacctcaacgttcttgcttatcgccaaagtattgcagcacatactttggtaaaaagtccacaaaatgaactgctatggctttccaaagaaaataacagtggcggctttatcaatacggtcgatgttacctatccatcagcgccattatatttgatttataatcctgagctgttaaagggaatgttgagcggaatcttttattttagcgaaagcgggcaatatccttatccttgggcggcgcacgatctgggtacttatccattggccaatggccagacgtatggcgaacctatgccagtggaagagtcgggcaatatgattattttaaccgctgcaatcacgaaagtgcaggggaacggagattatgcgaaaaaacattggaaaacgctgaccacctgggtagattatcttgttaaagacggtttcgaccctaaaacacagctatgtacggatgattttgctggtcaccttgcgcgaaatgcaaatttatctgttaaagcgatcgtaggtattgcttgttatgcgcagctcgctgagacaatcggtgaaacagccacagcaaaaaaatatcgtgctattgccgaagaaatggttccaaaatggatggaaatggcagatgctggcgatcactatgccctgacatttgatgataaaaatacctggagtcaaaaatataatttgatctgggacaaagtcttggggctgaatttgtttcctcaaaagtgtatgatactgaaatcaaatattacctga

SEQ ID NO: 86100 - DNA, 177 bp, Glycine max
  Peptide Sequence Number=SeqID_177785
atgactaagttacctaggcttagtgattcagcctcgcttagccacagaagaaggcaaaaatgtaggaaattgggtgtgagagagaagatacaggcagttcaacagtttctagcaaataggggtagttgcttagcgaattatggagcgcttagcgatgacattgctgcaaggaattga

SEQ ID NO: 86101 - DNA, 246 bp, Glycine max
  Peptide Sequence Number=SeqID_177786
atggtgaagttagtccaaaatgttggagttaagggtaaacacgccatttggtcgcttggagatatcaatgctgaacacgactactcatgccaacatagtaatattcccaagatccctccattgagcggggttatcacatgtgccacatccgaaactcactctcggaaagacactatgattataccaccatcctatcttatgtttccctcaagtccgggtgtaggacttatctcaccactcacgtaa

SEQ ID NO: 86102 - DNA, 948 bp, Glycine max
  Peptide Sequence Number=SeqID_177787
atggctccgaaaaagcttttcgcgaagaggtctaggagagacgctgcggctgaagggtccagtgctgcccccgagtttgatagccaccgtttccggagtgtcgagcaccagcagcgcttcgaggccatcaaaggatggtcgttccacagagagaggcgcgtccagctcagggaggatgagtatacagattttcaggaggagatagctcgtagacattggacgtcgctggtgactcccacggctaagtttgaccctgaggtagtcctggagttttacgctaatgcttggcccacagaggagggagtgcgagacatgcgttcatgggtgaagggtcagtggataacttttgacgcagatgccctcagccagttcctgggtgacccactagtgttggaggaaggccaggagtgcgagttcagtcagaggaggaacagggccgacgggttcgacgaagaggccattgcccagctgttatgcacaccagggcaggatttcgcccggaccgctgcagggagacgggtgcggatcatgcgcaccaacatgaccaccttgacccagacgtggatgacattgatgctcagcaatgtcttgcctaacgatcataactccgatctccctctgccgaagtgtcagttggtgtatgccatcctgacacggatgagcgtccacgtggcccaggtgattgctgacgccatctatttgtttacaggtatgccacccaccaggcaccctctagacccggataagtttaacagggccctggggtttccggcattgatcacggacctctgccagtcattcggggttcccgtcacccctattaaggtgatccgaccgccgatcacctgggctttcatcaagaagtattgcacacctaggcaggcgcagggtgatgcacctcaggccgcagacgcaatgccaccacctcatcaggccgatcccgcttga

SEQ ID NO: 86103 - DNA, 477 bp, Glycine max
  Peptide Sequence Number=SeqID_177788
atggggacaaggggttgcatcagttacaatcccgttcttgctataagacaacttggctaccctatgagaggggcaccactagaggaagagctcgcacctattattgcacgaggtttcaataagaccaacgtggaggcacttcagaaggtctgcaaggcgtgggagatggtgcaaaacggctaccgtaagtggttgaaagcccatatgcaaggtttagattggctcccgagtttgagaaccactaaaggggaggaagttgaggcaccagaggaagacgaagaggtgcaagcccttagggcagaactcgagcaagcccaaacagtcaaagaaaggttcaaatcagcagctcttaagatccaaaaggagaatgccgaattgagagatgtaaatatagctaccactaaggccttagaacaagagaccaaaagggctcgtagagaagaacacggccggaacaaattccgaggggctctgtag

SEQ ID NO: 86104 - DNA, 381 bp, Glycine max
  Peptide Sequence Number=SeqID_177789
atggtcatcgctcatctcgtggcgatagattatttcacaagtgggtcgaggcggcttcctataccaatgtcacgaggggtgtggtggtcaggttcattagaaaagagatcatctgccgatatgcatcacaattccacaccctaccagccaaagatgaatggagccgtagaagcggccaataagaatatcaaaaagattatccaaaagatgaccgtgctcatatcaaggattggcacaagatatgagctccttccgtcacggttccccgcgagaaatcaaatggcgaacgcttgcaactttggcgtcctgttctcattgctaacaccgcaggggagcgcttatacaagcaaagaactgaagacattcgacaagaaaggttga

SEQ ID NO: 86105 - DNA, 867 bp, Glycine max
  Peptide Sequence Number=SeqID_177790
atggtgtttgggcaggtcgcgtcaccgcagccagtcaataactgctgtttaaccggtcagttgcagaaactccaccagcccatcatggaaacgttcgccgttgtggcgcacgttgtcgcagttgagcagcgtcagcggacccgcgtcgtcggcgatgcgtttttcaagaatccgggtgatggtgccataaatggttttgcaatccccctgcaagtcggcctgcagatcggcgttgctggtttccaggcgatgctgcgtattgaggtaataacccccttccgtcaccgcgatctcttcatattcgcgctccccttccgggctcaccgtctcgaggacgtagcgtcctctctgctccgccagcgcctgcaccacgtgctcggcgtcgttacgaatatttcccgccgcgatatgccagcgcgaatcgccggaaacccgcagtcgatgcaggtaccacgcctgatgggcgcgatgaaaagaaccgagaccgatgtgaagccatgtgaattgcgtattcatgttctgctctccttgagccaaaatgcgggtatctgcgctactgcgcccgcgtatttaaggcaggacaccgtgagtaaagaagacgacatcaggctggatcagaaggtccgcgccgcatggatgtactacattgccggtcagaatcagagcgaaatcgccagccaccttggcacctcaaggccggtggtccagcgcctgatcgccgcggcgaaggaagaaggtattgtgtcgattggcttgcatcatcctgtggcgaactgcctcgattatgcgcagttgttgcaggaaaagtatcaacttcatcgagtgcaatatcgtgccgacctacaacgaagagagcacgctggatag

SEQ ID NO: 86106 - DNA, 156 bp, Glycine max
  Peptide Sequence Number=SeqID_177791
atgagcttacaaaacctaggtatctctacaaaagctgatcctcttgctgcctccggagctcttttcccgaaattggcaccgtggttcttctgtcgcgctaagcgcgctaaagctacgcttagcggtggatgcacgctttgcccactaatgagctaa

SEQ ID NO: 86107 - DNA, 1025 bp, Glycine max
  Peptide Sequence Number=SeqID_177792
cgcgccgaacacggtggagcgctgggacatgagcacggcgagcaccgcgcccgtcaccacggtgatcgcgatgcgggtccagccgatggtggagggccggatcgtcacccgctcctcgggggcgcggtacatcccgtcgccctcgcggacgtcgaaggcggtgtggaactcgtcgagatggccgacgacggtgttgcagcggaactccatcggggcgtgcgggtccacggcgaggcgtcggatcgcctcctgggtgcggttgcggccgcgccacacggtggcccacgaccagaacacgcgctgcaggcccgtgaagccgtcgatctcggcctccgcctcggcggcgtcccggctggcgaggtaggccttcaccgcgatcgacagcccgcccaggtcgccgatgttctcgccgatggtgagcgcgccgttgacgcgatggttctcgtcgagctcgcggggactgagctcggagtactgggtgatcagctgcgcggcgcgggcgtcgaaggcctcgcgatcctcgggggtccaccaggagcggaggttgccgtcgccgtcgtacttcgagccctggtcgtcgaagccatggcccacctcgtgcccgatcacggctccgatgccgccgaagttcacggcgtcatcggatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 86108 - DNA, 2007 bp, Glycine max
  Peptide Sequence Number=SeqID_177793
atggagatgcggatgggagccatggagaaagcgatagaagagaatcgcgaagcagtggagttgcgattgagttcgatcgaagggatgatacaatggttggcggcggcatgggagaaaaaatctcctgctatgaacgttcacacagttgacgtgagcggaggagatgagggcattgcagcgcatgacagcaatcggtggaggaatttggaaatgcccatattcgatggtgatgatcctatggctgtaatggttgcgatggatggggaagctctgggttggttccaatggtgggaatcttggaatccaagccattcttggaatggactcaagattgctgtcacccaaaggtttcaagcttctagcctgggaaatccttttcaagcgctactggtgttggaacaagaagagacagtacaaggattcataggccaatttgagaagtgcgttggaatggtgaagggattagaggagccatttctggtggaagtgttcctcaaggggttaaaggaagagattagcactgaggtaaggtttcatgaaccaaagaacttgatggaagctatggttaaggctcgaagagtggaggataaggacaaagttttagggaagttacccttgagtaatagccaggggtataatctgctgaaacccagttattcgagtctgaaatttgtaagggattggcaaccagtaaataataaggtagctgatcctactaatgctcctaaaacaggatccagtggatggcaaggtagaagaaccttccataatttgtcacccgttgaaaggatgaaggagacccttgcttatgaaatgcaggctgttttcctcgacttggccttaaggacaagttggtgggtggcactaacttggagtatatggaaccatagaaacagaatcatattttcaaacgatagccccaacaccagtaagatactggatgatgaatcctatattttacctgtgctcttacgatttgatggtcaacctgatgttgatgaggagggaaatattctgtataggtttccatctttgcagaggacagcttctcaaaagagtaagagaaaagaatatgttggaaggagatgggcagattgggttggaattgagaagtttttcaaggagaaaaaatggcaattcagtaaaactggcacgccagagagagcaatggtcattggcctgggtggcctcaatctgtttggagttattattcttggaaccatgttgaaagatatggcagttgcacccagtagcttcattaaatttgtagccgacatatttcctcttcttcagatttatgctggttccttctttgcaattcctcttgttcggtggttttttattcggaaaaagaatgctgatattgaaaagagaaacaaagctaggcagcagtgtgcacaagttcttgaattacctgacacttcactaaggcagaagatagctggaatcatcatcaaggagagaaagcatagcaaggacatagatagggccaatgcatctgggacaaagatcggggccagtgcatttgggacgaagacggggctagtggaagcttttgtcgagagagataggaaccaaaaacgcaaaccaaacactaccttaaaaaacctagggacgaccctcactttggtagcccaactagagcacaggctggatgtgccttcgtgcgctgcaaaagcttccaatgagggtgcggttcagatctgcatggtgttggccggaaaacttgctggcgacaagaaagttctttgttggaaaatggagggcgagcagagagcgaacgggacaagtgacaatggccggcaacagttggaaaatctgcttggaaacatgtcggaaaacatgccagaaagagacagtcctttggatccctctcattcggatgtgtattcgattcattcatttatccctcctgctggaagcctgctgggagccactccttgtccatgccacatctcttgtgcactagcgatcactccccgcgctcgtcagcgtccgggatgttag

SEQ ID NO: 86109 - DNA, 393 bp, Glycine max
  Peptide Sequence Number=SeqID_177794
atggcttctaggccccagcctcactacgatactcacaaattcacctttgatgacgcctggaaccgctacgctgacaacgctcttggtcggaacatccttccagaaaggaatgtgaagctttttgtcacagagtttgatgagttcaggacagagctagtcataagaaattggcacaggacgctaaccaacctcatggaggggagcatagatgtggctctcatgaaggaattttatgctaatctttatgtcccgggggataagcctccaaagcaagttagggtcagagggcatttaattaagtttgatgcggattccctcaacacttttctggagactccggttgttctagagccagggagactcttcctgcttactccaggttctgtagactaa

SEQ ID NO: 86110 - DNA, 621 bp, Glycine max
  Peptide Sequence Number=SeqID_177795
atggcttgcttagcgtgcccctgctcactcagcataattccctctctggttggaattgcacttagcacgcccttctcgcttagcgagacacaaaaagttgttagtttccaaatcccaacagtcagactgtggaaacatgtcttgggaagctccagatacaatttgaagatgatccagcgagtacctatcttcaagtgtcagtgggttaatggaaatattggtgtgcgtcaagacaaaaatgggatttcctttagtagaccttcaaaaggtggcttcaaggacaagcttttcaccatggcagaacaagccagacagaacatgaggatgatgatgtacatgcaaattgtaatgatcataatgaaggtttatgggagagtatccgtacataactacggtataccaaaagtcatggcaatacccccaaggtccccttcgcattcagatgctcctttggaggctatgtctaggagtagtagacaatccacccaactaagaagacaaaggatcaagctgaatgttttgatgatgccaaaggattacatgaatcatatgcttctcaaagatttactcaagacaaagcaattagagatattcaagatggatgatcaagacagtctatag

SEQ ID NO: 86111 - DNA, 471 bp, Glycine max
  Peptide Sequence Number=SeqID_177796
atgttcttaggttccaagtgtgaggaatcgacttgggataaatatgttctatccttccacgacaagagttgccaaggtagtgaaaatctcagcacaagagttggaccggttgtcctctttccgaatacggaagggttagtggacctagcagtgattgacgctttcctcgcctttcatcatggcaagaattgtttgttgtgcactggctctctatgtgtggctggtttcacacccttttctccaagaaggaaaggcgaattgggaccattcttggctagcatggaggggcgtctgttaattggttccctcgctagaaggaaggaagaatcaggattctatcttcatgcgaaggatgtccaaatgagaggagtgccatcaaacgaaagcatcatgcctttcatcgcacggggtttcggtgaccacaacgcgagggtactccaaggagttcgcaaggcatgggatgcggcgtga

SEQ ID NO: 86112 - DNA, 455 bp, Glycine max
  Peptide Sequence Number=SeqID_177797
ttcattggcccgaaatctaccctaaggctcatgagaaccctaaggccttctcttgcatctctggcccaatctacttggagtcttctatccaatgcccttgcggggtaggattgcatcaccaagtggcgcgcccaatgatggaaagggagatgatcacaatgatagtagacacgttaccagtgttctactatgagaaaatggtaggttatacaccctcaagctttgctgatttagtttttgtcggcgaaaggatcaaagtgggtttgaaaaggggaaaatttgatcatcctactttcacaaataaaaattttggggcaaatagagaggatgtgaagcacgaaggaacccatgatgtgattgtcgttcctacatggccaaatttcccaccaactcaacattgtcattactcagccaatattagcccttctcatttcccaccacccaatcatccataa

SEQ ID NO: 86113 - DNA, 216 bp, Glycine max
  Peptide Sequence Number=SeqID_177798
atgaattctgaagaacaacaaggattcatagaaatgaagatgttggaggctaagattccgatacactatggaacactactgagcaaggcaaaaatcttccagcaaatagttagcaaggccattattcacaagcaaggatcaaaggacttcctatccaatgctcacaagttcatcctatataacctcatggagtgcacttcgtttgacttgccctag

SEQ ID NO: 86114 - DNA, 336 bp, Glycine max
  Peptide Sequence Number=SeqID_177799
atgaagaaaaggatggacgcaacttcgtccaaggctggacctcctcaacaatgtctacctcctactctagttttccccaaggcaacaggtgtaatggcaaatgtctccaagaagcctgcacctaagaagcaacaacaaccttctccatctgccataggaaaaggcaattttgtggaccctagctcacccaggctagcctctggcttgcctgggtccccaatttgcttagggctgaaggaaccagctcgcctaggcgagccagtttcttcaggactaagcatcagctcgcctaggcgagctgccatagtccctaatgtcctcatttcctataaatag

SEQ ID NO: 86115 - DNA, 120 bp, Glycine max
  Peptide Sequence Number=SeqID_177800
atggcgctaagcgcgcctttgcggacaaaaaccctttttaagcctgaattgcagggaatgaaagaggaggtactcccttgtaatggagggctagaatcctttgttgggaaattccgctga

SEQ ID NO: 86116 - DNA, 609 bp, Glycine max
  Peptide Sequence Number=SeqID_177801
atggttatgggggatttcatcagcagactctccttccccgcatgtttgcattttagcgaagaaaacaccgagactttttcaagtctcacaagttatccagaactacgtaggtctgaattcctcattggaggatacgtaggagcaagagcctcgcttttgtcgaccataccgccttttgttgcacatgactcaagagctggtcagcacaccgcggagataccttacggttatccgcacccctttgctaggcagacacagttgtgtccgatggcaagcagagaccaagtttggtcattctgcaccagatacgcggagataccttacggttatccgcacccctttgctaggcagacacagttgtgtccgatggcaagcagagaccaagtttggtcattctgcacacatgatacgcggagataccttacggttatccgcacccctttgctaggcagacacagttgtgtccgatggcaagcagagaccaagtctggtcattctgcacacatgatacgcggagataccttacggttatccgcacccctttgccattcagacacagtcgtgtccaatggcacgcagagaccaagtttggtcattctgcacacatga

SEQ ID NO: 86117 - DNA, 47 bp, Glycine max
  Peptide Sequence Number=SeqID_177802
atggagcttacatcattaggatctagcatgccttatttgcctaagat

SEQ ID NO: 86118 - DNA, 585 bp, Glycine max
  Peptide Sequence Number=SeqID_177803
atgattaccggtgccagcccgggtattggtaaaacctttatctgtgccaacctggcgacgctggtatccaaagcaggtcagcgcgtgctgttcatcgatggtgatatgcgtcgcggctatacccacgagctgctgggtgcggacaacaagaccggcctgtctaacgtgctgtcgggcaagagcgagttctcgccggcgatgattcagaagggcgtgtacggttttgacttcctgccgcgcggtcaggtgccaccgaacccgtctgagctgctaatgcatcgtcgcatgcaggagctgctggactgggcaagcaagaactatgatctggtgttgatcgatacgccgccgattctggctgtgaccgacgcttccatcatcggtaagctggccggtacctcgctgatggtggcgcgtttcgaaaccaacaccaccaaagagctggatgtcagctacaagcgcttcgcccagaacggtattgagattaaaggcgtcatcctcaacgccgtggtccgtaaagcgtcgaatgcctatggttatggctacgactattacaactacgaatacggcaaagagagcaaaagctaa

SEQ ID NO: 86119 - DNA, 309 bp, Glycine max
  Peptide Sequence Number=SeqID_177804
atgtcagcattttccgatggagacttttcaagtctcacaagttatccagaactacgtaggtctgagttcctcattggaggatacgtaggagcaagagcctcgcttttgtcgaccataccgccttttgttgccatgactcaaaagctggtagcccgcggagacaccttacggttatccgcacctcgtcattcagtgagccccaagtgtgattcacgagtagagaccaatatggtcatctgcgccctttccggagaggtcgcattttccgatggagaaccttttcagtctcaagttatccgaactacgtga

SEQ ID NO: 86120 - DNA, 366 bp, Glycine max
  Peptide Sequence Number=SeqID_177805
atggcgcctaccaagcaccctctggacccggataagtccaacagggccctgggatttcccgacttgatcacaggactctgccagtcgttcggagtcccgttgcacctagcaagacaggcccagggggatgctccgcaggccgcagacgcgccgccacctcatcaggctggtccagccggatcgtttgatacagagcagtatttgcggcatttggttcgccagcaggcggccaaccaccgggctcatgtacaaactcatgattgtctttaccagatgagcctcagcctacagagccagggttttacttcttttccgtgccctacttcggaccagttcagggcagaggtcgcatggcctggagattag

SEQ ID NO: 86121 - DNA, 375 bp, Glycine max
  Peptide Sequence Number=SeqID_177806
atgttgttgaagcttggagggattaatggggacccggtgctgagaggaacgaggataagggctacatgggagtacgtgagcttagttgaaggtgggcaactgaggatggtgggttcatgtgtgatttgtggatgtggagagttgatttgcaccatcgcccgatcgccacctagtaccacatatgacgggcgagctcctgacagtcaaccgataaaagaacaaagaccacaaagcaaggaggcttgtgtggtggttggccagctatggatcttgagtgatatttggaatatagcctctggtaatcgattaccaagggaagttgagatggcttctggtaatcgattaccaaggggtgtaatcgattaccaggcttag

SEQ ID NO: 86122 - DNA, 804 bp, Glycine max
  Peptide Sequence Number=SeqID_177807
atgaaaacccgtctggccgttatgacctctgttgctgcgatattattttcacagcaggcattcgccaaaaacctgtgtaccctgattgttgacgctgaatcaggcaaagtcctgctggagagtggcaacgactgcagtagagaagtcacacccgcatccacctttaaaatagccatcagcctgatgggatttgatgccggcgtgctgaaaaatgaaaaggaacccgcctgggattaccaacaaggatacccggactggggcggtaaaaactggatgaataaaatcgatcctacggcgtggctaaaatattcggtcttctggtattcgcagcaggttgttaaaaaaatcgggcaacatcgctttgaaaactatgtaaaggcgtttgcttacggaaacgaagatgtttccgccgttgacgtcagcgcccccggtcagaatggggtgtgggttatgtcatccctgcagatttcaccggttcagcagattggctttttaaggaaagtcgttaatcgtgagttgcgcgtaaacaagcatgcctatgacatgacagataatattacccgctacgacgtcagcgttaagggctggacggtgcacggcaaaacaggaaccggctcaccggggaaaaataatcaatacgatccgcaccatgcctatggctggtatgtcggctgggcgaccaaaggcagaaaaaaaattgtttttgccaaactgattcaggatgaacaggtgttaacgccgaatgctggcctgagagcacgtgacgaagtgttgaagcagatgtcggcggtcattgcgccgtga

SEQ ID NO: 86123 - DNA, 369 bp, Glycine max
  Peptide Sequence Number=SeqID_177808
atgccgatctccccctgcggaagtatcagttggtctgtgtcgtcccgacatagggatcgcatccacaagacacccagtggacccggaaaagtccagcagggccctggggtttccagctctagttacgggcctctatcagtcctacaaggtgctcgtacccccccggcaaggtcacgtcatcataggcaggcacagggtgaaacaccacagcagcctggggatggccggcagcgggcaacagacgcaccgccatcacctctagagttcacctctgctcatccacaaaaaggtttgagtattgcctacaccacatggccgaccaataggcgaccaagtccaaagccaaaggacgcacctagttgctcatga

SEQ ID NO: 86124 - DNA, 642 bp, Glycine max
  Peptide Sequence Number=SeqID_177809
atggacatagactatgctataagaaaagacaaactacctgcaatcgctgatgaaagtagtttagttgatgttgcgttatataagtggtgtgagcggcccaaccaactccgcatgatgttctttaagacaaaaatcttggctgggatacatggttttgttgaccaacatgaaaaggttttagacttgcttaaggccattgatgaccagtttatcacttcagataaagctttagcaaggaccctgatcatgaatttatcctctcttcggctcaccagtgtgaaaggtgtgcgtgagtacataattaaaatgcgagatattttagttcaacttaagaaatgggaggttgacatgtctgagtccttcctagtgcacttcattttgaacactttttccgaagaagaaaggcagcttctaatggagatgagtgaaagtgcattgctgaaaattgcttgtgggaagaacaaagcaactaagtctcaagctaatcagaaggagattggtaaaataccacctcaagctaatattatgaagggtatgcaaaacctaaggaaaccagtgagaagtgagcaaaacattttatcaggcaataagctaggctcacctgtgaaggctattggaacttgcattttttactttaagtag

SEQ ID NO: 86125 - DNA, 300 bp, Glycine max
  Peptide Sequence Number=SeqID_177810
atgtcgaatcggaacggaaatcgcatatgccaatacgcccccatgagcctatcagtagtcggatacgcgcccatgagcgtactagctgatgacctctatatacaactagctccagcaacaaggttcgaacccactactgcgccatcaggacggatgaggcactggctgttgttgctagcggcggtagtggatcgtcagacccttttctcttcttccgtagtgaagctagtcaaagtgcaatggggccagggctcggattctatatatatatatataggtagttcgggttgctatgcctaa

SEQ ID NO: 86126 - DNA, 297 bp, Glycine max
  Peptide Sequence Number=SeqID_177811
atgggtgcatcttccaaggaaggaaaacgtgcggagtcgccaccaacgtttattcgaggaaaacatcggaaaaaaccgaaaaggagagaaacgttaaggcgttggacgattaacgttctcttggtttttgaaaggagagaaacgataaggcgttggactattaacgatctcttggttttcgaaaggagagaaacgttaaggcattggaccattaacgatctcttggggttgtcaacaaaagcggggcttttgctcatacgtatcctcaattgcgacgaggaaatcagacctacgtag

SEQ ID NO: 86127 - DNA, 411 bp, Glycine max
  Peptide Sequence Number=SeqID_177812
atgcatttgccggaaggctatccggtcgtgctgtccgacactgtcgggtttatcaagcatttgccaactaccttgatcgaagcttttggtgcgacactggaagaggctgcgcaggcagacttgttgctgcacattgttgatgttgccagccctaaccgggatgcacaaatcgagcaggtcaatattgtcttgaatgaaatcggtgccgcacaagtgccacaaatcctggtgttgaaccagattgaccgcttgggcatggctccgggaatcgaccgtgatgagtatggtaatatccgtactgttcgcgtctcggccaaagacggtactggcattgaagacttgcgccaggcactgttggagcatcagcaatacttgaaaaaactgagcacagaagaaagtgcttatgtctaa

SEQ ID NO: 86128 - DNA, 327 bp, Glycine max
  Peptide Sequence Number=SeqID_177813
atgtgggatactctccagttaacccatgaaggaaccacaagtgtaaaaaggtctagaatagatacccttacccgtgaatatgaattatttgggatgaacccgcatgaaaatatccatagtttgcaaaagagatttacacatatagaacacgagatggaacttcaatgcctcaatcagaatgaagaaaatgacaaaaagaagagaagcatagcccttaaagcctcatcttcgatacaaaaagaaaacgaagaagaagatcagatgatgaagagattttctttctttgttaagaaatttcatagaattcatcaagaaaagaagaattga

SEQ ID NO: 86129 - DNA, 623 bp, Glycine max
  Peptide Sequence Number=SeqID_177814
caacggagggttgcatgagctccccgctgatgcgcgaccttcagaatggatatctggataaggttgagcaggaacgagtccaggcaataatcgaacgagctcacaggctttgccatggctacgttagtgcgcagaaggcattcagagagctggatatcgagtatcagaacaatggcgttgcgcgactctactgcgataaatggcccctgacagggatgacgagtctgaaggccttcaagcagacaggatggagctattaccagcattactcaggaaatctcggcctattcatcacctctgtaattggagttgttatgtctgatgcaccttcagctttccggcaaattactcgcactgcccggaaggaacacaagtgctgcgagtgtcgccgtcctattcctacaggcgcaaaatacacttactcatctggcatatgggatggctcgcccagcgccgtgtctgattatgatgagcagcccatgttcacgcagctaaccgaatggctgggcaactatttccatcaaggttacgaccaagagttatcgattcgagacatttgccgcgacttaaatcttcgtgaggaggtgatttattacgcgctcaatggacgattcccatcatga

SEQ ID NO: 86130 - DNA, 1098 bp, Glycine max
  Peptide Sequence Number=SeqID_177815
atggcaaaaattttcggaaccgatatagggcatatccagatttccatttccattttttttgccggttttgctatcgggcagctactatggggacctttatctgataaaaaggggaggaagcctatgctgtattgcggattaatcctatttatgattggagccgttgctattatctttaccgaaaatatatatgtgttgtggatcatgcgttttcttcaggcttttggaggaagtgccgggattgtcattggtagggccattgtaatagacctctacgacaaagaaaaagcggtaactatcttttccaagcaatctcagataagcgggattgctcccattgtagcaccattaatgggcagtatttttctgaggttttggggatggaatagtgcgtttagctttttaagcattttaggagctatcactttatttcttgttgttaagtatattccggaaaccaattcccggatagcatcacctgaaacttcggaaactgacatccaattaaaaaatcagctgaaagttattatttccaatagagattttatcaacaatactattatcgggagtattgcttttgcatcactgattatttatatttccaatgctccattcctttttatggaaattcatggattttccagtgaagtattcagctttatatttgcctttaattccatggcattaatatttgcagcctatattactccgaaattaacccagagagttaaggatacccgaattctattttctgctgctatcctgttgttgtcaatgagctgtttacatttatttatatctctgggccaattgttcgtgggattggaagttgcggttctgttttcttctcttatagcaataggacttctttttcctattactactgcccatgcattatctccttttaaagagggacgtggaacagctgcagccctgatgggatttattcagttaatggttaccttcctcatgtcagctatagttggttttttagaatctcaatccattatgcccatgattatagcgcggatcgcactggcaggggttgctgtcttttttgcttatagaacttttttggcaaaaaaggtttacgcttag

SEQ ID NO: 86131 - DNA, 444 bp, Glycine max
  Peptide Sequence Number=SeqID_177816
tgtatccacaatgcaagcagtagacgtcaagagtgtgaaaattacattggaaggtggttgaaggaagcaggaaaacaaatttacatagcaccttatttaaaccaggcccattggcagctcgttgtattgtgcccaggcgacaatgtagtggtttggttttgttctttgaagaagaagccggatgttgccatcaagggtgcagtaaacagtgcaatgaaatcagtcaccaaaactgcagagggaaagccacctcagcatgggcctcagtggattgaagcaaaggaaattacgagtgtgggatactatgttatgcaatggatatggtgcatcgtaagtggtggattgaaggatgactggattcactggttttctgatcgatcaccgctaacagaagagaccatgaccacactccggcataaatgggcggcctatttatccaaatga

SEQ ID NO: 86132 - DNA, 567 bp, Glycine max
  Peptide Sequence Number=SeqID_177817
atgcctggcattctctcaaggctgaatgcaaccatttactgtcgcattcgggaagcaataacaaggcaacaaggagtgccgacatccttgtacagaagttcagctttgcctctttgttcgctcacttcaagtcacacacttcacacaaaatcaatgattactgcctcacattccaatgctatgctgggagatgtttatgcttatggcttaatctcaggtcgtggtagtgtgcgagacttcacaaagcctgctgtaggttgcttgaggggtagtgtgaatctaaggagactacaaccattgtatggtcctttgagttttgggtgttctacttttgatgctaataggaggatccgggattcgagtttgctgcatggatcatggctcaagaatttctcagcctcttcttctgcttgctactcagccggggctgcacatgctgtctcatttgatggaagccctcctgatgaacagcttgcaaattcctctttttcgcctgacccatttttcaatttagtccttgccacattggactcaaacttgtcacattgggttgcttacgtggactga

SEQ ID NO: 86133 - DNA, 393 bp, Glycine max
  Peptide Sequence Number=SeqID_177818
atggcaaggtatttgcatggtctcaatagggagatccaagacattgtagagttgcaccactatgcctctctgaaggatctcattcatcaagctatcaaggtggaacaacaagtaaagaggaagcaaacatgcaagaagaatagaggatcttcattgaaatctcatgaaaaggttcttcccttggtaaaaataattctaaccctactcccacttcatcaaaagcgagttccattaaatgttttaagtgtttgggaaagggtcatattgtctcccaatgtcctaacaaaaggacaatggctgtggtgggttatggggttattactagtgcatctttttcaggctcttctggttcttctactgagagtgaaagtcaatgtgatgtacaaccattga

SEQ ID NO: 86134 - DNA, 371 bp, Glycine max
  Peptide Sequence Number=SeqID_177819
atgacattgctacttagcaacattcttcccagcgaccgcaacgccaatctccccctgcaaaagtatcagttggtctgtgtcgtcccgacatggggatcgcacccacaagagacacccagtggacccggaaaagtccaacagggccctggggtttccagctctggttacgggcctctatcagtcctacagggtgcccggatcgcgcctgcaagacacccagtggacccgaagaagtccaacagggtcttggagttgtcaagctctaattacggcaagggcatcaggccccctactgatcgagctttcatcaagaagtactgcgtccccaggcaggcgcagggcgaaacaccacagcagcattgggatggccg

SEQ ID NO: 86135 - DNA, 663 bp, Glycine max
  Peptide Sequence Number=SeqID_177820
atggtcattgatcagtcactattcttttctttgactcatttacccagtcaaggtgcaccttttgagggcaccattgttgatgactggaaattcgattattcgagtcatgatgctcgtcacatggtttgtaatgatcaagctgaaatgactgcacaagcctctaaggaggatttgattcttatgtgggcttttcttaccggtcgtcagatcgactgggcccatttggttcagtaccgaatgcataaggcattacgggccaatgcacctcttccttatccacaattgattactctgtttttgcatcattttcaaattccgcttgatgatgaaccctttgttcaagtcaagcgttcctttgcaattggtgctggtgcagtgacctcctttgggtaccgtaaagatcggaatggtcaatggctgaagaaggatgcactccctcctcaagatgaacgtactccttcacctcctcctcaacgcaaagattctgcgctcatgaatgaagtcctctccgaattacggggtcttcgttcttatgttggtgactgcttcgactcgttagatacacgctttgccggtatggacattcgcctcacacagcttgaagaggatgtcggatacattcgtcagagtttcgatcttccaccaccacctccgtcttcttag

SEQ ID NO: 86136 - DNA, 859 bp, Glycine max
  Peptide Sequence Number=SeqID_177821
gatcccacctccgcaaggttcgtccacggagggtgagtcagggcctaagatcaggccgaagggcgtagtcgatggacaacaggacgcaaggtgcccctgctttttcagggtaataaggggtagagaaaatgcctcgagccaaagttcgagtaccaggcgctacagcgctgaagtaatccatgccatactcccaggaaaagctcgaacgaccttcaacaaatgggtacctgtacccgaaaccgacacaggggtgcctcctcacaaagggggtcgcagtgaccaggcccgggcgactgtttaccaaaaacacaggtctccgcaaagtcgggagccgacgaccgaagccccggtgaacggcggccgtaactataacggtcctaaggtagcgaaattccttgtcggacatgtctgtgaagatgcggactactgcacctggacagaaagaccctatgaagcttcactgtttctggggattggctttgggcttttcctgcgcagcttaggtggagggcaaagaaggcctccttctgggggggccagagccatcagcctcccaaaaggtaacggaggcgtgcaaaggtttcctcgggccagacggagattggccctcgagtgcaaaggcagaagggagcttgactgcaagacccacccgtcgagcagggacgaaactcacatcgacgggaaggtttggcacctcgatgtcggctcttcgccacctggggctgtagtatgttccaagggttgggctgttcgcccattaaagcggtacgtgagctgggttcagaacgtcgtgagacagttcggtccatatccggaccgggaaggacgcacctctggtgtgccagttatcgtgcccacg

SEQ ID NO: 86137 - DNA, 321 bp, Glycine max
  Peptide Sequence Number=SeqID_177822
atggccttcattattggagaatcatttggtggtagccatgcccgggagggtcctccagccaccctaggaccccatagatttatgtccttgtgccaagtgtcgtatccctcccgaagttcacaagtaccggatttgactcctgccgcccgtcaagtatcaaaacagtttgcggaaggcagctgtagcatggtataccaatctaagaagactgggtcggccaggagatctggagaggtggctatccagacgttttatcagtaccagtacaatagcggcacatggctcccgatggcggaacgaatctcagggatgaatttctaa

SEQ ID NO: 86138 - DNA, 450 bp, Glycine max
  Peptide Sequence Number=SeqID_177823
atgggtaatccaggtgatttacaaccctttgatcctgaaatagatagaaccttacatagattagttagacatagtttgcatcttggtcattctgtgcattctgatcattttgagcattttgttgctggtgattgtgaatattcggatattgagcattcggctgttaattttcatactgagaacatggctcaacctccacctagtgaaagcactcttaggcccttttgcgggcgagtgagacgaggctcacggttgcgcttttcaaaggaagaaagatgcgtggagtcgccaccaacatttatttgtggaaaacgttggaaaaaccgaaggaaaccggtcaaaaagaatattccaagttcgggagttgtatttacgtttgaggaaggtcgacaaaagcgaggctcttgctcctacgtaccctccatcgaagaggaaatcaaacctacgtag

SEQ ID NO: 86139 - DNA, 324 bp, Glycine max
  Peptide Sequence Number=SeqID_177824
atggcgttcaccatttggaatatgacgtttaccatggccgtaacgttgtggcgattcatggtggccatggtggatgcaacagggacatggatatgcactgcttcctcaaaccctactagtaagaggataaacattggatggaaacattgcacgactgttagaaaaaatgacacaaatgaaatatgttgtaagcattgccacaagatcatgaaaggaggaattacaagggggaaacatcatttgattggaaagccggggaatgttgcaccttgcttagtatgcttgaaagaagttgtagatgagataagggcatctgaaaaatag

SEQ ID NO: 86140 - DNA, 309 bp, Glycine max
  Peptide Sequence Number=SeqID_177825
atggagaaatctgaaaagaaaaattttagtgaaaagaaggtgaagaaggcctacatcatatgggatgacaatgatatggaatcatctgaggattcagaaaatgaagagataaacctgtgtctaatggctaaaagttatgaaagtgatgaagaggtatctttgaagaataaatggtacatagatagcggatgttcaaaacatatgatgggagatgcatcaaagttcacacatatctctcccaagaaaagcgggcatgccttaagcacaacttgcttagtgttagtcaattatgtgataaaggctatctag

SEQ ID NO: 86141 - DNA, 246 bp, Glycine max
  Peptide Sequence Number=SeqID_177826
atggaagcaaaagcacaaaaatggtggcctaggggcgaaaacctgcaaaacccatgggtgctgcgttttttgaatgagggaggggagttttgggtggagagaaactccccctcccctcgtttttatgtttccaggatactaggttccctcccagttgcgcttctcgcttgttcggagctgggcatgggacggagatccgtcgatcatgggcctagcctctactcacgtccgtccctaagtacctga

SEQ ID NO: 86142 - DNA, 411 bp, Glycine max
  Peptide Sequence Number=SeqID_177827
atgacaaatgaacaaaagcaaattgtgcaagttgtcaacaacaatgaaggtgacatgtttttcctatatggatacggaggtacaagaaaaacatacatatggagaacattagcaagttcattgagggcaaaaaatcaaattatgattatggttgcttctagcggcatagcttctctgttgttgtcaggaggcaggactgcctattccaaatttaagatacctgtgccaatttttgaagactcaacatgcaacatacttcaaggaagtcaactagcagaattgctaaatcaaacaaatctgataatttgggatgaagcacccatggctcacaaattttgctttcaagcacttgatcaaagtttaacagacattactgaagaaaaaaaatcccgatcaatctttggaggcaaa

SEQ ID NO: 86143 - DNA, 179 bp, Glycine max
  Peptide Sequence Number=SeqID_177828
atgaccacattggtctccgcttgtcaatcagacttggggtctccaaatgacgaggtgcagataaccataaggcgtcttcgcatgctaccagactcacgggtcacgatagcaggatggggtgcggataaccgtaaggtgtctctgcatgctattggactctcgggtcatgatagcaaaag

SEQ ID NO: 86144 - DNA, 576 bp, Glycine max
  Peptide Sequence Number=SeqID_177829
atgacaccggggccagatgatacaacgccagccgaaaagagggttgaggcgctcgcggcctacggcgctgtcggaacaccgtgcgaatgggacgatgggttcctgatcagaactgcgatcaaggtggagaccaagaagcgaatcgaccgccagcgtggcgtacgcactgccgatggttggttcaccagtgacgagcttttacaagagctgcgaactgaggatgccagtgaggttcgcagcgactgttgtgacccaagtgtgatctacgtgaaggttcgcgggagctggttcaaggccttccacaacaaagtgcaaagcgatgcgctcttatcggatcaggagcgactgtttcatttgctctgggcaccctcgttgcgctcacaatcggcaaaaagaaaagaggaagttgcccgtgctcgtcattcgcgccgagtgcaggcccaagcggcaaggcccgcaacagagcaccttgccccggtgccaatgcccggcagcgatgagaggctaaatatcgaaccagtgccacctgtgatcgcacaggacatcgttccgttcgatgaacgggaggactactga

SEQ ID NO: 86145 - DNA, 324 bp, Glycine max
  Peptide Sequence Number=SeqID_177830
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtcgactctagaggatcccccagccgaacgaccgagcgcagcgagtcagtga

SEQ ID NO: 86146 - DNA, 459 bp, Glycine max
  Peptide Sequence Number=SeqID_177831
atgatgtcagaagaaacgacgtcgattgactacgtaatggaggcggcatctaggtctcacttctccgccctgagactcgacggccaggtcccatcctccgccaccgccccgtcctccactctcgattcaaccctaaccctcaattcccttcccaatcaacccttcgccataggagtttctagaggtactgcctcgggtaaaaccaccgtcggcaatatgatcattcagcaactccacgatcactgcgttgtccttgtaaataaggacttgttttatcacgggttgaatcctgaaaagttgaaacgtgttcacaaggaagcatacatcagcaggagacaaagagcagatggtgccattagcagaagtccaagcacaaacagattaaacacaagcaaagggggtgcagggggtgcaaacaacaacaaacaagagaagaatggtgaggcctgcttaccttag

SEQ ID NO: 86147 - DNA, 165 bp, Glycine max
  Peptide Sequence Number=SeqID_177832
atggttcatgttagcacacaacttgatggaacaaacaagaccgctgttgttggtattctgtacaagtacggttcccccgatccattgctctctaaggtacttgggaaaatacataatggagattcagaggacgaagagaaaagcgtaggggtgattgatccctga

SEQ ID NO: 86148 - DNA, 90 bp, Glycine max
  Peptide Sequence Number=SeqID_177833
atggataagagcttgaaggtaggagaagatgagtggagggagagggagagaaaggaacaaaattttgggagagagaagaggaagaatgag

SEQ ID NO: 86149 - DNA, 1425 bp, Glycine max
  Peptide Sequence Number=SeqID_177834
atgtcagatgatcaatttcaagcaagtggaaactggtgggaaacagcaagaagcgtgagatttgagagtagagaatcacaatcttcttctggcctcaccaacaacattggaagctatgcagcttcttggcaacaacatcaacaacatgacatggcaacaaggtcttcttccatggataacaactctgtctcaggtggttcctctgtggtcttccatgaccagaagcagcttcaagttcatgattcatcaccagcagccacttccaccaatgaccccaactttcacatgatggccttgggcctctcatctcaagccatggactggagtcaagcatctttgccgctgcgaggtgagaagggttcagagaacagtttcaggtcgatgttgcaagagaatttgagctcatcaggcacaaattttcagcagcaagaatgtgggagcaacagtataggcttgtctcaacaccaccatcaccatcatcaacaagttcattggaaaccagaaaagttgttctcagctgagtcatcaagcaacgaattcaagaggggtttctccttggaccaaacacagttttctcctcaatacagctccggggacagcactgtcacaagccaaggcttgccttgttcttttcagatagactatgttgggaacccttcttcaatattgcaaggtcttttgggacaagagagcaacaacaaccaacaacaaccccaccaaggtggtggtgccatgaattttccttactcagcagcaagctatggattgaactcgaatattgagttggtgccttcttggtctaaagttcctcagtttctgagagcttctccgccaaaacaaccccccaataaccagttgcatttcaccaacaacgctcccttttggaacgctaattctgagcctgctattaaggattctcgatccaactttatcccctctttgcaacctcccttccccacatcaaatttcgatgtacaatcgaagaatatatctgaagttagagattcgggtggtgtggtgaagaaaagtgggagtgaggcagcacccaaaaggcccaggaacgaaaccccatcacctttgccagcttttaaggtgagaaaagagaagatgggggacagaatcactgcactccaacaattggtttcacctttcggaaagactgatacagcgtcagtgctctctgaagccattgaatatatcaaattcctccatgaacaagtgactgtgctaagtaccccgtatatgaaaagtggtgctccaatacaacatcagcagagttctggaaaatctaaggaatctgagggtccaaagcaggatcttagaagccgagggctatgtctggtgccagtttctagtacatttccagtgactcacgaacccacagttgagtattggacaccaacattcggaggaacttacagatag

SEQ ID NO: 86150 - DNA, 534 bp, Glycine max
  Peptide Sequence Number=SeqID_177835
atgaccggaaggcttcttgccggttcattggcttttgagagccgcatccttcattaccttattgttcgtatcttacttccaagatcttcaaaccttgcacaggcattgcgattaaatgctcctttaccatatccacacttagtcacccttttccttcaacattttaacatccctcttgattctgaaccttatgttccaatcaagatatctttcttaataggcgcttcagtcattgcatcctttggttatcacaaagagcatgatggctcttgggtgaaaaagggtgctcgacatgttgatgaagaaggacatggtggagaagattcatctcttcttcaaaagattttggataggttcgatggtcttcaaacctttgttggtgaaaggtttgatactatggagttacaagtggacatgcgcttcaatgagatggagtcaagaatcaccaaggtcgaagaagatgtttctatattcgttcaagctttgatctaccaccaccgccgccaccatcatcttagtttttctattatttaa

SEQ ID NO: 86151 - DNA, 303 bp, Glycine max
  Peptide Sequence Number=SeqID_177836
atggataagggcttgaaggtaggggaagatgagtggagggagaaggagagaaagagcatgactttttgtgcttcaaaagaggtgtcgcaacctacccttcggctggagggcggcgcggggctcacgagttcgtcttccatgggaggaaaatgcgcggagtcgccaccaaagtttattcaaggaaaacgtcagaaaaactggaaaaggtgtggtctacgaactttaatcgtgaaaggttctggagttgtttttaagcacggggaaggtattagcatcccacgcgtccgtcacaagggacagtag

SEQ ID NO: 86152 - DNA, 255 bp, Glycine max
  Peptide Sequence Number=SeqID_177837
atgggcccaaaatctaccctaaggctcatgagaaccctatggccttctcctgcatctctagtcaaatcttcttggagtcttctatctaatgcccttatgatgcaagctccattggagcttgtaggcctaggattttcttcatcaatggattcctttgcttcttggaagatgaatggcagcggactggagaaggaagagggagaggagacgccacttcaaggagaagatgagtctagaagaagctcaccaccatag

SEQ ID NO: 86153 - DNA, 232 bp, Glycine max
  Peptide Sequence Number=SeqID_177838
atgggtgccaagtacctcaaagttgtcaaacgagggtcgcatcccaacaaacagatggcaagaaatgacattgatgtttatctcagtcccttgattgaagacttgacagagttgtgggacgagaaggtttcagtgtttgatgggtttcgaaatgagacttttgatttacagtaccttgaaaaggtaaagcctgttgggcttcccaagtctcagcatgacgaaagagtgggag

SEQ ID NO: 86154 - DNA, 261 bp, Glycine max
  Peptide Sequence Number=SeqID_177839
atgcagaattcaaagagggatgtgtacctaggagcctacttgaatgctgcacattggcaaatggtcatcattttgcctaaggaaaatgttgtcatctggttttgttcgttgcacaataggccaaacaactacctgaaaggaattattaacagtgctttgaaaggatttaacgataatccacaaagtaaatccaaagttactctaggtggattgttgttaaatatttcaatgatgttagaccattggaaccacagagattga

SEQ ID NO: 86155 - DNA, 228 bp, Glycine max
  Peptide Sequence Number=SeqID_177840
atggggctccgaaaaagattgagaatggagaattgcactaagcaatcactacgcatggctccaaactcgaagggtgggatattgccagtcgagaatgatttcgaatggcaatctggcttgaagaattttggccaaggttcaaaaaggtctaaggttgtgtttcaatggggtcttttatcgtgggaaccaaatcttgatatctggggcgaaacaaatttgggtgtcaag

SEQ ID NO: 86156 - DNA, 504 bp, Glycine max
  Peptide Sequence Number=SeqID_177841
atggagaaagctccaaggattgacccgctctacaaccctaattcatcgtcattggggctattctctcgaaagaagagtgtgatagaagcatatccgtttcagcctagggatcagcctatcaaacaaacaaaaatagttggaatggtgtatccagcagacggtctttcatcagtaagcgatgtgctagtctttgttggtgaatacctatctggtgttcaagtctccggtccttgtccttctattagtggtgcgtccgctcactggccctttgaatctggagatgtagttgcgtgtactgattctcatcgagattgggttggtcttcagtgtaccgcttgtgtagcctatgcgaagcgaacaagcaagggattgaggcgaaagccgcgttcgcgcattcgtttgtttgggtacaagatcgaaaagaatgcattggatggatgcccgggcattgagaaggaaggacgctttcagaggcgaaaggccatggggagataccgtctgtga

SEQ ID NO: 86157 - DNA, 525 bp, Glycine max
  Peptide Sequence Number=SeqID_177842
atggctcaattgatttctgatgtcatctattgtttgcagggatcgcgcccacaagacgcccaatggacccaaagaagtccaacagggccctggggtttccagctctggttacgggctctgtcagtcctacagggtgcccgttccccagcgaggaatcgcacccacaaagacacccagtggacccggagaagtccaatagggccctggggtttccagctctggttacgggcctctgtagtcctacagggtgcccgttccccccgacaaggtcacgtcatcatagggaccgcgcctgcaagacatccagtggacccgaagaagtccaacggggtcttggagttagtgcctgtcacctccagcaaaggcatcaggccccctactaatcgagctttcatcaagaagtactgcgtctccaggcaggcgcagggcgaaacaccacagcagcctggggatggccggcagcgggcaacagacgcaccgccatcacctctagagttcacctcagctcatccacaaaaagtttag

SEQ ID NO: 86158 - DNA, 366 bp, Glycine max
  Peptide Sequence Number=SeqID_177843
atggggatacaaaagaattctcaggcggagaagggagacacaaatgaattcaggcggttagtcctttgttcttttggaaaagggagaagagagacacaaaaagaattcagggggttagtccttggcgaattctttttggcaaagggagaagagaatgaaaagatgaatagcacaagttttcaaggtttagaaaaccagaaaacttcagaaagcttttggtacaaagaagaagaagaagttcaaagagattcaaggcttgtaaaagattgtatgaataagtgttcaagattattgaaatgcaaaacaaagccttgcttttatagactcttcatgtctggtcaagaagaccatttagaagagttataa

SEQ ID NO: 86159 - DNA, 498 bp, Glycine max
  Peptide Sequence Number=SeqID_177844
atgaagttgacaaaattcatagtaaagaatttccagattggttccgtgaacgagttgctcgattggaagagcaagacaacactcgtgacaaatgatatcaagtggttagcacgtgatccactagaaatagtgagaagatatagagggtacattgttgatggagttggatttcatacaaagatacatgaaagaggttgcaaagttgataatttcgctaagaaagtattctatgtggagaataaaacacaaaatgattggcttgttgttatgcatgctaaaatcagagatgtatatgatatgggtgatgagcaatccaatgacatagatcaagggaatgaacaagtcttacaagagataaatgataatgatttgatcaaaccagaagctgatgatagtgatgatatcattgaagttgcaatacctatggagaacattttaccacatgacaaggatgataattatatagatgatgatgagagagatgcaaacttcttttga

SEQ ID NO: 86160 - DNA, 901 bp, Glycine max
  Peptide Sequence Number=SeqID_177845
atgagtgaggctgaagcccgcccaaccaattttatccgtcagatcgtcgatgaagatctggcgtcggggaaacacacgtcggtacatacccgcttcccgccggagcctaacggctatctgcatatcggccacgccaagtccatctgcctgaacttcggcatcgccaaggactatcagggccagtgcaacctgcgtttcgatgacaccaacccggtgaaagaagacatcgagttcgtggagtcaatcaagcacgacgtggagtggctgggctttgagtggagcggcaacgttcgttactcctcagactatttcgatcagctgcaccagtatgcggtcgagctgatcaccaaggggctggcctacgtcgatgagctgtcgccggagcagatccgtgaatatcgcggcaccctgaccgcgccgggcaaagacagcccgtaccgcgatcgcagcgtggaagagaacctggcgctgttcgagaagatgcgcaacggcgagttcgccgaaggcgccgcctgcctgcgcgccaagatcgatatggcttcgccgtttatcgtgatgcgcgatccggtgctgtaccgcatcaagttcgccgaacaccaccagaccggcaataaatggtgcatctacccgatgtacgatttcacccactgcatctccgatgcgctggaagggatcacccattcgctgtgtaccctggaattccaggataaccgccgtctgtatgactgggtgttggataacatcaccattccttgccacccgcgtcagtacgagttttcgcgcctcaacctcgaatacgccatcatgtcgaagcgcaagctgaaccagttggtgaccgagaagatcgtcgaaggctgggacgacccgcggatgccaaccgtctccggtctgcgccgccgcg

SEQ ID NO: 86161 - DNA, 258 bp, Glycine max
  Peptide Sequence Number=SeqID_177846
atgtggtaccctccccaaggaaatagcctaagcatgtccacacgacactctcacttaggaaaactaggcagtaagtgtcgaggtcaccctgtcgtgcacaagcaactcccctccccccccccctatggtgatccgcctgagtctcaagggagttccaaaccgagtgacatgcccccaagtacaagtattcctccacatgaggaactacaagtacttactgacaaagtttatactgtttccatgtcatatgaagtatga

SEQ ID NO: 86162 - DNA, 435 bp, Glycine max
  Peptide Sequence Number=SeqID_177847
tcgttcggggttcctgtgacccccagtaaggtgatccgaccgccgatcacccgggccttcatcgagaagtattgcacgcctaggcaggcgcagggtgatgcacctcaggccgcagacgcaccgccaccacctcatcaggccgatcccgctggatcactaggcatggagcattatctacaacacttggttcgccaacaggcggccaaccaccgggggctgttgccgatacatgagtgtctctaccggttcagcctcagtcagcaggggcagggtttcgctctttttgcatgccctactgcaaagcagtttggggctgagatcgcatggcccgaagattggctcgaggcccaggcaggggaggagcccgcaggatcccccggtgaggcagaggaggcccgtatggatgaagaaatgacggacttgcttggtttctag

SEQ ID NO: 86163 - DNA, 468 bp, Glycine max
  Peptide Sequence Number=SeqID_177848
atggagaaaattcccgatcaaaaggatcagaagaaaaaattcccaatcaaagagtgggagaaagcaaaaaaaagaagaaagaaaattctcgatcaaagatcggaagagaaaagaagaaatatgcagaaaggtcttaggaccagacaatatctgaacaatacaaatttgtcaccaagtaaacaagaaaagaaaggaaaccatgacctaaagtggtcctctccctttgattgccaaccaaaatcctgtgtgttagcgactttttcggcccgcactaaacaaaaacagaaaaggaaaaggccaaaaacattcaaagccaaaattcccacaaaaaaacacaccattcccaagaaaaagtcctaccgatccatgatcacgcatgtaatctttgattttataggaaatgatttgcaagatcaagtcatggcatatctatggttcggaattaggacgaaacacttacctgtgtga

SEQ ID NO: 86164 - DNA, 1221 bp, Glycine max
  Peptide Sequence Number=SeqID_177849
atgggtcagctccagcgacaagccttttgcaaagcttacggtaagatctgggacctagccatggcagaggtctccaaaaaggccattgcctccctcgcccaatattatgaccagccgttgaggtgcttcacctttggggacttccagttatcacccacggtggaagagtttgaagaaatcctgggatgccctctgggaggaaggaaatcatacctcttctcaggattctatccctctttagctaaaatttctaagatagtccaaatctcgacgcaggaattacaccacagaaagcaagtcgaaaatggggtggttggagtaccgagggaatgtttggaagcaaaagcaagagtcttggcaggtgaaggcgaatgggccccgttcatagaaatcctcgcacttttgatcttcggaggagtcctctttccaaatgtggatgggttagtggaccaggcagcgattgacgcttttttcgcctttcatgaccgcaaggaaagcccagtcgtcgctatcttagccaatctatatgacaccttcgaccgaagatgtgaaaagaatagtataaggattgtttgctatacttcggccttctacgtatggttggtttcacaccttttccgccaagaattgagacatgcttgcccgctagaaggccacctctcatgcacagagaaaaaagaggcaagttgggaccgactcttagcaagtaaagaaggagcgtctatcaactggttcccccgatggaaagaaggaagaaccggggttcttatttcatgcggaggatttccaaatattcccttattggggacaaggggttgcattaattacaatcccatcctcgccataagacaactgggctaccccatgagtggggcaccattaaaggaagacctcacacctattattgcacgaggtttcaataacaccaacgcagaggcacttcagaaggtccacaaggcatgggagatggtgcaaaagaaggacaaggaactcagaggcagtagcaacgggcccatcagtggctaccataggtggttgaaagcctacacgcaaggtctggattggctcccgaatttgagaaccacaaagggggtggaagttgaagctctagaggagaacgaagaggttcaggccctcagggcagaactcgagaaagcccaaacagtcaaaaaaaagttcaaatcagcagctattaggattcgaaagaaaccgccgaactga

SEQ ID NO: 86165 - DNA, 165 bp, Glycine max
  Peptide Sequence Number=SeqID_177850
atgtcgtggctgaacttacaaactgcctttcctcttgggccgaaacagaattttctacagcatatatctatccaggcagcaggattaaggagtaacagatggcgatattggtggatggcggatatgggaacttttagaaactgccaatacgaggcaagtgaatag

SEQ ID NO: 86166 - DNA, 354 bp, Glycine max
  Peptide Sequence Number=SeqID_177851
atggcctctaggaagaggaaatcaaccgcctcccgacctcaggaaccatatgacactataagattcatctcagaggtcgcattggaaagatacgagcaaaacattcactcccgaagcatccttctggagaggaacgttaacttattcattattgagtatgacgagttccacagggagctcgagaggaggtggtggcataaagccttgactagggattcgctcaacgcattcttggagaccctagtggttttggagccaggggagctgtcataccctaatttcgtccggggaccatccgttgttgggatacgaccctcgtttgaccactttgaggtacttggcacccatcgttag

SEQ ID NO: 86167 - DNA, 302 bp, Glycine max
  Peptide Sequence Number=SeqID_177852
atggtttctggagattccgaggctttcggggatgcaaatagcagttttcaaaatttcgaatctgccccttccagaatattttcgaagcagggttgcttcctccagaagcaacccagctcgcctgggcgaaatggggctgttccaaagatccatcatccccctgactatgcatttcagctgttttgggtgaaaaaaattgtttccacgaagaaaatccaagccgaggtgcttccgagacgtttccgtaagcaaatccgtgaaggttttccgtcgttcttcgttcgttcttcgttcttcaacgg

SEQ ID NO: 86168 - DNA, 216 bp, Glycine max
  Peptide Sequence Number=SeqID_177853
atgtgtgttcaagaagaagaaaaacttataatggagatgggtgagagtgcattgctgacaacttcttgtgggaagaaccaagcaactaagtctcaagctaatcagaaggagaatggtaaaataccacctcaagctgatattaagaaggtggcaaagtgtttcttttgtaagaagaagggacacatgaagaagaattaccccagattccagaaatga

SEQ ID NO: 86169 - DNA, 237 bp, Glycine max
  Peptide Sequence Number=SeqID_177854
atgactcaacaagttgaggtgtgtctcaccattggaagatataatgatagggtgttgtgtgatatggttccaatggaggcgactcatatactgttgggaaaacatggaagtatgacaccaaatcagtgcatgatggcttcaccaacaagatttctttccagcaccatgaccaaaaaatttattcttaaacctctgatgcaatcctccctaggaagggaccagtcactagaaccatga

SEQ ID NO: 86170 - DNA, 204 bp, Glycine max
  Peptide Sequence Number=SeqID_177855
atggaatttttgagaaagaacaggacctggatacttgtggatcaacccaagaagcagaatgtgtgggatagcaaagggtgtcacactattcctgtgcatcccaaaggcaattacttagcaagatcaagatggtggaagaggtttaggacacaagcacatagatgtgaaaccacttggccatcatacaaagctatctgtgattga

SEQ ID NO: 86171 - DNA, 333 bp, Glycine max
  Peptide Sequence Number=SeqID_177856
atgaagaaaagagatacaggccatcaaagtgtgtcattggagaataagataggagattcaattttgctgaagataggagattcggctaaagttgtgataaaacaagacatgaagggaggagagcataaatatgggtttaacaacaataaacgtgagaagacagagaagaaaagggtggtggatgatgaaactggcgacaaacatgagttgtatgaagtcctaaggatgccatctaaaacaaaataccgatgcctcaatcagaaaaaatgtagctgtcacttacttgctttggtgacctctgtctttgcagaaaattacattagacgatgttaa

SEQ ID NO: 86172 - DNA, 386 bp, Glycine max
  Peptide Sequence Number=SeqID_177857
ggaagctgagtgtgaagtatgcaattctgcataggattggcgctgcaaactgggtacccaccaatcatacttccactgttgccacagggaaagctgctgcttcaggtgctgtgtccaaagatactttgattgctgaactcaaggacacatgcaaggtgctggaagccaccatcaaagccaacacagagaagaagatggagctggaacgcctgatcaagagactctcagaaagtggcattgatgatggtgaagcagctgaggaagaagaagaagcagctgaggcagaggaagatgcagcagagatacagattcagatgatgatgatgattctgaagccaccccatgatcatcagacctttatattttttgctttttaccagctatag

SEQ ID NO: 86173 - DNA, 541 bp, Glycine max
  Peptide Sequence Number=SeqID_177858
atgactactccaccagcctcgcctcctcctcctcatcccgcagtagcatcagagtctccgtctaccttgaaacggacacgcaaagctacacggctacgatccttggccactagaccacctggggcagagagaccagtggtccacgtcgatcttgtgaccgacaaggccgacggtccccacaagaagaaattaagaaaatatttggggattgtcgctcgtgataaggtcgacgtgacatacgagatctggaaggaagcagaatttgaaatccctgaagcttctgatggtaggacaaagaagaaagttcttcagactgtcggtgagtggtggtggcagtttaaatctgatttgacgaggaaatggacacttgcagccaacaaggacggtgtggaggacactgtctctgaaaaatacgacatttgcaaggagaaatgggcccagttttgtcagacctgcagtgacccctcgtgggaggatgtgcggaaaaaggcacaggccatccagaagcaaaatactgccccccacatgttgtctcatgggg

SEQ ID NO: 86174 - DNA, 141 bp, Glycine max
  Peptide Sequence Number=SeqID_177859
atgttgtgctggtactccagatcgtttgagttgataggaattcgtgaagacccctgtgtttggtcaatgtactcaaaacaatttacctgtcaaggaaacctgatacaaccattgttgggtctgcacaagagtggtctatga

SEQ ID NO: 86175 - DNA, 363 bp, Glycine max
  Peptide Sequence Number=SeqID_177860
atgggcttacttggaggtggtcatgcacggttgcggatagtcacgtcggagggtcgcagagggggaaggaggaagggggagtggcggggcgggtctgggttcgaggtcggggtggatgtagtaatcccatactcgtacccgtacctgacttttgattattggggaaaactcaaacccgaacccatactcgatcaacttgggtattacccgtcaaagtcggaacgaatacccacgggtatgggttttcttgcaatgtctaagggggagagaggaaagagaaggaagaagaaggtggaggggaggggaagaaggaaagttaggagagaaggaggggaaaaagaaagaaaaggaaaaagaaggtag

SEQ ID NO: 86176 - DNA, 660 bp, Glycine max
  Peptide Sequence Number=SeqID_177861
accataggagagtggtggaggaagtttaagtcaaatctgacctctaaatgggccctggcacacaacaagaagggcaaggatgacaaagtctacgagaagtacggaataagcaaagagaagatgttcgaacgaaggcataggccactcaaaaacaaaacattgcccctcacgtgttgtctcgcctcacgaggaagctttatcgcccatagacgtcaggatatattggctgctgctattgggcgaccagagcaccctagtcgtgtctgtgctgctagagccacaactgacacaaatgatcatagaccagtgggaggagttgattacacaaaagtgactcaacaactaatgatgtccttcagccagatgcagtcgcaaatgcaatcacaaggaatcgcactgcctcctgaggttaaggggtccatgactgtccacaacattcctttgggcaatgatcaactcaagcttggtgttgacaaagttcgacatgctgatgctcgtgtttccgtactcactcaagagggtaagcaggtagctgagggactggcaaaacctatagatatgtcaaatcctgacgtcgatccgctgtacctgatgacattgaccattccgcaacatttcttgaagtcgttgcaggtgtcgtgggatgctagcgtgtttgcg

SEQ ID NO: 86177 - DNA, 2703 bp, Glycine max
  Peptide Sequence Number=SeqID_177862
atgcttcatttccacgtacaaggacttttagatctttcaagaggatatatagggccttgcggtgaacgttattgtctaaggcttcgaggtatttgttttctcatttcaaagggttataaggttggcttggtggtgaagggagaagggaagggggggggaaggataaggaattgtttgacacagttgtatgctaaagacataacaccggacgataaacaggagcttgatgaggctttacaaagagagcattgcagaaatgctatgatattattatgctcttcttgcatgaagattcaagctgcatttcgtacggatgaaattcgaaggacccctcctacaccacaagatgagatgagagcaggaatgagctactttcacgagacgatctggaaaggcataccaaaatttttgcgccgggttgacactgctctgaagaacattggcataaatgaacgtgttccatataatgcccctgttattcaattctcttcttggatgggaggagatcgtgatggtaaccccagggtaactccagaagttacaagggatgtgtgtttgctggctagaatgatggctgctaatttgtacttctctcagattgaggatctcatgtttgagttgtctatgtggcgctgcaatgatgagctacgtgttcgttctgatgaactccttagctcctcaaagagagatgcaaaacattatattgagttttggaaacagattcctcccaatgagccgtatcgtgttattctcggtgatgtaagggacaaattatataatacacgtgaacgtgctcggcagttgttagccaatggaagctctgaaatccctgaggagactaccttcacaaatgttgaacagttcctggagcctcttgaattatgttatagatcgctgtgtgcatgtggtgaccaaccaatagctgatggaagccttcttgatttcttgcgccaagtttccacatttgggctttcacttgtaagacttgatatccgtcaagaatcagatcggcacactgatgttatggatgctattacaaaccacttagagattggatcttatcgagagtggtctgaggaacgcaggcaggaatggctgctatccgagctcagtggaaagcgccctctctttggtcctgatcttcctaaaacagaagaaattgctgatgtattggaaaccttccatgtcattgcggaacttccttcagacagctttggtgcctatatcatctcaatggcaacagctccatctgatgtgctttctgtagaacttttacaacgtgaatgtcatgtgaagcagccattaagggttgttccattgtttgaaaaacttgctgatcttgaggctgctcctgctgcggtagcccgcctattctctatagattggtacagagaccgtatcaatgggaaacaagaagttatgatagggtactcggactcgggaaaagatgctggtcgtttctctgcagcatgggcactatacaaggctcaagaagagctcataaaggttgcaaaagagtttggtgttaagctcacaatgttccatggcagaggaggaactgtgggaagaggaggaggtcccactcatcttgctatattatctcagccaccggatactattcatggctcacttcgggtaacagtgcaaggtgaagttattgaacagtcatttggagaggagcacttgtgcttcagaacacttcagcgcttcactgctgctacacttgagcatggaatgcaccctcctgtggcaccaaaaccagagtggcgtgccctcatggatgagatggctgtcattgctacagaggagtatcgctccattgttttccaggaaccccgtttcgttgagtacttccgatgtgctacacctgagctggagtatggaagaatgaacattggcagtcgtccgtcaaaacgaaagccaagtggaggaattgaatcacttcgtgcaatcccttggatctttgcttggactcagactaggtttcatctacctgtatggcttggctttggggcagcatttagccatgttattaagaaggatccaaagaatctccaaatgcttcaagatatgtataatcaatggcctttcttcagggtcagccttgacttggttgagatggtgttcgccaagggagaccctgggattgcggctctttatgacaaactcctagtgtcagaggaactgtggccatttggcgagcgattaaggtctatgtttgaagaaaccaagagccttctcctccaggttgctggacacaaagatctccttgaaggagacccctacttgaagcaaagacttcgacttcgcgattcatacatcacaaccctcaatgtcctgcaagcctacacattgaagcgaattcgtgatcctgactaccatgtgaagttgaggccacatttgtccaaagactacatggaatcaaacaagccagcagctgagcttgtgaaactcaaccctacaagtgattatgctcctggtctggaggatacccttattttgacaatgaagggtattgctgctggcatgcaaaacactgggattagtgtgtcttccaattttaaaattgatggggcaaaacccattttgctcgatgctctcaaattctgttgcatagggaacaacctatctgaatttcaccaacatgcagcagtgctttgtccaaaagtgacaaacttcgtgaatgaaaatatacccatttga

SEQ ID NO: 86178 - DNA, 228 bp, Glycine max
  Peptide Sequence Number=SeqID_177863
atgctgctctttttcaaaaccaaaaggcttcaaaatccctacacattaagggtcacaacagccatggagaaaccaaagttggaggatttgctgctccggtctacttgtctatcccttccaagagggactccaattccttcttctggcccttcactacccatcaatggacgtggggaatgttccttaatgcaaaccaggcagagatgtttcaagccaaatgcaaagtag

SEQ ID NO: 86179 - DNA, 627 bp, Glycine max
  Peptide Sequence Number=SeqID_177864
atgacccgccaaggagttgaaactaatttgggccgagcatgggtcaatgttgtcgggagggtcaagaggcgggtcatatggcactatattaggcagagttgtgtcttcatcatctgtgatcaacagaaaaaccctagaggcacaaccgtgacctctatggacgacctggagaaggaagtagcggtggaagggaaacagaatgcggtggtggcaagggttggtgtggcggagcacgagggcgagatgaatgacggacgcccaagagtttctcctcttggaggcaatccagactggccgcttgcacgaaggtcaggggttggtgtgcttccacttcatgccgaatttccggagtactgtgctactgttcctcactgtgttaatttgaatagagctccgatagggtccttgtattgtgatggtactgacggcagtggcggaacatacaaggttgaggaaggggatgatgagaggatgggcgtcatgcggtggagcacaaagcatcatcgagtttgtcggaagaccccatgggtgaaggtggggaggaagctcaatgagagcaccaaaattgataaggaagcaagaaaagggaaagctggcttcgagggccagaacctccagacaaggtag

SEQ ID NO: 86180 - DNA, 621 bp, Glycine max
  Peptide Sequence Number=SeqID_177865
atggataatgaagagggcatgcaggaacagatgaaggccgatctatcggccttaaaagatcaaatggcttccatctcgaaggtcatgttaaaactccagaaaaccatagaggataaagccacggcaaccgcctcaagtacggttagggaagcggagccggtgctgcaacccattttaaattcgggcctagacagaaacacggccgtgttcggtcgaaggtatagcccgcaagcttatccttatggcctacctcctgacttcaccccccgtgccaccccggaagatttaagccaagcccctactttcgaggggcaactcccgccttatgacgactatcccgggcaagacgatgaggaaggagatacccatcttggccccctgctccacctcaaagatccatccccacatgaactactccaaccgaacatagtccgccatatcccggcctcacccacacccgtaaaagaatctgttctcttcgcggaagataagggaaagattgaggcacttgaagagaggttaagagcagtcgagggccttggcaattacccatctcggattagcggattatgtctcgtgccaatatcgtcattcctccaagttcaaagtgccggactttga

SEQ ID NO: 86181 - DNA, 288 bp, Glycine max
  Peptide Sequence Number=SeqID_177866
atgttttccttaaataaacgttggtggcgactccgcgcatattcctttctgggaagacgaacctgtgagtctcgcgtcgccctcttgccgaagggtaggttgcgacagatagcaaatgagactttttcgcagtctcggctagaagaggctgacatcttcggggaagtcttacggatagcaaataagactttttcgctgtctcggtcggaagaggctgacttctccagggaaggtggagatgaagacgttagtcactgcatgccattgggccttgagtcttacggatag

SEQ ID NO: 86182 - DNA, 629 bp, Glycine max
  Peptide Sequence Number=SeqID_177867
gcgtacggaaagatcttagatttgaccatagcagagatatccacagaagccatcgcatcactcacccaatactatgatcagcccttgagatgcttcacgtttggagacttccaattagtaccgactgttgaagaatttgaggagattctaggatgtcctcttgggggaaggaaaccgtatcttttctctggatttcttccctccttgagcaagattgcagttgtggtcagggattcggcgagaggattggaccgcgtaaagcaaactcaaaacggcatagtgggcctaccgcggaagtacttagaaggcaaggcgagggatatggagaataaagaggagtgggtcttgtttatggatacattagcattgctaatctttggggttgtcctttttccaaacgtggatggtttggtggacctagccgcgattgatgctttccttgcatatcaccatagcaaagagagtccggtggtagctgtcttggcagacttatttgacacatttgaccgaagagtagattgggaccaacacttggctgggataggaggcagaacagtcaattggtttccacgatggaaagaaggaaaggagggtgttctcttctcatgtgggggctacccaaacatccc

SEQ ID NO: 86183 - DNA, 280 bp, Glycine max
  Peptide Sequence Number=SeqID_177868
tccacagggccctggggtttccagctctggttacgggcctctgtagtcctacagggtgcccgttcccccgggcaaggtcacatcatcatagggatcgcgctgcaggacacccagtggacccgaagaagtccaacagggtcttggagttgtcaagctctaattacgggtctctgtcagttctacggaggcgaaataccacaatagcctggggatggccggcagcgggcaacagacgcaccgccatcacctctagagttcacctcagctcatccacaaaaag

SEQ ID NO: 86184 - DNA, 233 bp, Glycine max
  Peptide Sequence Number=SeqID_177869
atgaggagaggcaagagtgaggcaaacactgaaaagaagaaggatactaatccaaatgaaggcaaggaagtaccttatccattggtaccttcccggaatgataaagaaagacatttggccagatttcttgatatcttcaagaaactggaaattactttgccctttggaaaaacacttcaacaaatgcccctctatgccaaatttttaaaagatatgctgacaaagaataaccg

SEQ ID NO: 86185 - DNA, 261 bp, Glycine max
  Peptide Sequence Number=SeqID_177870
atgttgcggaaccttacggattacgtaatcatccctcttttgccttccggaacgttacggaactttacggattgcgcactaacacttccttttaatttctggcatgtcacggaacttcacggattgtgctacaacgcttttattttggcttccggcatgtctcggagcttcacaaattacctaacgatgggtgtcaaatacctcaaagtggtcaaacgagggtcgcatcctaacaacggatggtcttcgaacaaaattagg

SEQ ID NO: 86186 - DNA, 522 bp, Glycine max
  Peptide Sequence Number=SeqID_177871
atgggatcaagtcaaaagccttcacttaaaaagaggttctatcaagtcaaggtcaagagcctaggaatcaccagcctcaaagagctagggcagttgatgggtcagctccagcggcaagcttttcgcaaagcttacggtagaagcgaatggaccccgttcatagtcgttctcgcactgttgatctttggaggagtcctctttccgaatgtggatgggttggtggacctggcagcgatcgacgcttttctcgccaatcataaccacaaggaaagcccggttgtcgctatgctagccgacctatatgacaccttcgaccgaagatgtgagaagagcagtatgaggattgtctgttgtactcccgctctttatgtatggttggtttcacacttttttcgccaagagagaaaggaggcgcaaattgggaccaactcttatcaaacaaagaaggagcgtctgtcaactggttccctcgatggaaagaaggaagaactggagttcttgtctcgtgcagaggatttctga

SEQ ID NO: 86187 - DNA, 456 bp, Glycine max
  Peptide Sequence Number=SeqID_177872
atgccgatctccccctgtggaaggatcgcgaccacaaggcacccagtggacccgaaggagccatggggtttccagctcgggttacgggcctctatcagtcctacagggtgtccgtgccccccaacaaggtcatgccatcatgacatagggatcgcacccgcaagacatccagtggacccagagaagtccaacaaggtcttggggtttccagctctgattatgggcctctgtcagttctacagagtgcctgtcgcccccagcaaggtcatcaggccccctactaatcgagctatcatcaagaagtactgcgcccccaggcaggcagagggcgagacaccacaacagcttgtggatggcccgcaacaggcaacaaatgcaccgccgccacctccagagcccctcagctcatccacaaaaaggttagagtattgcctactacacatggccgaccaatag

SEQ ID NO: 86188 - DNA, 927 bp, Glycine max
  Peptide Sequence Number=SeqID_177873
atggtgcaggctaaccgtaacgaagcgatcaaacgcctgaatgacggtcgcgttaacgtgctggtcgcgaccgatgtcgccgcgcgcggtatcgacattgataacgttactcacgtcatcaactatgacttgccgcgcaccgccgatgtctatctgcaccgcattggccgtaccggccgcgccggacgcaaaggtaccgcgatctcgctggtagaggcacatgaccatccgctgctgggtaaaatcagccgctacgtcaacgaaccactgaaatcgcgcgtaatcgatgagctgcgtccggaaacgcgtgcaccgagtgctaaagtcaccggtaaaccgtcgaaaaaggcgcttgagaagcgcaaagagaagaaagcgaaagaagaagagaaaccacgcgtgaagaagcgtcaccgcgatactaaaaatatcggtaaacgccgcaagccaagcggcagcagcacaccggagagcgccgatcaattacaggctttcggtaaaggtacgggtgataacgtcacgctgctgttctggcgtcagcgcgttaaagcgcaccgcatagcccgacacgcgaatggtcagctgcggatatttttccggatgcttcaccgcatcttccagcgtttcacggcgcagcacgttaacgttgaggtgctgaccgccttcaacgcgcacctgcggtttctgctccagtggaatttcacggtaagcaatctcgccaaggtcgctgactgcaacaacctgatcttccgtgaaatcgccttttgcgcacaggcagcgggcttcggctttctcattgtccagcagccagaacgagttcagcagctgcggattttgtgcctgagtaatttgaataccggtaatcatagaggcctccagggcttagcgctgcggcaggagcacagcgcggttcttcgggttatgtga

SEQ ID NO: 86189 - DNA, 261 bp, Glycine max
  Peptide Sequence Number=SeqID_177874
atggagaaaaatgaagaaacaacaatagaggagaagcttgcttgtggagcttctatggaggctggatctttgagcttcaatgaggtccttcaatggcgaagaggtgaggagaggcgccatccactagggaataatccatggaagaaggagcttcacgaccaagaatgtgtcttggataagaagcttggagaggattgtagaagcaagcttcatgatgatgaaccaagcaattttgatgatgccaaaagcccaagtgattga

SEQ ID NO: 86190 - DNA, 693 bp, Glycine max
  Peptide Sequence Number=SeqID_177875
gaagatcatttacaatggcctaactaatgagattaccctcacccatcttggcactaaatttgtgttgcatcctcaaacaccttctcaggtggccaaagatcaactaactaagaaaaataagagggatgaagaagaaaaactagaaaaccaaaagaaaaagaaggatagtaaggccttgtcttcaaaggccaaggggaaggaaaaagaggaaaaggatcaagcacatgtagctaaggatcaagcagaaataaaactcaaatgggatgaggaaaagaatagaaaaagaaaagaagaacaacctttaatggttaaggagaagtgtaaggaggtaagtgtctcctccaagaggttagctaagaaggaaagtcatcttgcaataaagacaaacattaaagaattttcccttcttagacaatctccgcatcttctcctttgtaaaaggacacttgttagcactaccatacctcttgagcttgaggttattcgtcaagtaaaggagttgttggatgagggtttggttcataagagcttaaatccttgtgctttgttggtgcccaaaataggtattatgaggcaccaaatcccaatgataggtggtatgatgaatgtgttgagtggtgcaaccctcttttgtaaaatcatccatgcatccaacatcttcatgattcacatgcatagagactcattaggttg

SEQ ID NO: 86191 - DNA, 1272 bp, Glycine max
  Peptide Sequence Number=SeqID_177876
atgcgcgccagcctggccgacgaggccgaactcgaacgctttctcgccatcagtcagcagccgctgcgccgcagtctgcgcgtcaatacgctgaaaatcagcgtggaggattttctcacgcgcgtggcgggctatgggtggcagctgacgccgattccgtggtgtcgggaaggcttctggattgcgcgtgatgacgaatcgctgccgctcggcagcgtcgcggagcatctcagcggtctgttctacattcaggaagccagctcaatgctgccggtcagcgcgctgtttgacgccgcgccggatgcccgccaggtgatggacgtggccgctgcgccgggctctaaaaccacgcagatggccgcgctgatgcgcaatcagggcgcgatcctcgccaatgaatactccgccagccgggtgaaagtgctgcatgccaatatcagccgctgcggcgtcagcaatgtggcgctgacccattttgacgggcgcgtctttggtgccgcgctgccggaacagttcgatgccgtactgctggatgcgccctgctccggcgaaggcgtggtgcgcaaagatgctgacgcgctgcgcaactggacgctggccagcaccgaggccatcgccgccacccagcgcgatttactcgacagcgcttttcacgcgctgcaaccgggcggcacgctgatttactcgacctgtacgcttaatactatcgaaaaccagcaggtgattgcctggctgcagcagcgctatccgcaggcgctggaaattgtgccgctcaacgatttgttcgctggcgccgaacgcgcgctgacgccggaaggcttcctgcacgtgtttccgcatatcttcgacagcgaaggctttttcgtcgcgcggctgcgcaaaactgccagcgtgccgccattaccggcgccgacctacaaactcggcaagctgcccttctcgcccgccagccgcaagctggtagcggaggtggcgcaggccgcgcacaaggtgggactgcactgggatgagagcctgacgctgtggcagcgcgacaaagagctgtggctgttcccggcggcgctggagagctggctcagcaaagtgcgtttctcgcgtatcggtctcaaactggcggaaaccttcccgaaaggctttcgctggcagcatgaagcggtggtggcgctggcgcaaccggacagcgcgctggcgttcgaactggacgaagcgcaggcggaaagctggtatcgcggtcaggatattcatcccgacacgccgcccgcgcgtgatgaa

SEQ ID NO: 86192 - DNA, 504 bp, Glycine max
  Peptide Sequence Number=SeqID_177877
atgggggaagcacatgaagtaccccgagaccatactcaagccgacttcgagcctcacctcatatatgccattgaggggcaagcatttggtggcattcccttgccatacactttggggggacttcaggctattgaaggaggcagagattatgcctttactgacatggcagaactgtgcctagtgcctgatatcgttatccctctaaagttcaaggtgctagatttcgataagtacaaggggactacttgccccaagaatcacctgaagatggatctggcagctcaagtagtgcccccaatggtggaaagggagatgataacaatgatagtagagacgttaccggtgttctactatgagaagatggtgggctacacgccttcaacctttgcagatatagtgtttgctagcgaaaggatcaaagtgggtctgagaagaggcaaatttgattatcctactttgatgaataggaagcctggggcaaatggagagaataagaaggagtga

SEQ ID NO: 86193 - DNA, 736 bp, Glycine max
  Peptide Sequence Number=SeqID_177878
atgtggctgaaaggggtgaaaacccatgtgtgtatttctgggaatttcgatgaacgagctaagatcgcctactgtgcttaccctgctaagcacgcttgtgcgccaagcctgactgtctttctgttgagatttgcactcctgaggcctgatcctcaggagttagctgctaagctctgtatcccagggaggggattcgagcttaaggatgatgggcaacctttgaagattctgaggaagaacatgactgctcttgctcaaacttggagcattatttccttttctaacctcatccccacttcccatacttctgatgtcactcttgacagagccaaactcatttatggcatcatcatgaagatgaacatgaatgtggggtacctcatctcccaccagatctccctcatagcacagtatgacacatccagactaggattctctgcattgatcgcagctttatgtaaggctaggggagttcagtcagattcaaggtccctggagagcttgagtcctgccattaatttagcatatattaagaagaactattggaatcttgatgatccaacaataactttcagaggacccaggaaggctaggggtaagagatctgaggtccccaccacttcagcaccagagacaccaactccttcttcttccacaggtccattacctcccattcagactctagttattcctcctacacccacacagataccacttccagctcctttatctgcag

SEQ ID NO: 86194 - DNA, 669 bp, Glycine max
  Peptide Sequence Number=SeqID_177879
atgtggtccaccttgacgctttccgggacctcgctcatagtggtggttacgcttggggggttgccgcgctggttcatatgtactgaccagttagatgaggcttgtaggaccaccacccgacagcttgcggggtacttgacgctacttcagtgctggatctatgagcacttccctagtgtgcatcagtgcgtgactgacgatacataccaggagacgtccccacgtgcttcccggtggttgacgtcgaaggcgcacatgaagggcatcacaggagcaccctacagggcacgttgtgatggtttgaccgtcacagatgtgtcctggttgccgtacacggagcatcggggtgttagggcgtttcaggagatttcatcgttccagggtcagctcagatggggtcctatgatcgtcacagttcgaccggagagggtggtacgccagttcggttacatccagagcatccctccgccgcctgtatctgcggattacattgagtggtttttccgcatatctcaccctttcatgacaccgacccaggcagctgaccagcagagggatgcaccagctgcagaccctgaggactacatacagccgcccagcccccaggttccagtggcatttgacccccctccatatgtggtaagatatttgcgcgttaatgttttatga

SEQ ID NO: 86195 - DNA, 189 bp, Glycine max
  Peptide Sequence Number=SeqID_177880
atgacaagtcccgcgaatttgctgagaaatagatcaacattgtcaagatatgaaatcttacaacattcgacagaggaaggaacatctacacaggatatccctttacaaactgctacttctgttaatgataatgaaatatatctgaatgttgatggagctccaaattacaaggggaacatgtatggctag

SEQ ID NO: 86196 - DNA, 387 bp, Glycine max
  Peptide Sequence Number=SeqID_177881
atggctcttctttcttgggagatcccactgttccttcttccgaggacagggatggaaattctcatcctgggtcaaggtttatggtggtttgaggtcttgggtcaaaaggcttgcagaacgaccagacatgatgtatatcagggtgttggttttgccagcggttcagggataaaggggatgtcccacatttatttccatgacacacatacaacaatgatgatttggaaattttatgcaaaactggtcatgcaagcatgcacccatgtggacactcaagcatcaagtttttatggtcatgtgacactagggctcaggactcatttttcctatttaagtcaacccagtgtttccaaaacatgttttttcatcaaaaaccttgtgttctga

SEQ ID NO: 86197 - DNA, 408 bp, Glycine max
  Peptide Sequence Number=SeqID_177882
atggaacacttactttttaggaaatttagatttgttgatttttcccgtgtcattgctagtcattttcaaactaggctcttggttgatgttattggcgtggttgatgaagtggtattccgatatgtgtcatcgaaaaatacgaaggtactatcctgcacactctgggaaaattactgcttacagtttttgtcttatttgaatgaggttgaagatgaaagacccatcattattcttttgacacatgccaggatcaaggaagcccagggatcatatctgccatcagtcagtaattctttcaaggcgtctaaactcatgatcaacgagcttgtgctggaaattcaagaattgagagagaggcttttagatttagggatggaggttagatcagttttgacgcctattggataa

SEQ ID NO: 86198 - DNA, 280 bp, Glycine max
  Peptide Sequence Number=SeqID_177883
cgcctatgcaatcaattcgtggggctcctgtctcgattgtggaggacgcgtgaccagcgttaggcaatcaattcatggggctccgaataagattagatgttggaggatgcatgagcagcgccctgcaatcaattcgtggggctccggactcgatggtggaggatgcatgaacgacaatcaattcatggggctccgaataagatttgatggtggaggatgcacgaacaacgttaggcaatcaattcgtggggctccggactcgatggtggaggatgcatga

SEQ ID NO: 86199 - DNA, 84 bp, Glycine max
  Peptide Sequence Number=SeqID_177884
atggaaaaagaaagaggagcttggttgaaatccttgcctttatcagacaaagaaaatgcaggaattagaaaggtttatgactag

SEQ ID NO: 86200 - DNA, 956 bp, Glycine max
  Peptide Sequence Number=SeqID_177885
caaacagaaacacagaagttgaaggttctagagctgagaacaagaagaaagagagtgtggtgcttccttctcccattccatggcgttcaagatcaggaagattggaacataagcaagaagaatttgatgaagcctctaacatgatgtttccttcttcaaaggaggaatctcgccctgtgaagtctcaaccttctcgcgcttcttcgcgagacaattccgtgtctccttcgccttctttctcatcggaatctcctgcgaagaacacagaggattcggtgaggaagaagggcttctacaagtcttgtcctccaccacctccgccaccgccaccaacaatgtttcagaaatcagtgttcatgaagccaaggttcggtggttcatccaacgaagcaccttgcttcaataaagagttgaagagaagcttcacaagtgagagaaccacaccagtgggaaagaaaagtgatgaagaaaataaatccatgcaacccacattgtttagaagtaacaagttcatagggcatgcaagcgtgcctcttgtgtcacagccagctgagaaagaaagccttcttgtggaatctgacgatgatgatgacgacgatgacacagaaatcgaggaccaagacgttgaaggaggaagaaccgttgctaagaacaatgacagtggaaagagtccacctgttattggtggagaaagttcaaaaacagatggtgatgaaggaccagatgtggataagaaggctgatgagttcattgctaagtttagagagcaaataaggcttcagagaattgagtcaatcaagaggagtacacgcagtgcaagaaacgcttcaagttgttttgaatgggaaattgtgattagatcacggttttggccatttgttgttgaaaaatgtcaaacggaattcccatatactaatatacacctagaaagagaaagaaagaatagagaaaagtaa

SEQ ID NO: 86201 - DNA, 1146 bp, Glycine max
  Peptide Sequence Number=SeqID_177886
atggttgcgactttgagtcttccgatcatagacctctcttctccccatcgtctttccacagccaattccattcgtcaggcatgcgtggaatatggtttcttttaccttgtgaaccatggggtggacaccgattttgtgagcaaagtcttcgaccaaagttgcaagttcttctcgcttccggtccaacgcaaaatggacctggcccgcaaggaatatagaggctacactcctctctatgctgagacacttgatcctacttcactctccaaaggtgatccaaaagagacctattacattggtcctatagaagatacctctattgctcatctgaatcaatggccttctgaaggacacttcagaattactgccaaactggagacctacaatgaaatccttatattggaaactactaatttacatattcttcttatctttcccagggctgctggaaaaagtctgctgtctctgattgccttgtccttgaatctggaagaagattactttgagaagataggtgccttgaacaaaccagcttcttttcttcgccttctgcactatccaggtgaattgggatctgatgagcagatatgtggtgcctctcctcattcagattatggcatgatcactctcctaatgactgatggtgttcctggactgcagatctgcaaggataaagtcaaccaacctcaagtctgggaggatgtgcctcatgtagaaggggccttaatagtgaacattggagacatgatggagaggtggacaaattgtttatacaggtcaacacttcacagggttatgccaacaggaaaagaacgttattccgtaattactaaccacttcctcagttgctttaatctctatgggtcgagtgagtttttagacataggtgacagagcttgcgacccacactatctcatacacacacagaggggaggggtgaaaaattcacatgcaaattctgatgacaaaaaggtggcattcttctttgacccggcctcagactgtgtggtggagtgctttgaaagttgctgcagtgaatcatctcctcccagattctctccaatacgtagtggggactacttgaatgaacggttcagactcacctatggttctgaaaaggatctaaaatgtgatttatccagttga

SEQ ID NO: 86202 - DNA, 1254 bp, Glycine max
  Peptide Sequence Number=SeqID_177887
atggtagccacgacttaccaaacctcccatgaatgttcggaagaaaccattataaacattttagtggcaggattttccggacaactaaaaggttggtgggataattatctcaccaatgaagaaaaaaccttagcagattttagatggtacagggatactttcttgactagggtctataccagagaagatagtcaacaacctttctggaaggaaaaattcctagccggtcttccaagatctttaggagataaggttagagataaaattcgtagccaatacaatggagatattccatacgaaagtttaagttacggtcaattaatttcttatgtccaaaaggtagccttaaaaatttgtcaagatgataaaattcaaagacaattagctaaagaaaaggctcaaacaaagagagatttaggatctttttgtgaacaatttggcttgccagcctgtccaaaacaaaagaagcagacctctagaaaagaagcccatgaaaataaggtcgttaccaaaaagatatttccaaggaggagatactcgcacaagccttcaattagtaaagaaatagaaaacccaaaacaaaaactaaaatctaaagtaacatgctataactgtggaaaacaaggtcacattagcaaatattataggttaaaaagaaaattaagaaatcttaatttagaaccagccattgaagagcaaattaataatttgctcatagaaagttcggaggaagaagaaacaaaaacttcatcctccatgatctctgatgaaaatctcaatctaattcaacaagatgatcaattgtcatctacagaggatgaaagaaaaatcaatactttaacaagagaacaagacctcatgtttgaagcaattaattctatacctgacccccaggaaaagaaaaattttctagaaaagctcaagaaaacattggaagtaaaacctaaacaaaaggattttattaccaataacaaatttgatgttagtaacattcttagaagattagaaaatacttcagccaaaccaacaacaatccaagacctccaaacagaaattaataatcttaagaaagaagtaaaagaacttcgccaacaacaagaaattcaccaaaatatcctttctaagctcgaagaagaaagtgattctgaaagcgtcgctaatagtgacacaaatcatatagaaaatccagaagataatatgtttatgggtttaatcaataagatcaaaatccaaaagttttacataaatatttag

SEQ ID NO: 86203 - DNA, 312 bp, Glycine max
  Peptide Sequence Number=SeqID_177888
atgatcattcttttcagatggcttctgaaagagaaaggcacctgcctcaacatccaggcctgctatgaccgctttagattcacatctcaggaggcctgggattgctactctgatatagtgattggcaggaagatcctgctagagagaaatgtcatgatttaccatgcagaatttgatgaattcaagtatgagcttgagagaaagaattggcacaaggagctaaccaatttcatggatgggagcatcgatgttgccattgttaaggatttctacgcttacctttatgatcctgaggataaatcacctaagtag

SEQ ID NO: 86204 - DNA, 1422 bp, Glycine max
  Peptide Sequence Number=SeqID_177889
atgttctccgggtttcttccctccttgagtaagattgcagctgtggtcggagattcagcaaaagtgttggatcgcatgaagcaaactcggaacggcgtagtaggcctaccgcggaagtacttggaaagcaaggcaagggacatggcaagccaagagaagtggggcccgtttgcggatacactagctttgctgatttttggggttgtcctctttccgaatgtggacgatttggtggacttagccgcaattgatgctttccttgcatatcaccatagcaaggaaagtccagtggtggctatcttggcggacttatttgatacctttgaccgaaggtgtgagaaaaacagtgcacggattgtctgttgcttacccgctctctgtgtgtggttggtttcgcacctattccaacaagacataagacatccgtgtccacttcaaagttatcgttcgtgcatcgaaaaaagaaaagttgattgggatcaacacttggttgggataggaggcagcgcaatcaattggtttcctcgatggaaggaaggcaaggagggagttcttttctcgtgtggggactaccctaatgttccattgatagggacgaggggttgtattaactataatcccgcactttccataagacagttagggtaccccatgaggggagcgccaacaaaagagagtctctcgcctttccttgtgaaggatttaggcccgcaaagtctcaaggttatacaaagagtccacaaggcatggagaagtccgttgaggatagacaaagagcttaggggcatccgtaatggcatcatcggtggttatcatggatggctaagagttcatacgcgagggttagattggctctccaagttgaaagttatcaatgaggagaacttcgaaactccggaggaagatgaagaagtccaagctctaaaattacagctagggaaggcaagactcgccaaagaaaagttcaagtcagctgctacgcacatccggaaagagtgcatcgagttacgagaggaaaacgcggccactgcaagagcccttgaacaagaaaccaaaagggcccacaaggaggaacatggccgagataaattccgaggagctttgtggggtagcaacaatgagctcaagctctggagagaggaaagagaccggtcacgggtgcatggcatgatcttaaaagaagagttagctgcttgcgtaagatccaagaggagtttggctcaacacttggaagccacggagcaaagcatgctagctatcatagggcagtacaaggaagagttgaaccagtctgtgacccatgaacaaaagctagtagaggatttcgcacaagtatacgccgaaaaagaagcaagagggagggtgattgatgcattgcatcaagaagcgactatgtggatggataggtttgccttgacctga

SEQ ID NO: 86205 - DNA, 252 bp, Glycine max
  Peptide Sequence Number=SeqID_177890
atgagggttcactgtaatcaagcaagtcggagacctagcatgatcatagattcacctccactccttatgttcccacgaacctggttcccagtggagtcgccaactgtcgcaacctacacttcggtggggagggcgacgcgtgactcgtgggatgcgtcttccaagaaaggaatcgcacggagttgccaccaacgtttattcgaggaaaatgtcggaaaaaccggaaaggtgtggtctacgaactttaagtga

SEQ ID NO: 86206 - DNA, 684 bp, Glycine max
  Peptide Sequence Number=SeqID_177891
atgacaccggtaaaccgaaagcagacagagagcgcacgagggagccgccagggggaaacgcctggtatctttatagtcctgtcgggtttcgccaccactgatttgagcgtcagatttcgtgatgcttgtcaggggggcggagcctatggaaaaacggctttgccgcggccctctcacttccctgttaagtatcttcctggcatcttccaggaaatctccgccccgttcccttttttctcctgccacatgaagcacttcactgacaccctcatcagtgccaacataagagaaatagcctgtgctgttagatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 86207 - DNA, 282 bp, Glycine max
  Peptide Sequence Number=SeqID_177892
atgactcgtttgttcccggaggaacaaaaaggttgcagaaggcctatgtcagtctctacatgtcatcgggccccgccgcctctggatgacaaaaagggtgcggataaccgtaaaggtatctccacgcgtcatcaggcccgccgcctctggatgacacaagggtgcagaatgaccaaattttgtctctgcgtgtcatcgggcccgccgcctctggatgacacaagggtgcagaatgaccaaattttgtctttgcgtgtcatcgggcccgccgcctctggatga

SEQ ID NO: 86208 - DNA, 309 bp, Glycine max
  Peptide Sequence Number=SeqID_177893
atgactagccaagaccaacctttaatgcaggtggatattctggatttcaacatggccagcaatataatcagcaacagggatagtggagaactcaccctgactgaccgtcaagcagctttggagccaacagagaagaatcctaaggatgaatgcaaggctgttatgactagaagcaaaatggtgagcatgaatgaaggtgagaagaagataggtgaagaaaaacaacagctagtaactgaaccagaaattgacccagtggtggaacttttgagcaagactgatgtgccatcattttcttctattttctaa

SEQ ID NO: 86209 - DNA, 444 bp, Glycine max
  Peptide Sequence Number=SeqID_177894
atgatcattgatcaatctctgttcttttcattgactaaattacccagtcaaggtgcaccttttgagggcaccattgttgatgactggaaattcgactattctagtcatgatgctcgccgtatggtttgtaatgaccaggctgaaatgactggtgttggtgcagtcacttcatttggttaccgtaaggatcgtaatggtcaatggcaaaagaaggacgcactacctccgcaagatgagcatactccctctcctcctcctcaacaagatgattcctccacccttctgactgaagttctttcagagttacggggcctctgcacctatgttggtgaacgattcgattctttggatggtcgctttgaaggcatggatacttgcttcacccagcttgaagaggatgtaacttatcttcgtcagagcttcgaccttccaccatcgtcttag

SEQ ID NO: 86210 - DNA, 915 bp, Glycine max
  Peptide Sequence Number=SeqID_177895
atgggaccgcaagtcgaacaagctgttcggcggcagcgacccgcgcaatccggtgggcagtgcccaggtcgtcccggcgcgctgatccggtcgtgccggctgctggccggcaatccggctgattatcgaaaccccgcctttgccggcgggcgcctcgatggcggcgcgatgttcggcaacgcgccgcgcgcgttgtgggaaaaatgggcggcaccggacgagctcaatcgcatcgagctggcctgccgtgcgctgcttgccagcccgctggaaggcaaaaccgtgctgtttgaaaccggtatcggcgcgttcttcgacccgcgcatgcgcgagcgctacggcgtgcaggaaagccagcatgtgctgatcgattcgctgcgcgaagccggcttcgagcacgaggatatcgacgtggtggtgctcagccacctgcacttcgatcatgccggcggcctgctggcggcgtggagcgaagggcgtgagcccgagctgctgttccccaacgcaacctttgtggtcggcgcgcagcattggcagcgcgccgtgcagccacacccgcgcgaccgcgccagcttcattccggaactgccgggcctgctgcaggccagtggccggctggaagtggtggacggggagtactcgaaggcgctcggccgcagcgtgcgcttcagctacagcgacgggcatacgccggggctgatgctggccgagatcgtcggtcacgcgcatgccggcgaaagtgcgcacggtggcgtggtgttctgtgccgacctgatcccggggcgctcatgggtacacgtgccgatcaccatgggctacgaccgcaatgccgagctgctgatcgacgaaaagcggcagttccttgaagacaagctggcgcgcaacgtgcggctgttcttcacccacgacccgcag

SEQ ID NO: 86211 - DNA, 213 bp, Glycine max
  Peptide Sequence Number=SeqID_177896
atggatgttatggactggtgtgagcttgggaggattgatggggacccggtgttgagagaaacgaggatatgggctacgtgggagtacgtgagctcagttggaggtgggcaacaggggatggtgggtttatgcgcgcattgtggatgtggaaaaacttgttgtgcaccatcgcccgaccgccacctagtaccacatgtgatgggtaccccataa

SEQ ID NO: 86212 - DNA, 462 bp, Glycine max
  Peptide Sequence Number=SeqID_177897
atggataatgaagagggcgtgcaggaacaaatgaaggccgatctatcggccttaaaagatcaaatggcttccatctcggaggtcatgttaaaactccagaaaactatagaggacaaagccacggcaaccgcctctagtacagttagggaagcggagccgatgctacagcccgccttaaatctgggccgagacagaaacacggcagcagtgtttggtcgaaggtatagcccgcaagcttacccctatggcttgcctccggacttcgctcccagtgctgccccggaagatttaagccaagcccctaccttcgaggggcaactcccaccttatgacaactatcccgtgcaagacgatgaggaaggagatacccatctcggccccctgctcctcctcaaagatccgtccccccatgaactaccccaaccgaacatagtccgccatatcccggcttcacccaccccc

SEQ ID NO: 86213 - DNA, 769 bp, Glycine max
  Peptide Sequence Number=SeqID_177898
atggctgcaagtggcattgctattctcagagataaagcccacataccaacaaagaaaagtcttctggaacttacatcacaagatgtgttgttggcacaaaacaagttgttgtccaagcaattggaagcatttatcgaaacactaaggtgtgccatctgtggtggagctcacaattctggctgctgtatccccaatgaagaaacaactcatgaagtcaattatgtggggaaccagcgaaggaaaaatttcaatgcaggtggatattccgggtttcaacatggccagccatataattcacagcagggacaatggaggaatcaccctagtaagcaattcaacagagaccagggtggtccatctacaaggccacaacagcaaggaccttgtctctatgatcgaacaacaaagctggaagagactctagcacaatttatgcaagtatctatgtcaaaccataagagcacagagtccgccataaagaatttggaggtccaagtgggacagctggaaaaacagttggcggataggtcgtcaagcagctttagtgctaacactgagaagaatctgaaggaagaatgtaaagttgtaatgacaaggagcataatggcaattcatgctgatgaaggtagagctgaagagaaggtggagggatataaacaacagtcggcagctaagccgacattggaaccagtttctgatcttattgaacttgaggaagttgtggaagacgaagatgacctacaagagagagagacaccaataaaagaga

SEQ ID NO: 86214 - DNA, 801 bp, Glycine max
  Peptide Sequence Number=SeqID_177899
ttgtcctctttccgaatatggaagggttagtggacctagcagtgattgacgctttcctcgcctttcatcatggcgaggaaagcccggtcgtcgccattttggccatgtatgacacgttcgaccggggatgtgaaaagagcggcgcaagaattgtttgttgtgcactggctctctatgtgtggggttgtattaattataatctcgtcctcgccataagacagcttggctaccccatgagaggagtgccatcagacgaaagcatcacgcctttcatcgcacggggtttcagtgaccacaatgcgagggacagagagcttaggggaagcagtaatgggatcatcggcggctatcataagtggctgagagtccggacacaaggattggattggctcccaaatctaaagactatgagagatgatgaggttaaagcttcggaagaaagtgatgaggtacaagccctaaaggcagagcttgaaagagcccgggtagtcgaagagaagttcaagtccatagccatcaaaggcagcaatagtgagctcaagctccaaagagtgcaaagagaagctaatctagcagcgactcacgagcaaaggctagaggatgagtacgccaagatatcagcagaaagggaagtaagggaaagagtaattgattcattgcaccaagaggcaacaatgtggacggaccgatttgctcttactttgaacaggagtcaagaacttcccccattgctagccaaggccaaagcagtggcggacacctactccgcccccaaggagatccatggacttctcagctatt

SEQ ID NO: 86215 - DNA, 402 bp, Glycine max
  Peptide Sequence Number=SeqID_177900
atggcagctatgcatcaagatacgtccgaggatcgtgaaatagtgagtgagaaactctgggagatttttgatatcgatagttgcagtccaatggcacgcaaaatggtggcagaggtgtgtgacatagtgaccgagcgcggtgcacgcctagccggggccggaatcgtggggataataaagaagctgggcagagttgagaatagaaagagtgtggtgactgtggaaggagggctttatgagcactaccgcatcttcagaaactaccttcacagcagcgtgtgggaaatgcttggcaaggatctctcagacaatgtcatcattgaacattcgcatggtggctctggaactggtgctttgttccttgctgctgctcacactcacgcacaccgtgcggattcttga

SEQ ID NO: 86216 - DNA, 933 bp, Glycine max
  Peptide Sequence Number=SeqID_177901
atgattatgaggggccaagacatttatagtatccaagatgaggctactacttttccttcctctagtgaaagtgaagaagcaaaaggggaagaatctagtgaagagatctacccacaagaagaagaacaaacgttaatggttaaggaggagtgtaaggaggcaagtgtctcctccaagaggttagctaagaaggaaagacattttgaaataaagacaaatattaaagttatttcccctcttagacaacctccacattttctcctttgtgaaaagacacttgttagcattgccagacctcttaggcttgagtttattcctcaaatggcatctaagaaaatgaagggtccttctacaccttcccaagtcagctatgatcggtctaggttcacatctcaagaagcttgggagaggtataccgatattgtggtgcctaggaagctactaccagagaggaatgtggtagtttattacactgagtttgatgagtttaaggaggaactcgagagaagacattgggatgaggagttgactgattttgctaacggtagcatagatgttgctattgtgaaggaatttcacgtgaacctctatgaccccgaggataaatcacctaagcaggtgagggtgagaggtcatttagtgaaatttgatgaagatactctgaatacctttttgaagaccccagtgattctggaagagggggagaatctctgtgcttattacaggtttgcactcctgaggcctgatcctcagcagttagttgctaagctttgtatcctagggaggggattcgagctaaatgctgatggtcagcccttaaagatattaaggaagaacatgaccactttagctaagacatggagtgttctttccttctctaatttgattcctacctcccacacatctgatgtcacattggatagagccaagtaa

SEQ ID NO: 86217 - DNA, 348 bp, Glycine max
  Peptide Sequence Number=SeqID_177902
atgaaggaggacttgaagaaattaagagatatgaacaaagatgacactaactcccaagctaatgtagtaaaaagtatggaagatgaagatgatgtgtttttgaacacaaagatgagatcatcacaagggtacaaatatgttggttcaaaatggggatgcaaagtgtacaaggggagacatttggtgttgcaaggacagaaaagtaaagttaacatttgctatttggatggtcaagtcttgaagaggaactatgatagcaaagtgaagaagaaagtgaagttttctaatgttgtggaagtgttgagagatacttctgttggagggggagtttgttcactctcaaattaa

SEQ ID NO: 86218 - DNA, 343 bp, Glycine max
  Peptide Sequence Number=SeqID_177903
ccacgcagttccgtggaggtatgcgcctccaagcgaaaggaaggaagaagccaccgacatcagctcgttgttggccaaggtaaccaacatcacggggctgagcaacgtgacccacagcagtcgcgtgttcgcacctcctgacctgcccacacaacccgcaaacgttaaagggaaggcaaaaatagcagaagaacaaaatgacaaaatgatccccactctgaatgagaatattccagtgaaaggtctttcggagaaaaagaatggttgtggcaagaaagaagtatcgctagaggaagcaggcgagttcaaccgaataaaatccgaccgatctttcatgccataa

SEQ ID NO: 86219 - DNA, 222 bp, Glycine max
  Peptide Sequence Number=SeqID_177904
atggagaccaacatgttggccatcatcagcaagtaccaagaggaactaagtctagccatgacccacgagcatagagtggcggacaagtatgcccaagtgtacgcggaaaaggaggctagaggaagaaacttccctgactactggccaaggccaaagcgatggcggacacctactctgctcccgaggagatccacagacttctcagctattgtcagcatatga

SEQ ID NO: 86220 - DNA, 297 bp, Glycine max
  Peptide Sequence Number=SeqID_177905
atgaagtcgctgagaggaaaggagatcgcgttggtgaaagtgcagtcgggacccgacgagggtgattcaacctgggagttagaggataggaagtatgtacattgggggaaagatacgcagggtctcattctgagcgttttgatatatatattgcctactttcgaaaacgggccccgacgggtgcaaagaaacgcgaggaactggaaccagagaggcggcatgaaaaccgaggcaggatttcatcatccaaaaagtttcaatttttttttcttccttatggctgagtatgatgtctaa

SEQ ID NO: 86221 - DNA, 990 bp, Glycine max
  Peptide Sequence Number=SeqID_177906
atggatcaactccaacgtcaagccttccgcaagactatggaaaaaatctgggatttgactatgataaaagtgtttgttgaagccattgcatccctcgctcaatattacaaccagccgctaaggtgcttcacatttggggactttcagttagtaccgaccgttgaagagtttgaagggatcttgggatgcccgctagaaggaaggaagttgtatctgttttctgggttatacccctccatggcaagagtagcaaagcacttggaagagaaagcgaaagctttggcgaatcaaggagagtgtaattcattcattgatgttttagctctattggtgttcggggttgtcctctttccaaatgtggatgggctagtggatctagcggcaatcgacacttttcttgcttatcaccacaacaaggaaagttcggtcgttgctgttttggtagatgcctatgacacgttcgactggagatgcgagaagagcagcacgagaattgtttgttgtacacctgctctttatgtatggctggaaggaggggccggggttctgtgctcatgtgaaaggttcccaaacgtccccttgatgggaacgagaggttgtattaattataatctcgtacttgccataagacaactaggttatcctatgagaggggtgccatcggaagatagtatcgcgtctttcatcgcacgaggcttcagtgaccccaatgcaaaaatgcttcaaagagtccgaaaagcatggaatacggtgcaaagaaaggataaggagcttagaggaagcaacaacggtgttattggcagatatcataaatggttgaaggctcgaatgcaagggataacttggctcccgaagctaaagagttcaggtggggaagaggctgatgtccctgaggagagcgaagaagtgcaagccttgaaagcggaacttgaaagaacacaagtggtcaaggaaaagttcaagacaatagacatcagggtcaggaaagac

SEQ ID NO: 86222 - DNA, 951 bp, Glycine max
  Peptide Sequence Number=SeqID_177907
atggcttctaagaaacacaagagtattggttcaagacccacaacacaatatgatacaaggagatttcactccttagatgcttggaaccagtacacagataatgtcctggggagaaacatcttgcctgagaagaaggtggaactctaccacactaaactagatgattttaagactgaattgaagaggcgtaatttccataaacgcctcaccaatttggttgatgggagcaaagacttggctttggtgaaagaattttatgcaaacttatacagctctgagggcccttcaccaaagcaagccatagtcagaggccatttagtgaagattgatgttgatagtctcaacacattcctagagacacctgtggtattggcagagggtgagactttacccatatactccagatactgcagcctgcccacagattatagagagattgaggcaaccttatgcataccgggccgaaggttcattttgaacactgagggccatcctgggaggattctcaggaaagatttgactactttagcccaggtgtggagtgctctctcatactccaatatgccccccacatcacatacctctgatctgacagtggacagagctaggctgatctttggcctagtctctcgcatggacatgaacaaaggagctcttatttctggccagatgacttctatagcccagtctaacacttctagacttgggtttcctactctgatcaccgccctatgtagagccagaggggttgtctctcacagccttacttttgagcgcctgaacccggtcattaacttggcctacatcaggaacaactgttggaatcccgaggatctaacaatttctatccgaggggctaggagggcaagggcgaggccagctgcgcttccttccacatctgtagctcctactccaacatccacttcagtagctccttttgtcccaccttag

SEQ ID NO: 86223 - DNA, 2073 bp, Glycine max
  Peptide Sequence Number=SeqID_177908
atgggtattctgtccgaacgtggcagcttcagctatgtcatgttcactttggaactcgacagagatataatagggtcacgttttatggtttacaagatgcagaactcaaaacctgtgaacgcaagagcgttgaaggaacgtccaacgtgggagtcggtgtcacacctggaaacaaagagattgctatggcttattggcattacatttgcagtgatcttaactttccagtacctcgagtttccatatggaactgttctactctctctattctctgctgagaagataccaacaccaggaagtagtacattcaaggcttcagatgcaccgtctatttccgaattggttaacaatgttacgcttttcaatccagcaaactctactggtgaccatgcctttgagatagctaataaaacaaagtctggggaaaatgacaccattccaagaattggcttggtcttggaaccaggaagcacaccaaacaactctctaggattagatggctctgaccaaagttccaaaacgaaaagtattaatagatcagaaaatgtagctgaaacaccgcagggaggagatcctggaccaatcagttttaacaatactattgatttgagtttctctgcaaaccagttccaagaagacaacatttcatcaactgaacagaaatctggaagtcaatatgcttcttcgacaaatgtgagcacaaacattgtaactgcagtgttatcaaatgattcctccatatctttatttcagaaagacaacacaactaactccataaaggaagagagtattaggtcatcacaaaatgatgccaaggtaagtgtgcctaatgagaagaaagattcccatacaccaattccagaagttacaacagtatctgaaatgaacaagttattacttcaaagccataattcatatcgttctatgagaccaagctggttttcagctgttgatcaagagctactacaggccagatcagagattgaaaatgcaccaattgtaaagaaggatccaaatttttatgctcacatttatcataatgtttccatgttcaagaggagctatgaattaatggaacagactctcaaagtgtatgtatacagagaaggagctagaccaataatgcactccccatttttcacaggactttatgcttctgaaggatggtttatgaagcaaatggaagctaataagagatttctaactagagacccaaacaaggcccacttgttttacttaccttttagttctcgaatgctagaggaaacattgtatgtgcagaattcacataatcataagaacctggttcagtatctgcataactatgttgaaatgattgcagggaaatatactttctggaacagaactggaggcgctgatcattttcttgttggttgccatgattgggcccctggagaaactaaggttgacatggctaattgcatacgatccctttgtaatgctgatgtgaaagaaggatttgtttttgggaaggatgcatctcttcccgagacgtatgtccgcgatgctaagatccccactaaggatctcagcgggaattcagcttcgaagaggacaacgcttgcattttttgcagggagcatgcatggttatgtgaggccaattttgttgcagcactgggaaaacaaagaccctgacatgaaaatctttgggagattgccaaagtccaagggcaacaggaactacatccaatacatgaagagcagcaagtactgcatttgtgccaaaggctatgaagtgaacagtccaagagtggtggaagccattttctacgaatgtgttccggttataatatccgacaattttgtgcctccctttctcgaggttctgaattgggaatcctttgcggttattgttctggagaaggacattcctaacctgaaaaatatactcctttccatcccagaaaagcagtatcttcggttgcagatgagggtaaaaaaggtgcagcagcatttcctttggcacaagaaccctgtcaagtatgacatatttcatatgatacttcattctgtttggtacaacagggtcttctctgcaccagctaggtga

SEQ ID NO: 86224 - DNA, 696 bp, Glycine max
  Peptide Sequence Number=SeqID_177909
atggtgacaaatcaaactggcaaaaggttttatcaagtcaaggttaaaggcctagatgttaccagcattaaggaattggggcagttgatgggacctctccaaatgcaagccttccgcaagacttatggaaagatcttagatttgaccattgcagaggtatccatagaagccattgcatcactcacccaatactacgaccagcctttgagatgcttcacgttcagagacttccaattggtaccgaccattgaagaatttgaggagattctgggatgtcctctcggggggagaaaaccatatcttttttccgggtttctcccctccttgagcagaattgcaactgtggtcaagggttcagcaagaggtttggaccgcgtaaaacaaactcgaaacggcatagtgggcctaccacggaagtacctagaagacaaggcgagggatatggcaaatcatgaagagtgggtcccgtttatggatgtgttagcattgctaatctttggggtcgtcctctttccaaatgtggatggtttggtggacctagccgcaatcgacgctttccttgcataccaccatagcaaggagagcccggtggtagctgtcttggcagatttatttgatacatttgaccgaagcaagacacgaggcatccatgtccgctctgaagccatcgctcgtgtgctgaaaagagaagaatag

SEQ ID NO: 86225 - DNA, 735 bp, Glycine max
  Peptide Sequence Number=SeqID_177910
atgaggggagcgccaacggaagggagtctctcacctttccttgcgaaagatttaggcacgcaaggtctcaaggttatacaaagaatccacaaggcgtggaggaattggctctccaagttgaaagttatcgatgaggagaacttcgaagctccggaggaagatgaagaagtccgagctctaaaattagagctagggaaggcaagactcgccaaggagaagttcaaatcagctgctacgcacatccggaaagagtgcaccgagttacaagaggaaaaagcggccactgcaagagcccttgaacaagaaaccaaaagggcctgcaaggaggaatatggccaagagaaattccaaggagcattgtggggtagcaacaatgagctcaagctccgaagagaggaaagagatcggtcacgggtgcatggcatgatcttaaaagaagagttagttgcttgcacgaggtctaaaaggagtttcccctccccacttggaagccacagacccccccccatgctagctatcatagggcaatacaaggaagagttgaaccagtctgtggcccatgaacaaaagctagtggaggattttgcacaagtgtacgccgaaaaagaagcaagagggagggtgattgatgcattgcatcaagaagcgactatgtggatggataggttcgccttgaccttgaatggaagtcaagacctcccgcgtctattagccaaagcaaaagccatggccgaa

SEQ ID NO: 86226 - DNA, 924 bp, Glycine max
  Peptide Sequence Number=SeqID_177911
atgaaaagagaaaaacatgccttctatagtagtcataactcttgcaagagcctaagtgaagaacttcgtgactattatgaaggaagacataggtcacatcttagacctcactcccataggagagaaaatgaaagaaagcctcaagaggctaacattaacctcccatacttccatgggaaggacaatgtagaggcttacttagattgggaaataagggtagagcaaaaacttaaaagaaagtctactttaaaatattatggctctcattcttatccaaagaaagaccaaggtctaggcatcttaggggcagtaccttctaagcccaaatatgataaggggaagacaatagaaaaacaaccccttaaggctagtatgcaagaaaagactagttctataaagtgttttaaatgtcttggaagaggacacattacttctcaatgccccaccaagaaaaccatgattatgaggaaccaagacatttatagtagccaatatgaggctattacttcatcttcctctagtgaaagtgaagaagcaaaaggggaagaatctagtgaagaaatctacccccaagaaaaaggacaacctttaatgtttaaggaggattgtaaggaggtaagtgtctcctccaagagcttagctaagaaggaaaggcatattgaaataaagacaaatattaaagaaatttccccttttagacaacctccacattttctcctttgtaaaaggccacttgttagcattgccacacctcttgggcttgagtttattcctcaagtaaaggagttattggatgagggtttagttcgcaagagcttaaatccttgtgttttattggtacccaaaataggaataatcaacatgaaaataaagaaaaagatgttgaggaaagaatccatgagtttcaagaacctctggatttga

SEQ ID NO: 86227 - DNA, 420 bp, Glycine max
  Peptide Sequence Number=SeqID_177912
atggccacagagaccatacgcagctctgtgaagctcaaatcaagtgccccagatggctcttccaagggaaagattgattcttcagctgtcaggaagaaagtcgaaagctcaagcaagctccccgctgattcaaagatgaaatctgtttcaactgtgacaaagtctgaggtcaaatccaaatcgacatcgtcatcttcaaaaacagtaacaaagacaactacaaaagtgagagagaagaaagtctacagtctgcctgggcagaaacatgatcctccagaacagaaagaacccctgagggttttctatgagtcattgtcaaaacagataccaactagtgaaatggcagaattttggttagtatcctttcaatcttacagctgtttacccaccattttcactcccatgaatgaacattggtag

SEQ ID NO: 86228 - DNA, 549 bp, Glycine max
  Peptide Sequence Number=SeqID_177913
atgagacgggttgttacacctgacgtatgctggatgccttatggtgaccatcaaggagttagggtgtttgacctcatttcatgctttcaaggtgagcttagatggggttccattatggtcacacatcgcccggagagggtggtgcgccaatttggctacattcagaccattcctccaccgcctattagtgccaccttgtcatttgaggatatggacaacaggtggatgcattactcagaccatctagcagctgatccgcccagacatccacctgtcccacagcatgagacatacgtggagctagatatctcggaggtcccagtggcaccagaagctggatcttcacaggcagctgatcagcctaaacatgtagtggatgcttgtgaagcgatcgtagaaaggttgaagcatatgctcaacctaaggatggtcactgcaggcacagagttacatgacatcatggaagactgccagaggatcgctaggggtgtcacctcagatggaaatgtgtatgttagggcgcgacaaagatggcgcacggatcagtga

SEQ ID NO: 86229 - DNA, 1239 bp, Glycine max
  Peptide Sequence Number=SeqID_177914
atgtcatactttgtgtcataccctaatttcgttccgagacaattgtttgtcgacatgcggattttttccagtcacattgagttgcttaaagccaattgtcgtgtgattcgtaaggaatcttctggaggaagcaaaagctcgcctaggcgtgcatgttgcttcaagcttaagccaccagctcgcttgggcgagctgagcatgccgtggggaagtcggaaggcctgtatcactttcttaaatgcgtacatggggcatcgtgctgccaaatgttgccgtttgcgagaattggggcaattgatgggtcagctccaacatcaagccttctgcaaggcctatgggaagatttgggacctagctacggtagaagtctttgtggaagcaattgcatcccttaccaagtactatgaccagcccctaaggtgcttcacatttagggacttccagctagtaccgactatggaagagtttgaagaaatcctgggatgttcgcttggagagagaaagccatatctctttttggggttctatcccttcatggaaagggtagcaaaggtagttaaaatctcggtgcaagagttagaccgtgtgaagcaaaataggaatggggtagtcggaataccaaggaaacatttggagggaaaggcgaaggcattggccgatcaaggagaatgggttccatttattaacacctttgcactattgatatttggagtcgtcctctttccaaatatggaagggttagtgaacctagcagctattgatgctttccttgcttatcaccatagcaaggaaagcccggccatcgctattttggccgatcactatgacacgttcatccgaagatgcaaaaagagcagcacaagaattgtttgttgtataccagctctctatgtgtggctcatctcacacctttttcgccaagaaagtaggccaatctgtccactacaaggtttcaatgaccccaacgcgagggtacttcaaggagtccgcaaggcatgggatgcggcacaaaagaaggacaaagagcttaggggaagcagtaatggggtcatcagcggctatcataagtggctgagagtccggacacaagggttggattggcccccaaagctaaaggctgcaagagaggaagaggctgaagctccggaagaaagtgaagaggtacaagccctaaaggtggagctcgaaaaagcccgagcagtcaaagagaagttcaagtcaacgaccatcaaagtctga

SEQ ID NO: 86230 - DNA, 673 bp, Glycine max
  Peptide Sequence Number=SeqID_177915
ccttaaggagttgggacggttgatgggacccctccaaaggcaagccttccgcaaagtgtacggaaatattttagatttgaccacaacagaggtatttacggaagccattgtatccctcgcccaatactatgaccagccattgagatgcttcacgtttgaggacttccaaatagtattgactgttgaagaatttggggagattttaggatgccctcttggggaaagaaaaccgtatcttttctccgggtttcttccctccttgagcaagattgcagctgtggtcggagattcggcgaaagagttggatcatatgaagcaaactcgaaatggcgtagtgggcctatcgcggaaatacttggaaggcaaggcaagggatatggcgaatcaagaggaatgggtcccgtttgcggatatactagctttgctaatctttgcggaaggaaaggagggagttctcttctcatgtggggactacccaaatgttccgttgatagggacgaggggttgtattaactataatcccgcacttgctataagacagttagggtaccccatgaggggagcaccgatggaagagagcctctcgcctttccttgtgagagatttcggctcaaagtttcaagattgtacaaagagtccacaaggcgtgggaaagcccgttgaggaaagataa

SEQ ID NO: 86231 - DNA, 102 bp, Glycine max
  Peptide Sequence Number=SeqID_177916
atgagtgagataggaaggtttggaggtttgggaatggaggaacgtcgcaaggaggaaggggctgcgcaggggattctgaaaatgccatctgttctagtgtaa

SEQ ID NO: 86232 - DNA, 359 bp, Glycine max
  Peptide Sequence Number=SeqID_177917
ggtacatcctttgtggtacaagtagagcgtacatctactttggttgtaatactgagaacaagagaggatacatctcttgtggatcagttcaagtggagggtacatccacttggttgttcaaagagaacaaggaagggtacatcccatgtggatctttgcttgcaaaggattttacaaggttattggaaatctcaagaatcggtggttgcttggggactggacgaagccacgggttgtggccgaaccaagtgctaaaagcaaaaagctggagaaataacgaagaaaagaataacttgcaacaaggcccgacccaacatcgcgctcagcatgtaactcgtgctaagcgcaccgagaattag

SEQ ID NO: 86233 - DNA, 858 bp, Glycine max
  Peptide Sequence Number=SeqID_177918
atgagaggggcaccgctagaggaagagctcgcgcctgtcatttcacgaggtttcaataagaccaatggggagacacttcagaaggtccacaaggcatgggaggtggtgcaaaagaaggataaagaactcaggggcagtaacaatgggcccatcggtggctaccgaaggtggttgaaagcccacatacaaggtttggattggctcccgagtttgagaactgctaaaagggaggaagttgaggcaccggaggaagacgaagaggtgcaggcccttagggcagaactagagcaagcccaaacagtcaaagaaaggttcaaattagcagctcttaaaatccaaaatgagaatgccgaactaagagatacaaatatagctaccaccaaggccttggaacaagagaccaagagggctcgtagggaagagcacgaccggaacaagttccgaggggctctgtggggcagcaacagcgagcttaagctctggagagaggaaagagaccaatcacgagtacatggcatggtcttaaaggaggagttaacttcttgctcaagatcaaagaaaattttggcccaacacttagaagccacggagcaaagcatgctagctataataggacagtacaaagaagggttaaaccagtctttgacccatgagcaaaagctagtagaggacttcgcacaagcatacgtcgagaaggaagcaagagggagggtgattgatgcattgcatcgagaagcgaccatgtggatggataggttcgccttgaccttaaatggaagccaagacctcccgcgactactagccaaagcaagggccatggccgaagtgtgttcagccccagaggaattcacgggctaa

SEQ ID NO: 86234 - DNA, 483 bp, Glycine max
  Peptide Sequence Number=SeqID_177919
atgaaaagagaaaaacatgcctcctatagtagtcataactcttgcaagagcctaagtgaagaacttcgtaactattacgaaggaaggcataggtcacatcttagacctcactcccatagaagagaaaaggaaagaaagcctcaagagtctaacattaacctctcatacttccatgggaaggacaatgtagaggctaacttagattgggaaataagggtagagcaacaacttaaaaagaagtctcacttcaaaatcttatggttctcactcttatccaaagaaagaccaaggacacattacttctcatgccccaccacaaaaaccatgattatgaagggccaaaacatttatggtagccaagatgaggctactacttcactttcctctagtgaaagtgaagaagcaaaaggtgaaaaatctagtgaagaaatctacccccaagaagaagaacaaccattagtggttaaagagaagtttaaggag

SEQ ID NO: 86235 - DNA, 354 bp, Glycine max
  Peptide Sequence Number=SeqID_177920
atgggttctccacctgcctccactcctcctcctcctcctcctcctcctcctcctcctcatccttcttcttctcctcctcctcctcctccttctccttcggatgcatcggcttcgctgtctgcggtgaagcgaacacccaaagcctcacgtctacgatcgttgtccactagaccacctggtgctaagagaccagtggtgcatgttgatcctgctaccgggaaggccgacggtccccacaggaagaaattaagaacatatttggggattgtggcgcgtgataaggtggacgtcacctacgagaactggaaggaggtccctactgctcagaaggacctgatttgggaggatattcag

SEQ ID NO: 86236 - DNA, 309 bp, Glycine max
  Peptide Sequence Number=SeqID_177921
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttgcgaacaacgaattaatgattgaagctggtgcaacaaagggaataggggaaacaatctggggtgggagttttgtgggcagagtagcattgttctcagccgaaggagagaagaaagggctggtttcaaaccttttgtag

SEQ ID NO: 86237 - DNA, 532 bp, Glycine max
  Peptide Sequence Number=SeqID_177922
atggatgaaaattggttccagctgttgaccccatttatcagtcagtggaataatcgagctgagtttagggtcgacatttatcctcgacaggagggcctattgagttttaactcggattacatggtctggtataggcaaaaaacaaagatgtttgtcgaccaaaacaatgcaaagacagctacattggatgaaggtgcggagacattgcagtatatggtgtcaccacaagggcgtaacacatggacagtggatgatctcgtgtcttatgtggagaagctgacgattttatccgaagagcaagagaggatcactgagcctgtggcacatggtccagcatcagagcgtagctttccgccacaacagtttcacatgcttccgtccagtgtggaaactcgaggttttgacagacgaagggagattgttcaagcggaagatttttcccaacaaatggagcagcgtggccatggaatgtactactcgccaccaacattttctcagtatccttcgcagatgtatcagtatcctttcgaag

SEQ ID NO: 86238 - DNA, 177 bp, Glycine max
  Peptide Sequence Number=SeqID_177923
atgcaacctaaagtactaaacctcgatccctcaaatccccaactagggtgtttagccagccatacaaggaaccctaatgcaaatgagacagaaagtacagagcaattgttgcttacacaagaagggggatcccttctcctcttcttggcacctcgcaatcactcaaacactctctaa

SEQ ID NO: 86239 - DNA, 543 bp, Glycine max
  Peptide Sequence Number=SeqID_177924
atgagcgtccatgtggctcagttgattgctgacgccatctatttatttgcaggtatgccacccaccaggcaccctctaaacccggataagtctaacagggccctggggttcccagcattgatcatgggcctctgccagtcattcggggttcccgtcacacctagtaaggtgatccgaccgccgatcacccagaccttcattgagaagtattgcacgcctaggcaggcgcagggtgatgcaccacaagccgcagacacaccaccaccaccttatcaggctgatcctgctgggtcattaggcatggagcggtatctacagcacttggttcgccagcaggcggccaaccaccaggggcagggtttcgttccttttgtgtgccctactcttgatcagtttagggctgaggtcgcgtggcccggagattggcccgaggcccaggcaagagaggcgcctacagaggctctcggtgatgcagaggaggcccgcaaggatgaggagatgatggatttgctcgatttcttgggtgggagcggagccacatga

SEQ ID NO: 86240 - DNA, 147 bp, Glycine max
  Peptide Sequence Number=SeqID_177925
atggccgtgtggtcacctgatcatggttgtggtcatctgaccatggccatggttgcctcaccttggttgagtgttagatttcaacaaactttcactatgactatggcagggcataggtactccgaagacgtatatgtcatgatgtaa

SEQ ID NO: 86241 - DNA, 453 bp, Glycine max
  Peptide Sequence Number=SeqID_177926
atgagtatcagaaagtgtttgtcagaggaaaatgtgttagtctcccctgctgtaatcaacaaatacctgggcagaccaactgaaggagtggtggatattgctgtttctgagcatcaaattgccaaggaaatcactgccaaacaagtccagcattggccaaagaaagggaagctttctgcagggaagctaagtgtgaagtatgcaatcctgcataggattggcactgcaaactgggtacccaccaatcatacttccacccacaggttgtggactatggcacagaagaagagcactccaatcactcctaccacatccagatggagcaaagttgcaatcccttccaagaagaggaaagaaatttcctcgtctgattctgatgatgatgtcgaaccagatgttcccgacatcagaggaccaagacatcagggaagaacgtgcctggaaatgtcctga

SEQ ID NO: 86242 - DNA, 233 bp, Glycine max
  Peptide Sequence Number=SeqID_177927
atggcggagtcaggcctagaagagtcagaatgggctcaagcacgctacgaccaacttaaccttattgaaggagcagaatcgtctcaggtcgcagttagaagtcaagacaagttgactgcggaaatcaaccaaggtacatggggacggatgcaaatggggatagggtcacgacccaccgatcgttgccctttcccggcgctaaacaagcagagaacatcgctgaaggcagccca

SEQ ID NO: 86243 - DNA, 471 bp, Glycine max
  Peptide Sequence Number=SeqID_177928
atgctagttattccggccactcaggctgctcccaaggttcagggatgggggcgagtgaatatgcaaggagccattatcgataccgcttgcgccattgccgccggcagtcgcgatcagactatcgatatggatgtgttgccgctgggaaatattgcgcgcgatggacagggcaatacgcgcccattcaccatcgaattaatcaactgcacgtttgaacggccaaagcccaatttgccgaactggaagcaattccaggttgtttttgacggcgatgccgatggcgagttattcggcgtgcgcggagacgcgaagggtgtggcgctgcaaatatccgatggccaagggaatatcgcggcgcccggtgtgcctttgccgcgtggagatatttcaccaggaagcacgtcgctcaactattccatcaagctggttgccaataagcaaccgctgcatgccggaagctatttttatgcg

SEQ ID NO: 86244 - DNA, 234 bp, Glycine max
  Peptide Sequence Number=SeqID_177929
atggctgtggaatggagaagaagaagagttgagaggaaacgccacttcaaggagaagatgagtctagaagaagctcaccaccataggaggccttggataagagcttggaggaagaagaagatgaatgaagggagaggaagagaagagcccaaaatttggtgctctaaaggagctcttaaatctgaacccactaatccaaggtcaagtccaagattctccactaagtgtgcttag

SEQ ID NO: 86245 - DNA, 396 bp, Glycine max
  Peptide Sequence Number=SeqID_177930
atgcacggagttgccaccaacgtttatttgtggaaaacgtcggaaaaaacaaaggaaaccggtcataaagaatattccaagttcgggagttgtatttacgttggaggaaggcgagaaaatggcttaaatgatcggttaaagttcgtcaaaaacggaagaaaagaaaccgaaattgaacgaaataaaaatgaaagccaagaaacaagaaatgaattaaaagtctcggatttggaaacttacccgctgaagaacgaagaacggatgaagaacgggttatgggaattttacggaagcattacaggtgtcctggaagccccgaaagcccattttttaacaaaacgggggaggtggttaccacctagctcgcccaggcgagctaggttgcttccaccctaa

SEQ ID NO: 86246 - DNA, 252 bp, Glycine max
  Peptide Sequence Number=SeqID_177931
atggacccatacattgtaattaaaaaggatttgatgggaacgggagaggacgataaaggtggtacgtgtaccaatgttcaaagtgtttatgctagagaatattactcattaaggagtcctaaagttaagaaagagattaaaaacttcaacgagtttaatcatcgtcttataatgaatttctggcatggtagtagagaccatcacttgcaacatgtcacaaggttgtacgactttggcccgttgtacttgtag

SEQ ID NO: 86247 - DNA, 1914 bp, Glycine max
  Peptide Sequence Number=SeqID_177932
atgcctgaggctcctagccagtacctttgcaacaagccaaatggaaaacttgatgatggtggtgctactaatactagcatcatcatcgagcacaacaataagaaagcactcaaatacattgaggatgttactagcaacgctgatgaaattcagaaaagggtccttgctgagatcctttcttgtagtgcacacgttgagtaccttcaacgccatggcttggaggggcgcacggatagagaaacattcaagaagatcatgcctgtggtgacatacgaggatttaaagccagatattgatcgtattgctaatggtgatgcctccccaattttatgttccaaacctatttctgagttcctcactagctctggaacatctggaggggagagaaaactgatgccaaccatagaagacgagctagagcgaagatcattgctctacagcctcttgatgccagtgatggaccaattcgtaccaggtttagacaaaggcaaaggaatgtactttttgttcataaaatcagaatccaaaacccctggtggactcttagctcgtccagttttaacaagttactacaaaagctcacacttcaagaacaaaacacacggtttaaattttgacccttacacaaactacactagccccattgagaccattctctgtcaagactcttaccaaagcatgtactctcaaatgctttgtggactttctcaaaacgagcatgttctccgtgttggttctgtttttgcctcaggtttcatccgtgccctcaagttcttagaaaaacactgggaaagtttgtgtcatgacataagaaatggcaccattgaccatgaaatcactgattcaaccgtgagagaggccatcatgaaaatactcaaaccaaacccaaaacttgcggattttatagagggtgagtgcaagaagggtttgtggaaagggatcattactaggttgtggcctaataccaagtatgttgatgttattgtgactggaaccatggctcagtatattcctatgttggattactatagcaatggtcttcctctcgtttgcaccatgtatgcttcttctgagtgttattttggactcaacttgaaccctttgtgtgatcctagtgaggtgtcttacacccttgttcccaccatggcttactttgagttcttgccacttaataagatgaagggacatgccaattcaatttctcacaccgagcaggaacttttggttgatcttgtggatgtggagctggatcaagaatatgagcttgtggtcaccacttatgcagcttctaacaattatgtcatcatgcacaatccacacacaggactctacaggtaccgggttggcgacatcctccgtgtggcaggattcaagaacaacgctcctcaattcaacttcgtgtgccgaaagaacgttgttctgagcattgattccgacaagaccgacgaggttgagctacaaaacgcagtgaagaatggagccaagcaccttgcaacattgggtgcatcactcacagaatacacaagctgcgctgacacgtccactataccaggccactacgtactatactgggaaattaacatgaacaataatgatcaaaccccaattccaagttctgtttttgaggagtgttgctttgcagttgaagggtctctcaacagcgtgtatagacaaggaagagtttccgagtccattgggccattggaaatcaagattgtggagaacggaacttttgataagcttatggactttgcccttagccagggtgcgtctataaatcagtataagacacctcgttgtgtgaagtatgctcccattgttgagcttcttgactccaagactgtttccaattacttcagtccaaaatgtccacagtgggttcctggtcacaagaagtggtgcatgtacccttga

SEQ ID NO: 86248 - DNA, 428 bp, Glycine max
  Peptide Sequence Number=SeqID_177933
cctcagccaccactctccggtcgtgtcgtcttctccgaccacctccgacttcgccaccgccatgtcgcttctctttcttgcgcaaacttgtcatcggcaatactaatggcttccgcggcgccaccgaatcccatcgccaacctattgaactaccctcctttcttcctcctcttcccccacctcgcatgatatggctccaatctgttggaaacttgcgcagttgcgaagtgggtcaacgtgtccccaacgatggaggggttattgatgcgattgcggcggcaaccgttgtggacttggtgctcaccgatgtcgcggtggagatcttgttttccgggaggaagacgatgaaagggatccccgcagctgcgaagtatccggaaaacgcgacggaggtagcagtcgtggttgtggaagatgcggtgtcgtag

SEQ ID NO: 86249 - DNA, 414 bp, Glycine max
  Peptide Sequence Number=SeqID_177934
atggaaggtatgtgcatcttaatccaaatgtgggcatgggaacgatgcacgactttggctccaaagaggactcctcccgtgatagaaaataagtcactcggacacagagatcaactcgccatttgtaatggttattccaagcttaactcgccagtgctactggcaactccaactacagcgcaattcgccagtagcactggcggtttcaacctgattaaagttgtcttccctgcaacgcttcctgcaaccctacactgcgtaaacagcaaccctagctcaactcgccagtcaaactgtgacaaccaatatagagttgcctctgctttcgtcaagatgggcaatgtcgccatgatcgtggtcgatgtagctggcatggtggtggtggtggagggtttggtcttcggaggtgactag

SEQ ID NO: 86250 - DNA, 552 bp, Glycine max
  Peptide Sequence Number=SeqID_177935
atgcaatcacagggacttgcactacctcctgagcctgaggttgttccttcatctgctcgtgtcagcacaaaggaaagttgtgttgatcccttagggaatgatccagacacgggtgacttagacaaatgcgggttgtacatcgaagaacatcctccccgcctggttgccctaggaagagtttatgagggatccacaatcgttcacaacatccctttgttgcatgatcaagtgaaggttagtgttgaggacgttagagatgcagatgctcctattcctgtacccactgaagaggttaatttagtgggaaatgcacttaacaccttccttgcttggtcgacacatctcgtcaaacgtttttcagaacatgatgctaccgtgttcggggtgtttaatgaagacttccctttgtacataaaacatgaagatctatctaaaattgcacatggtgatcaatgtctcaacatctttgttatacaattgtggattctgcatatgactaaggcaagtatgcaagcggggaattctgatgtgtatggattcctcgagccatag

SEQ ID NO: 86251 - DNA, 378 bp, Glycine max
  Peptide Sequence Number=SeqID_177936
atgaaggaaaacattattgacatcaagctgtctgataaaccacttattcgaagcagcgagtgccagcaaaagtcgaactatagtaattttggctactggagaaaaggcttcagtataagacttaggctcaatattagcagagacattaagaataaagctgtgataatgggaagagagcttattataggaaatcacagaggaaatatgatgtttggtgcctggatgattggtgacagtggttggtgcgaaactggtttgatagtcattgaatttgatgggtctggttcgaactctgttagtcttacaaagggaatgtttagaggaggtgggttcagtatatggctggtcaatagatataggttcaggttgaggaggtaa

SEQ ID NO: 86252 - DNA, 207 bp, Glycine max
  Peptide Sequence Number=SeqID_177937
atggggatcccacggtcatgtggctctgcatgccatcggactcctgggtcacgcatttcgtttctaaacaaccatatagtggaaacactgggtccaataaagataggagaaaatcactcaaagtgtattagtctcacacattgcgtggcgagaaagtcgctagcgcacaggattttgtcggcaatcaaagagagaggaccactttag

SEQ ID NO: 86253 - DNA, 496 bp, Glycine max
  Peptide Sequence Number=SeqID_177938
tctgagaaccgctaagagggaggaagatgaggcaccggaggaagacgaagaggtgcaggcccttaggacggaactcaagcaagctcaaacaatcaaagaaaggttcaaatcagcagctcttaaaatccaaaaggagaatgccgaactgagagatataaatatagctaccaccaaggctttggaacaagagaccaagagggctcgtagggaagagcatggtcggaacaagttccaaggggctctgtggggtagtaacaacgagcttaaactccggagggaggaaagggaccaatcgcgggtagacaggatgagtgaaaggcttgctcgagagaccaacatgttagtcatcatcagcaagtaccaagaggaactaagtctagccacggcccacgagcatagggtggcggacgagtatgcccaagtgtatgcggaaaaggagactagaggaagggtgatcgactcgttacaccaagaagcaaccatgtggatggactga

SEQ ID NO: 86254 - DNA, 141 bp, Glycine max
  Peptide Sequence Number=SeqID_177939
atggatacctcaaagccctacactggggcaatgaggggcaccgtgcatgagcctcaagttcgccgccacaaggtcatgacgaaagataacaataggtacctcaaagccttacactggggcaatgaggggcatcgagcatga

SEQ ID NO: 86255 - DNA, 363 bp, Glycine max
  Peptide Sequence Number=SeqID_177940
atggcagctcaggtagcgcccccaatgatggagagggagttgatagcaatgatagtagacatgttgtcagtgtcctactatgagaagatggtgggttacatgccttcaagctttgccgatttagtgttcgccggcgaaaggatcgaagtgggtttgagaagaggaaaatttgattgtctcgcattgacaagtaaaaagcctggggcaaatagagagaatgagaagggggaaggaacccgtgttttgactgccagtcctacatggccaaattttctacctactcaacaatgtcattactcagccaacattatcccttttcattatccaccacccaatcatccacgaaggtcatcactaaattag

SEQ ID NO: 86256 - DNA, 107 bp, Glycine max
  Peptide Sequence Number=SeqID_177941
gtgttaagggaaggagcccagagtatcaagaacctcaggatttgaggtcaaatccttttcaagggggagggaatgatgcaatcctactccgcaagggcatgggatag

SEQ ID NO: 86257 - DNA, 591 bp, Glycine max
  Peptide Sequence Number=SeqID_177942
atggcttccatgatggaggccatgttaggaatgaagcagctcatgggagaaaaacacggccactgcccgtccgctgtcagttcggctgccgaagcagacccaactctcttggcaactgcgcaccatcctccctcaaacatagtaggacgaggaagggacacactggggcacgatggcaaccctcatatgggatacaaccgagcggcttacccttatggattgctgcccaactactcaccacccgtcctgcaagacgatgcgggccatattgcttctcccgtccttgaaagagaacctcctcaacagcccgacgaggtccacaaagaccctcaagactatgctcgaagggatgtcgagttctatcccccgatccccgaagggccggcacccagcacgttgcctcagcccaacatcacgacacaaccaatagttttgtccacggaagaaccgcccccggcaactgaagaaaggaggaagctcgatctcctagaggagagattgagagccgtggaaggatttggggactatccgttcgctgacatgacggatctttgcttagtacccgatgttgttatccccccgaagttcaag

SEQ ID NO: 86258 - DNA, 381 bp, Glycine max
  Peptide Sequence Number=SeqID_177943
atgtcgatgacactgtatgagaaaaagtacgacattagcaaggagaaagtggaccccaatttttgtcagacctgcagagacccttcgtgggaggattcattggaggagcaggcctcacagggttcctttgtcgcccatggacgtcaagatgtaatgactgttgccattgggcgaccagaacaccctggtcgtgtgcgtgctgctcgagtcggtgtgaccatcaagcaatactttggaccgactccaaggacctcctgcacatcttcgtccatggctcccaaagacttggagcagcagatgcaaaaaatcagggaccagctggaggagtcgatcacagaaaaagtgactcaacaactaatgttatccttcagtcagatgtag

SEQ ID NO: 86259 - DNA, 444 bp, Glycine max
  Peptide Sequence Number=SeqID_177944
atggtatttggtggagattttcggcagattctgccagtcattcctaggggtagccggtctgacattgttaatgcaactataaattcatcttatctatggaatcattgccatgttttgacactgtcgaaaaacatgcatttagaagccaatatagatgcaacagacagagaagaaacttcagcttctgcacagtggatccttgatattggtgatgggattgttgggcagcaaaatgatggttatggttcaattgaaattccaaaagatctattaatcacaaaatatgatgacccactatatgcaattgttaattctacatttccaaatttatctcaccatcataacaatcatgaatactttcaatctacagcgatattagcttccacaaatgaaatcgtacaacaagttaatgattatatactatcattgatcccaggtgaataa

SEQ ID NO: 86260 - DNA, 288 bp, Glycine max
  Peptide Sequence Number=SeqID_177945
atggacgaagatcaatggaggtatgactttgcgatgtcacaagaagttcatatggattatgattatgataatcaagaagaatgtggagtgaatgaacgacatgtcgattgttcaaatgcttttaatacatctcagggttgcgttgtagtgattatgagatctgacacagagaccggtagcagaggaagaagttcatttgtgttaattgggtgtgaaaggagtggcttcgtgggaaaccagtgcgtggaggggaagttggatggtgaagttgatctgtgggattcataa

SEQ ID NO: 86261 - DNA, 234 bp, Glycine max
  Peptide Sequence Number=SeqID_177946
atgcgcatagacgaattctgcgccctttgccattcagatttcgcaaattgggtgataaacgcgcatagacgaattctgcgccctttatcattcagggacaacaagttgggtggtaaacgcgcagagacgaattatgcgccctttatcattcaggagcagaacaacaagttgggtggtaaacgcgcagagacagattctgcgccctttgtcattcagatttcgcaagtcgagtga

SEQ ID NO: 86262 - DNA, 360 bp, Glycine max
  Peptide Sequence Number=SeqID_177947
atggggatcgcacccacaaagacacccagtggacctgaagaagtccaacagggtcctggggtttccagctctggttacgggcctctatcagtcctacagggtgcccgtaccccccctagcaaggtcatgccatcccgacatagggatcgtgcccgcaagacatccagtggactcgaagaagtccaacagggtcttggagttgtcaaagctctaatcacgggtctctatcagttcaagggagtgcctgttgcccccagcagggtcatcaggccccctactgatcgagctttcatcaagaagtactgcgtccctaggcaggcgcagggcgaaacaccacagcagcattgggatggccggtag

SEQ ID NO: 86263 - DNA, 333 bp, Glycine max
  Peptide Sequence Number=SeqID_177948
acccgggccttcattgagaagtattgcacgcctaggcaggcgcaaggtgatgatgcacctcaggccgcagatgatccgccaccacctcatcaggctgatcccgctgggtcactaggcatggagcgttatctacaacacttggggcagggtttcgctccttttgcgtgccctacttcagagcagtttagggctgaggtcgcatggcctgaagattggcccgaggcccaggcaggggaggtgcctgcaggatcccccggcgatgtagaggaggcccgtatggatgaggagatgacgaattttctcggtttcttgggaggaagtggagccacgtga

SEQ ID NO: 86264 - DNA, 482 bp, Glycine max
  Peptide Sequence Number=SeqID_177949
actcaaagcatgatagcacgcaaagactaacgtcgtcttctgcgccttttgtcatccagaaggcggcgggcccgatgacatgcgaggaaccatttgaggcggcgggtctgatgacatgcggttatccgcacgctcgcaaattggtgataaacgctgtagcactagacgaatctctgcgccctttatcattcagaaccagcgagttgagtgatttctcaagttgggtgataaacgcgcagagacaaattctgcgccctttgtcattcggggacaagacaaattatggtcattctgtgtctcgccgcccaggctcgatcgtgtccaacaaaatgcagagacaaattatggtcattctgcgtcttgtatcaaccaagaggaacaaattcgacagttccactggcagggaggttcactggccgaatggtcccgagacatgccagaagccaaaagaaaagcgttgtagcacaatccgtgaagttcag

SEQ ID NO: 86265 - DNA, 357 bp, Glycine max
  Peptide Sequence Number=SeqID_177950
atggaaaaaaggttccttgctgaaggcatggagatcaatttgctgatcaaaaacacactggaagcttcactcaaatccttcaatgattatgttctgtttaatgtgaatatgtttatgcaacaaaggttgcctccgaccatccaaccacctccaccacctccaactacaatttttgcatctacctccaataaaaatcttattcatcttctcgctaagcctatctcccggcttagcgagccatccgctgagcgcaccactcttgcggctgagcgcaccactcctgcggctgagcgcgaggaagaatctagaagaaggatgagctggacacacgcactaagcaagggctcatcccgctaa

SEQ ID NO: 86266 - DNA, 927 bp, Glycine max
  Peptide Sequence Number=SeqID_177951
atggaagaggcaattcatgtaagatttaatgacaacaagcttgacattacaatgtcagagctggatgagtcttttgcagagatgaaaatagaaaatatcgtgaaatctgctgctgtgtccaatcaagacaaacacgcgttcaaatcactagacaaagtccagataaggaactctctcaagcatacaacattactcttagagattaagccaaaacacatagaattcctcaaaggcaaatatgttggagcaaagtgggtgttcaaaaacaagttggaaaaaacaggtaaggttatggggaacaatgctaggcttgttgccaaaggctactcgcaacaggatgcttatgtaggaagagttcaaaatgagtatgatgggagaattgaagttcttccttggactttaaatcaagcaagcggacgaaggaatatgcatacatcaaaccatgtagtgaaaaaacttctgaagaagttcaaggtggacgatgcaaagcatatgaaaacccccatgcatccaaccattgtacttggactggatgatgaatcaacgaagaacccaacccaaaccatccaagttgaactagacttcaagaacaatccaccatctgcttcattcgacgaaggtgaggctctacaaattgccagacctgcaccagtgaccatcattgttgtagaagtttcattgaaagacaaagagcccaatgttcacattgaacatttcttcgacattgagtcattggagaatgatggctacatgatcaatgcacacctcatgttgtgcggcatccaccacttcttcgaggacccaaagttgtctatagataccattactcaaaccattggttgtgagcataaaggaaccaagttcatgaacagttggggcaatgaaattgaagaacatattgggcactctctatggggacccaactag

SEQ ID NO: 86267 - DNA, 435 bp, Glycine max
  Peptide Sequence Number=SeqID_177952
atggcttttcagtcctttgaggtagtgagcaatgctttggtggaatccctcccgatgcgaccctgcatgtccgacgccacgatgatggtggcccatgtgatgttaggacatgggtataagcctggaatgagtttaggacggaacaacgatggaatggccaacttggtagaaatcaaggaaaaccgcaggaggtttggactaggctataggcccacacatgctgatgtgagaataagcgccctagagagaagcaggggcatgggccaacagcaaaggccacaagtgaaagaggctcatccatgtcacatcagcaagagtttcgtgagtgcaagctggaggtgtgaagagcaagtctccatgatacacgacgaagccccccaagaccattcaaactgggaacaactgtgccttcctgatttccaattaggaaactag

SEQ ID NO: 86268 - DNA, 226 bp, Glycine max
  Peptide Sequence Number=SeqID_177953
atggctgatgagccaagacgagtgaccctggaagattactcaagtacttttgtgccacaattcttcacaagcattgtgtggccaaaggtacaagctcagaatataacctatccatattcattaattcaattaattcagaacaatttgtttcatggtctgcccaatgaagacccgaatgcacatctagctacctatattgagatatgcaatactattagaatagctg

SEQ ID NO: 86269 - DNA, 1071 bp, Glycine max
  Peptide Sequence Number=SeqID_177954
atggcatccctcaaacaagtttcacccctattattactcttccctctattgctcatttccctcttcaagtcctcccacgctgcaggaattgccatctattggggtcaaaacggaaacgaaggctccttggcagacgcatgcaacactggcaactaccaatttgtgaacatagcattcttgtccacatttggcaatggccaaaccccccaactaaacctcgctggccactgtgaacccagcaccaacggctgcaccaaattcagcgacgaaatcaaggcgtgccagggcaaaggcatcaaagtgctactctccctcggaggagccagtgggagctactccctcggctcagccgaggaagcaacacagcttgcaacctttctttggaacaacttcctcggaggacagtcgagttcccgcccattgggcgatgctgtcctcgatggcatagactttgacattgaggccggtggcggcaaccattgggatgaacttgcaagggccctcaatgggttcagctcacagaagaaggtgtacttggctgcagccccacagtgtccaatccctgatgctcacttggactcagccatcaaaactggcctctttgactatgtgtgggttcagttctacaacaaccctccatgccagtactctagtggcagcaccaacaatctcatcaattcttggaaccaatggacctcaagccaggccaaacaagtgttcttgggactgccagcttctactgcagctgctggtagtgggtttgttcctgctgatgtgttgacctcccaggttcttcctgctatcaagggttctgccaagtatggtggagtcatgctttgggacagattcaatgatggtcaaaataaatacagtgatgctattaagggtagtatggacaccactattactcaactcagtccctcctgcaatactgccgtcgaaccgccgcgacgtagtccaccagagcccatcgaaaagaatgagatagaggacgaacgcgatgaggattactccaacactgagaatcacaagaagaggaagaggcccaaggctaaaacagctcctggataa

SEQ ID NO: 86270 - DNA, 557 bp, Glycine max
  Peptide Sequence Number=SeqID_177955
gggggaaaataaaaaggaaaacccctgaagaagcaacagagttgattgaaaacatgtctgccagtgatcaggccattctacgtgatagagtgcatcaacccactaagaagagtttactagagttatcatcacaagacgctgttgtaccatatgtggtggtactcatgaatccggcctttgcattccttttgaagatcaaatgcaataggttagctgcatggggaatcaataaaggcaaggatacaatcaaggttgattctcagggtggaccttctaataggccgcctcaacaagggcctaacatttttcagaggacaaccaaactagaggagactctaactcaattcatgcaggtgaccatgtcaaatcacaaaagcactgagtcaacattgaagaaccttgagatccagggattaagagaccgagggtctcttgttgtaaagaaatctaaacacaaaggaagggttgtccttgtgtggttcagaacttgtaaaggacttttgcaagatagtggaactctcaagcgggttgcttggggactggacgtaggcacaagg

SEQ ID NO: 86271 - DNA, 279 bp, Glycine max
  Peptide Sequence Number=SeqID_177956
atggtaatcgattacacctttgaaaaaccattttcagaaatatttgggctactagtaatcaattactaccttctgatagggagaggaaagaaagagaaccaacaaccactttctttaaccagtctcacaaacttgcatctagaatgtgattgtttcgagagtgagacagcctctagtgtaggagtcgttgctttaggagatctggtaacggcagcgacgctggtggcagtcgacgtcgtcgagctactcatagatggtggaggagaggacccagtttga

SEQ ID NO: 86272 - DNA, 570 bp, Glycine max
  Peptide Sequence Number=SeqID_177957
atggacaggagtatgattgatgctgccagtggtggagcgctcggtgatatgactcctgttgaggctagaaatatgattgagaagatggcttccaactcccaacaattcagtgcaagaaatgatgctattgtccttagaggagtccatgaggtggccatggattcatcttcatctgctgaaaataaaaagcttgagggaaaacttgatgccttggtcaacctagtaactcagcttgccatcaatcagaaatctgcacctgttgcaagagtctgtggtctatgttcttctgcagatcaccatacagatctctgtctttctttgcaacaatctggagttaatgaacaacttgaagcttatgctgcaaacatttataatagacttcctcagcaacaaaaccaacaacagcaaaataattatgacctttcaagcaacagatacaatccaggttggaggaatcatccaaatctgagatggacaagtcctccacaacaacatcagtctatccctcgtttccataatgctactggtctaagcaagccatatgttcctcctccaatgcaacaacagtag

SEQ ID NO: 86273 - DNA, 923 bp, Glycine max
  Peptide Sequence Number=SeqID_177958
atggcctccaggaagcgtaagagcattggggcaaggccaattgctcagtatgacactggacagttccattcacttgatgcttggaaccgttatacatataatgtcttaggaaggagcattttgccagagaggaaggtagagatataccacacagagtttgatgacttcaagacagagttggagaggcgtaatcttcacaaacgcctcaccaacttggctgatgggactattgatgttgctttggatccttcaccaaagcaagccagagttagaggccacttggtgaagatagacgctgacagcctcaacacatttctagagactcctgtagtcctagaggagggggagacattacccacctattctaggtactgcaggattctcatgaaggatcttactaccttggcccaggtgtggagtgttctttcttactccaacctggcatctacatctcatacatcagaccttactgtggacagagccaggttgatctttggcctggtctctcatatggacatgaacatcggtgccctcatctcaagacagatgacttccattgcccagtctaactcttgtagacttaggtttcctactttaattaccgccttatgccgagctcgaggggttgtctctgacagcctcacatttgagcgcctaagcccggccattaacttggcctacatcaggaacaactattggaaccctttcatatggttcaaggcaatttaccccaaatttgggggagttaaccgggattcagctctagcactaggcaacactggaagattgtacttctctaaagatatgcaacagaaagtgtgtgtggtccctactctttctctccacagcagcggcctcgtgttaagtgccaaagctattagacaacagctagttggaatctctcaacggattgaagctctgaa

SEQ ID NO: 86274 - DNA, 325 bp, Glycine max
  Peptide Sequence Number=SeqID_177959
atgactagagacaatccatctgacttagaaccccttgatcctgagatagataggacatttcatagattagttaggcatcattttataccttttgagcatcctgagcattttattggtgattttgaacatcctgattttgagtattataatgttgaacattctgagaacatggcacaacctccaccccgtgagaggactctaagggaaatggatgcacctgatttcacctacgaaagcctgtgcatccaataccctgatgaggatgtcccatatgttcttaaaactggactaatccatttgcttccaaagtttcatggccttgcag

SEQ ID NO: 86275 - DNA, 357 bp, Glycine max
  Peptide Sequence Number=SeqID_177960
atggagaacaatgatgctacaagaaagcaaaggctgaaatgcttaaataagagatgctctcgggaacggaagcttatagcacactatagacatcttctcaaagatcccaacggtcagatcatggaaaagcgtcttgtgaagttgcaaaccaaatttcgagaagatccaacggttaacgaaggctgggaagcgtttttaccgaggcagcttcatgtagttttctctagaagcttcattaagagacttctagaacactccaaatatcttctcaaagatcccaacggtcagatcatggacaaatgtcttgtgaagtttcagatcaaatttcgagaagatccaacgtttaacgaaggctaa

SEQ ID NO: 86276 - DNA, 2042 bp, Glycine max
  Peptide Sequence Number=SeqID_177961
atgggatcaaatcaaacacctctgcttaagaaaaggttctatcaaggcaaaattaaaagcttagaggtcgccagtttgcgagaattggggcaattgatgggtcagctccaacgtcaagccttccgcaagacctataggaatatttgggacctagctatggtagaagtctccgtggaagcaattgcatcccttgctcagtattatgatcatccccttaggtgcttcacgtttggggacttccagctagaagaaagccatatctctttggaggaaaaggcaaaagcattggcagataaaggggaatgggcttcgtttattgaaatcttggcattgttgatatttgttgtcgtcctctttccaaatgtagagggattagtggacctagcagcaattgatgccttccatgcttatcaccatagcaaggaaagcccggtcattgctattttggtcgatgtctatgacacattcgaccgaagatgcgaaaaaagtcatcgcttatgcaccaagaaaggaaaggaaaaatgggagcaactcttggctagtgtggtaggggcatccattaattggttcccccgttggaaggaaggaagaaccgggcttggctaccccatggaaggagcgccgtcagaggaaagcatcacgcctttcatcgcccagggttttagtgaccccaatgcgagagtacttcaaggagtccgcatggcatggggtgcagtgcaaagtaaagataaggagcttaggggaagcagcaacgggatcgtcggcggctatcataagtggctgagagtccgaacgcaagagttggattggctcccaaagctaaaagctgcaagagaggaagaggctgaaacttcgaaggagagtgaggaagtgcaaaccctaaatgcggaacttgaaagagcccaagtagtaaaagagaagttcaagtcaacagccatcaaagttcgaaaagagtacaatgaactaagggacatcaatatgaccacaaccgaagccttggaacgagaaaccaagagaagccgaaagggatcagtcgcgggtcgaaggcatgatcttgaaagaagagttaaaggcttgccaaaggttgaaaagaagcttgtccaagcatacaaggaaaagctaagcctagcagcgactcatgagcaaaggctagaggacgagtacgccaaggtatcagtcctgcaagcggagagggaagcaagggaaagggtgatcgattcattgcacagagaagcaatgatgtggatggacaggttcacctttactttgaatgggagtcaagagcttccccgactgctagccgaggtcaaggcaatggcggatgtgtactcagctcccgaggagactagaatcatgggtgacgtagacgaggtgcaagaacagatgaaggccgatatggtggccttgaaagaccaaatggcttccatgatggaagtcatgctaagcatgaaaagactgatagaaagcaacgcggtcacggctgccaccgccgagatagaccctactcatctgtctgccatgaatcaaatattggggagcaccggcggcccgcatctggggtataacagaaatgtctatccctacggcttaccccccaatttcacaccgcccaccatgcacgagaatgtggatcatgccattcccataaccttcgaaggtcagcttccccaacccatagggggcacccgcgaaaagccacaggagcgtgcccaagttgacgtcgactcataccccccgttcaccgtcgagggactgacattccacgccatgcctcagcctaatactgcggaagcctctcaaccctgctcgatacaaccactacatttcttcgtagagggaccacctctggtagcggagggaaaaggaaaacttgatctcatcgaggagagattaagagcggtcaaagggtctggtggttacctttttgctaatatgaccgatttgtatttggtatcggatgttgtcatcctcccaaattcaagggatgagaagttgctcatgcactttttccaagacagcttagtcggggcagcgaacacctg

SEQ ID NO: 86277 - DNA, 795 bp, Glycine max
  Peptide Sequence Number=SeqID_177962
atggtcgaggtctccacagaggccatcgcctccctcgcccaatattatgaccaacctttaaggtgcttcaactttggggacttccagttaacacccacggtggaagagtttgaagagatcctgggatgccctttgggaggaaggaaaccatatcttttctcgggattctatccctttttagctagaatttctaaaatagtcaaaatctcggcacaggaattggatcgcgggaagcaagtcaaaaatggggtggttggggtaccaaggaaatgtttggatgcaaaggcgagagtcttggcaagtcaagtgattgatgcttttcttgccttttacaaccgcaaggaaagcccgattgtcgctatcttagccgatctatatgacacattcgaccgaagatgtgagaagagcaatgcaaggatcattttttgtacaccgactctctacgtatggttggtttcgcacttctttcgccaagagatgagacacgtttgcctgctagaaggccaccgctcatgcaccgagaaaaaagaggcaaacttggaccgactcttagcaagcaaagaaggagtgtctgtcaattggttcccccgatggaaggaaggaagaaccgggattcttatttcgtgtgggaaatttccaaatgttcccttgatggggacgaggggttgcatcaattacaatcccgtcctcgctataagacaacttggttaccctatgagaggggtgccatcagaggaaggcctcataccttttattacacgaggtttcaatagcaccaatgtgggggtgctttag

SEQ ID NO: 86278 - DNA, 505 bp, Glycine max
  Peptide Sequence Number=SeqID_177963
acgcatccgcgggaggaaagatcaagttaaagacacccgaggaagcgatggaactcattgagaacatggcagctagcgatctggctatccttcgcgaccggacacatgagcctggacaatacacaatccaacatgatccctctcaagaaataaattacatgggcaatcctaatcgccacggttttcaaggctacaaccaaggaaacccgtctggatacaataacgggccaccaggatttaaccaaggaagaaactttaaccaaggctccggttggagaaatcaaggaaatcagtacaaggagcctaggaatcaaccaccataccagcaccctagtcaaggtccgagtcagcaagagaagtcgtctctcagtatagaggaaatgctcttaagtttcatccaagaaacaagggcaagcactgaggagacaaaggcattcatccaggagacgagatcacaccaaaagagcacagatgcagctattagaaacctgggagacacaactgg

SEQ ID NO: 86279 - DNA, 363 bp, Glycine max
  Peptide Sequence Number=SeqID_177964
atggcggcgcagctaatccgtgatcgagtagagatggagtgcctagagggagcttgggagaccctcgaaggcaacacgaggtgccgatttcggggcaccattcgattcacggctacttcttggtgcatccagatgaacctgcacggacgcttcagcgcactgtggagactggaggagctacctcctgagcctgctgtggatgcccttgactttctagagggtgatgaggatccacttcttgaggtggattctcccgaggaagtcatgtcggcatctgaggcagactctacggaggatagtcggcccgagggagatggcgatcagcggaggctcttcgtcctagtggacagctttttggattag

SEQ ID NO: 86280 - DNA, 565 bp, Glycine max
  Peptide Sequence Number=SeqID_177965
atggccggcggccaggctggagcaggcgctgaaccaacgccaggaaccgctgccggcgccgctggcggccgaagaagacagcgccgacatcgcctaccccgacgacggcgacgcgccggtggtgcagttcatcaaccagacgctgcgcctggccattcagcgccgcgcctcggatatccacttcgagccctttcggcagcattttcgcattcgcctgcgcatcgacggcgtgctgcaaaccctcgcctcgccgtcaccccagctgaccgcacgcctcatcgcccggctgaagatcctcggccagctggatatcgccgagcgccgtcagcctcaggacgggcagctcagcctgacgctggacggcgcgcgctatgccatgcgtatcgccactctgccgacgctacacggcgaaaaggtggtgctgcgcgttcagcagggcgaacagcaggagctgccgctggatcaactgggcatgagccgagcggatctggcgcgctacgcggcggcgctggcctgcccgcaaggtttgatcctggtgaccggcccgaccggcagcggcaagacg

SEQ ID NO: 86281 - DNA, 360 bp, Glycine max
  Peptide Sequence Number=SeqID_177966
atggccggtgacttttcacttggcgcgggggctgtatttaatgagtctccttacaaaggatataatgaaaataccaccgcggttccgttaattagctatgaaggcgacagattctatgttcgccagaccacgggcggatggatcctgtggaaagacgcaaagaatgaattcagcctgaccgcatcgtggatgccgctgcattttgatccagaagataacgacgaccatcagatgaaaaaacttgatgagcgtaaagcgtctgccttcctcggtggcgcttactaccgccacgaaagctggggttctctgaaagtggccgttgctggcgatgcgatggatgaaagcgcgaggatcctctag

SEQ ID NO: 86282 - DNA, 561 bp, Glycine max
  Peptide Sequence Number=SeqID_177967
atggcatcgttcggccagatgcagtcccagatgcaatctcagggacttccactgcctcccgagcctctggttggtccctcaggtcctcgagtaagcacaaaggggagttgtgttgatccctcaggaaactatcctgagacaggtgactcagataggtgcagcttgtacatcgaagcagattctgcctgcctggttgccctggggagagttaatgagggatccactgttgttcataacactcctttgttgtctgaccaagtaaaggtaggtgtggaggaggttacagatgcagatgatctagttcctgtacccactcatgaggtttccttagtggggcaggcaatgcacaccttccttgcttggccgacacatctggtcaagtctttatcacaacagacagctgtgtctccggcaaaaccacctcagaagtccgatttggaggtcgatgatccgctttatctgatgacattggccatcccagagcttttcttgaagccttatcaggttacatgggatgccaccgtgttcggggtctttaatcagacttctcgctctacataa

SEQ ID NO: 86283 - DNA, 504 bp, Glycine max
  Peptide Sequence Number=SeqID_177968
atgagcattcacgtggctcagttgatcgctgatgtcatctatctattgcagtcgttcggagtccccgtcgcaccaagcaaggtgattcggccgcccatcacccgagcttttattgataagtattgcacgcagagacaggcccagggggatgctccgcaggccgcagacgcaccgccacctcatcaggctggcccagctggatcatttgatacggagcagtatttacggcatttggttcgccagcaggcggccaaccaccgggcgaatgtacagacccatgattgtctttaccagttgagcctcagcctgcagagccagggttttacttcttttccgtgccctactccggatcagttcagggcagaggtcgcatggcctggagattggcctgaggcctgggcaggagaggcaccagcagaggctcccgacgaggcagatgaggcccgcgaggacgaggagatgaccgatttacttgatttcttgggagggagcggagccacatga

SEQ ID NO: 86284 - DNA, 681 bp, Glycine max
  Peptide Sequence Number=SeqID_177969
aaagaccatggtcaaggcatcttaggggtgacatcttctaagcccaaagatgataaggggaaggcaatagaaaagcaagcccctaagactagtatgcaagagaaaactagctctataaagtcctttaaatgtcttggaagaggacacattacttctcaatgccccaccacaaaaaccatgattatgaggggccaagacatttatagtagccaagatgaggctactacttcaccttcctctagtgaaagtgaagaagcaaaaggggaagaatttagtgaagaaatctacccccaagaagatggacaaccattagtggttaaagagaagtgtaaggagacacttgctagcattgccacacctcttgggcttgagtttattcctcaagtaaagaagttgttggatgagggtttggttcgcaagagcttaaatccttgtgctttgttggtgcccaaaataggggttcccatgaaccctaagagaataaaggtcattcctgagtggcccattccaccaacaccactcattgagttggtgagaaaccatgttctttcatgggaagatgcccaggaaatgggtgttgaaggaaagagcccagagtatgaagaacctcgggatttgaggtcaaatcctttccaaggtggagggaatgatgcaatcctactccgtaagggcattgggtag

SEQ ID NO: 86285 - DNA, 150 bp, Glycine max
  Peptide Sequence Number=SeqID_177970
atggaggttgaggaaccttggctggggttatggctaccattgcattatcgagcagataagggagcgagccttgtggttgacttaggggtggcctttgcggatgattgggcattcttgactggtagggtggtgggtaatgagaaggattga

SEQ ID NO: 86286 - DNA, 531 bp, Glycine max
  Peptide Sequence Number=SeqID_177971
atggtggtgacgggtgacggagaattaggttggaccttgggttgggtcgatcggtccgcctccggtgtgcaccggtcggctcgtcccttctgccggcgatgcgctcctgtccttaactggccgggtcgtgcctccggtgctgtttactttgaagaaattagagtgctcaaagcaagcctacgctctgtatacattagcatggggataacaccacaggattctgatcctattgtgttggccttcgggatcggagtaatgattaacagggacaacgaacaactgcgaaaagcatttgccaaggatgttttcattaatcaagaacgaaagttgggggctcgaagacgatcagataccgtcctagtctcaaccataaacgatgccgaccagggatcagcggatgttgcttttaggactccgctggcaccttatgagaaatcaaagtctttgggttccggggggagtatggtcgcaaggctgaaacttaaaggaattgacggaagggcaccaccaggagtggagcctgcggcttaa

SEQ ID NO: 86287 - DNA, 143 bp, Glycine max
  Peptide Sequence Number=SeqID_177972
aaaatggaataagagagaaagtgacgagtttatggagggctgaatggaaggtatttggttcaaagtttgaatgtgttcggatgaagaatgaagatgataacaatggtgttcaagtgagattaaagaatgaaggtttagaatga

SEQ ID NO: 86288 - DNA, 504 bp, Glycine max
  Peptide Sequence Number=SeqID_177973
atgggtgaagtagaggaggtgcaagagcagatgaaggccgacatggacgccatgaaagagcaaatggccacaatgatggaggccatgatgagcatgaagaagataatggaagccaatgcagttgcagtttccgctaccagcgttgttgctaaggtgaacccgacgcccccatctggcctcaaccaaatgaatcatccaacctcaaatatggtaggcaaagagttgggagagcaagaagttggtggtatacccctgcaaaacactttggagggccctcagtatcacccacaaccacaccccttgcattccacagcgagtaaaaacccttatgctatggcagaaatgggaaagttggatcatctagaggaaaggctcagggccattgaaggaggcgaagattatgcctttgctaacctagaggagttattcctagaatccaatatcatcacccctcccaagttccaagtgccgaactttgacagtaccagggactacttgccctag

SEQ ID NO: 86289 - DNA, 337 bp, Glycine max
  Peptide Sequence Number=SeqID_177974
gatacgtaggagcaaaagccctgcttttgtcaaccaccccaccttttgttatcgtgacccaagagtccggtggcatgcggagacacccgacggtaacccgcacacaccctttgctatccagcaacccgagagtccgatagcatgcggagacaccttacggttatctgcaccttgtcatttggagaccccaagtctgattgacaagcagagaccaatgtggtcatctgcaccctttccgaagatgtcagcatcttccggtagagactattttagtctcacaccgctttcgcaagaactacgttggtctgaattcctcatcgcgattgaggatacgtag

SEQ ID NO: 86290 - DNA, 159 bp, Glycine max
  Peptide Sequence Number=SeqID_177975
atggctagaacacgaggtttaggttgtgccataggtagacttgtaggcagagatagacatgatgaccatgatgcagctgatgttcccgagaggcgtaggcctactacctcagcccataggcaacgggttcatcagatggctgcggagggacgtgatatg

SEQ ID NO: 86291 - DNA, 348 bp, Glycine max
  Peptide Sequence Number=SeqID_177976
atgtcattgcctagcgctgttcatgtgttctccattatcaagcgcgaagtctctgatgactgggaaacacgttattctgttgttttccggatcggttccttcgtcaaatttgtaagaaaaaaggaaggagtggagacgagagtcgtcatcacagaaagggcaggacggacgaaatcattgtcctatctttgctttcctcttatctccgatgagagggggggtgcaaatagcaacaaggtccacttgggccctccagaagattcctccagaaggctgttgcttctggaggaagcaaccttgctcgcctgggcaagctgggcggcaagcttctcccctattttgctataa

SEQ ID NO: 86292 - DNA, 267 bp, Glycine max
  Peptide Sequence Number=SeqID_177977
atgtatgacactaatttcgctcctctcggtgacgagagtcgcggggaccatgaaatttccgcatgtaatgactttgttgttcccggagaacaaaagaatgaccaaacttggtctctgcgtgccatcggaacacaactgtgtctgcctagcaaaggggtgcagataaccgtaaggtatctccgcgtatcatgtgtgcagaatgaccaaacttggtctctgcgtgccatcggacacaactgtgtctgcctagcaaaggggtgcagataa

SEQ ID NO: 86293 - DNA, 363 bp, Glycine max
  Peptide Sequence Number=SeqID_177978
atggttaaaggaactcgttatatgaaaaattgccattcattgtatctgctaacaagtacagcagaattcttcagtagcaatgaaagggagttgctaggtgcacccaacaatattgctggtgcacccagcaatttattgaaaggtcaattttgcccttcatttaaaaacataaaaaactttatccctctttcggaagcattctgtcttctctcttccgcgaaaaagcttttctcctctcttctctcttccgcgaaaaagcattctgtcttcttctcttcttctccgcgaggcttctccggcttcatcttctccgcgaggcttgtcttccatttgcatttcgaggtaggtgggctttcttcttag

SEQ ID NO: 86294 - DNA, 201 bp, Glycine max
  Peptide Sequence Number=SeqID_177979
atggatctcattgaaaatatggctgcaagcgacattgctattttgagagatagagctcacattcccaccaaaaagagtttattggagttaacctcccaagatgcattgttggcagaaaacaaattgttgtctaagcaactagaaaccttgaccgaaacactaagatgtaccttagatggaggagctcatgaatctggatga

SEQ ID NO: 86295 - DNA, 600 bp, Glycine max
  Peptide Sequence Number=SeqID_177980
atgggttatcttcaatttggcagacatggtgttaggcaggtccttagatttagagatgctagttgtgataatgttgtggacatagataagctgggaaaggcaggtgacactgtcaaagttgcccctggatattttcgcaaccacctaatgcccaagctccttgctttccctaacattgataagtttgcttatctcctcaatgagcagcgcaagatctatcaaccaactgaagaagaaaaacaagaagatgtcactctagttaaagagtccaaggaagatatgatgaaagagtatgaaaaggcagcattacgtcttgataaagctcagctggttttgcggaggttaattaatgttcaaaaagccaagtcacgtgaatcaaaagaagaccccttggagttacgttatcctgtgacaaaagatactcttgtggctgaggtggcaagacaactttgtgtgaacgttgcacctgataacctgcatcttccatcacctctatccacattaggagaatatgaggtgccactgcgtataccaaggtccatcccgttgccagagggcaaggttaactggagtttgaaagttaaagtcaggagtaaataa

SEQ ID NO: 86296 - DNA, 204 bp, Glycine max
  Peptide Sequence Number=SeqID_177981
atgacattccacagggaacaaggaaaacaaaaatattctgtagttcgatcaagacttcttaaggtgaatacgatgcattatttgatgcaatcctatcccgcaagggcattggatagaagactccaagtagattgggtcagagatgcaagagaaggccctagggttctcatgagtcttagggtagattttgggcctatgggctaa

SEQ ID NO: 86297 - DNA, 237 bp, Glycine max
  Peptide Sequence Number=SeqID_177982
atgaaaaagggggagattgtggaagcaatgtcttccaagagggtacatctacttggggattgttatactgagaacaagaaagggtacatctcttgtggatcaattcaagtggagggtacatccacttgggttttcaaagagaacaagggagggtacatcccttgtggatctttggcttgtaagggattttacaaggttgaaagaaatctcaagaaccgcaggttgctaggggactag

SEQ ID NO: 86298 - DNA, 560 bp, Glycine max
  Peptide Sequence Number=SeqID_177983
ttacagtttgtaccatctgtggtgaggctcatgaaacaggccaatgtattcccattgaagaacacactcaagaagttcactatatgggaaatcaacagagacaaggatatactcaaggaggattttcaggcttccagcagggtccttttaatgaacaaggataatggagatcacaccctgccaatccaacaagggcctaacatctttcagaggactactaagctggaggagactttgactcagtttatgcaggtaacaatgtcaaatcataaaagcactgagtcagcactgaaaaaccttgaggtccaggcgaaggataaggataatgtagagtccaagaagaaagttgctgaaaagaaaagtactgatgaaaagaaagatgatgctagagagaagaaaagagaaaaagctatgaatgaaggtgcggaagtaccatatcctgtggtaccttccaggaaggagaaggaccgtcatttggcaagattcttagatattttccagaaactggaaataaccatgcccttcagagaagctttacagcagatgccactctactccaa

SEQ ID NO: 86299 - DNA, 226 bp, Glycine max
  Peptide Sequence Number=SeqID_177984
atgtcattccctattgctgttcatgtgtcctccaccttcgagtctggagccccgcgaatgtcattgcctagcgctgttcatgcatcctccacccaaaccccatcaatgtcattgcctagcgttgttcatgtgtcctccaccttcgagtctggagccccgcgaatgtcattgcctagcgctgttcgccaattctccattctccactttttttcggagccccatgaag

SEQ ID NO: 86300 - DNA, 672 bp, Glycine max
  Peptide Sequence Number=SeqID_177985
atggaattactctttttaagagctgaacttagggtggaggaaagaacaagcatagctaggttccttagtgggcttaatatggaagtgagaggcaaggttaaactccttccatatagggagctagatgagctagtccaattttgtataagaggtgagcaacaacttaaaagaaagccttcttcaaaatcttatgaatttcactcttatcgaaggaaggaccaagcccaaggaattttgggggccgcaccttcaaaacccaaagaagataaggaggtcacattgcctcttattgcccccacaaagaaaaccatgattatgaggggtcaagacatttatagtagtcaagaggagactacttcttgcccttcctttagtggaagtgaagatgaagtaaggggtgaagagtctagtgaggaagcctacccccatgaagaaggtgacctcttaatggttagaaggctccttggaggtggccaaagatcactaactatgaaagataagagggatcaagaagaaaaactagaaaaccaaaagaaaaggaaggatagtaaggccttgtcttcaaaggccaagggaaaggaaaaagaggaaaaggattcctctaagaagattgtaaagaaggaaaatcattttgcaacaaaatgtgatataaaaaaaagcactccttcttaa

SEQ ID NO: 86301 - DNA, 255 bp, Glycine max
  Peptide Sequence Number=SeqID_177986
atgaaagtaaaattcgaagtcacaggtattagggatgccgtcaccatcgatgtgtgttcgtccgacaaagtcatagacctcaaagaaaaagttcgatattgtacgcttattcctataaataagaaaaaactaatcttcaatggccaagttttggaagacatctacgatgttggaaatatcctaatctttgagggtgaaagcatcaaggtccatgcaggtcctcaaatgtgcattcagtcccagattctcaaatag

SEQ ID NO: 86302 - DNA, 124 bp, Glycine max
  Peptide Sequence Number=SeqID_177987
gtgcagaaaagttgtgttctatgccatattcatcacaaaacatttcaaaatcgttatgtcataccctaatttcgtccggggacctttgcttgatgacatgcgacttttgtttggtccttgtaag

SEQ ID NO: 86303 - DNA, 183 bp, Glycine max
  Peptide Sequence Number=SeqID_177988
gggcaactgtcataccctaatttcgtccggggacctttgctcgatgacgtgcgaccattctttggtcctcgtgagaaggctgttgcttctggagggaagcaacccctgctcgccctggggcgagctgagctcgcctgggtagctggggcggcaagcatcctcccctattttgctataaaatag

SEQ ID NO: 86304 - DNA, 204 bp, Glycine max
  Peptide Sequence Number=SeqID_177989
atgcctgaggagagtgaagaggtgcaagctttgaaagctgagctcgaaaagacaagagtggcgaaggagaagttgaaggtggcagtcactagggttaggaaagaatgttatgagctgaaagatatcaacatgatcgcggatgaagcactagagcaggaaatgaagaaggtcagaaaagaagagtggagcagaaaaaagttctga

SEQ ID NO: 86305 - DNA, 210 bp, Glycine max
  Peptide Sequence Number=SeqID_177990
atgggggtgcaaatagcaaccgggcccacttgggccttccagaaaattcctccagaaggcggttgcttctggaggaagcaacctaggtcacctgggcgagctggaaaatccaagccgagacgctttcgtaacgtttccgtgggtgatttcgcgaaggttttcaaccgttctttgatgttcttcattcgttcttcggtcttcaaccggtaa

SEQ ID NO: 86306 - DNA, 330 bp, Glycine max
  Peptide Sequence Number=SeqID_177991
atgctgaaggtcgcggttccaccatatactattttaaacaccgttaacgccaaggatcagatttatggtgaagttagtatgtcatttgctgtgaggtggaaagacctacttgattgcttttggcttttcattgtcaaggatgaaaattttcataccgttgtctacaaccaagatttggacaaaccagccattgtagcagggtggacaacactaagagatttttatcacctaaccggagatcatcaagggtcgttaacttattatggtagaagtgtattctttctcaccttattcaagagcagtagcctgccaaaatcattcccaagatga

SEQ ID NO: 86307 - DNA, 552 bp, Glycine max
  Peptide Sequence Number=SeqID_177992
atggcctcaaagaagataaaggaacctgccacaccttcccaggtctgggaaaggtacactgaaactattgttcctaggaagctattgccagagaggaatgtggtaatctaccacattgagtttgatgagttcaaagaagaattggagagaagaaaatgggatgaggagttgaccagttttgatgaaggaagcattgatgttgccattgtgaaagaattttatgctaacctctatgatcctaaggataaatcacctaagcaagtgagggtgagaggtcatttggtgaagtttgatgaggacacattgaataccttcctgaagacccctgtgatcattgaggagggggagacattagcagcttattctaggtttgcactcttgaggcctgatcctcaagagttagctgctaacctctgcatcccagggaggggatttgagcttaatgttgatggtcagcctctaaagatcctcaagaagaacatgaccacacttgatggacatgaatctgggctacctcatctctcaccagatttctatcattgcccagcatga

SEQ ID NO: 86308 - DNA, 417 bp, Glycine max
  Peptide Sequence Number=SeqID_177993
atggctgttaagtaccttgaagcggtcaagcaaaggttgcatgccaccaaacaatggtccccggacgaaattaggcgaaacctatcattcagaaagaaaagaaaaggcattagaagcgtcaacaaacttcagtgtcttgaaagcgacaaagttggacaaccacgacacttccctatgccattgcggaagagtgtttatacggataaccacttgggtatctccgcttgccccttaacttcacgggttagtattgaaagaaattgtctgtgcggagaattacttgtgtatctccgcacgtcacctaacttcacgggtcaggataacagaaagtgtggggcggtcgacaaaagcgaggctcttgctcctacgtatcctcaatttgtgacgaggaacacagacctacgtagttctggctaa

SEQ ID NO: 86309 - DNA, 836 bp, Glycine max
  Peptide Sequence Number=SeqID_177994
atgctatcggccagctcctgggatatccgttagtgctagaagagggccaggagtgcgagtatggccagaggaggaaccggtctgatgggttcgatgaggaggccatcgcccagctgctatgtataccggggcaagattttgcccggattgctgcagggaggcgagtgcgaatcatgcgcaccaacatgaccaccctgacccagatatggatgacgttgctcctcagcaacatcttgcccagcgatcataattccgacctccccctgccgaagtgtcagctggtgtacgccatcctgacgcggatgagtgtccatgtggctcagttgatcgctgatgccatctatatttttgcaggtatggcgcctactaggcaccctttggacccagataagtccaacatggccctgggatttcccacactgatcacaggactctgccagtcatttggagtccccgttgcacctaccaaggtaattcggccgcccatcacccgggcttttattgagaagtactgtacccagagacaggctcagggtgatgctccacaggccgcaggcacgcccccaccacctcatcaggctggccaggctgggtcatttgacatggagcagtatttacggcatttgatgagcctcagcatgcagagccagggcttcgcttctttttcatgccctactccagaccagttcagggcagaggttgcatggcccggagattggcccgaggcccaagcaggagaggcacccccagaagctcccggcgatggagaagaggcccacgaggacgaggagatggccgatttgcttgacttcttgggagggagtggagatacatga

SEQ ID NO: 86310 - DNA, 243 bp, Glycine max
  Peptide Sequence Number=SeqID_177995
atggcaattttgatcgccaatacttcaacaacatttcatagggatgaaaaactcgggaatacgcatgctatgcatggaaaatgtcgacaaaagcgaggggctcttgctcctacgtaccctccatcgaagaggaaatcagacctacgtaattctttcttaagggtgaatcaagtgattctttttacttggaaggtggtcattttaaggcgttggaccttaaaaatgatcctttttacttggtaa

SEQ ID NO: 86311 - DNA, 258 bp, Glycine max
  Peptide Sequence Number=SeqID_177996
atggtgcagcccaaaccaagtactggcctaaaggggaaatctctccaacatgctctcactttcatacctcctcacattcaaaaatcaaaggcttgggtccctattcctaagtcatgtgcaaacaccattgaggcatttcaccgagcacttggtgggcgcacttttgggtaccaacaacaaggggataagggaaatgtggcttgccccagcatttcaaaacacaacctaggcctaaggccatcccctacaaccccctaa

SEQ ID NO: 86312 - DNA, 312 bp, Glycine max
  Peptide Sequence Number=SeqID_177997
atggggcttattcagagagattgtccatatcccaagaagaagcaaaatggtgggggcctgaatgaccaaactggacatccgaaggccacgggaaaagtctttacccataacggtgtcgaagcttcgaaatccaaagatctaattgaattgagtaaggatatgatgtttatctctgccaaccaagttgtgacatctttaaaagaagatgctcaagtgtacatgatcatgtctaacctagagacaaagatttccatgtgtgacctccctgttgtcagagagtttcctgaagtgttccctgaggatatgatgtga

SEQ ID NO: 86313 - DNA, 544 bp, Glycine max
  Peptide Sequence Number=SeqID_177998
atggaggataagcttcatcgtcgagagggaaacagcccggatcaccagctaaggcccctaaatgaccgctcagtgataaaggagccacctgaaagagtgcgtaatagctcactgatcgagcgctctgcgccgaagatgaacggggctaagcgatctgccgaagctgtgggatgtaaaaaagaatcggtaggggagcgttccgccttagagggaaggacccgcgcgagcagtgctggacgaagcggaagcgagaatgtcggcttgagtaacgcaaacgttggtgagaatccaatgcctcgaaaacccaagggttcctccgcaaggttcgtccacggaggggtaataaggggtagagaaaatgcctcgagccaaagttcgagtaccaggcgctacagcgctgaagtaatccatgccatactcccaggaaaagctcgaacgaccttcaacaaatgggtacctgtacccgaaaccgacacaggtctccgcaaagtcgtaagaccatgtatgggggctgacgcctgcccagtgccggaaggtcaaggaa

SEQ ID NO: 86314 - DNA, 537 bp, Glycine max
  Peptide Sequence Number=SeqID_177999
atgagtagagggcgcgcgtcgctgcaaacccagggcgcgagccgggcgagcgtcgtcggtgcagatcttggtggtagtagcaaatattcaaatgagaactttgaaggccgaagaggggaaagcctgcccaccctggaaacggctcagccggaggtagggtccagcggctggaagagcaccgcacgtcgcgtggtgtccggtgcgcccccggcggcccttgaaaatccggaggaccgagtgcctcccacgcccggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactggtacggacaaggggaatccgactgtttaattaaaacaaagcattgcgatggtccctgcggatgttga

SEQ ID NO: 86315 - DNA, 1275 bp, Glycine max
  Peptide Sequence Number=SeqID_178000
atggcttctaggaaacacaagagtattgatgcttggaaccggtacacagataatgtcctggggagaaacatattgcctgagaggaaggtggagctctaccacaccgagctagatgattttaaaactgaattggagaggcgtaatttccataaacgcctcaccaatttggttgataggagcatagacttggctttggtgaaagagttatatgcaaacttatacagctctgaggacccttcaccaaagcaagccagagtcaaaggccatttagtgaagattgatgctgatagtctcaacacattcctagagatacctatggtgttggcagagggtgagactttacccacatactctagatactcaaggctgcccacagattacaaggagattgaggctgccttatgcatatcgggccaaggtttcattttaaacgctgagggccattctgggaggattctcaggaaagatttgaatactttaacccaggtgtggagtgttctctcatactccaacttggcccccacatcacatacctctgatctgacagtggacagagctaggctgatctttggcctagtctctcgcatggacatgaacataagagctcttatttctggtcaaatgacttctatagcacagtctaacacttctagacttgggtttcctgctctgatcatcgccctatgtagagccagaggggttgtctctaacatgcttacttttgagtgcctgagcccgattattaacttggcctatatcaggaagaactattggaatcctgaggatctaacagtttatatccgaggggctaggagggcgaggccagttgagctcccttccacatctacaactcctactccagcatccacttcagtagccccttcagtcctagctcagattttggagagggtagcctggcctgggacccaaccttctcttcacagggaagatgaaggtcccaaagctcaggtaccacaacatgtggaggatgagtcatttgaggccaccattccagagccattcacgatagaggaggaggcaggtgaggcacaagatagacaggaagctactgctactcctgagaggtctagagaggtcacatcagatccacccacaccaatggtggacctatcctcgcctcagcatgcagcagatccctccattcctatcctagagataccagaggacccggctacaccagtcttgactctgaacacttctcctccagctactccagtactccatctaacagatgaggaggatgttcagacatag

SEQ ID NO: 86316 - DNA, 591 bp, Glycine max
  Peptide Sequence Number=SeqID_178001
atggagttagagcaactcgatgtcaaaactttctttctccatggaagattggagaataacattttgatgcaacaacttgagggttttgagaaggaaatgagccaaaaacatgaaaatgggggtgtatctagcattgggcccatctgggcccatctagaagattatgggcattttgttgcttcaggtggaagtaacccagggaaacttcatcaagaagcaaccagctcggcgagctgggcggggctcagcaccctgggtatccagaattcacttaaaattagtgagaaaaagaagaaggagaaaatcaaagccgaggagctttcgtatcgctttcgtgacgtttcggtgatcaatttcgtggacgttcttcaccgttcttcgttcattcttcatccttcgtcgatcttcaaccagttagcttttgattttgaagccttgaattcattctatgcaccctttgggttccattcttgctttgtatgtcttcatctttattcttctactctcgtgcaattgaggatacttaggagcaaaagccccacttttgtcgaccccaaaatgggagagattgttaaaggtccaacaccttaa

SEQ ID NO: 86317 - DNA, 267 bp, Glycine max
  Peptide Sequence Number=SeqID_178002
atgaggaggatgatgtatgtcgcaccctaccctacgaagggagggcaaggtgaaatggataagccaaagcgttcgtctccaagggagaaaacgagtggagttgccaccatcgtttattctaggaaaacgttagaaaaaccaaaaagagatctgcaaattttgaaaataagggttcgggagttgtttacgcatgaggaagggtcgacaagggggctgcccttgctcctacgtatcctcaggtgcgatgaggaattcagacctacgtag

SEQ ID NO: 86318 - DNA, 390 bp, Glycine max
  Peptide Sequence Number=SeqID_178003
atgtcttcaatcatttatgctttcaaaaggcgacaatgccttcatttacatttcgaagacaacaatgtctttggtcatttatgctttcaaaaggcgacaatgccttcatttacatttcaaatgacgacaatgtcttcaaccatttacgctttcaaagacgacaatgttgaaaagaatgcggaaaatactcaaaaaggagggcaaaagggtcattttcacactttttcagacctttggctcacccaggctagcctctggctcacctgggccaccaaaataacttcatggggaagcgtgattgggctgaaggaaagaggttacaaggtccagaggtccagaattgagaagaaggaagagaaaagaagaagaaagaagataaaaagaagctaa

SEQ ID NO: 86319 - DNA, 252 bp, Glycine max
  Peptide Sequence Number=SeqID_178004
atggctccaaaaaagcttctctctaagagggcaagaaaggacgctgcgggagaaggatccagtgtggctccacaagcagacatagaatttgacggacaccgtttccgaagtgaggaacatcaacagtgctttgaagcgatcaagggttggtctttcctcaaagagagacgggtccaactgagagagggggaatacacaaagttccatgaggaagttgctgtagaagcaagcttcatgatgaatcaagattga

SEQ ID NO: 86320 - DNA, 825 bp, Glycine max
  Peptide Sequence Number=SeqID_178005
atggcaaagtatgactcagaagtagtcatggaattctatgcaaatgcatggcccaccgaggaaggagtcagggataagtgctcctgggtgtggggccaatgggtcccctatgatgaagatgccatcaaccaattcttggggcatccgttggtcctagaggaggagcaggattgtgagttcagtgaaaggagggtccaggcttcaggatttgatcaggaggccatagggcccatggcaaagtatgacccagaagtagtcatggaattctatgcaaatgcatggcccaccgaggaaggagtcagggataagtgctcctgggtgtggggccaatgggtcccctatgatgaagatgccatcaaccaattcttggggcatccgttggtcctagaggaggagcaggattgcgagttcagaggccataggccagctgctgtgcatttcgggataggactttgcaagaagcatgacaggaaggcggatctagatgacgctgctcctcagcaacatccttccagcgatcataattctgatcttcccctgccaaaatggatcacacctccaagacacccagtggacccagaaaagtccaacaaagcactgggatttccgcccttgatcacaggtctctgccaattctatggggtgtcggttacgcccacaaagcccatccggcctcccattaacaggtccttcattgaaaagtactgcatgccaaggcaggcacaacagccggggcaggaccagcagcagcagctagccgcagatgcaccactgccacctctacaacagccactatctctagagtccatctcttctcacatttag

SEQ ID NO: 86321 - DNA, 279 bp, Glycine max
  Peptide Sequence Number=SeqID_178006
atgccaatgattgcaaggaataaaagtgtggaggttatatgtttgtgcaaaatttcgattgactcgcttagcgcgagtgactcgctaagcgagcattcagtgacgtttgaatttttcaggattcaaacttgtgcgcttagcgggacagacttgcttagcccaattcagaaattagaaaacccgagaaggttttgggctcagcgcacaggtgcgcgcttagcgagttatgcagctctgattggtctgcaagttctgctaagtgggacatggttggcttag

SEQ ID NO: 86322 - DNA, 429 bp, Glycine max
  Peptide Sequence Number=SeqID_178007
atggcctccagaaagaaatcatccacatcccgacctcaagaaccctatgatacgactagatttgtttccgacgtctcttgggagaggtacgagcaaaatgtacattccaagaatatcctccccaagaggaatgtggatttgtacgtgacacagtatgacgagttccggaaggagcttgagaggaggagatggcataaagccttgaccaggcagtctaatggtcacattgatgtggcactagtccaggaattttatgcaaacttatttgatcttgaagacaagtaccccaggcaagtcagagtgtggggcaagcttataaagttcgatgctgagacgcttaacacattcatggagaccccgatggttttggagccaggggagcggtactccacatattccaggttctgccatgctcatccagacccatag

SEQ ID NO: 86323 - DNA, 1263 bp, Glycine max
  Peptide Sequence Number=SeqID_178008
atgcgcgatccgctgccgtgctacccggtggtggccgcgcacggctgcacgctgcagctggccgatggacgtgagctggtcgacggcatgtcttcgtggtgggcagcgatccacggctataaccatccgcgcctcaatcaggcgttgcagcagcagatggcgcagatgtcacacgtgatgttcggcggcatcacccatccgccagccgtggagctgagccgccagctgatcgccatgacgcccgaggcgctggagtgcgtgttcctcgccgattctggctcgatcgccgtcgaagtgtcgatgaaaatggcgctgcagtactggctgggacgcggagagacgcggcagaaattcctcacgctgcagcgcggctatcacggcgatacgtttgccgccatgtcggtctgcgatccggaaaactccatgcacagcctgtggcgcggctacctgcccgagcatctgttcgcccgcgcaccgcagtgtggctttgacgatgactgggatgacaacgatattgccgatttcgcccggctggccgaacagcaccatcgcagcattgccgcggtaattctggaacctatcgtgcagggggccggcggcatgcgcttttaccatccacgctatctgcaacaggtgcgggcgctgtgcgatcgctacggtttattgctgatcgccgatgagatcgccacctgcttcggccgcagcggcaagctgtttgcctgcgagcacgccggcatcacgccggacatcttgtgcctcggcaaggcgctgaccggcggcaccctgacgctctccgccaccctgaccacgcgcgacgtcgccgatgccattagccgcagcgcggcaggctgctttatgcatggtccgacctttatgggcaatccgctggcctgtgcggtggcggttgaaagcctgaagctgatcaacgaagggcactggccggtgcaggtggcggcgattgagcagcagctgcgaacggaactgctgccgctgcgcgaccatccgatggtggcggatgcgcgcgtgctgggggcgattggcgtgattgagacccatcagccggtgaacatggcggcgctgcagcagttcttcgtggaacgcggcgtatggattcgcccgttcgctgacgcagctgacggcggcgttgagcgctgcactggcggtggacggccactttcagccctgacaccgctggcactcgccgccattttccaccatcatggcaagcagtacacaacagaaaaggagagatcatgcgcgtag

SEQ ID NO: 86324 - DNA, 987 bp, Glycine max
  Peptide Sequence Number=SeqID_178009
agtttcctctggcttcgccccgctcaggcatagttcaccatctttcgggtcccgacaggtatgctctcactcgaacccttcacagaagatcagggtcggtcggcggtgcaacccacagggggatcccaccaatcagcttccttgcgccttacgggtttactcgcccgttgactcgcacacatgtcagactccttggtccgtgtttcaagacgggccgaatggggagcccacaggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactctttgactctcttttcaaagtccttttcatctttccctcgcggtacttgttcgctatcggtctctcgccagtatttagccttggacggaattaccgcccgattggggctgcattcccaaacaacccgactcgccgacagcgcctcgtggggacttgggcccggtccgccactgaggacgcttctccagactacaattcggacgccgagggcgaccgattttcatggtgggcttttcccggttcgctcgccgttactaagggaatccttcgggtagccccgcctgacctgaggtctcgttgggagcgtgcgtgcacgcaaagggtcgtcgatgggtccagaactgaccggctcgcacgtgattggtctcgagcgtggctcatccaccattttatcacggcgaagtcggccatgaacccagatttcaaccaaccacgaggcgggcgtgccctcggcctaatggcttcgggcgcaacttgcgttcaaagactcgatggttcacgggattctgcaattcacaccaa

SEQ ID NO: 86325 - DNA, 293 bp, Glycine max
  Peptide Sequence Number=SeqID_178010
atggaggacgcacccgtgagccctcgcgtcgaaggactcgtttgtcccctacaaggtcatcgcatgtgtgccaagaaattgaaggaaaattgggaagaactcttggtaggtatggtaggggcgtccgttaattggttcccccgatggaaggaaggaggggctggagttttgtgctcatatgaagggttcccaaacgtccccttgatgggaacaatgagttgtattaactataatcccatactggccatcagacaactaggctaccctatgagaggggcacccatcggaagagg

SEQ ID NO: 86326 - DNA, 689 bp, Glycine max
  Peptide Sequence Number=SeqID_178011
cgccgcctcgtgttcctggtgctcgccctggtggtttaccgtttgggtacacacatccccgttccgggtatcaacccggacgcgctggcggacctgttccgccagaaccagggcgggatcctgggcctgttcaacatgttctcgggcggggcgctctcgcgcttctcgatttttgccctggggatcatgccgtacatttcggcatccatcatcatgcagttgatgtcggtggtggtgccgtcgctggaagcgctcaagaaagagggcgaggccggtcgtcggaagattacccaatacacccgctacggcacggtcgtgctggcgctgatcacggaacgcggtctcggcaacgggatttccatcctgatcttcgcaggtatcgtggcgggtctgcccgcggcgctggctgcactgttggacctggtccgcaccaacgcgatgtccgtgctgtcggcactgttcatcgtggctctggtggtgctggttaccgcttttgtggtgttcgtggaacgcggacagcgcaagatcacggtgaactacgccaagcgtcaggtcggcaacaaggtctacggtggtcagagctcgcacctgccgctgaagctgaacatggccggggtgattccgccgatcttcgcgtcgtcgatcatcctgttcccggcaacgatcacgagctggttctccagcagtga

SEQ ID NO: 86327 - DNA, 171 bp, Glycine max
  Peptide Sequence Number=SeqID_178012
atgtggaccaccacgggaacccttgcggattacataatcatccccttcttgacttacggaatgttacggaacctcacgaattgtgcaacgatgcttccttttaagtttcggtatgtcacggaacttcgcaaattgcctgacgatgggtgccaagtacctccaaatggttaa

SEQ ID NO: 86328 - DNA, 537 bp, Glycine max
  Peptide Sequence Number=SeqID_178013
atggtgctggggcatttcatgtgtctcccccacggtttaagagacatgtacatgatgaggttgttggctctcaatgagtatgggagcggagttattgacatcctcattaggaatgcatgccacattgggtggtgtatagttgggaggcaagccatatggcgggaaggcatgctcattttgaattgtcacatcatggggccatccatcagatgggggcatcgggttcaccttagcaatagcgctggtagcggcaacttcaaccatattgacttccataatcttcttcatgctcatcatggcctccccattgtcggctctcaatttcatgggtccagcggagcttcatttttgacatcctctattcacattactctagctctagcactgggtgttggagtaagccgcactaagcgctccatttatctcctttatgctcataatggggccatccaatcattgtggtcattttctctttcaaggcctccgtgtcggccttcatttgctcttgcgcctcctctacttcacccattactctag

SEQ ID NO: 86329 - DNA, 163 bp, Glycine max
  Peptide Sequence Number=SeqID_178014
atggcgaaaaatcttcatggaattacccacagaaatgtttcggacgcgttacagaagcgcctcggaaaatgggggaggagcttgccgcccagctcgcccaggcgagctaggttgcttcctctagaagcaaccgccttctggaggaacatcctggaaggcccaa

SEQ ID NO: 86330 - DNA, 591 bp, Glycine max
  Peptide Sequence Number=SeqID_178015
atgaataggtggatgactatgaagaacctcatgctagaagacacgggaacaccacgctctgataggatgggtagagggtgtcacatgatccgcactcttctctttgcagcggcacaggtgaaatcttgccccggaatgcatagtagctgcgtgatagcctccctctcttatgtgctcgcacagttggggcataggaccttaaattctcttaaggtgtggctatggagcccactgaaagtgaggacacgtagctctctaaagttggtgacatgtcaccctttgaaggcgagggcgtctagcccactaaaggagggggtgtgcagccctctgaaggcgaggacgtgcaaccctctaaaggtgaggacgtgtagtcctctgaaggtgagggcgtgtagccctctaaaggcgaggacatgtagtcctctaaaggtgaggacgtgtagtcctcagaaggtgatggtgtgtagccctctgaaggtgaggacgtgtagtcctttgaaagtgaggacatgtagtcctctgaaggtgagggcgtgtacccaagggtccacccttatgcgaaagcaagagattgactcatcgagagggccg

SEQ ID NO: 86331 - DNA, 525 bp, Glycine max
  Peptide Sequence Number=SeqID_178016
ggacttgcactgcctccgaagcctaaggttggtccctcaggtgctcgtgtcagcacaaaggagagttgtgttgatccctcagggaacgatccacagacaggtgactcagacaagtgcgggctatacattgaagaaaatccttcccgcctggttgccctaggaagactttatgagggatccacaacggttcacaacatccctttgttgcatggccaagtgaaggttggtgttaaggaggttaaagattcaaaggctcccattcctgtacccactgccgaggcagctgtgtcttcagcaaaacctccagaaaggccggatcctgaggtcgatgatccgttgtatttgatgacattgaccatcccacagctatttttgaagcctcttcgggttatgtgggatgctactgtgtttggggtgtttaatcaaaacttcctattgcatatgactgagacaagtatgcaagcggggaattccgatgtgtatggattcctcgagccagagtccattcagagagctgggcaataa

SEQ ID NO: 86332 - DNA, 162 bp, Glycine max
  Peptide Sequence Number=SeqID_178017
atggggaaaacggcttactatggcttaaaggaattacattgtggtgaagttcttttttctgttcctgttgttcaaagtctaatgctctcctggatatgggatttcgctggttgtggaaattacgtctggttgcttcatctctgcagacactgtttttctcaa

SEQ ID NO: 86333 - DNA, 672 bp, Glycine max
  Peptide Sequence Number=SeqID_178018
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgatggagtttcgctcttgttgcccaggctggagtgcaatggcgcgagcttggctcactgcaacctccacctcccagacggggtttctccacgttgaggctggtctcgaactcctgacctcaggtgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 86334 - DNA, 887 bp, Glycine max
  Peptide Sequence Number=SeqID_178019
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccaggcgaattggagctccaccgcggtggcggccgctctagaactagtggatcccccgggctgcaggaattcgatataagagaacaactgtgtggccttgggcatgtgtatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 86335 - DNA, 606 bp, Glycine max
  Peptide Sequence Number=SeqID_178020
atgtgctgcatcccgccttgctggcctgccttcttggaggcgaggcacagggagacgcgacatgaggcatgccaccggcaggggcgcccgcctggcggggctggacctggcgcgctacctggcgctggcaggcatggtgttcgtcaacttcaagcaggccatgcatcccgcgctgcaggagccgggctggctgctgtcgttcttccatttcctggagggcaaggcctcggccaccttcgtggtgctggcaggcctgggcctggtgctggccacgcgctcgctggagccggccacggcgcgcctctggacgctgcgccgcgcgctgttcctgctggtggccggtggcatgaacctggtgatctttccggccgacatcattcactactacgcggtctacttcgtgctggccatcgcctggctgcaggccggcgcaagggcgctgctggccggcatggcggccgtggccatgctgtccgcctgggccttgctgcagctggactacagccagggctgggactgggccagcctgtcctaccagggcctgtgggagccggccggctttgcgcgcaacctgctgttcaacggcttccatccggtgctgccgtg

SEQ ID NO: 86336 - DNA, 229 bp, Glycine max
  Peptide Sequence Number=SeqID_178021
atgggtgtactgtatgaagtgactggatgggcagatatgtcttgcccgtcaaatctatggcccccttccactgcactgcttgcaaccttgtcaccggttaatttcgagcttggcgtaatcatggtcatagctgtttcctcgctagcggagtgtatactggcttactatgttggcactgatgagggtgtcagtgaagtgcttcatgtggcaggagaaaaaggctgcaccg

SEQ ID NO: 86337 - DNA, 1961 bp, Glycine max
  Peptide Sequence Number=SeqID_178022
tcgaagccaccgccttcggtggcggcatcgtcattgcccaggtcaacgaaatcgtcgacaccctcccccgcgtcgacattcccgctgactgggtcaacttcgtggtgcaggcaccgaagccgaaccatatcgaaccgctgttcacccgagacccggcgcagatctccgagatccaggtgttgatggcgatgatggccatcaagggcatctacgccgagtacggcgtcaaccgcctcaaccatggcatcggcttcgatacggcggccatcgaactgctgctccccacctacgccgaatcgctcggcctgaaggaaaagatctgccagcactgggcactgaacccgcatccggcgctgattccggccattgaatcgggcttcgtgaagtcggtgcactcattcggttcggaactgggcatggagaaatacatcgcggcgcgaggcgatgtgttcttcaccggcgccgatggctcgatgcgttccaaccgcgcgttctcgcagaccgccggcctgtatgcctgcgacatgttcatcggttccacattgcaggtcgacctgcagggcaacagctccaccgccacccgcgaccgcatcgccggcttcggcggtgcgccgaacatgggctcggatgcacgcggccgccgccacgccagcgacgcctggatcaaggccggccaacaggccgctcgccctggtgaaataccacgcggccgcaagctggtcgtgcagatggtggagaccttccgcgagcacatggcaccggccttcgtcgatcgcctcgatgcctgggacctggccgagcgcgcacagatgccgctgccgccagtgatgatctacggcgatgacgtcagccatgtgctgaccgaggaaggcatcgccaacctgctgctgtgccgcacgccggaggaacgcgaacaggcgatccgcggcgtggccggctacaccgccgtcggcctcggccgcgaccgcgcgatggtggaaaacctgcgcgaccgcggcgtgatccgccgtcccgatgacctgggcatctctgtgcgcgatgccagccgtgacctgctggcggcgcgttcggtgaaggacctggtgcgctggtccggcggactgtacgacccgcccaagcgcttccgcaactggacacactgcggtgcagtttccgcgcgatgcggtgctggtcggcgtactggcctcgggcaacctggaaatcctgctggagccggcggcgcaggacggcgcgatgacggtgcgcatcatcaccgccgcacagggcttcggcaacgtgtggcaagcggtgatcagcgacttcgcagagcgtcatccgctgcgcgatcctgcgactggaccaggccgtggaaaccctgctcagtggagatgcacgatgaaccggacgcagcgccacagttactacgaagccgatgcgcgcgagcgcatcgccgggttgatcgacgcgggttcgttcagcgaattcctcggcccggcgcggcggatgatgagcccccacctggcgcagctcgatcagcctgcggcctcgacgatggcatcgtcgtcggcgaagccacgctgcagggaagacgcgtgctgctggccgcacagcagggtgaattcatgggcggcggcgtgggcgaggtgcatggcgccaagttgaccgggctgctgcgccgtgcggcggcaacccgccctgacggtgtgctgctcctgctcgacaccggcggcgtgcgcctgcacgaagccaatgcagggctcatcgccatttccgagatcatgcgcgccaccctggccgcgcgtgcagcgggcgtgccggtgatcgcgctgatcggcagcggtaacggcgccttcggcggcatgggcatcgtggcccgctgctgcagcacggtcatcatgtccgaagaaggacgcctgtcgctgtccgggccggaagtgatcgagaccgtgcgtggcgtggaagagttcgaggggatcctctag

SEQ ID NO: 86338 - DNA, 494 bp, Glycine max
  Peptide Sequence Number=SeqID_178023
cattattcgaggttgcactagaacgatcagcaccaatctgtgcttcttcctcgtctaccagtgtagtttacaaaagcaaaggtgaaaggaaagatattgagctggtagaggaggaacatgcacggattggtgctgatccttctagtgagacctccaataaatctgagaattataaggacgaagcacggaagaaatcacagaagcataaaccaaagagggtggagagtgtcaacactgatgcagaagcctttgctgaagcagtagaacatacgaacaaaagagatacaggccatcaaaatgtggcattggacaataagacaggagattcaactatgctgaagatgggagattcagctaaagttgtgatcaaacaagacatgaagggaagaaggcataaatatgggtttaacaacaatgaacgtgagaaggcacagaagaaaagggtggtggatgatgaaactgccgacaaccatcagctggatgaagtcctatga

SEQ ID NO: 86339 - DNA, 723 bp, Glycine max
  Peptide Sequence Number=SeqID_178024
atgtccataacagagaaagtgacgaggcaggtcatggcatccttcatccagcttcagtcacagatgcaatctcagggacttgcagtgcctcttgagcctctggttgatccctcaggtcctcgagtgagcacaaaggggagttgtgttgatccctcaggaaacgatcctcagacgggtgactctgacaggtgcggcctgtacatagaaatagatcatgtccgcctggttgccatggggagagtttatgagggatccactattgttcataacactcctttgttgcctggccaagtaaaggtgagtgtggaggaggttacagatgcagatgctctagttcctgtacccactgatgaggtttccttagtggggcaggcatttcacaccttccttgcttggccgacacatctggtgaagtctctatcacagcagatacttattttccttactatatatacccattttaggttccactgtagcagacactggcagatggtggtcatcctgcccaaggaacacctagttgtctggttttgttcattgtataataggccagacaactaccttaaggggattattaatagtgctatcaagggtcttgatgatgctccacagcctaaatcaaaggcttctgccagacaaaaaggaagtactgagtgcggctactatgtgatgcactggatgtccaccatcattttaggaacttttagaaataattgggaagcg

SEQ ID NO: 86340 - DNA, 808 bp, Glycine max
  Peptide Sequence Number=SeqID_178025
atgacgacagcttcgcaatcagacatcttcagccctctcatcggttcgaatgggcactataccctgaaggcggattggctagaaggcgagtttatcgccagaaggaaaaccggggccgcagccccggtcggagcgttacagcatgatgctgccgagcaggaagccgaatatcacggcgaaaatcacgcccatggtgccgggaatgaagaacggatggttgaacacgaagcggccgatacgcgtggtgccggtatcgtccatctgcaccgcggcgaccagcgtcgggtaggtcggcaggatgaacaggccggagacggcggcgaaggaggcgacggcggtcagcggcgacacgttcagcgccagcgccatcggcatcagcgccttggcggtagcggcctgcgagtacagcagcgccgagcagaagaagaaaatcaccgccagcagccacgggtgcgcctgaatgacgctgccggccgtctctttgatccagtcgatgttggcctgcacgaaggtatcgcccagccaggcgacgccgaggatacagatacaggcgctcatgccggccttaaaggtgctggagttcagcaccatgtcggtgtcgacgcggcacagcagggtggtcagcgtggcgacgctcagcatgatgatcaggatggcgttggtggtgttcatcagcggcttggccaccaggccaagacccgggctgttgatgatggcgtaagccactacgcacagcacgcccagcaggaacagcagcaccgaggttttggggcgcggtttgatctccagcgcgttgttgccgcgcagg

SEQ ID NO: 86341 - DNA, 267 bp, Glycine max
  Peptide Sequence Number=SeqID_178026
atggcaggagctggtgatggtggtggtgattatcatcaattggacggatctcaacacttattactaggagctggtgatggtggtggtgattatcatcaaatgagcttctctctgggttccttattgaaccaatctcaaacttatcaaggtaatccttgtgacgtctatcctgacttatctttcttcactggaagtggcgtcatccaaatctctgtagcctgtattaagcgatccgctcctagtcaggatcacatcaccatactttag

SEQ ID NO: 86342 - DNA, 270 bp, Glycine max
  Peptide Sequence Number=SeqID_178027
atggcttgccggaagcgggaggtgaagcctggaacagacccaggaagtgacgacgaagctgccaagaccggaagtggcagcttccgacgctggcacggtggcgcggttgggtcgcgcttctcgaggcgatctgaaccctggtctcgccggagaaaaccgccggagatgacggcggccgtcggcggcggacggcggacggcgcggcggcggacggcggacggcggacggcgcgacggcggacggcggcaacccgctctgatgccaagttga

SEQ ID NO: 86343 - DNA, 294 bp, Glycine max
  Peptide Sequence Number=SeqID_178028
atggcaccagcatcagcgcgtgcatcacaccggtcaagtgcagcttctggaagtgaaggtctcgaggttgttgctcatgttcgtaagctttcaaatgagagtgttggaagtaatggaagctcaatacgaggtagtgacatgtctaattttgggattccaaattcatctggtaatagctctcatgaccttcctggatctgctatgcgaaggctaggcactgcaaaaactgatatggaggaccttatagttagattaaatcaagaaatagctgcaaaggattttcttgcaacaaag

SEQ ID NO: 86344 - DNA, 699 bp, Glycine max
  Peptide Sequence Number=SeqID_178029
atggaaaaagataacggaggcaaatgtgttttcttaaaattgaagttcattgcgacgtccgagacgttgcgaacaccgacaaccactccatcacctgcgacacccctcctcgacttcctcgccacctccttcgacctcctccgtgcttggcgcatttccaatcgaacgttgaatcctccctgcgcgtcaaactcaaaagcctctacaacggcaacaagaacaagatgtttgaaaaggaggttgtgggctttctggttttgggatggtattgtggagtgggtgttgacagaagtggaagtaagcactgtcgttagctccgcgaggatcttctcttccacagtggggtggttcatgatgagccagaagaaccagcttatcgccattgacaacgtgtccctgccagcgaggaggaagtttagtgcgatttgtcgcagtgcagcgacactcagtggttttctggcaccatcacgcttctttatgaaggagagaatggtggcattggagggggagtacaacgcgagggagtggatcgagatgaagccaaattgggagtcgcagggcacgaaggtcagaccaggagagaaattagaggaggatgtgctagcgaagaacgttggcgagggcagctggggagaggtggtcgttgaaggtgtggtaggcgttggggacggcgagaatggagagggaggagcggtctga

SEQ ID NO: 86345 - DNA, 480 bp, Glycine max
  Peptide Sequence Number=SeqID_178030
atggcttctaggaaaagaaaggcaccctctacacctacccaagccagatttgatagatccagattcacttcccaagaggcttgggagagatacactggcgttgtggttccttgtaagcttttaccagagaggaatgtggtggtttactatacagagtttgatgagttcaaggaggaacttgagaggtgccattgggatgaggagttgactgactttgtggacgacaatattaatgttgccattgtgagggtgagaggtcatctaattaagtttaatgaggatacccttaacacatttttgaagacccctgttgtaatggaagaggaggaaacactttgtgcatattccagatttgcactcctgaggcctgatcctcaggagttggttgctaagctttgtatcctagggaggggattcgagcttaattctgatgggcaacctttgaagattctaaggaagaacatgaccatgcttgcttag

SEQ ID NO: 86346 - DNA, 486 bp, Glycine max
  Peptide Sequence Number=SeqID_178031
atgtctggctccagaaagaagcttcttctaaacaccgtgtccgtgaaactaggctgcagcacctgcagaagaccaaacctgtgtcgcatattccacccaaagccaaaacccaagaatcttaacaacacttaccgaaagcacaaacattcttcttcttcttcttcttcaggccaatggggtggtgaggacaagtgtgacagcaccagcaccacccccacccccacccccaccaacaccacattctcaaatcctatcactgcctcctctcaattttcaagaggtaagaaccaagtaaaagcatcatgtaatgtgggcagttggacaacagaaatggatagtcagccatccgattctgctgcagatgttgtagatgttaatgagtctggaagtagcaagttaggtggatccgagcctgagggtgatgttctttgcttgcatgatcgattaaagtggctcgatcagcaggtcatcagaaaggttgtataa

SEQ ID NO: 86347 - DNA, 363 bp, Glycine max
  Peptide Sequence Number=SeqID_178032
atgatttgtgcaagtttggggaggaactattaccaggcgcttgatgtcgtcatcttcaacgcggcgttattcgactttgacggcggctttgatgtctttgcgttcgccgatgaagaggtcccaacgaaaaatctaggagagattgttcatcatgtcgtcgagctcctcgtccttcatgcccaccagcatgctcaccgtgaacccgagctcgcgggatggaacgttggggtcactagcgacggagcgattgcgtattcgaggagaggaggtcgcgagggtgccgcgggtgggaggacggtgcatgggtcccacttgaataggctggcagtgaatgcatctagatcattgagggttggaaagtga

SEQ ID NO: 86348 - DNA, 1866 bp, Glycine max
  Peptide Sequence Number=SeqID_178033
atgggagaggttagcatacaatctcttggaagattatctgtaggccgaaagaggatgagggggaaagtggtcgactatgttaaccagcaaggagggtgggatatagataggatctattattttcttcctccatttgctttatatccttgcttatcctatgcctcatttgttgagagattggaaaaaaggcttcattgggtaaggtgctttatttggatggtgttgcaagatgggttgaagatgaatgttaaaagagaggagtgtgggaggtttagactggggttgttcaatttgtatcactttgatatgatagcgtttttctttgttggtctatttgatcaggtaaaggtgaatcttaccaaggaccctggtgattggagaaccctggtcaatgatatcattaatagagctatcttcactagtatgcaaactgatcaagctatgcaagtctttgtgcataagcatccttctttggagggtaggcttgttgcttggcagcctcccattgaggggtgttttaagtacaacatggatgcatctattattcaaggtggtgagaggggtgcttattgtggggtgcttcataatgcaaatagtcgcacaaaaagactaagggtgagtgtggttgtcatagggccaaccgatgtggaccgagggcacaaaaagactaaggcaagtgtggttgtcactgagccgactgaggtgggccaagggggtacacaaccctctagtcttgagtgcatgagtacaaaaagactaagagcagtgtgggcaaccgaggatttccctaggaacgagacattgggtcttgaaacattgtgtgtgggcggtgaaggtggtgtggtttcaagaaagggcagaaattgggggagagtggtatgggaagggtttgaaatagaggaggaattacttctcaccaccaacggcgatgatgacatggtcatcgtgcttagatttcccttaaccgccttcaagaagtgggtgttgaggaagttgaatgtcgcgctggccatcgatggacaagggatattgacgttgtatacaacgtcatacaagaatcttaaaggtaggtttttcaaagccttatcggtcattgacccagaggatattgaattcaagaaacaattaactttgtttgctacaatgttcaaatattcatgtatcatcgagttggagtatcgatcggtgaatctaagggtgttcatcaaaaagtcgtccaagaaaagtatggcaccttcaagaaaggccgccgcagttactgctactgctgagacaactctagttcaaggcatcttggaagattcgttcacagttgccgtggagaaaccctggtctctagaaaaaagtgcgattctttacgtagttaaggatcgaggtcgagatctgatgaaggcgaaggaggctctcaatgtccaaaagtcgcgtctggcagcggaggtcaaaaggcttaggaagaaagcgatggatgctaaggccaagcacattattttttaccaagctaaggttaatttagaaaaagaaaaacagctgctcactgagaaggagaatgagatcctcggcagcctcgcggtggtgaagaaggagaatgaggggatggaggttaaggtaaatccttggaagtggaatccaaggctactgttgatgagggagaaaaccagtggagtcgccaccaacgtttattcgaggaaaacattagaaaaaccaaaaagaggggtcgacaagggtgttgcccttgctcctatatatcctcaggcaaaaggccaccttggggcagttgcagcacacccaggcgagctgaaacctaaccctgaagcagtgagcttgcccaggcgagctggagctcgcccaagcaagctagtcacttag

SEQ ID NO: 86349 - DNA, 705 bp, Glycine max
  Peptide Sequence Number=SeqID_178034
atgccttctccagaccccataattgaacctttattggttcaagctgaattttcagatgttgcaaagcttggacaagttaaaatcgacaacgctttggtaattgctttggttgaaaggtggagacctgcatcacacacatttcatcttcctgttggagaatgcacaatcaccttgaaagatgttgatctacaactagcgaattctaaaattttccttacacaatttgcaacttatcccaatgttggagcgacatctcgttcaactccaaacatggaaactgaacaacatcctccacaacaaagttcatcaatggctgctagcatgcatgatgaaggactaccaccacatgctcaatcatatgaattcacaccacaattcatgccacaacctcatcatcatcaacaagattataagtacaatctgaagttcttcagtgcaaatggagaagactttatgagcaatctcatgggtacagatcttcgcacactggagtcattagtggaagaacagttggtcataccttcgcttgcatcctttcaccaaagtatgaccaacagttcttccactaatgacttcgtacaagaagaaccagttgttgttcctagtgaacaagtcgaaccacaacaacatggtcgagtacatcgacaatcgacaagaaataggcaaccacccagatgtggatctggtggacccaaacggtattaa

SEQ ID NO: 86350 - DNA, 324 bp, Glycine max
  Peptide Sequence Number=SeqID_178035
atgtcaaaagaagaatcaaacaaagttgcttcaaaggataagcatggcttcaagattaatacaagattgcttcaacaaacaaagccttgcttcaagattaactcaagctcaagccttgccttaaaacaaagtgctttcaagacattcaaggctctgacttatcaaggtaatccttgtggcgtctgcccagacttatcttccttcaccggaagtggcgtctatcctgacttatcttccttcactggaagtggcgtcattcaaaactctacagcctgtatcaagcgatccgctcctactcaggttcacatcagatcttcattgtaa

SEQ ID NO: 86351 - DNA, 162 bp, Glycine max
  Peptide Sequence Number=SeqID_178036
atgtatggtaagagcaggtggcttgggcttgagtcagtcgtgagactgcttcctcaagacgttcgatggttgtttgtttggtattgtggtctggcatggtggctggctgagacaggccagaattggattgtggttgattgtggttctgaagttgtcccctaa

SEQ ID NO: 86352 - DNA, 308 bp, Glycine max
  Peptide Sequence Number=SeqID_178037
atgcaagaactccctctcccaccaaacgcaatacccccgtgtcgtttcatcaatccactccctcttccccaaactcaccctcaaccttctctcttctcaaatccaccttacgcttatccaaatgtgaaaaccggcgaaggaaaagcgattttcactgcggagtgttctcacgtctttcacttcccatgcctagcaggtcacgtgaaaaaacaccgaatggtcacgtgccctgtgtgcaacgctaactggaaacaactgcagcaaaacgcagacgaaaacaaaggaaacgcagaactcaaaacgacgag

SEQ ID NO: 86353 - DNA, 708 bp, Glycine max
  Peptide Sequence Number=SeqID_178038
atgaatagcacaagttttcaaggtttggaaaaccagaatacttcagaaagcttttggtacaaagaagaagaagaagttcaaagagattcaaggcttgtaaaggattctttttgttcatcacatttgtcatcatcttttgttgtcatcattgttatcatcaaaacacctttgaatcacattcaccatgaagccttgcttctacaattggctcttgaaagccgcatcctccattatctaattgtccatatcttactctccagatcttcaaaccttgcttttgaagaagatctaatagtcatgtggacctttcaaacctatcctcacttagttaccttgttccttcaacattttaacatccctcttgattctgagccatatgttccaatcaagagatctttcttgatcgtggctgctgtggttgcctcctttggttaccgcaaagagtgtgatggctcttgggtaaaaaagggtgctcaaccaaatgatgatgaaggacacttactggttgaaggggactcttctctccttcggagtattttggacaggtttgatggacttcaaacctatggttgtgagaggtttgactccttggaacgtcaagaggatacacgattcgaggagatgaactcaaggattgcaaaggttgaagaagatgtcaccattattcacgactgctttgatttacctccaccaccaccatcagtttag

SEQ ID NO: 86354 - DNA, 900 bp, Glycine max
  Peptide Sequence Number=SeqID_178039
atggcagaatcatcaaagaagcgaaaaggatctttcttcaccaccaccactacaggccaccgccgccaaggaacctctggaaacccacccgcaccagttcctccttctctttcatctcttagatcatccacattgttttccttggatgatcagcgtcaaaggtactactctcaattttgtaatagagtcattctagaccctaagtaccttgaccttgaattctttgatgaagaaacatttgattgttaccaagatggtattctttactctgagggcacccttgttgatgactggaaatttgattattctagtcatgatgctcgccgcatagtctgcaatgaccgacatattacttactgggatttgattctagtgtgggcctttcaaactggtcgtcagatagaatgggtccatttagttcggtaccagatgcataaggcattacgggccaatgcacctctgccttatcctcaccttgttactctttttcttcatcatttcaatgttcctttggatgatgaaccatttctcaaggtcaaaaggtctttctctattggtgctggtgcggttacctcctttggttaccgaaaggatgttgatggtcaatgggttcgcaaacatgacttgcctccacctattcctgacgagcgtaccccatctcctccaccacaacagggtgattccacttctcttctaactaaagtcctcacagaactccgtggtcttagagcttttgtgggtgaacgctttaatgcgatggatactcgctttgatgcaatggatactcactttgatgggatagatacaaggatcactcaactcaaagatgataagagcttcattagtactttgattaagcttgccttggatgtttactattctgttttgctttatgtttag

SEQ ID NO: 86355 - DNA, 450 bp, Glycine max
  Peptide Sequence Number=SeqID_178040
atgcacactggccatcaaattctctgggcacatcttgttcattaccgtatggataaggcattacgggccaatgcccctttaccttatccccatctggttactcaacttctgcagcacttcaaggtctgtcttactaatgaaccatttgtcaagattaagcattcagttgcaataggagtcgctgtagttgcttcttttggttataagaaagatcttgatggtcaatgggtttgcaaacaagatcaccaagctaatgctcccgaagaacgcactccatctccaccatctagggatccctcccctactttactaaatgatgttctcaacgagattcgggatcttcgcgcttttgttggcgaaaggtttgattccatggattctcgtatcactcgtcttgaggatgacatgggatttatccgtcgttgctttgatcctccaaccgatccttaa

SEQ ID NO: 86356 - DNA, 673 bp, Glycine max
  Peptide Sequence Number=SeqID_178041
atggagtaccgcaacaaacttgttctcgctcctatggtccgcgttggcactctcccatttagattactagctgctcaatatggtgcagatatcacttactgcgaggaaatcattgaccacaagatgctaaagtgcgagcgccgaattaacgaactcattggatccactgattttgtggagaaggggacaaacaatgttgtgtttagaacctgtgatgaagaaaaagatagggttgtgtttcaaataggaacatcagatgctgtgagggccctaactactgctcagttagtgtgtaatgatgttgctgcagtagatattaacatgggttgcccgaagtcattttctgtgagtggtggaatgggtgctgctctgttgtccaaaccagagcttattcatgatatcttaacaacattaaagaggaatttgaacacaccagtaacatgtaagattcgacttctaaaatcaccacatgataccgtggaattagccagacgaattgagaaaactggtgtttctgctcttgcagtccatggaagaaaagtcccagataggcccagagatcctgctaagtggaatgaaatcgctgatgttgtgtcagcattatctattccagttatagaaaatggtgatgtttttgagaatgatgatgttgaacgcattaaatctgccacag

SEQ ID NO: 86357 - DNA, 816 bp, Glycine max
  Peptide Sequence Number=SeqID_178042
atgtctcgaaaagaaaatcttatatctgaattgcatccaaggaaagggacatggaagatagcagtgtgtataatcgatatgtgggatgttaagaagcacaatgtgagacaagcgattgacatggtcttaatagaccaaacggaggttgaaagacctgaaattcatgctaatgtacacgtgataactgaaattgctgatattatttctggcattgcaccgcggcatactttagttgacaagtatcctctgagtgtcctaaatataaaaaatggttccaagttgtatgtgaactccaatgatattgccgagataaggaaattccgtgatagtttatgtgttccatattatgttggtggagtaacaaaaaaagggagtggttcgcaatcccaatacactagtaattcacaaagaagcgatcgtgataagttcttgcataatgctcagatggtgagcttaggtgacataagcagactgagagaggactgtttctgtttgatcgttgctatggtggatgaggtcctgattgatacaccatggagttatgttagctatccaaattgcactacaacgtttgatccattaaaaataatgggtgtctgtcgttcgtgccagaaccaagttagtcatacggttcccaggtataaattagttttgaaatggaacacaatggggagaaagctaactttcatttttgggatgcaacgtgtatcaaaatgttcgggtggtgacgagatcaaagtgttccctgagtgtgtggatgatttggttggtaagacattggcgctaaggttcaagtaccgtgtaaacatgcgctag

SEQ ID NO: 86358 - DNA, 852 bp, Glycine max
  Peptide Sequence Number=SeqID_178043
atgccgacaagtgactacgatggaaacggtaacgggctgacaaagattgaagttggtgacgatgaagaaggtcatccaacggtgaaggctcaaaccattgatgagcttcactctttgcagaagaagaagtctgcaccttccactcccaagggcacttttcctgcgtctaacagcgtctttaccgaagaacgcaacaaacagcagctagagtccatcagtgcatctttggcatcactaacaagagaaagtggaccaaaggtagtgaaaggggatccagctgctaggaagttcgaagggtcaagggttgaacacgtgccacaccaaattctcacacccaccattgctgtcagtgacagtgccttgaagttcacacatgttctctataacctctcccccgcagagctttatgaacaagctatcaagtatgagaaaggatcgttcatcacttccactggggcattggctacgctttctggcgccaagacaggtcgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 86359 - DNA, 276 bp, Glycine max
  Peptide Sequence Number=SeqID_178044
atggaggaggagcatccctctgaaatcaagataaagaaaaccattgcgggaattaaagagatcaaacaaatgctacaatttatgataaagaaaaagggcatcgttcttgagttcgaaaaagaggacaaacaacccatgcagacagtaccgactttgcagttgggcatgatggcaatcaatcctctactcaaatatcgtctttcttcaaatccaagtaaccaaagtgatgtgatcctgactaggagcggatcgcttgatacaggttacaaaatttag

SEQ ID NO: 86360 - DNA, 243 bp, Glycine max
  Peptide Sequence Number=SeqID_178045
atgtcttataaaaaggaacctatgaagcaccgacacggacactggacacgacacagacacatggacacctgtaatgtccaaaatatagaatgtagtacgggtgttgtgtcggtgtcggacactgacacggacgcgtgtcggacaccggacacggggctgggaatggaaagcagggaaggcaaatcaatttctgacttgtacgaagaaatttgtcacaaattcagagatttcatgacagagtaa

SEQ ID NO: 86361 - DNA, 540 bp, Glycine max
  Peptide Sequence Number=SeqID_178046
atgaggtccttcaatggtgatttttcaccatggagatgcagcggaaggcaaaggagaagagaagaggggaggcgccatccactagggaataagccatggaagaaggagcttcaccaccaagatgagccttggataagaagcttggaaggatgcttcaatggaggaaaagaaagagggagagaaagagagaggggggagcacgaaattgaaggaataaaagagggggagaacccaatctacttggagtcttctagccaatgcccttgcggggttttcctgtttgcaaactcaaaatgtaagaggtatttccataatcgcctgaagccttcaaagctcacctggactgtagtgtacagaaagcaacacaaaaaggacattgctcaagaagttgtgaagaagaggagacgtgctgccaaaaagccttactctaggtccattgttggtgcaaccttggaagttttcctgtttgcaaactccaaaattgaaattaaggagaggatcaagaaaacaaagaatgagaagaaggctaagaaagcataa

SEQ ID NO: 86362 - DNA, 879 bp, Glycine max
  Peptide Sequence Number=SeqID_178047
atggatgagtcaaaaaacaggcataatgataatttgggtgtgaacaaaatggggaaaaacattaggaagagcccattacaccagcccaattatggcaacaacaacaacagcagcatgaatgggggtagacagcaacagcaacagcctcagcctcaggtttacaacataagcaagaatgatttcagggatattgttcagcagcttacagggtctccctctcagtctcaggatcatcctcaatccaaacctcctcagaatcagaacaattccccaaaacctcaaagtatgaggttgcagaaaattaggcctccccctttgccctatgtgaggcctccattgcacaccaccttgccagcagctagacctgctcactttagacaacaaccatcaccaaaccctaataatatagctgagtcaccaatctctgcctacatgagataccttgaacattcaattacagatcccacttcaaggggtgcccaatttcaaccccatcatcatccagcttcttctgctttgcttcctaaccctcctatgttgcctttgaatgccacaaaccctcttcctcctcctcctgctatagctgctgttccttctccacaaccaaatggacctcctattttacctttaccttctccaacctctcagtttctcttgccttcaccaaacggctacatgagtttcctctccccccagtatggttatccaccactgttgtcccctggctttcagtttccatctcctttttctcccaattttcctttctcaccatttgcacagtcagggattttaggccctggaccacagcctccgctttccccgggactgtttcctttgtctccttcaggctttttccccatcacaagtcccaggaggtga

SEQ ID NO: 86363 - DNA, 879 bp, Glycine max
  Peptide Sequence Number=SeqID_178048
atggatgagtcaaaaaacaggcataatgataatttgggtgtgaacaaaatggggaaaaacattaggaagagcccattacaccagcccaattatggtaacaacaacaacagcagcatgaatgggggtagacagcaacagcaacagcctcagcctcaggtttacaacataagcaagaatgatttcagggatattgttcagcagcttacagggtctccctctcagtctcaggatcatcctcaatccaaacctcctcagaatcagaacaattccccaaaacctcaaagtatgaggttgcagaaaattaggcctccccctttgccctatgtgaggcctccattgcacaccaccttgccagctgctagacctgctcactttagacaacaaccatcaccaaaccctaataatatagctgagtcaccaatctctgcctacatgagataccttgaacattcaattacagatcccacttcaaggggtgcccaatttcaaccccatcgtcatccagcttcttctgctttgcttcctaaccctcctatgatgcctttgaatgccacaaaccctcttcctcctcctccttctatagctgctgttccttccccacaaccaaatggacctcctattttacctttaccttctccaacctctcagtttctcttgccttcaccaaatggctacatgaattttctctcccctcagtctggttatccaccactgttgtcccctggcattcagtttccatctccttttactccccatttccctttgtcaccctttgcacagtcggggattttaggccccgggccgcagcctccactttcgccagggctgtttcctttgtctccttcaggttttttccccatgacaagtcctaggtggtga

SEQ ID NO: 86364 - DNA, 396 bp, Glycine max
  Peptide Sequence Number=SeqID_178049
atgtgtgaacaatatttgggtgttgtttcgctaaagggagaagcaatagtaggctctgccattaagcttaagtggttgcaagataatatgtcgtcgcttccctcggaaccaacacaacaacagttagaagcacattgtagagtttacattttgtggctaattggtggggttttaatgcaagacaagatggaaaattgggttcatttgatgtacctcattgtgttggatgatctcgacagagtcagacggtggagtggtggtggattaagacatggagatgtcatcaattatagaatgagattagactacatgacagctgaacagttttcttggaatccatatctccactttttggatgctttggagtctacaacttttgtagactcatccatatag

SEQ ID NO: 86365 - DNA, 885 bp, Glycine max
  Peptide Sequence Number=SeqID_178050
atggatgagtcaaaaaacaggcataatgataatttgggtgtgaacaaaatggggaaaaacattaggaagagcccattacaccagcccaattatggcaacaacaacaacagcagcatgaatgggggtagacagcaacagcaacagcctcagcctcagcctcaggtttacaacataagcaagaatgatttcagggatattgttcagcagcttacagggtctccctctcagtctcaggatcatcctcaatccaaacctcctcagaatcagaacaattccccaaaacctcaaagtatgaggttgcagaaaattaggcctccccctttgccctatgtgaggcctccattgcacaccaccttgccagcagctagacctgctcactttagacaacaaccatcaccaaaccctaataatatagctgagtcaccaatctctgcctacatgagataccttgaacattcaattacagatcccacttcaaggggtgcccaatttcaaccccatcatcatccagcttcttctgctttgcttcctaaccctcctatgttgcctttgaatgccacaaaccctcttcctcctcctcctgctatagctgctgttccttctccacaaccaaatggacctcctattttacctttaccttctccaacctctcagtttctcttgccttcaccaaatgactacatgaatttcctctcccctcagtcttgttatcgaccactgttgtcccctggcattcagtttccatctccttttactccccatttccctttgtcaccctttgcacagtcagggattttaggccccggtccgcagcctccactttcgccagggctgtttcctttgtctccttcaggttttttccccatgacaagtcctaggtggtga

SEQ ID NO: 86366 - DNA, 297 bp, Glycine max
  Peptide Sequence Number=SeqID_178051
atgatagattacattcttcctggtgcttcgaacatggactacactccaccagttgtccaaccagatgatttcctgagcaatgtttttggaactgattgtggcatgccagcatcagcttgtgaatacatgcatagcctacagaacaaagtggaaccaagtttcactctaatgtttaaccaagatgttgaagagaataatccatcactacatgatataccagatgagtgcccacatcgaaattcaggacgtaatatgagatgccctccatatggaccaggacaccattatggggattaa

SEQ ID NO: 86367 - DNA, 201 bp, Glycine max
  Peptide Sequence Number=SeqID_178052
atggtgatgaccacgaccacggtcaagtcagaatggccatggtcaaatttcataaagagattagcgtgtgaccgtggtgatcttagtatggttgtggtgatgaccatgaccatgcctcctccttatggaaagttcaagttgaattgtgatggtgttgttgtgatgggtggtcaggcaacttgtggtagtgttaccaaataa

SEQ ID NO: 86368 - DNA, 108 bp, Glycine max
  Peptide Sequence Number=SeqID_178053
atgcatttctacaggagaagtgcatccagagaccatatctggactgttcaaattactcagactttgcttggtgatcctcagcctctgaaacttccaccttctacatag

SEQ ID NO: 86369 - DNA, 1959 bp, Glycine max
  Peptide Sequence Number=SeqID_178054
atgtcttcttttttgtctgattctgccattggattaggcgacaacaattttggaggctcgattgaggaatccatcatggatcgagagggtgaggacctcacaccaaactggtgtgagcacttctctccctcgcagaagggcatgaccttatgctacttccggggagcctgtcccggttactgtgatcctccccattctgcttatgagggtgtgaggagaggtagtgtcaatggagatgtgagggtgtttccccgcgtgcaacgtagcaagagtgatgggtcagcatcgtctaccctggtcattgctggctatgaatgggtgagggatgacgtgttgaagtataagtcttgtctaaccttagcgacaagtgttgttgggcttcaatgtcagggcggcgcctggttgtccgcccttcttctttatgtactggagcacttgaatgtgaccccttcccaaattcacccgaacagttgggcaatgttgtctgggaagattggatgggtctccttaaacagtgtgtccaagaagctgttcgagtttgaattaaacgtctttcgccatgtcaatgatcgtttctttagggtcctaactactgatgtcgtggctgatggaatgccactaatcgattttggagcagctgccatactcgctagacgcgtgggccatattgtctcttccttcgacgagcgatcatctcactgccttgcatatattatgggtgacttcgcttggaggccactcgtgaagcaggtaggacctacaagtggaatcgtgccaccgtctgttgctactccatccactggagaagagggccaacctgctagtgaggttggtcctatttttattgctgctgaggttgcctccaacgctcattcctttgttttggtaaagaggaagatggatgatgttgttgggttatcaggccgcaagaagttgatgcccgctgcagggttgatgcccactgcaggtcacctttcgactgcgaaagatgtgtttctggctccaccggctatcgaggctcttgctccactgaccgtcgaggctcttgctgccgctgctagtactcctgttattcatgctcctttacctcttcccgttgttgctattcaggaggttgctcttgctattgtgccagccactcaggatggtattgttgtggtgtcgttgcccaccatcgtggaacctttgttaagtgctggtgtggctgccactggtgcttccacgatgatgcctccttcctctatgactctgatggcttttccctctgttattttagcgatggtagcatcgctttcttcactctcttgccctcgtgtcttgcttggtcattcgtatacctctagtgatgttgactcactgtggggtgcaacttatacgatggagcacaagaccccggttggctttgtgtcagccttcgacaagaacctcattaggtcgactagggtgcagaatgctactgactctgccaaagtgtttctccaaaggagtttggcaattttggaggagaatggattgcaacaccaagagactgtgcagaaggtggcatccttggcagatggtgatgagttgtttggatgctgcaagggcttgcaggccaagaagatggacttgggtggcaaagtggagagcttggcgactgagaaggatgggcttgccaaagtagttgttgacttagaagcccgacttaaggagtcggagaccaggctggaggagtccaagttgtgggctgccaaggaaaggaaggtcagtagggagctcgaggaagagctaattctgtataagaaggaggtcgtggagcagtatgagaaacagtttcagaaggccatcaggcatgtcgatttctttgcgaaggatgtgaaggagggtgttctgcttgatgaggaagaaattaatgtggaggaggaggctgctgatgaagggcagtgtgctgcggagcaaggtgatgatgcatgtatctaa

SEQ ID NO: 86370 - DNA, 600 bp, Glycine max
  Peptide Sequence Number=SeqID_178055
atggcctcccataaacgccgagtcatgcccacacctggggaagcgtccaactgggactcttcccgcttcacttcagagattgcttggcacaagtaccaggataacattcagctctggaacatccttccggagaggaatgtcgagcttggaccagggatgatcgatgtggctctggtgaaagagttctactcgaacctttatgatccagaggaccacagtcccagattctgcagggtgcgaggacaagtcgttcgctttgacgctgatatgattaacgacttcctcgacaccccggtcatcttagaggacggagaggagtacccagcctatgccagatatctcagcactcatcccgatcctgactccatcgccaccacactgtatactccaggggggcgtttcgttctaaacgccgatggtctcccttggaagctgctgaggaaggacatgatgacactcctcagacatggaggcatgcttgatctacagcttagtacggaggatggatatggacgtgggcagcttcatatctcagcagatcagtcagattgcccagtccagtacctcgaggcttgggttcccggcgttgatcacaacgat

SEQ ID NO: 86371 - DNA, 480 bp, Glycine max
  Peptide Sequence Number=SeqID_178056
atgcgaggtagatctacatctagaactgtcgttcccatagacttagaaatcgaagctacttgtcggcgtaacaacgccacaagaagacaaagggagcaagacatagatacttcacctcctctttctccaaatcacgctcaaatggacgaagaaccagcacgtagggttacattagaggatttctctcatactgctactcctgaattcttcataagtatcacatcgccagaggttcaagcgcctaatatttcgtaccctcattctctcattcagttgattcaggggaacctcttccatggtctcccaacgggagaggcaaaaaattggttgcattcctttaagggcaacacctttaggacttgggaagaagttgttgagaaatttctgaaaaagtacttcccggaatccaagacagctgaagggaaactggaaatctcatatttccatcaattcccagatgatcccttagcgaagccttag

SEQ ID NO: 86372 - DNA, 577 bp, Glycine max
  Peptide Sequence Number=SeqID_178057
atggtcattctgcgcctttccatccaggctcgatcgtgtccgatggcacgcagagacaaattatggtcattctgtgcctttccatccaggctcgatcgtgtccgatggcacgcagagacaaattatggtcattctgcacctttgtcttccagaggcggcgggcccgatgacatgcgggaaccatttggtcccgcactttttacctttagtcatccagaggcggcgggcccgatgacatgcgggaaccatttggtcttgcactttttcaccttttgtcatccaaaggcggcgggcccgatgacatgcgggaaccagttggtcccgcacttttttaccttctgtcatccagaggcggcaggcccgatggcatgcggggaaccatttgatcccacaccttttttcactatccagaaacaatcaagttcgatagcacacggagacaaattatggtcatccgcgccttctgtcgaccgagaggaacaacttcagcagtatcaggatgatgttggtcgttcggtgctgatcattttcaaaaattttgtaggtgccgctggcggggatattgaccggccgaagg

SEQ ID NO: 86373 - DNA, 450 bp, Glycine max
  Peptide Sequence Number=SeqID_178058
atgggctcagaaatctaccctgaggttcatgagaaccctagggccttctttagcagctatagtccaatcttcttggagcctcttgctcatggttctagtgactgtttatactttgtacttactgttaagggcaagtatctcagctgcatggaggacaacatgtactatgtacaagactgctttcacttacatcctcgtgttgttcttgggttatgtcccaaaacctcttttgataaagaggatggaaagaccttgtatacattggagggagttgattcgtcaagcttagccaataaggttgctaaagtagcaggctcaattaaccttggagaagttgcttctcatgccattcttcggatggcagcaggggatgccgttcttgaaacagtgaaagaatttgataaacataagcataagccacacatcaccaaggtgtacacccacaaatag

SEQ ID NO: 86374 - DNA, 603 bp, Glycine max
  Peptide Sequence Number=SeqID_178059
atgagggtagaactcaagacgatagacgaagtccaagaaatggtcaggatcagagaagaagctacaaagctccaagcaacgaggcttgtcaaagcccatggtccgcccttggagattcctataggctcgcacattatgtctccagtacgtgccactccacaagtgacactacatgtcactcgtgatgtcactccacgagtgacatgtatgcaagagcatgacattatgtctccagtatgtgccactccacgagtgacatgtatgcaagagcacgaaattacgtctccatatgtaccactccacaagggacacatatgcaagagcatgacattacgtctgcaagagcacaacaccatgtctccagtacatgacactccacgagagacacgagacccaacaaatcttgcccgtcagcttcatctagaagaaataaagaaacactggcacactaggccagatgttgaagtaggggcacaaaatctcaaaggccctcaccgtggcccaactgttagggtggagctgagaaggggccatgttcaagtgctcaagcagagcacactggaatgcggtcaagggaagaatgagacacaagacctcaactag

SEQ ID NO: 86375 - DNA, 330 bp, Glycine max
  Peptide Sequence Number=SeqID_178060
atggacaaaagtacccctttcaccaggaaccttcattctgaaatgacctatcatccatgccacaccacccccaacctatccttcgtcaaaaccccacagcccccaagagaaaaccgcaacaacgttgtttcactcctcgcttgttctcaaccccattgcttcttcatcccacttgcaccactcttcttccacgtgcttctcgaagaaagtccacaactcaagccgtgggagaaaatcaaggttattgaagaagaagggcttcttcaaggggatggtcaccacaatggacttcttcgtcggtgctactttctcgtgttcgttgttgggtga

SEQ ID NO: 86376 - DNA, 300 bp, Glycine max
  Peptide Sequence Number=SeqID_178061
atggttgataaaaatcgaactctcaaggaattggctacaccagatgttgtgtatcaaccttggtgtattcggtatcccgagactaaggttagttatgagctaaagtctggactaatccatttgctgccagagtttcatggtcttgcagattatgcaaagatgaaggcattttcattctctttggatggtgtggctaaggactggttgtaccttcaaccagatactatcaacacctggacaaatatgaagaaaagattcatagagaaattcttccctacatctagaacaacatctatctag

SEQ ID NO: 86377 - DNA, 684 bp, Glycine max
  Peptide Sequence Number=SeqID_178062
atggctgctagtgatcatgctattttgcatgatagaacatattttcccaccaagaaaagtttgttagagctttcatcacaggatgctttgttggcacagaacaaggttgcactatttgtggtggagctcacgaatctggctgttgtattcctactgaagacacaacacatgaagttaattacatgggaaaccagccaagacaaaattttaatgcaggtggatactcaggatttcatggctagaattacaaccagcagtaaggacagtggagaactcaccctggtttctatgtcaaatcacaagagcacagagtcggccatcaagaatcttgagatccaggtgggacagttggccaagcaactggcggacaagccttcaagcagttttggagctaatgcaaaaaaaaatttgaaagaggagtgtaaggctatcatgacaaggggtagaagagccatttttgctaaagatgaaggaaggttggttgctgaacaccaagatgtagttgctaaagaagaaaaagaaggagaggagaaaaataagaatgagaaggaaataaatgtagaagaaaaagaaaaagaaaaagaaaaaaatgaaaaagagaaagagaaagaggagaagaaaagaactaagagtgagttggctcgtgaaaagaagagaaaggctagtccatctacagggaaatag

SEQ ID NO: 86378 - DNA, 1005 bp, Glycine max
  Peptide Sequence Number=SeqID_178063
atggctccgaagaagctctccacgaagaggtctagaaaagatgccactagagaaggctccaggccgccttggagtttgatagtcaccggttccggagtgccgagcaccagcagcgcttcgaggccatcaagggatggtcatttcatagggagaggcgtctccagctcagggaggacgagtaccctgacttccagggagaaccagcagtgtgaatttagccagaggaggaaccaggcagacggtttcgataaggaagccatcacccagctgctgtgcataccggggcaggatttcgcccggagcgctgctgggaggcgggtgtgtatcatgcgcaccaacatgactaccctgacccagatatggatggcactgctgttcagcaatgtcttgcctagcgaccataacttcgacctccctctgcctaagtgccagttggtctatgccatccagacacggaagagcgttcacgtggccaaggtgattgctgatgccatttatttgtttgcaggaatggcgcctactaggcaccctttggacccggagaagtccaatagggccctggggtttttggctttgatcacgggcctctgccagttctacggagtgcatgtcacccccagcaaggtaatccgaccgccgatcacccgagccttcatcgagaagtactacacgcctaggcaggcgcagggtgacgcacataaggctgcaggcgcaccaccaccacctcggcaggccgattcggctggaccactgagcgtggagcagtatcaacagcatttggttcgccagcaagcggctaaccaccatggacaggggcagggttctgccccttttgtatgccctaccccggagcagtttggggctgaggtcgcgtggcctggagactggcccgatgcccagacaggggaagagcctgcagaattccccggtgaggcggatgaaccccatacggacgaggatatgactgaccttctcggtttcttgggagggagcggagccacatga

SEQ ID NO: 86379 - DNA, 420 bp, Glycine max
  Peptide Sequence Number=SeqID_178064
atggtggaggtctccacggaggccattgcctcccttgcccaatattatgaccagcctttgaggtgcttcacctttggggacttccagttattacccacggtggaagagtttgaagagatcctgggatgccctctgggaggaaggaaatcaatctccaaaatagtcaaaatctcgacacaggaattggaccgaggaaagcaagtcgaaaatggggtggttggagtaccaaggaaatgtttggaagcaaaggcaagaaccttggcaagtcaagacgaatgggccccgttcatggatgtcctggcgctcttgatatttggagtggtcctctttccaaatgtggataggttggtggacctggcaatgattgatgcttttctcgcctttcacgaccgcaaggaaagcccggtttcgctatcttag

SEQ ID NO: 86380 - DNA, 219 bp, Glycine max
  Peptide Sequence Number=SeqID_178065
atgaagctttgcttccacaacctccaaccattgttatcgaccttcttcagccttcacagttttagctttcagaccctcgctcactcaaactcaatgatgtgtttatttgaagagaggagtagggttggtgatgcaaaactgagagcacctgattctatttatagagctctgcccatcatagagctcaacctccatggattagaacgtgggtatggataa

SEQ ID NO: 86381 - DNA, 363 bp, Glycine max
  Peptide Sequence Number=SeqID_178066
atgacaattgaggaatcaatacatgttacttttgatgaaactaatattacctccccgagaaaggagttcgttgatgatattgcagatgctttggaagacactcaaaatgaagaaagaaatctgaaaagaaagagagatgatgaagacaaggatgatcaagataacacagcacaagaaaatgataatcttctcaaagaatggaaaacttcaagaaatcatcctcttgacaacatcatcggtgatatctcaaaaggggttaaatggaccaactgggagaatgaatggattttctggtttatcaagaaccattcagcaacaacccatgatcttatccatacccacgatctaatccatggaggttga

SEQ ID NO: 86382 - DNA, 201 bp, Glycine max
  Peptide Sequence Number=SeqID_178067
atggaagttattgaaagtttaaagttgaaaatggaagttggaaggggaagttactggaagttgaagttggaagtggttgtcatcatcaaaaagggtgagaatgtaaatcatgaagattttgatgatgtcaaaaagatcaagcctgggataatgagtgtcatcatcaaaaaaggggagaatgttgatcatgcattgttttga

SEQ ID NO: 86383 - DNA, 369 bp, Glycine max
  Peptide Sequence Number=SeqID_178068
atgggtgccaagtacctcgaagtggtcaaacgagggtcgcatcccaacaacggatggtccccggacgaaattagggcgcagaatgaccataatttgtctctgcgtgtcttcggacacgatcgagcctgggtggcaagacgcagaatgaccataatttgtctccgtgtgccaccggacacgatcgcctctggatggcaaaaagaggttgtctgcgcggaagatgacgttaatctccgcgtgtcaacgggcttgttggacgtgattgacaaagggtatctccgcatgtcacatgaccccagggtcagtatgacagagattgtggggttgaccgacaaaagcaaggctcttgctcctacgtatcctcaatga

SEQ ID NO: 86384 - DNA, 315 bp, Glycine max
  Peptide Sequence Number=SeqID_178069
atgagaggggcaccactagaggaagagatcgcgcctgtcatttcacgaggttttaataagaccaacatggagacgcttcagaaggtccgcaaggcatgggaggtggtgcgaaagaaagacaaagaactcaggggcagtaacaatgggcccatcggtggctaccatgagttgaaggtttgcacaaggtccgaaagaaacttgcctcaacggttatgtgagacagagaccaacatgttagctattgtcagcaagtaccaagaagaactaaatctagccacggcccacgagcatagagtggcggacgagtatgcctaa

SEQ ID NO: 86385 - DNA, 270 bp, Glycine max
  Peptide Sequence Number=SeqID_178070
atgattacaaccaagaagttattcccacttcttgcaatgaaccccaaggaacgttggtcctttgtgtccactgataacaaccaagaagttatacccacttctttgatcaaccaagaagcaaatcctgcttcttgcaatgaacccaaggaacgttggtcccttgtgttcagtgtttgtaaccaagaagaccttctcttgaaaacagtcaccaagaataggtctcttgaaaagctttttgtaagaatgaaggagaggaagaaaatagaatag

SEQ ID NO: 86386 - DNA, 375 bp, Glycine max
  Peptide Sequence Number=SeqID_178071
atggtgattttccaccatggagatgcagcgaaagataaaggagaagagttttttagaggagtttgggactgggagagggttgtgatagggggatcctctattacctttctttatcttataatggcagaaggattaagcatgatgttcaatgaggtagtgaagagtttattttgtgggtttcagatagaaggttttcctataatggtcaattataagagattggctgcttgggaaccaatggtgcagaacatgaagaaaagattggtttcatgggataagcacctccaagtattattacttcccttgaaagcttatttaaaaaatttctttggggggaggggggtagtgtggataaaaggaagatttgttaggtag

SEQ ID NO: 86387 - DNA, 810 bp, Glycine max
  Peptide Sequence Number=SeqID_178072
atgattcgatgtcatggctcttatgttcgactttcatggctgcgagacgtgtatcagatgaaaattgatgcatgtcactggattgtagcagtgcgagcatatttgttgcatctacttggatgcacactctttgctaacaagagcgtcacatacgtgcacgtggtattcttggatgcattgcgtgacttgacgcagagtgggacttacgcttgtgtgctgctgcacttgtgcatattcgctgaggattatgacgaggggagaccgcgtgcatgccgatggacctctggcaaggcattgcccgtgtcgacgtatcgcaggcatctggacagactgacccctgacgtagtgtgttggattccatatgatggggttcctagatggtcattcaccgattggagagggttgtacgacagtttggatacatccagactatttcgccagatcctactgcgccttcggtctctgttgaagaaatggatgatagatggatatagtttacaaaaggatcctcctagagtttcgctggttcaacaatatgacacatttgttgaaccagatgtgcatcaacaaccagtggcggcaatgacacctaatgaagcaaacgttgttgtccatcatcttaggcatgtagtggatggttatgtagcaattgctgataagttagagagacttctgaacctgaggatcctgaccgaaggaacaaaagcctatactattgctgaagaatgtttgagtatcgcaagaagctacattagccaaccaactataggtcacaaatcgaggcgtaggcggcgtacatatgatcattga

SEQ ID NO: 86388 - DNA, 2145 bp, Glycine max
  Peptide Sequence Number=SeqID_178073
atggccttctgtggtggtactttcgttaagccaaactattctgcgtccccatgttacaaatatacagctctaagtccataccatggctgcagaaacaagttctgtgtgagagtttcagcaagtggctcagctgatgaggaaaggactattataaagaaagagaaagatgggtggaagatcaattactcaggagagaaaccagcaacaccactgttggacactgtcaaccacccaattcacatgaagaatctgtcaacacaggatcttgagcaacttgcagcagagctgagggcagatattgtacacagtgtgtcagaaactggtgggcatcttagctcaagcttgggagtggtggagttatcagtggctttgcatcatgttttcaacacccctgaagataaaattatatgggatgttggtcatcaggcataccctcacaagattctcacaggtagaaggtctaggatgcacaccattaggaagacttcaggactagcaggctttcctaaaagggatgagagtgttcatgatgcttttggggtaggacacagttctactagcatatctgctggtcttggcatggctgttgcacgtgatctattgggaaagaataacagcattatttcagtgattggagatggggcattgacagcaggccaagcttatgaggcaatgaacaatgcagggttccttgattctaacatgatagttgtacttaatgacaacaaacaagtctctttaccaactgccacacttgatggtcctgcaactccggttggagccctcagtagtgctttaagcaaaattcaagcaagttctgaattccgcaaactcagagaagctgcaaaaaccatcacaaagcaaattggaggacaaacacatcaggttgcagcaaaagtagatgagtatgcaagaggcatgatcagtgcttctggctctactctttttgaagagcttggcttatactacataggtcctgtggatggtcataacattgaagatctggtcaccatctttgaaaaagtgaaagcaatgcctgccccaggtccagttttgattcatgttgtgacagaaaaagggaagggataccccccagcagaaaaagcagctgatagaatgcacggtgtagttaagtttgatccaaaaacaggccatcagcttaaggccaagtcctctacactttcatacacccagtactttgctgaatctttgataaaggaagctgaaatagacaataagatagtggctattcacgcagcgatgggtggtggtaccggcctaaattatttccaaaaaaagtttcctgagcgctgtttcgatgtgggaatagctgaacaacatgctgtaacatttgcagctggtttggctgctgaaggcctcaagccattttgtgccatttattcatcattcttgcaacgtggatatgatcaggtagtccatgatgttgatcttcaaaagctgcctgtccgatttgctttggatagggctggtttggttggagcagatggaccaacccattgtggagcatttgatatcacttacatgtcatgcctacccaacatggtggttatggctccttctgatgaaactgaactcatgcacatggttgcaaccgcagcagctatagatgatagaccaagctgctttagatttccaaggggaaatggaattggagccactctgccactcaataacaaaggaaccccacttgagataggaaagggaagaattctggtggaagggagcagagttgccattttgggatatggttctgtggtccaacaatgcagacaagcctcagaaatgcttaaggaactaggcattgatgtgacagttgctgatgccagattttgcaaacctttggatactggtctcattaggctactagctaaagagcatgaaatactcatcacagtggaagagggttctatcggtggttttggatcacatgtatcacaattcctgagcttatctggtatcctagatgggcctctaaagtggagagcaatgatgcttcctgataggtacattgagcatggatcaccccaagttcagatagaagaagcagggctttcatcaaagcagattgcagccacagtcttgtctcttatggaaaggccaaaacaagctcttctgttcaaataa

SEQ ID NO: 86389 - DNA, 258 bp, Glycine max
  Peptide Sequence Number=SeqID_178074
atgactacaccacccagttctcttccttctccttctcctcctcctcttcctactgatgcaacatcacattcccctcttaccttgaagcggacaagaaaagccacacacttgagatcattggctaccagactagttggggcagagagacccttggtccatgtggatccagcgaccgggaaagccgacggtagatgtgacataggagaattggaaacgagtccctattgcgcagaaggattgatatgggaggatattcag

SEQ ID NO: 86390 - DNA, 207 bp, Glycine max
  Peptide Sequence Number=SeqID_178075
atgacacatcaagaagtcactaggcaacctcaatcatcaaacattgactctactccatggagtttcgacaccatatggctaggacatattcagaagcatagcacatatgtggagcataggcctatagtggaagatttccatgacatagattctgcaatcaaaagtaggattaccagaaggagggctattcaaaagttaaaaaggtag

SEQ ID NO: 86391 - DNA, 243 bp, Glycine max
  Peptide Sequence Number=SeqID_178076
atgaaccacaaaggaatcctctcctttttgttcagtgattacaaccaagaagttatgcccacttcttgcaatgaacccaaaagcgctttgagtccagtgataacaaccaagaagttgtacccacttcttgcaatgaacccaaaagcggttagtcttttggatctagtgatcaaccaagaagcaaatccgcttcttgcaatgaacccaaaagcggttagccttttgagtccaatgtttaactaa

SEQ ID NO: 86392 - DNA, 273 bp, Glycine max
  Peptide Sequence Number=SeqID_178077
atgacacgtgaacaaagccatgtgttcacaacacttagaggcactacagtgtatcttgcacctgagtggatcacaaactatcccatatcagagaaaagtgatgtttatagctatggtatggtgttggtaaagatcattggggggaggaaaaactatgatcccaatgaaactttagagaaatcctatttccaatcttttgcttttaagatggtggaagaagggaatgtgacagagattcttgactcaaaggtagaaacttatgaaaatgattaa

SEQ ID NO: 86393 - DNA, 843 bp, Glycine max
  Peptide Sequence Number=SeqID_178078
atggtactagacaaaggttatacaggaggacaagcatctccaatcttaactgcattcattgcaggacaagctgctacctttaagatgtttgaaacgattaagaggcagccagatattgatgcttatgacactgggcaaagtggaagtgagaaatcaacaattattagtttaattgagagattttatgatccacaagctggtgaagttctcattgacgatgggccaatagatgaagaaatcagagttgcagctgaacttgctaatgctgctaagttcatagataaatttcttcgtggacttgacacgatggttggcaagcatattagaacaagcactaatttaagaggggcaatgggatacattgcacctaaatggctagggaatgcaccaataactgccaaagttgacaaatacagttttggggctaaggaatgcaccctgcttctgctttcgatggacaatgaggaactaaagcttttgaaggaggatggagaaaggcttcatggaagccctaggttgcttgcagcgctacgattcggctaccgcgtgttcgatctgcgggtgaggggaccttgtgaaattgcatcatgtggttcagagagcaatttgttggaccttgtgaaaatatgtcttgttatgttcataggactaagtttagagaataatccttgcttcagagagcaatttgacgacgtagcagtggccaaggaagttgttgaaatgagaatatgtttacttcttcttgttgcatttgcaactaaatattgtcttcctttggtttatgtcggtgggtccttcattgctgccaagggtcatgatcctgaggtatgtaacaactattag

SEQ ID NO: 86394 - DNA, 675 bp, Glycine max
  Peptide Sequence Number=SeqID_178079
atgactacaccacccagctctcctcctcctcctcctaccactgatgcaacatcgcattccctttttaccttgaagcggacaagaaaatcgacacacctaagatcattgacgactagaccaattggggcagagagacccctggtccatgtggatcctgtaacagggaaagccgacggtacccacaaaaagaagtttagaacatatttgggtatcatcgctcgcgataaggtagatgtgacatacgagaattggaaacaagtccctgctgcccagaaggatttgatatgggaggatattcaggctgaatttgatatacctgaagcatctgatctgaggacaaaaaagaaaatacttcaaattgtggggcacttgcaaccaacaaggacagtgtcgatgacactgtttgcaaaaagatgtgtgaaaaaaggcacaggtcattcagaaacaaaacactgcccctcacatgttgtctcgtggggttatgagtttcttgaaaagaagttgatggataaaaggaaaaagaaacaactggaggaagctactcaatcccgaagcactgacatcgtgattgatccttcatctcccattagacaacacatgaaatggaagatgacccacaccaagaaaagtggtcaaatgacgtctaaggcagtaaaggaaattgctgacaagatt

SEQ ID NO: 86395 - DNA, 234 bp, Glycine max
  Peptide Sequence Number=SeqID_178080
atgtggtaccatgtcagtgaaaaaccacgtcggcgcctaggagtacatgacaagacaaacaacacactaggagaccaattagggtcacgctgctttgtgagaatgctccaaccatgtgggattggcacaggcttaaaggagcactcaaatcgggtgacccccaaggcctacactccgaagagtccgtcatggccactccctcttgattcaggtccaacccagaaaacattttag

SEQ ID NO: 86396 - DNA, 2319 bp, Glycine max
  Peptide Sequence Number=SeqID_178081
atggagagtgtatccgttcatgtgtattgcgatggtgacatgattccatcatacgaagggataatgtttgaatgccctagtgatcctaaagtcatcacaatgagtgatgacataccgcttcaagatgtacatgctcctgtgccagggatgacacggaaggttgacaggttgtccaatgtcgaaagagatattcttgtgtcgagggtaattgtcccgtggcgtgggagattgcctgatgtcgggggtagtagccttaatagggtggacatgcttttagtttcacaagtgaggtctgatgtgtcagtgggtacgtactggagacacagatcgtggttgagtggagctgcgttgtggtattttcctttgatcatgtcttttttcctttctaactccgtcattggcatgggcggtagtgactctgagggttcgattcagcaacacctagtggaccaaaaggtcatctccatcggcagttcctccttagagggcaatcatcatggggcttctaacagtggatcctcttcctcagaaaggttgagggttttgtgccatgctggtggaggcacttctggcctccacaggaaggcgggagcaaggataagtggttgtgaagacattagggcgtcctcccttgatgatgttttgaagtatcggtcattcattacgtttgtggcgagcatcactgtattgcaactccaagtaaaattggcaagtcctgtagactcttgcaagatagtcgtccaagcttgtgggagtgatgacttctcttttctgagggcagcatcaaacaatccacccatctttttcatgtacatgtgtcttttcaaggtcttgggtttagttctcctcttgaccgcattccagtgtgctcttcttgagcacttgaacgtggcccattctcaactccaccctaatagttgggccatgatggagttaatggacaaaaatggttggatctccttgaacatcctgtccaagaagttgttcaagtttgactcgaatgtgttttttcgtttgaaggaccatttccttaagcttgatcctaccaggtttaagtctttcaacaaggatctgttgacccttgtggagagggtcaacaaagctatttttggagcagctaggggtcaacctgccattgaggttaggcctattactagtgttgatgaggtctcccccaatgttccttcctccattttggctaagaggaagcgagatgacatcgttggggcttatgttcctgttgctcttgctcctccacctctttctgttgtgcccgttcaagaggtcgctcctactgctaaagttagtgtaccaactgcttcaacttgtcttgttgtggctccttctaagtgtcggagtggcaaccacaagtgctcctatgatgtcacctcctccttcttcggctccaatggttccttcctctattatgttggtgccacattctatgaattttgccaaggtctttctccaacgaagtttggcaatcctagaagaaaatggccaaaggcagcaagaggcactaagaagggtgacattcttggagtctggagagtgaagcaccctaaggtagctaatgccatcgttgccttcattgaacctatgaagtcaaaccaccaacggtcatccaaggttgacaatgttctggccaagttgctacacaccaagttggatggtgatgaattattcaagcgctacaaggacttgcagaaagagaaagaaacttggttggcagggagtcggagtccaagctggaagaatccgagttgcgggcgtcctaggagagagaccgtgagcaaggaactcgaagaggagctgctgatgtacaagaaggaggctgtggagcagcatgaaaagggatttcacaaggtcaataggcaagctgggttcttcgcgaaagaccttgacttgggtcttttttatcctttcaaggaaatgaaggatggtattttgcttgatgaggaagaccttgacttgggtctgttacttgtggtagtaaggatgagtcatcgtgacatgagtcaaatctttgacggtgtaggaaccaagaccttggcatacgcgaggaagaatctagaagaagatgagttgtcaagtccgctaagtgcaccgctccagatctgcgctaagcgcacgagcactaacaaggccacctatttaagcttgaaatcagatttgcaaagggagtttggcacttttcttgagaagctttgcatgctcaaaggttctagagagagaaaggtccaagttccagagagttctgagagattttgctgtgtgaagatctacagagacgcgagttcgaagcggaagccgttttga

SEQ ID NO: 86397 - DNA, 162 bp, Glycine max
  Peptide Sequence Number=SeqID_178082
atggagttagaatcaagacatgacaggcaagatgggctcataaagctctttggcatgcttccttgtggcacatgcatgaggcccactagcttgagcctagccattagaaccgatgtagaaaactcgcattctacatcggttataactacacaatcgatgtag

SEQ ID NO: 86398 - DNA, 1476 bp, Glycine max
  Peptide Sequence Number=SeqID_178083
atggcgagcttatggcacataatgttgaggttgattaccagcatgtcagatggttgccaagagaacgggtctgtgttcctatgtaggacatcaactatgcgtacactgcctgggtttgtgtccaagctgcaacttgatgagttcttcaataagctttgggcctctatcgaaagtgtcatcgcacagatctacatcgaatatgttgtccaggcttgcttggctttcaacgtagcaatgtcgtgcttgggtttgatctgccttgatagtcatgatctctcctgtcaaggtggggaacttcatcttcaggcacggtgtggagacgatggctctgagctcgttgagcgttttcttgccaatcataaggtcaacatagcctctggtctctactctttctcttgtgaagccaaggagtggactgacttgaggctagatgatgtcgatggagccgccctggtcgatgatgaccttggacaccatgaagttggtgattacaatggagacaaccatggcatagttgatgtcaatgtcccagatggcgtggaggtgatgcttgcaagagtagcaagaatgcccttcgtaagagaatccacccacaatggtgttgattacacatatgtttttctgggtgggcttagtttcccattcttggtggtgtctctgtcttcctcgatcttctgctttgtctcttcttctatcgacatcgtggtttctgttgtgatcctcttggccctaacaatcttttgtgttgtgaccataattgtggttgtatttgcatatttggtcttgtctaaccccggcctaggtgaaagcggtggaggtagttttattggttcctccgtgttgaaagcctccttaaagattgtagtgcgattggctattagggtgtcgaagctgtcgatggaccttggaggaaatccactgtaccaggttaatgcctcccttttgagggacgttgggaagacacgacacaagattgcatcgtcattggtgtacaaatttgcctggatgaggaaagcatctagatgttcatctggatcggtggtctcattataccgctctaggttgagtgatttccaacctaaggtcttcgactttttaagctcctcctcatggtgtcactccatctccacaatgcagttttggagttgttggagaatgtcaatatccatcatggttgttggaggaggattggagtctttgaaagggatatcgcgtctgaggctagactgcatgctaaccatgggtgaaaaagggaaattgcggggtatgttttaccgtggccctacggtggacaccaaatgtacctaccaaagttcagagttggcacacgtaagggtagatgtggctaaggagagtatgagtgagcatgaaaagaatatgagggaacctggtacttatagtgtagagtggaagttacgggtccttgtttgtaagggctgttacagtgacataacaacccttgcagatagtttttga

SEQ ID NO: 86399 - DNA, 375 bp, Glycine max
  Peptide Sequence Number=SeqID_178084
atgctcctcctcctggaaccacttcgtgctgcttcttttccttgtcccggaacaccacttggtgctacttcttttcttcttcctgcatgcttcttcttctccacgagaccagcgagcccggctacttcttcttcttcgcgaaccacgccttttgccttccagaagacgccgaaaaaattggggaaaggagtggttacggtggcagcttccggaagatccgtgaagggttcttccggaacttccggaagaagagttcttccgaaagtaaccaaagggcatccgaaagaacacatcttccggaacacctcttccggaaactttccagaagaagtagttcttccggaaaatttccggaagaagggttcttccggatga

SEQ ID NO: 86400 - DNA, 231 bp, Glycine max
  Peptide Sequence Number=SeqID_178085
atggaaacaagattgtcaccgagcttcaaagatgcaaaacatgcactacagcttggcataagggtcgacggtaggccaatcactggtgcaacctactatgattgggaggaaatgtgtgaacaatatttgggtgttgttctgccaaagggagaagcaatagtaggctctgccattaagcttaagtggttgcaagataatatgccactgcttccctcggaatcgacacaataa

SEQ ID NO: 86401 - DNA, 204 bp, Glycine max
  Peptide Sequence Number=SeqID_178086
atgaaggagatcagtggggtcctgatccaaggagaaggaggactgcaaagggtcgtcccgtttcaactcgcattcctactgagatggacgaagacgaaaatgaacaagcaagtagaaaaaaatgtggactttgccggcaacagggtcatagcagaaataattgtcctaatacatattttggggagagaaggtgtagtacggtaa

SEQ ID NO: 86402 - DNA, 537 bp, Glycine max
  Peptide Sequence Number=SeqID_178087
atgtctggcgcggcaattatggtggcccgtgtgatgttagggcacaactatgaacccggaatgggcttgggaaagaataatgacggcacaaccaacttagtggacatcaaggaaaatcgtagaaagtttggactaggctataagcccacgcggactgatctgagaagaagcatcatagaaaggaggaacaggggcacgagcccacaactaaggccacaagcgagggagaaccctccttgtcatatcagtaaaagcttcatgagtgcgggcttgagacatgaagagaaagtcactatgatacacggtactaataccgaggaccctgctgtcgattttgaacaagaagcgaatcgacctgaggttgaagaagacgaaggtatggaatttccctctgagctagaaaggacggtcgctcaagaagaccgagagatgaagccgcaccaagaagaaatggaagtcgtaaacttaggtgttggcaatgaaaagaaagaggaaaaggtggatacgggcatgaccacaccaaatgaattggcataa

SEQ ID NO: 86403 - DNA, 999 bp, Glycine max
  Peptide Sequence Number=SeqID_178088
atgcctgttatttctgaaggtgtgctaagcgtgggtgtctcgctaagcgcccaaccctttttacagcttatgacctccaggaaaagaagagcttccacctctagacctcaggagccttatgacacatcttggtttgtgacagaggtcacctgggagcgatacgaggagctcaagaggcacaggtggcatagagccttgaccaggcaaccagataatcatattgacttagccctggtcaaggagttctatgcaaatttatatgatcctgaagaccaccccccgaggcagtgcaaggtgcgggggaagctcattaaatttgatgctgctactctgaatgaattcttggagaccccagtggttttggagcctggggagaggtactcgacctactccagattctgcagcactcatccagaccctcaggagctcatcaccatggaagctcctgaggaaggacttgactacactcgcacagacctggagtgtcctttcctactccaacctccccccacttctcacacctctgaccttaacatggacagggcgaggttggtttatgggctcgtcatgaagatggacatggacattagcaagaactggtggaacccagatgatctgacgattatattccctgggtcccgcaaggccagggctagggcttcttcagatgcttccatcccagcactagcaccagctctagcaccagtcgacccctctatgcagaccacagacattctagtggcctggcccggagtccagccttcctctttggggggaggtgaggctcctacagcccaggagccgcagccacaggcaccagaggcagaggcagaggcagaggagacacctgaggagactccagcagacacgcctatggaggagcctggcgaggaagggacttgggatccatggcccactccagctcaggatactcttatgccagctcaggatgccctcacaccacctcatgatgacccaactccggctcaggaggagtga

SEQ ID NO: 86404 - DNA, 441 bp, Glycine max
  Peptide Sequence Number=SeqID_178089
atgaagttgaacttcaacttggaaagaaaattaaggctatcaaattttgaccgtggtggaaatgagagatttcttgaggaagttaagtttgggaaggaagagaacataaggaatattgtctttgaggaagaacttgttattgacagtgctcaagtccccatacctattactgttcaagaaacaactccagtaatagaaaacaatgttctaattattgttgatgacattgttcaagaacaagacaacaatgaggttctccctcaaatacctatacaacaatctcaagaagtgtcattaaggagatctgttagagagagaagaagttcaatcccatatgattatattatctttctccaagaacatgaggatgacattggtttaatagaggatgatgcaatcaacttttatcaagctatgcgtagttctaactctcaaaattag

SEQ ID NO: 86405 - DNA, 276 bp, Glycine max
  Peptide Sequence Number=SeqID_178090
atgacgttctttcttcttagaagtcaaccaccaaccgattcttctgtgcattgcaaaatatgtatcggtcacgtctatgacaatcattttgttcaggtttattttaaagaccgttgtcctttaccgcctctagcattgttatggtctagaaattgccatcctcaagcaaagcagtggccaactccatatattagtaaaatgcagcagtacagaaagttgatgatgttgaaaaaagactatgttgacataactgaagacagaacatgtagcttctaa

SEQ ID NO: 86406 - DNA, 945 bp, Glycine max
  Peptide Sequence Number=SeqID_178091
atggttaaaactagagagttaggtcgtgccttagccagggttatgggtagagccttggggagagaggatcatcatgatttagatgatgttctccaacggcgaaggcctacgacatctgcacgtaggcaacgggaagctgcccctattgctgaggatgatcctatgcttactgaagacgtacatgcacatgctgaagaagttgttgatgatgttgagggatttccaagtgggctgtgtgacccatcagtgctgactgactatggtgaccatgttgtagtcatcgtatggaatgaagaggttcagaaatttgggaggcctgttccaaaaattgaagggctagtcgctgcccttgaagcacggatgcggcacctcagcggcgtgtcccgcgtcggaagcgcactggacacgcattcgggtccgacttcggtgcgacgcggtgtccgttgcttccgccgtcaccggacacgcggttcttcttcgtcttctccttgccgtttcccgcaagcgaaccaaacgcctccaccagtgcacgttgtcgcctccgtttccccggcagcaagaaatcctcattataggaagacatttgtctatgctgccaataataagatcaatggttaccaacctcgaggtgtgagcattgttagtgatggatggagtgacccgcaaagaagatctcttattaatttcatggttgtcacagagagcagacctatgtttttaaaggccatcgattgttcaaatgagatcaaagacaagaatttcattgccaaacatatgagggaggaagatgatgttgcaaaggctaaatttgtgaaagatactttgttggatgataaatggtgggataaggttgattatattctttctttcactagccctatctatgatgttcttacaagaactgatacagaagcttcatctctccatctagtatatgagatgtga

SEQ ID NO: 86407 - DNA, 1220 bp, Glycine max
  Peptide Sequence Number=SeqID_178092
ccgaattcgacaacaccgtacagtacttgcttcgacttactgtattgtgcgttgcattgccccttcatcacatcatcaacaacgttcactggaaaatggtgcgtaattttcttctcattgcaagattaactgcatcgttcacacaccacagaagaatctcttctgattctgaatcagatgatgaaaaccaccacaaaggtgacacctttactgtgtcttacctcatcaactcatgggggttgtccccaagacgggccagggaaatctccaacaggatcaatttgaaaaacccagatggcccaaacgctgttattgatcttctcaacaactatgggtttgaaaaaacccatcttgcaaaacttgtggagagaaagccctcagtgcttcttgcggatgcagagaatacccttttgcctaaactcaagttcttccgttctattgggatttccaacactgacatgcctaaaatcctaattgctagccataatatgttgttcagaagcttgaacaaatgcctcattccacggtatgagatcctaaagagtgtacttcgtgacaaaggggaagttgttagagctttgaaaaatgccccatttagttttacgtatggtgacatgatgaaacgcttggttccaaacattagggttttgagggaatctggtgtgcctcaaggttccatttcttatctgttgatgcattctaggactctagcctacagggaccattccaaatttgtggaagctgtcaacactgctaaggaatttgggtttaatcctttgagaagaacttttgtcgtgggtgttgaagttcttgccattaagagatgggaatcaaggtttgaggtttatgagaggtgtggctggaaccgcgaaatagctcttcgagcagttcgaaagtttcccagtgttgtgaagttgtcagaggaagtgtttataaaaaaaatgagttttctagtgaaggatatgggttggccatcagaagatattgctgaatatcctcaagttgtaacgtacaacttggagaagaggattatccctagattctcggtaatcaaaatgttgaaatcaaaaggtctgctcaagaataatttgcactttagtggcattatttgcataaccgaggcgaagtttttgaagaaatttgtcattagttttcagaaagatttgcctttcttgccagatttctacaacagtttggcaaatcaacagaatgtattatag

SEQ ID NO: 86408 - DNA, 81 bp, Glycine max
  Peptide Sequence Number=SeqID_178093
atgtggacggagcaatcaatgtctacaacaccaaatcatcatctagttgtcaaagttcctcttataccaacaaagcaatag

SEQ ID NO: 86409 - DNA, 746 bp, Glycine max
  Peptide Sequence Number=SeqID_178094
cgaaagaacatggaacagaagcagcactgcaggagttgtcagaaaatggaactgatagagctaagagaaaagttggaagcatattggaactcttgcagcgaatggaaggggacctatggaagctcaaaatccctttaaaaccaacaacatttgcttggcaattgatcaaagatacaatcccaactaaagggaatttgcggaaaagacagctggagaaaggctttgcccagccctacaactattggtctagcaaggaaggcagcaaagcaatctgtgtggtggagagatttaaagcaatcattcaatattccaaattagggagacatgattcaaagcaacatgagatggaaggtggatgggagtggcaattcacttggagaaggtcgatgtttgataatgaaattgaagcagccatcaatttcctaagggacatagaagatatgattattcagcagcatggatctgatgagtgggtatggttaggagatcaatcagggaattattcgacatgcagcgcttataagctgatatgggaggctactgcaacaggccaacaagaagaatggtgtatggaattatggaagataaaaatccctagtaagattccggtgtttgcttggagagatgctgaggaggaggtctcccatctttttttccactgcagcaagatccaaccaatctggagtaaggggaaagaggtggagatattggtggctagcggtaacatgggctatttggaagtttag

SEQ ID NO: 86410 - DNA, 618 bp, Glycine max
  Peptide Sequence Number=SeqID_178095
atgattcaaagttttgaacaacaacaagaaatgtctgtcatagaattatgtgttgaagttgatgttgcgggtgcttctgcaattaatttgacaaattcattattatcatgcggaaataatatgtctcacaatgaatctggtagtgcaacagttggaacaaattcagaagaagattttgatgatgatgattatttaatatctaattcatacgttaaggactcatcagatgaagatgaggatattgatgaaatgtctgacacagatgatgaagctgcccgtttgatcgaaccacttacaattgtgcaatcgggagaaggtggaagtcagactccattctgggattctgcttctcactatagtaatattaattggagtcatcctgaccaagaagaaatttgcggtttagatatgggatcaaattttaatatgggtcaagaattatatgttggtatggaatttgataccaaaagcgcagtaaaaaatgcattacaacaatatgtaatgaaagtgcatcaaagtttcaaagttgttgaatctaaatcgcagaaatatgtcgtctgttgtggaaatagaagtgatgacatcccatgccctttttatatgagggaaattttataa

SEQ ID NO: 86411 - DNA, 333 bp, Glycine max
  Peptide Sequence Number=SeqID_178096
atggatatggttaggagtatgttaatcaattcaactttacccatatctttgtggatgtatgctttgaaaactgtcattatgagaattgtcaaaactggaaatgcaaggttcattgaaaatggtgaaattagtggaagtatagttccacgagaaatgaaaattaaagaagttagagtgcaagttcctttagcttgtgcctctagcagtaaggtgattgctcctttagttattgttacaaacaataatgaagaagcacaacacaataatgagtccatgatacataatgaacctattgtggaagaaccacatgaagtagcattaaggaggtcttaa

SEQ ID NO: 86412 - DNA, 82 bp, Glycine max
  Peptide Sequence Number=SeqID_178097
atgtcagggctcaaccctggacaagcagtggaaactaccaagctggagtacggtaggggcagagggaatttccggtggaacg

SEQ ID NO: 86413 - DNA, 411 bp, Glycine max
  Peptide Sequence Number=SeqID_178098
atgcttttacagagtgcgcaaatctttagaaacctcatggttaaaccaattaggtatgttattttgcaagcactcaagtattggacaattcttcctgctcccctcgatactcccgacctttttgaaactagatcctccttaaaatcaggcatttatggatggggtctctttactcgtagagatatacaagaaggagagatggttgttgagtatcatggtgtgcacataaggcctggtgttgcacaaagtgcaaccaagactacatttttagctgctaccattcgcaaatgtagtggaaatgaggagaaagggaaaacaatatacaatgcttacggatcaaatgggcagctgagaggatcaagcaacaacttgaagctagtcaatttgttaagtgaccaattcatggagtga

SEQ ID NO: 86414 - DNA, 524 bp, Glycine max
  Peptide Sequence Number=SeqID_178099
atggcacatcaccgagggtttcttaaagttgtaaggttatctgaacacaagggaaaggttgttcctgaaattggtctgtgtattgagaaattttgtgattttggactattggagtatgtcgcaacctaccctttggcgggagggcgacgcgagagctcacgggtgcgtcttgtagaagcaaagcttcatggtgaatcaaagaacaattcaagagttcaagataagaatcaagaagaattcaagactcaagaagaaagtttagagtcaagaatcaagattcaaggttcaagatctcaagaatcaagatcaagattcaagactcaagattcaagaatcaagagaaggcttaatcaagataattctagtggaggtgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgaacttttaagtgaaag

SEQ ID NO: 86415 - DNA, 309 bp, Glycine max
  Peptide Sequence Number=SeqID_178100
atgccatccaaagatcaacttgtagaagcaaagcttcatggtgaatcaaagatgattcaaaggtgttttgatgataacaatgatgatgacaaagggtacatcctttgtggtacaagtagagggtacatctacttgggtttgactgagaacaagagagggtacatctcttgtggatcagttctagtggagggtatatccactaggttcaaagagaacaagggagggtacatcccttgtggatctttgcttgtaaaaggattttacaaggttgaaagaaatctcaaggaccgcaggctgcttggggactag

SEQ ID NO: 86416 - DNA, 438 bp, Glycine max
  Peptide Sequence Number=SeqID_178101
atgtcagggtggacgtggccaaagtgggcctcaggacttcatatgtcaaatttgaggatggcctttgttgagaggacaaaaggagggacctgtaaaacaaaggactctgatgctcaaggtgacgagtttgtggagcgcctaagtatggacgagtattgtccattgtcgggtgtgcttgtgaatcccctaagcttggacaagtgttgtctgagttgcttttgtcaagttgtccgtgagggacatgtctttggcgtcttaggcgtgtgtgacacatgtgcaatactcttgcatatgtgtcagtcgcggagtgggcacttattggagtcgcggttcgtgcatgagtgggagagcatgatggtgccaaattttagggcaccaattcagctccgaccagttattgaagagttcgtctctcttttaaatggagtgaacgtttga

SEQ ID NO: 86417 - DNA, 873 bp, Glycine max
  Peptide Sequence Number=SeqID_178102
atggctgaagagcaacctcgacgagtgaccctggaagactactcaagtacatctgtgccgcagttctttactagcattgcgcggctggaggttcaagcacaaaatataacctatccacattcattaatgcaattgattcaaaacaatatttttcatggtctgcctaatgaagacccatatgcacatctagccacttatattgagatttacaacactgtcagactggctggtaacagtcttaagacttgggatgaagtggttgaaaaattcttgaagaaatacttccagagtccaagattgctaaaggaaaagatgccatctcatcctttcatcaatttccagacgattgtgttatatgtggtggggcacatgattctggctactgcattcccacagaagatacaacacatgaagccacaacaacaagggcctagtctctatgatagaacaacaaagctggaagagactcttgctcagttcatgcaagtatccatgtccaatcaaaagagcacaaagtcagccatcaagaatctagaagtccaggtgagacaattggcaaaacaactgacagaccgaccgtcaagcagctttgcagccaacacagagaagaatcctaaggaggagtgcaaggagtttatgagtagaagcaaaatggtgagcatgaatgaaggtgagaagaggataggtgaagaaaaacaacaattggtgactgaaccagaaattgacccagtgctagaacctttgagcgagactgaggaagaagtggaagctgaagatgatcagcagaaggagataccaataattggaggaggtgccatatccattggtaccaacaaagaaagacaaggaatgacatctggctcgtttccttga

SEQ ID NO: 86418 - DNA, 423 bp, Glycine max
  Peptide Sequence Number=SeqID_178103
atggaggagaaagggcacacacgaaacttcaagaagaaagcacaacacacactggaagagtttagcaacttgggaagaagtgagaaaaagttaataatcaacggtcaaaagcctactcctgcattttcagctgcaacgctagcctgcatcttcagaaaacactgcaaccctactccatcagaaacactgcaaccctactccatgcctgaaggtgtctcgccaatgggagaggcgagaccttcttcacgtggctccacgtcagctgtctcgccattggtgatggcggcacccatgcatgcacgccaggtcagccagcttctcgccattggtgatggcggcaccggtatctcgccattgctttcggcgacacccctacaaaaacagaccccctttacaaatagtttgaaaagggaccctgtttga

SEQ ID NO: 86419 - DNA, 925 bp, Glycine max
  Peptide Sequence Number=SeqID_178104
atggcaggagctggtgacaatggtggtgtatatcatcaactggacggatctcagcgcttatttctggacgcgatgactacacaaatgcaacgtttgttgaaccgtaacaaagaagagctctatagacgaatagccaaatcttccttgtttactcttaaacctctatcccctagagaagagattcctcatggactgccaccttcaagaggcatagaacatcaagatgcacatgccaaagtggaatatgtgaaaatattgtatgaccaagtgaaggtgcaaattgcaaagaagaatgaaagctatgccaagcaagccaacaagaaaaggaaggaagtggtacttgaacccggtgatgatcctggacatttgagggcaaatgttttccaaaaagaagggaatgatgagaatcctgaaattggccaaatacaggctaaaggcccaagtggagaaagttcacatcatgaagatgatagtgttgatggaatatttgatacagacgatgaagtcactgacatcattgaaccagtttcaattgttcacccaacagaaggtgtacaaggaattcaaaatccattttggaatgatgttttgcattataacaatatcaattggagtcatctagacgaggaggacatttgcggtttggacatgccatcaacttttaatgttggacaagaattatatgttggcatggattttgacagtaaagatgcggttgttgaaactaaatcgcacaaatatatcgtttgttgccccaacaacagtgcagagtctccatgccctttttatatgagggcaattttatctaaaaaaactgatgcatggaaagtgacacaatggggtggaccgcacgcatgtctaaatatgagtatgacacaagaccatgagaagcttgattcagatttaattgcgacttgcatagtag

SEQ ID NO: 86420 - DNA, 279 bp, Glycine max
  Peptide Sequence Number=SeqID_178105
atgtcagttctagaattgtacatagaaaaggatgttgctggtgattctatgtttgattttgcaaactccgttacgtcatgtggacataatctatctcataatgagtcagaactgccaagaaatataagcaatttacatgatgatgaagatgatgattatcttgcatctaactcatacgttgaagagtctttggatgaaatgatgagaatcctgaaattgaccaaatacaggctaaaggcccaagtggagaagggcgaaggcccaagtggagaaggataa

SEQ ID NO: 86421 - DNA, 603 bp, Glycine max
  Peptide Sequence Number=SeqID_178106
atgatgcttggtagctgcaaaggacctacttcatttgaggacataagaactattgcaaatatccaatatgcaacatatagagaagcatattttgccatgggtttcgtacaagattacagaaaatatgttgaagcaatcaaaaaggctaaggactggggcacaactaattatctaaggaaattatttgtattaatcctattaacaggtgccatgagcaaacctgaagaagtttggaaccaatgttggcattggctggctgatgacattgcatatcgacatagcaaatcaacaatcaactcagaattgcatatcaatgatgatactcttagaaatttgacattgattgaaattgaacaactattgcacacaaaccaaagatcactgaaagactatcctacaatgccataccctcaggatatcaatctgacatcctacctacagaacaacttggtattatcagagcttgattacaaccatgatacaaccagatcagaatttgagcatctttttgcatccatgacatgcaatctacctattcatatattacaaattctattgataacagttaacatcttactaaaagatgctcatcaggaattataa

SEQ ID NO: 86422 - DNA, 210 bp, Glycine max
  Peptide Sequence Number=SeqID_178107
atgatgacaaaaagctcaaaggtcaatcaaataatgagttcaagatgttcaagaaggaatcaagaaaaattcaagactcaagaggaaaagttgaagaacacttcaagattcaagaggaaagttgaattcaagaatcaagattcaagaataagatcaagattcaagatcaagattcaagactcaagattcaagaatcaagagaagacttaa

SEQ ID NO: 86423 - DNA, 315 bp, Glycine max
  Peptide Sequence Number=SeqID_178108
gatatacccgatgttgaaggagataaagaacatggcatcaattctttatcagtacgcctaggtcagaaacgggtattttggatttgcgttttcctttttgaaatggctttcggtgttggcctcttggcaggagcatcatcttcttaccttcatactaaaattgtcacgggtttgggaaatgttgttcttgcttcaattctcttgtaccaagccaagtccgtagatttaaacaacaaagcttccactggattcttctatatgttcatttggaagctattgtacgcggcattctttctcatggctttaattagataa

SEQ ID NO: 86424 - DNA, 690 bp, Glycine max
  Peptide Sequence Number=SeqID_178109
atggagattattgataacatacttcttctactttttgccgctcatgatacttctagatcagtgttatcattggtcatgaagtatcttggacaattgcctcaagtttttgaacatgtcttgaaagaacaacttgaaattagtcaagggaaagaggcagggcagttgttgcaattggaagatgttcagaaaatgaaatactcttggaatgttgcatctgaagtcatgaggctatccctacctgtgagtggtgcttacagagaagctaaagaggatttcacctatgctgattataacatccctaaagggtggaatacaagtgcatgtatgctgaaaggagaaaatcttgatgtcgctgcacttaagcttgcaaggagcctcaatgccatcgtgctcacactcggagggaatctcgatgccgctgcactcaagcttgcaaggaacctctccgctgcacccatagggagccttgacatcatcatcacatttgcacttgcaaaaccctcactgatcgttgctgcgagcttcacaccacgcactcccctcaattcgttggtctcagaaaccagtgcgaagatgggtggaaatgaagaagccttggtcggtggcagcggcatagtggataggtggtggcgacaacacggtgcagttgcgtgcggtggagatatggtggtacacgatgggggcggatag

SEQ ID NO: 86425 - DNA, 231 bp, Glycine max
  Peptide Sequence Number=SeqID_178110
atgcctcaccaaaagaggaaaactctagatgaggcttcactgctatcaagcgagtcggagacccagcatgaccacaaatcgacctccactccctatggcttacacagacccgggtgtcatgtatgcatagagcaatctaagaattaccccaccctacttgccaagcaaacatacaattcccagatagacagatgcacaccaagagacaataacatggcaaaggttatataa

SEQ ID NO: 86426 - DNA, 230 bp, Glycine max
  Peptide Sequence Number=SeqID_178111
atggcctcatccaactttccatttcttgagggaaattctattaataggcctcttatgttcaatggcgagggttattactattggaaaacccgaatgcatatccttattgaggccatagatttaaatatatgggatgccattgaagttggtccttttattcctacaaaggtagtcggaaatgcaattatagaaaaaccaagagaagaatggatgatgatgaaagaagaaag

SEQ ID NO: 86427 - DNA, 450 bp, Glycine max
  Peptide Sequence Number=SeqID_178112
atggccttcataggctctttcactgctcctgtatcgccagtgcctccaacaacgacttacactcaaaatgacgtcatcgtttcctcctcctcctccacattcgaaaaattccttcgccagcgtatacgaaggttcttcaaagagagggcgttgaggttcgtcaagataaacgtcgacgttttcgcggagcgggagaaggatctaagagagagaacggggagcgtgacggtgctgaagatcttctttgacgagagactgatcggaggcttggtggagctgaacgcgctgaggaagaacggtgacgaggagttggaaaggaggctgacgacgccagtaggcgaggggccattggcaccgatgtatggattcgacgaagcgacggaggtggaggaggcagcggtggcgacgtacgttcgacatcatggttgtgctccttccaaggtacgttga

SEQ ID NO: 86428 - DNA, 342 bp, Glycine max
  misc_feature (341)..(341): n is a, c, g, or t
  Peptide Sequence Number=SeqID_178113
atgggtgaagtagacgaggtgcaagagcagatcaaggccgacatagaggctctgaaagagcaaatggccacaatgatgaaggtcatgatgagcatgaagaagataatggaggtcaatgtggctacagttgctgctaccagcgctattgctgaggtggacccgactcccccatttggcctcaaccaaataaatcatctcatctcggatatggtagggcagagaggtaaagaattgggaagtgcaggaagcgcccattttgtgcaagttcaaaacaagcatatgttctcgccatatggcttgcctcccaactatacaccacccaatggggatcctctagagtna

SEQ ID NO: 86429 - DNA, 189 bp, Glycine max
  Peptide Sequence Number=SeqID_178114
atggatatctctatttcctttggaaacagacttagaaaagtgcgaggggataataatgatgaagattgcaagcatggtatgatacatgggacatgcaatatggatgctagtaaaattagaaaagtgcatgatgtggttggtgcaaataccaggactatgtcttcatttggtagcataggttacatgtga

SEQ ID NO: 86430 - DNA, 1313 bp, Glycine max
  Peptide Sequence Number=SeqID_178115
taaccattagggaacaagtcaggaatgagattcaagaagaaaagaagcgaagtctacaggcttggaaaaatgagctgaaggatgccatcattactgacatatttgatggagataaggtctcagcaccggctaattttgatttaaatgtgttaggtgcacgcgtgagcacaaaggagagcaatgctgaaattgttgtgaacccgtctagggaagaacatgttggtcgtgtaacaccacctatggggttgtacgtccaaagtcaagattgtacaaagctggtggcgttggtaaaaattcatgatggaccatctaccatacattgcgtagcgtatgcagatgatgtcgtaagggttagcatcgaaaaagtaattgatggtgaagctgaagttccatttgcgacatcagaaattaagtatgtgagagaggcccttaacacattcattgcatggccattgcctttggtaaaactggtatcaaatgagcattcaggcgtcactccaaacaaagttgtgaatgctgccaaattaaacaatgattttccaaaacaggaccccttgcgtgagttgattaagacccttgttgagatttacaacaagtctattgagtttgtgtgggatcttactgaatttgggattccaaatcctcaatctatacacaatgcaaaggacagatgtgggcaacgtgaagaatatattgaaaactggcttaaggaatcgcaacgacaactgtacattggagtgcatagaaggcctgatgttcatatcaaaactgcaattaacaagaaattaaacacgactgctgatgggaaagttcctaaaactgcaccccagtggcttgaactgaagactcacgttcaacgcggaggctatgagtgtgggtattatgtgatgcattggatgtggaacataattggcgcgaagttgaagagtgattggaatgtggtgctatcttcatgtatgagaggtcgcaaacatacagtagttactgcagagaccatcaagggtaggctcttgatggaaatgaattatatgctagcatatggttctgggaaagcttctttgaggctattatggaattccggtagcctagatatacttctcccctttgagcccgaccttaaaagcaaacgtttcaacgttgttgctgacgtcaacaacgtcttcgaaggcgaagcttcaactacggccatgacgtcagccccgtcgcaggaatcacgtccttctaaaacggtctacaacgatgtcgcatttaaagacgggcgtgcatcgtcgttgaacgccgacaaggatcgacgtaaaacggcttttttctag

SEQ ID NO: 86431 - DNA, 354 bp, Glycine max
  Peptide Sequence Number=SeqID_178116
atgaggttgtttatgaatgtacccaaatacaggaaaccagaggagaaacagaatcaaggttccggtctgaacaggggagggatgctcttatgcacaagctacattgacaaacaaatcgatttgggttcccaaagattagtgaagaaatggaggaaagtacccaaggaggcatctttgttcaaccttcaaaaggctttcttggggttaggatggtggaagaggttaaaccttggagggaaggaagttgttgttggcaaaggaatcatgtcatcgttgatgatgaatcagtcgaagaagaatggtgaggtcaacaagggatttgccttcgctcctacatatcctcagatgcaatga

SEQ ID NO: 86432 - DNA, 408 bp, Glycine max
  Peptide Sequence Number=SeqID_178117
atggttacccaaaacaatgagagtagcaaatttttgctctgggaccgtgaatgtactaaattgattggtgaaacagctgatgatgtgaatagggtcaagattgaagtcaggattcaatcaaaattcaaaaatgcagttgtacttagatactcaaaagacctggatttgatcaatgttgttctcgagatgctgcctgatagtgaggcatgttccaaaatagatccttccaatgttgattgcaatgatgctacgcatgctgaatttgaccatgatccggttgcgggattgcctttaacacccaaaaagcggatgtcatctgatgaagccgatgaagagttagggagctctcaaatttcgccagcccaactatcgtctaacaaattaacaagacattctcataagagctaa

SEQ ID NO: 86433 - DNA, 618 bp, Glycine max
  Peptide Sequence Number=SeqID_178118
atggcaggaaagaacgattaccaactccccctttcgaatggtatcttcctcaatcctcttggaaaagtgaatgttacagccatgagaagacattgtttaacaaatgaactagactttggtgcctcaaaggattttgcacaagtgcagaaaaatactaggcatttgctggttgtggaaagagcagtgcagaatgagttctggatgtttgctagtagatcccaacggaattgttactgtggtctttacgtgagaaaagctgtgattttggttgatcttgggaggattgatggggacccggtgttgagagaaacgaggctatgggctacgtgggagtacgtgagctcagttggaggtgggcaacaggggatggtgggtttatgcgcgcattgtggatgtggaaaacttgttgtgcaccatcgcccgaccgccacctatggtacctggagatatgtcgcgggggtcaggagaccttggggacgtcaggcgagctcctggcagtcaacagataaaaggaaaacaagaccacaaagcaaggaggcttgtggtggctggccagctgaggctaagatggtctctggtaatcgattaccaaggggtgtaatcgattaccaggcttga

SEQ ID NO: 86434 - DNA, 273 bp, Glycine max
  Peptide Sequence Number=SeqID_178119
atggtaatagcgatattgccatgcatgggaaccgccaatcaaactggcgagttccaagttgcaggttgtaggcttcaggtggcaggttgcaggcttggcagacatgcttttttcagatggtacatcatgaattcggttataacagtgttgtatttcaatggaagggtatatgaagaaaatgatagtgtaatatttgaaggcaataaaaaagcgattcagatcaaacgtggaattagtttcaatgcgttgaagaaaaaattggagataaggtaa

SEQ ID NO: 86435 - DNA, 186 bp, Glycine max
  Peptide Sequence Number=SeqID_178120
atgtgtcttgttggtatggcttctacaagtggagatggcactccaccatctccaaaaactgcaaggctcatggtggagatgattaaacttggtgatcaaatgagaaggatgagttatgacaatgaagaaaggatggagagaatgaggagagtttgggaagaatacacaggaatagtgaagctttag

SEQ ID NO: 86436 - DNA, 201 bp, Glycine max
  Peptide Sequence Number=SeqID_178121
atggctgagcctctaatgaataagctcgagacactttgtgctgttgatggctgctcttacgtcattttctggcaaattcatcctcaaaattctttatcaattgggagaagagattatcgacagggtttcataggtccgtttgatggacgaaggttttcaccaaataaacaagataaagtgcaaattttaaattttaagtaa

SEQ ID NO: 86437 - DNA, 237 bp, Glycine max
  Peptide Sequence Number=SeqID_178122
atggaggacgacgcgggtggagaagaagaccttgacgcggggagaagactgctggacgcgtggagctctggtcgcggaagaagaagaactcgaagcttcatgctgcttccgatgctcctaacgcctttgttcacgatgttttggccctctgtgacctcttcaccgacacacgcaaggacgacgccactgttcaggcacgttgtggtggaggaacttgcgtcgtgggacttgttctag

SEQ ID NO: 86438 - DNA, 930 bp, Glycine max
  Peptide Sequence Number=SeqID_178123
atgtaccagggtaggtatcgggccaggcaatgggttgctgcagctcgggcatacctacttcatttggttggttgcactcttttcgctaacaagagtgcaacccatgtccatgttgtgcacctgcaggcattcagagacctggcacaggcagggacattctcttggggagcggccgctttggtacacttgtacgatcagcttaacgaggtgtcgcaggcccctacacgtgctggatttacgagcactttccatcagtccacaggtaaggcccagatgatcggcattaaggaagccccttacagagcacatattgatgccctgacagtcactgacgtctgttggatgccgtatgctgagcatcggggagttcggggctatgacttgatctcctcgtacatggggcaagtcagatggggtccgatcatcgtctaccttcgaccagagagggtggttcggcagatggggtacattcagacagttcctccgccaccggttcgtgattcgttgacaggtactgatatagacgaccggtgggtacagttttcagatcatgtagcgcctacaggggagctctgtgtagttcctgggcaagtggccccagactacatggagtgcttttttcagatttcacacccctttgtgacgccggcggaggacattgctgagcccagacctgcgcctccccttcccactcatgatgatgacttcgtggagccacctgtcgcccaggttccaatcgcgtcagatccccctacgcattctgtggttgattgcacagcatgtgtcaggatgggaaggattgctgagcatttggagcgcgtcatcaacctcaggatggtgactgcaagaattgacttatatgatatcatggatctttgcctgaggatagctagagatgacgacccagatgacagtcttaggccgcgatag

SEQ ID NO: 86439 - DNA, 1476 bp, Glycine max
  Peptide Sequence Number=SeqID_178124
atggccgcctcagtaccaaccgttggagccgttaacattgcacagttgaaactgaatggctctagcagtagggtgacaagctcaccattctttggaacaagtttgaagaaagtcaattctgagagttcaagccagaggggtgtgtgtcggaatttcaaggtttctgcacagattgaatatgatgaggagaagcaaacttcaaaggatagatggggtggacttgcctatgacacttcagatgaccagcaagatatcactagagggaagggaatggtggacactctcttccaagctcccatggaaagtggcactcactatgctgtcatgagttcctatgattatatcagtgccggacttcgccagtacaatttagacaacaccatggatggcttctatattgctcctgcatttatggacaagattgttgttcacatcaccaagaactttttgaacttgccaaatattaaggtccctcttattttgggtatttggggaggcaaaggtcaggggaaatcatttcaatgtgagcttgtctttgccaagatgggaatcaaactacaatccaaaattgcgttaactctttggcctattgcctttgaattcagccccatagtgatgagtgctggagaattggaaagcggaaatgctggagaacctgcaaagttgattaggcaaaggtatcgcgaggcagcagacattatcagaaaaggaaagatgtgctgtctcttcatcaatgatcttgatgcaggagctggtaggcttggtggaaccactcaatacacagtcaacaaccagatggtgaatgcaacccttatgaacattgctgacaacccaaccaatgtccaacttcctggcatgtacaacaaggaggagaatccccgtgttcccatcatagtcactggcaatgacttctcaacattgtatgctcctctcattcgtgatggacgtatggagaagttctattgggcacctactcgggatgacaggattggtgtctgccaaggcattttcagaacagatggtgttctaaaggaggatattatcaagcttgttgacaccttccttgggcaatctattgacttctttggtgccttgagggccagagtctatgatgatgaagtaaggaagtggatttctggtgttggggtggagaatattgggaaaaagctggtgaactcaaaggagggacctccaacatttgagcaaccaaagatgactcttagcaagctccttgagtatggaaacatgcttgtccaagagcaagagaatgtgaagagggttcaattggctgacaaatatctcaatgaggctgcacttggagatgcaaatgatgatgccatcaagactggaaacttctatggacaaggagctcagcaagttcatgttcctgtccctgaaggttgcactgaccctactgctgaaaactatgatccaacagccagaagtgatgatggaagctgcacatacaaattttag

SEQ ID NO: 86440 - DNA, 204 bp, Glycine max
  Peptide Sequence Number=SeqID_178125
atggaaataacaaattttggcatagtagtgggaggtagtagcattacaagtggttctagcttgcctgttacttcatgggcttctgttattgttgcggaggcagagccatttgacaacgatgagaatggcgtagacagtgaggaggaagggttggtcgagctccatgttcctgaccttggcggcaaacacgacgaaaaaggataa

SEQ ID NO: 86441 - DNA, 450 bp, Glycine max
  Peptide Sequence Number=SeqID_178126
atgagattgcatagtaagcagaacctgggagtatcaaccagcatagtaaatatggttatcgtcaccattcaccaatcattactggaaatgaagacttatcaaggtaatccttgtggcgtctaccctgacttatcttccttcactggaagtggcgtcattcaaaactccgtagactgtatcaaacgattcgctcctagtcaggggcttgtggggatagttggaagtgtatcagagaagtattgggatcatcatttgggggatatcagcctggcaacaatggccggtgtgaaaattttcatcacaataataatagaatcccttagcatgtctctcattgtattgacaagatgtcaagtgtttaaaaggaagattaggggatcaaggagtggggttagggtttggagtgggtgtgggaggtgtgaaagaatgggtaaaaaggcttgggtttga

SEQ ID NO: 86442 - DNA, 201 bp, Glycine max
  Peptide Sequence Number=SeqID_178127
atggaagacgcacccgtgagcctcgtgtcgccttcccgtcgaagggtaggttacgacacccctctatgccaaatttttaaaagatatgctaacaaagaagaatcgattgcttatccgctaagcgcaaaccttgcgctaagcaccatctcttcacgcgctaagtcgagcttgctcgcgctaagcgcaaagacccctgattga

SEQ ID NO: 86443 - DNA, 930 bp, Glycine max
  Peptide Sequence Number=SeqID_178128
atggcatatactcaaggtgtttatgatgaagcatggagagtaaatgtccgtatacaaggatgtgaccttgagcatgggtatttgtgtggcaccatggaagctcttaatgttcctatggcagacacacctgtagtaacattctgggaaggggagatagttgatacaaagaattatactttcttcactggcaaatgggaggcatctcccgaggatgatataaggcactggtctaaatttccatctttttctcccttattgggccaagtggaggctgatggtggcaagtctttggacctgagcaactatccttacatattcatgaggctcttcgctatgcgaaggtatgggggagggatattgtgcgcagccttacccttgcatatgcaaagaggctgtttccggattcgaacccatgaccaacaagtcaccaaggcacaactttaccgctgcaccagggctcgccctcaccaagagaaaatgataatgttgaaaaaaaaaaggtggaaggagcagtactttgtgaatgttggaaccgactgtggattaaccatagccggattttactacatttgtttctcttgcagcgatggctctatcagtggattctattatgatcccaatagcagagcacgcaaaatggacttgacctggtgggctgggctggccagccttcaagtagggccaggatgggctctcaaaaagattatggttagaaccaaaggtttaggtcggactttaggcaggattataggaagagccctaggagataagctagtggtgatgcggatgaatccccccagcagcgaaggcctacaacatctacacatagacagtgagaagttgcacctgttgctgaggatgtttagcatgtggatcatgcagatgatgaggtccatgaacagcctaaagaaacagctgctgatgatgtag

SEQ ID NO: 86444 - DNA, 192 bp, Glycine max
  Peptide Sequence Number=SeqID_178129
atggcggaatggcatcgcgggtttttggataaacgccaccaaatagcggtggcgttgcgggggatgagcaccagtgcgacgaacagcaccagcaccacacaccagcgcaccacgcacacgacgaacgaacgacggctgcggcggcaacggctacagtttgcgacggcaatgtgccctcttttaaatggctga

SEQ ID NO: 86445 - DNA, 342 bp, Glycine max
  Peptide Sequence Number=SeqID_178130
atggaatttggtccccagcaagcacttgatcacgcacatgatcgaagtctgaatgtccaggaggtgacggcgaggctgccgggaccggaagggacaactcccgacgccggtacggcggcgcgtgagcagcaggcgccggaaatcgcgcggaggaaaggaggcgcgtgtgggcgcgtgcggcggcctacggcggcgcgagttccaggggtggatcgcgcttttcgaggcgatccgaaccctggtctcgccggagaaaaccaccggagttggcggcggccggcggcggcgaacggcggacggcgcggcggcgtacggcggcaacctgctctgatgccaagttga

SEQ ID NO: 86446 - DNA, 240 bp, Glycine max
  Peptide Sequence Number=SeqID_178131
atggctggtacattcttccttttgaaacagcaaaatagtttagagattatgaacgggacgccacaccatgacatccctgccattacacaaccatggttcaacctgattcatgaaaaaaatttaagacccggagatgaggtagtcttttactaccgttttcatgaccatgcatgggagctgctcataaggaacgccatcgaatggaacaacagcaacaccgaccttgactttgatgaataa

SEQ ID NO: 86447 - DNA, 234 bp, Glycine max
  Peptide Sequence Number=SeqID_178132
atggcattggaatggagaaggaagagagagaggagatgccacttcaaggagaatattagtctagaagaagctcaccaccatatgagagcattgtgtcccgacgtccttcagcacaaggttcctttaagcacttcacctagccatctgctcccccgaacacaaggttcaagatcatcacaggatccaaacaggaacaacaaaccgggagtgagttatcatattcctaactactag

SEQ ID NO: 86448 - DNA, 1143 bp, Glycine max
  Peptide Sequence Number=SeqID_178133
atgactaatgcaaactgtccgcaagagtcattgcattcagtctcaaacgggaatctaaggtttgacgctgcacaaactcttgtgtcaaggttccttcacgtttcttcttttttcgaggatgagggtgagagccccgtcgagtctgatgaaataaaagtccaaacttggagcagccaacactacaggaacgaacctgtagttgttgttgctgctccatggttgcaaaagtattctagttttgatgaccagagtggggagcagcctctgcttttgcccattcgaagcttgaaatctcgcttatctgaaaaagatattgatgttcaatctctgaacatgtcaatgagttctaaaagattttcaagctattcgaatagaaaagcagaagttgaagctgttgatgttgatgttgacgttgatgttcaatatctaaataggtcaacaaccttcaaaaggttttcaagcaattcaaatagaaatgcagaagttgaagctgatgctgctgatacagatgttcaatctctaaataggtcaacaatttctcaaggattttcaagcaattccaatagaaaagctgaagttataatgttgtcttcaaacacttatgttataatgttgtcttcaaacgcagaggattcagtgaggaagaagggcttctataagtcttgtcgtccaccacctccgccaccgccaccaataatgtttcagaaatcaatgttcatgaagccaaggttcgatggttcatccaacaaagcaccttccttcaataaggagttgaagagatgcttcacaagtgagagaaccacaccagtgggaaagaaaagtcatgaagaaaataaatccatgcaaggcacattgtttagaagtaacaagttcatggggcatgcaagcgtgcctcttgtgtcacagccagttgagaaagaaagccttcttgtcgaatctgatgatgatgatgacgacaatgacacagaaaccgaggaccaagacgttcaaggaggaagaaccgttgctcagaacaatgacaggggaaagggtccacctgttattggtggagaaagttcaaaaataaatggtgatgaaggaccagatgtggataagaaggctgatgagttcattgataagtttatagagcaagtaaggctttag

SEQ ID NO: 86449 - DNA, 474 bp, Glycine max
  Peptide Sequence Number=SeqID_178134
atgactcctgccgcagatagcgatccaggtccagcgctgcggccgatgccccacccacaatcgctcccaacagtacagccagcacaatcctgcgcatccttcccccatggaaaaccggacaccctaaaaaacgacggcaccgttgccggtgccgtcgttaccactaccttggagagagagtcaggacgtgggttcggggggcgtgcgccgggtcagtggaccccgcgcaccgccaacgtgagggccaggatgctgaggatcacggcaatgcggcgccagcaggcgtgcacccaggccctgcgcggtcaaccacaggcagctggcggtgaccacgccagcggcgaaggccatgcgggcgttgccgaagttctcggcgatcgaaccgatcaccatcatgtccagccagaagtgcgggttgatcagcgagaaaccgaccgcggccatcagcaccccgcggcggctgccgtcgtcact

SEQ ID NO: 86450 - DNA, 210 bp, Glycine max
  Peptide Sequence Number=SeqID_178135
atgacaggtgctggtgcaataacttcatttggttaccgtaaggatcgtgatgggcagtggttgaagaaggacatgcagcctctgcaagacgagcgtactccctctcctccgcctcaacaagatgattcctcagcccttatgaatgaacttgaagaggatgtgggttatcttcgtcggtgcttcgaccttccaccaccttcccagttttag

SEQ ID NO: 86451 - DNA, 186 bp, Glycine max
  Peptide Sequence Number=SeqID_178136
atggttgtgaatgagggttggacctggatcaggaaggtgaggcccaaacggattcttcggagtctaggccttggggctaaagatactcggtttgagtgctcctttaagcccatgttgatcccatgtggttggggcattctcgcaaaacagagtaatcctgactggtcaccttatgatgttacttag

SEQ ID NO: 86452 - DNA, 261 bp, Glycine max
  Peptide Sequence Number=SeqID_178137
atgttgcggaaccttacggatcacgtaatcatcccttttttgccttccaaaatgttacggaactttacggattgcgcactaacacttccttttaatttccagcatgtcacggaacttcacagattgtgctacaacgtttttcttttggcttcctgcatgtttcagaacttcacaaattgcctaacgatgggtgccaaatacctcgaagtggtcaaacgagggtcgcatcccgacatcggatggtccccggacgaaattagg

SEQ ID NO: 86453 - DNA, 162 bp, Glycine max
  Peptide Sequence Number=SeqID_178138
atgggtggtctgaaaaagggacgcatgaacgaaaacgcagttcaaggggctccgaaaaagggtagagaatggagaattgcactaagcaatcactacgcatggctcgaaactcgtgggtggaggatgcatgaacgaaaacacaattcatggggctccgaataa

SEQ ID NO: 86454 - DNA, 240 bp, Glycine max
  Peptide Sequence Number=SeqID_178139
atgacgctgttaatggtgcatgttgtgtatgttcgtggggggtgcattggccttgtcggatgtcccttttgtgggaaaatagagtggttaaagagtctaagcatttccgaggggatgcttaggagctttaattcatccatggtcattgtacttgatggtgcccacgtttatatgtcgtatgttgtgtatgtccatggggggtcattgaccttgtcggacgtcccttgtgtgggaaactaa

SEQ ID NO: 86455 - DNA, 207 bp, Glycine max
  Peptide Sequence Number=SeqID_178140
atggaggccatgaaagagcaaatgaccataatgatggaagccatgatgagtatgagaaaaatgatgaaggtcaacacggctacagtcgttgccacaagtactaccactgaggtggacccgactcacctgtctggccttaatcaaaatgtcgataactctgcttccatacccattgagagccaacaaccccaatctggtcatgcatag

SEQ ID NO: 86456 - DNA, 177 bp, Glycine max
  Peptide Sequence Number=SeqID_178141
atggtgatggaggagcaagaagaaaacataggggaagaaggagaagaggctggaaatttctggaggaaagagagagaaggggtatcatccccttcgaaaaagcatattgcgacagtagggactaccagcaacaatatgttatcaaagagaaaaactctatatgagggttcactgtaa

SEQ ID NO: 86457 - DNA, 468 bp, Glycine max
  Peptide Sequence Number=SeqID_178142
atgtctaatcataagagtactaagtcagccctgaaaaaccttgagattcaagtgggtcaactggccaagcagttagctgagaagtcatcaaacaactttggggcaaatattgagaagaatcccaaagaagagtgtaaagttgttgtaacaagaagcagaaagcttatggtggctgaggataaggatgttgttgctttgaaggagcatgctcctttaaaggacactactattaaaaagaagaatgaggtaactgatgcaatgagtcagaggggggaaaaacaaataatggtcgaagaaagaaaaataaaagaccaagaaaatgaaatagaggtaggaaaagaaaaagaaaaagaagaaaaagaaaaagttaaaaaaaataaagatgaagaaaagagtaggaatgaaaaagaaagagaaaagaggaaagaaaaagcttcagataagggtatggaagtgccatatcccatg

SEQ ID NO: 86458 - DNA, 382 bp, Glycine max
  Peptide Sequence Number=SeqID_178143
atgactagaggcaatccatctgacttacaaccctttgatcctgagatagataggacatttcatagattagttaggcatcattttataccttttgatcattctgagcattccataactggtgaatctgtgcattctgttattggtgattttgagcatcctgatcttgagcattataattttgagcattctgattctgagcattctgattttgcacattctgagaacatggcacaacctccacctcgtgagaggactctaagggaaatggctgcacctgatttcacctatgaaagcttgtgcatccaataccatgatgaggatgtcccatatgttcttaagactggactgattcatttgcttccaaagtttcatggccttgcag

SEQ ID NO: 86459 - DNA, 192 bp, Glycine max
  Peptide Sequence Number=SeqID_178144
atggcgggagggaaatgtggggattttggtggatctgcagctcgcccaggcaagttgttgcttcaacctgaagtaaccttgctcgcccagaaattggtgttgaatagcttaattcggctaacgagaatcaaaatgttagcgaatgatagtccccggacgaaattagggtctgacaccatgatactagagtaa

SEQ ID NO: 86460 - DNA, 339 bp, Glycine max
  Peptide Sequence Number=SeqID_178145
atggtttctagaggtatcatccccttcgaaaaatatattgcggcagtagggactaccaacaacaatatgttatcaaagagaaaaactctagatgagggttcactgttatcaagcaagtcggagacccagcatgactacagattcacctccactccttatgttcccatggacccggtccccagtggcgtcgccaactgtcacaacctacccttcggcgggagggcgacccggggctcgtgggtgcgtattccaagaaaggaaaatgcgcggagtcgccaccaacatttattcgaggaaaacgtcggaaaaaccggaaaaggtgtggtctacgaactttaa

SEQ ID NO: 86461 - DNA, 348 bp, Glycine max
  Peptide Sequence Number=SeqID_178146
atggcgtgccagaccgagcagcagcccccagctcagttccagcggcgccgcgctgctactggcggtgccgcacaccgcaatcagccgttcggcacaggcgcggcctatcagccgggcgctgagcggcgtgcgttcgcgcatcaccaccaggatgtcggcgtgggcgatgtgagcgaccagttcatcttcgtcggcgtagtggcggtgcagcgcgctagtttgtacctgcggttgcagcgatgcccagtcggccagcgacagggcaacattttgataatcatcaagaatgatgcagttcaggctcatgatggtcctcaacgggaagcggttggcgcccctgctgattaa

SEQ ID NO: 86462 - DNA, 474 bp, Glycine max
  Peptide Sequence Number=SeqID_178147
atgtcgcttgcagccatattttcaatgagatccatggcttctttaggggtcttcaatttgattttcccacctgcagaagtgtctaatagctgtttggactgcggtcttaacgcatctataaagatattgagctgtattgaatctttccaaggcctcactcaaagattcatcgggaaattggtgaaaagaagagatggcagctttgccttctgtagtcttagactccagagaaatatttcttcagaaatttctccacaacctcatccctgtggaagcaatgccttccaagattattttgatgatgccaaaatatcaagagttaagaaaattccaaagtttcaagatacaagattcaagaatcaagtttcaagaatcaagaatcaagtttcaagaatcaagattcaagattcaagatcaagattcaagactcaagattcaagaatcaagagaagactcaatcaagataattactaa

SEQ ID NO: 86463 - DNA, 204 bp, Glycine max
  Peptide Sequence Number=SeqID_178148
atgtcgagaggcttggagttggatcaacgcgttgcatcacaattttttgctgagagactgagagtgagagtgagagtgaaagaccgagaacgggagttgcaatgccaagaggagagtgagagtgaaagaccgagaactggagtttcaacgcgacgaggagacattgcgaggagggtgagactaagagaccaagaacgggagtga

SEQ ID NO: 86464 - DNA, 483 bp, Glycine max
  Peptide Sequence Number=SeqID_178149
atggggcttaagttgcgtctggacataccagagcaggcaatggaagtaacaaccgtattctttcgtgcaacaacaccagcaaatgaatatcataaaacaatgaaatcgctagccgatcaaagggacagaaatatgaaggttatacaggagaaaatgaaccttgacaaaaaagaaatgaaacgctttaatcctgttgatgcatttccaggtgatattgtaatatttggaagggttcttaatcttctaagagggctttcttccaccatgaatgtacgaatagtatatatggacattatgaggccatttgctgaatcagttttgagtggaggtacacttgccaggtacattagtaaaggaccatccctaaatgatagatggatttttgattcacccgtccattctgatgtagaatccaagctgaggcagcttttaatcgagatgggaaataatgataaaatactcggaatccagggtattttataa

SEQ ID NO: 86465 - DNA, 1929 bp, Glycine max
  Peptide Sequence Number=SeqID_178150
atggccaaaattcccatcttttcggtggggattatgctcttgcattgttgggcagccatgacaggggcagagtacttgaaatataaagatccaaaacagccactcaataatcgaatcaaggatcttatgaacagaatgactttagaggaaaaaattggccaaatgacgcagattgatcgcaaggttgcttctgcagaagtcatgaacaagtattatattggaagtgtgctaagtgggggtggcagtgttccaagggcacaggcttctgcaaaggattggattcacatggtgaatgattttcagaagggtgctttatcgactagattgggaattccaatgatatatgggattgatgcagttcatggccataataatgtctacaaggcaacaatttttcctcacaacgttgggctaggggctaccagggaccctaaactagtgagaaaaattggagaagcaactgctcttgaagttagagcaacaggaattcaatatgtgtttgcaccttgcatagcggtctgtagagatccaagatggggaagatgctatgaaagttatagtgaagatcataaagtagttcaagctatgactgagattattccaggactgcaaggtgatatcccaccaaactcaagaaagggtgttccatttgttgctggaaagaagaaagttgcagcctgtgccaagcactatgttggtgacggtggaaccacaaagggaatcaatgagaacaacacagtgataagcaggcatggattgcttagcattcacgtgccagcctattataactcaatcatcaagggcgtttcaacgattatgatctcttattcaagctggaatggacaaaagatgcatgctaatcataatctaatcacggactttctgaagaacacactacgcttcaggggttttgtcatatcggattggcagggaattgataggattactaccccttctcatgctaactacacatattccatttatgctggaatcactgctgggattgacatgataatggttccctataattacacagaatttatagatggcctaacctcacaggtgaaaaataatctcatacccatgagccgaattgatgatgcagtaaagagaattttgagggtcaagttcattatgggcctgtttgagaacccgttggctgattacagcctagtcaagcagcttgggagtaagaagcatagaaaattggctcgaaaagctgtgaggaaatcattggttctattaaagaatggtgaagatgctgatcagccactgctccctcttcctaaaaaggcttcaaaaattctggttgctggaagccatgctgataatctaggatatcagtgtggtggctggacaatcgaatggcaaggacttgaaaccaacaacctcactaaagattccttttcaacttctttggcttttgtaaaccttgctaaaggtacaacaattctcagtgctatcaagaacacagttgacaaagacacggaagtggtctacaaagagaaccctgatttagactatgtcaagtctaatggtttttcgtatgccatcgtggtagttggagagaaaccatatgctgaaacaaatggtgatagcatgaatttgacaatatctgaacctggaccagacaccataatgaatgtatgtggaggagtaaaatgtgttgctgtgatcatctctggtcgtcctgtggttatacagccatatcttcacctaattgatgcccttgttgcggcttggcttccaggaagtgagggacatggtgtgactgatgtcttatttggtgactatggtttcagaggcaagcttccaaggacatggttcaaaactgttgatcagttgccaatgaatgtgggagattctcattatgatccccttttcccctttggatttggtcttgaaaccaaaccccccaaagccaattag

SEQ ID NO: 86466 - DNA, 513 bp, Glycine max
  Peptide Sequence Number=SeqID_178151
atggcttttacccaactttgtgtagaagcaaagcttcatgatgaatcaagattgattcaaagatgttttgatgataacaaaaatgatgacaaaggtgatgacaaaaagctcaaaggtcaatcaaagaatgagttcaagatgttcaagatagaatcaagaacacttcaagattcaagaggaaatttgatttcaagaatcaagaatcaagattcaaggatcaagcttccaagaatcaagatcaagattcaagaatcaagagaagacttaatcaagataagtatgaaaaggttttttcaaaaactgagtagcacatggatttttctcaaaacatgtttaccaaagagtttttactctctgagggtacatctacttgggttgttgactgagaacaagagagggtacatctcttgtggatcagttctagtggagggtacatccactaggtccaaagagaacaagggagggtacatcccttgtggatctttgcttgtaaaaggatttttaccaggttga

SEQ ID NO: 86467 - DNA, 450 bp, Glycine max
  Peptide Sequence Number=SeqID_178152
atggcgccgaccaggcaccctttggacccggataagtccaacagggccctgggatttcccgcattgatcacaggactttgtcagtcgttcggagtccccatcgcacctagcaaggtgattcggccacccatcactcgggcttttattgagaagtattgcacgcagagaccggcccagcgtgatgcaccacaggccgcagacgcgccgccaccttatcaggctggcccaactgggtcatttgattcggagcagtatttacggcatttggttcgccagcaggcggccaactaccgggcgcatttcagggcagaggtcgcatggcccggagattggcctgaggcccaggcaggggaggcacccgcagaggctcccagcgaggcagatgaggctcgcgaggacgaggagatgactgatttgcttgatttcttgggagggagcggagccacatga

SEQ ID NO: 86468 - DNA, 337 bp, Glycine max
  Peptide Sequence Number=SeqID_178153
gtatatgatgaattcggttataacaatcttgtatttcaatggaagggtatatgaagagactgatggtgtaatctttgaaggcagtaaaaaatcgattcagattaaacgtggaattagtttcaatgctttgaaaaaaaaattggagataagaaataatttatctaataatgaggcgcaaccgccaacaaatgtgagcaacttacatggtgatgaagatgatgatgatgatgatgattatcttgtgtctaactcatacgttgaagagtctttagacgaagatgatagtgttgacggtatatctgatactgacaatgaagtcactgacatgattcaacca

SEQ ID NO: 86469 - DNA, 114 bp, Glycine max
  Peptide Sequence Number=SeqID_178154
atgactcccattgatagcctgcagaatgaccctttagagctagcatggtatgtaaactatctatgcaaaaagaaagaaaatcacgcaagagaaatgttgtctaaaaacaagtag

SEQ ID NO: 86470 - DNA, 540 bp, Glycine max
  Peptide Sequence Number=SeqID_178155
atggaatggtgtaatcaaagtacatccattaaatatttgttcaaatacatcaacaaaggttctgatcgtatcacagcttttcttggaaatcaagatgaaattaagcaatatctcgattgcagatatgtatctcccccagaagcatgttggaaaatttttgcattcccaatgcatgtgcgttccccggcagtggagcggctatatttccaccttgaaaatcaacaacatgtttactggacagatgatcaacaaataggtgaagtcctatcaaaaaacacaatcaaagaatccatgttcacagcctggatgcattctaacaaaatatgttcttatggacgggatcttacatatcatcaatatatctcaagatttgtttatgtcgcccgcaaaagatgctggcaaccaagaaaacaagggaatacaataggcagactcatatgggtcccaccttcagctggtgaactgttttaccttagaatgatgctatccactgccaaatgtgcacagtcttacaatgacatcagaacagtcaatggtctg

SEQ ID NO: 86471 - DNA, 88 bp, Glycine max
  Peptide Sequence Number=SeqID_178156
atggccttggagggaagttccttgttgcgttggaattaccaaccgggcgagtcgtgttcggagttggaacttggggagctccctctgg

SEQ ID NO: 86472 - DNA, 213 bp, Glycine max
  Peptide Sequence Number=SeqID_178157
atgaagaaggagaatgaagaagggggttggaagaatcactcctccggaattggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 86473 - DNA, 855 bp, Glycine max
  Peptide Sequence Number=SeqID_178158
atgcgcttgcaatccaatccttctaaccatagcagcactcatgaactcatacagttttctgattggttactagacataggtgatggcaaacttggccaacctaacaatgtacattgcgaaatcaccatcccagatgagtttcttataatggtttttgaggatcctatccaagcaattgttgatgcaacgtatccagatttattacaaaactacaacaatgcagatttcttgcaaaagagagctatcctagcctctacaaaagatgttgttgacaaaataaatgactatgtcctgtctttgattcctggtgacgagaaagagtattgtagtgctgatagtgttgacaaatctgatgaactactcaatcctacttttggagtactaacacctgagtttcttaacaccttgaaaacatcagggatacctaatcacaagctaagaatcaagattggtactcccatcatactactccaaaatttggaccaggcagatggtttatgcaatggaactcgactaattgtcaccaaacttggaaccaatgtagttgaagcagaggtaatagctggacccaatataggtcataggacatacataccaagaatgaatatgtctccttccgattctccatggccattcaaattaattagaagacagctttcattcatcgtttcatttgcaatgactataaacaagtctcaaggacagtccttggcacatgttcgattgtatttgccaaacccagtattttgtcatggccaactatatgttgcactttcacgagtgcaaagtaaaaaaggactacgtattcttattcatgataaacaaggcattgcaaaaaatactaccattaatgtg

SEQ ID NO: 86474 - DNA, 555 bp, Glycine max
  Peptide Sequence Number=SeqID_178159
atgaccaccctaactcagatctggatgactttgctgctcagcaacatccagcccagcgaccataattccaacctccccctgccgaagtgtcagctggtgtacgccatcctgatgcggatgagctttcacgtggctcagttaatcactgatgccatctatatatttgcaggtatggcgcctaccaggcaccctctggacccggataagtccaacagggccctgggatttcccgccttgatcacaggactctgccagtcgttcggagtccccgtcgcacctagcaaggcggccaaccaccgggctcatgttcagacccatgattgtctttaccagatgagcctcagcctgcagagccagggttttacttcttttctgtgccctactccggaccagttcagggcagaggtcgcatggcctggagattggtctgaggcccgggcaggagaggcacccgcagaggcaccagcagaggctcccgacgaggcagatgaggcccgcgaggacgaggagatggctgatttacttgatttcttaggagggagcggagccacatga

SEQ ID NO: 86475 - DNA, 462 bp, Glycine max
  Peptide Sequence Number=SeqID_178160
atggatctgccagtcgttcggagtcaacccgttgcacctaccaaggtaattcggtcgcccatcacccgggcttttattgagaagtactatacccagagacaggctcagggtgatgctccacaggccgcaggcgcgccaccaccacctcatcaggctgggtcatttgacatggagcagtatttacggcatttggttcgccagcaggcagccaaccaccgggcacatgtgcagacccatgattgtctgtaccagatgagcctcagcatgcagagccagggcttcgcttctttttcatgccctactccagaccagttcagggcagaggtcgcatggcccggggattggcccgaggcccaagcaggagaggcacccccagaggctcccggcgatggagaggaggcccacgaggacgaggagatggccgatttgcttgacttcttgagagggagtggagatacatga

SEQ ID NO: 86476 - DNA, 1154 bp, Glycine max
  Peptide Sequence Number=SeqID_178161
gggggggcggtgctggccggcgccgtcagcgttcgggggcggaggcggagccgttggcgagcatgcggcgcaggaagtgcatcagttgcgtgacttcgtcggcggaaaaaccgcgcagatgatggttcaacacatgggcgatattgggcgggatttcgcgcgccttggcttcgcccagttcggtcagttcgattttcacgacgcgccggtcttgctggctgcgggcgcggcgcagcaggcccttggcctcgagccgatcgagcgtgcgcgtcatggcgccggtgtccaccccattgagccgggccagttcggcgggcgtgtcggcacggcccagggagaccatggcgatgggacgccactgcatggcggtgagatcgagcggagccatttcctggtccagcatccggttcagggagttggcgacgagcttgatcaggtagccggcgttctcttccatcatgcagcgcgtgtcgccgcgataatggatcggattttcggaggaatcagggcggggcggggcgttcatccgcgaattttactgcctagacaaggtcttgcgcaggccggaccagacgatggcggccacgatcagggccgcgccggccatcatgcgcacggtcggctgctggctgaacaggatccaggcgaaggcgatggcgtacaccggctccagcgcgatcaccaggccggcgctgcgcgcgttcagccgcgtcaggctggaaacgaacaggaaatgcgacaggccggtgcagaacacgcccagcaatgccagccagaaccagtccatggcgggcagggcgggcaattggccgatggcgaatggcagcatcaccagtgccaccaccaggttctgccagcaggctacctgcatcggatccatgcccgaggccgagcggcggttgctcagggccagcagcgcgaaggtcaggcccgacagcaggccccaggccaggccgatggtgccctggtcggcgaggtcgaacgacggcgtgaccagcaccaggccggcggtgaccagccccagcagcaaccattcggccagccgcacgcgctcacggaagatcaggccctcgaacagcgtgatgaaggcgggaaagctggcaaagcccaaggtggcgatggcgatcccgcccactttcaccgaaatgaagaag

SEQ ID NO: 86477 - DNA, 811 bp, Glycine max
  Peptide Sequence Number=SeqID_178162
cagaaaactacacattcttgcctttagagcgctacagaccctcgcttttagaggactacacgtcctcgccttcagaggattgcacgtcctcccctttagagggctacacgccctcgcctttagaggaccccatgtcctcaccttcagagggctactcgccttcaccttcagaggactacatgtcctcgccctcggagggctgcacgccatcgccttcagaggactgcatgtcctccccttcagaggactacacgtcttcgccatcagagggatacacatcgtcaccatcagagggctacacgccctcacctttagaggactacacgtcctcgccttcagaggactacacgtcctccccttcagaggactacacgtcctcgccatcggagggctacacatcgtcaccttcagagggctacacgccctcgccttcagaggtctgcacgccctcgccgtcagaggactacatgtcctcaccttcagagggctacacgtcctcgccttcagagggttacacaccctcgccttcagaggactacacatcctcgccttcagaggactacatgtcctcgccttcagagggctacacgcccttgcctttagaggaccacacgccctcaccttcagagggctacgtgccatcaccttcagaggactacacgtcctcgccctcagagggctgcacgccatcgccttcagaggactgcatgtccttcccttcggaggactacaagtcttcgccttcagtgggctgcacgtcgtcgccttcagaggactacacgtcgtcgccttcagagggggatcctctaga

SEQ ID NO: 86478 - DNA, 579 bp, Glycine max
  Peptide Sequence Number=SeqID_178163
atgctcagattcgggaagtgctgctggcacagccgcttaacgatctcgcatggtgtcttccggctcatcgtggcaggtgatcacgatcgacttggccttctcggcgcccgccgcgcgcatgcagctgccagcgcctcggtggcgtcccgtaataaacctgccgtaacgccgcagcacgccgacggcgctgacgtcgcgctccagtacggtaatgcgcattttgttggccatcaacaggcggccgatcacctggccgaaacgcccgaagccgacgatgatcacctgcggatcgtcgtcctctacgtacggcgttcctcttctcgccctggcgccggccagaatggggatggcctgcatcaacgcgcgtggtcatcatcgcgtcaccatatcctggaacagcagcaccgagaagtccgagctgccccccttcgttgcggttcatgcccttctcgcgcatcagctgcagcgccatggcggtggaagacatcgccgaaggccgataccgccgatggctgcaccgccgcctgccaggcgaagtgcgtcagatacagcaacgcgccccgtagcaccgcacggtga

SEQ ID NO: 86479 - DNA, 465 bp, Glycine max
  Peptide Sequence Number=SeqID_178164
atggctccgaaaaagcttttcgcgaagagatctaggagggacgccgcggctgaagggacaagctccgcccccgagtttgatagccaccgtttcaggagcgccgagcaccagcagcgcttcgaggccatcaaagaagagatagctcgccggcattggacgtcgctggtgactctcatggctatgtttgaccctgagatagtcctggagttttatgctaatgcttggcccatagaagagggagtgcgagacatgcggtcatgggtgaggggtcagtggattccctttgacgcagatgccctcggccagttcctgggtgactcgctagtgttggaggaaggccaggagtgcgagtttagtcagaggaggaacatggctgatggggaggctggtgcggatcatgcgcaccagcatgaccaccttgacccagatgtggatgacattgctgctcagcaatgtcttgcctag

SEQ ID NO: 86480 - DNA, 49 bp, Glycine max
  Peptide Sequence Number=SeqID_178165
ggtgaatgctgtgaaaattttcccggacgcccaaaatggactcagatga

SEQ ID NO: 86481 - DNA, 239 bp, Glycine max
  Peptide Sequence Number=SeqID_178166
ggccttttgttgtgaagagggctttttccggaggagccctggtgcttaccaacatggatggcgaaaagctaccttcacccgggcaggatcatcttgaactaccttctggggtgaggacaacacatggacagcagaaaccaatcaaggaatggatgcaagtggggatagggtcacgatcgactgatcgttgccctctctctgcgctagacaagcagagaacgtcgctgcaaggcagcccc

SEQ ID NO: 86482 - DNA, 389 bp, Glycine max
  Peptide Sequence Number=SeqID_178167
atgccttccaaggttattttgatgatgccaaagaatcaagagttaagcaaattccaaaagattcaagattcaagaatcaagtttcaagatcaagattcaagaatcaagtttcaagaatcaagattcacgaacaatcaagatcaagattcaagactcaagattcaagaatcaagagaaggctcaatcaaatggtacatctacttgggggttgttatactgagaacaagagagggtatatctcttgtggatcagttcaagtggagagtatgtccacttggttattcaaagagaacaagggagggtacatcccttgtggatctttggattgtaaaggattttgcaaggttgaatgaaatctcaagaaccggttcattgcttggggactggac

SEQ ID NO: 86483 - DNA, 845 bp, Glycine max
  Peptide Sequence Number=SeqID_178168
atggctacctcaccaaaagaaacttcatctcctggttcaccctctgtaccatcatctccatcatccaccaaagcaccatcaaaccaggaacaacctgaattccatatccaacccatacaaatgattcctggtcaagcccctgttcctgagaaactggtccccaaaagacaacagggagtgaagatttctgaaaaccctagccttgcaacaacatttgaaaatgcttctgtccctgatgctgatgaagatgttccaacatcttccacccctaatgtttctgtcgctgatgctgataaagatgttccaacatcttccaccccaaatgctgaaatcctctcttcacccagcaaagaggactcaacagaggaagaggatcaagccacagaggagacccctgcaccaagggcaccagaacctgctccaggtgacctcattgacctagaagaagtagaatctgatgaggaacccattgccaacaagttggcacctggcattgcagaaagattacaaagccgaaaaggaaaaacccccattaagagacggagcaaagttgcaatcccttccaagaagaggaaagaaatttcctcatctgattctgatgatgatgtcgaactagatgttcccgacatcaagagggccaagacatcagggaaaaaggtgcctggaaatgtccctgatgcaccattggacaacatctcattccactccattggcaatgttgaaaggtggaaatttgtatatcaacgcagacttgccttagaaagagaactgggaagggatgccttggattgcaaggagatcatggacctcatcacggctgctggactgctgaagactgtcaccaa

SEQ ID NO: 86484 - DNA, 480 bp, Glycine max
  Peptide Sequence Number=SeqID_178169
atgcgcacgggtaaagagcccgtcgaacttaggctctccgcaggctctctcggccctacggctcaggctatcgtgtatccggctaatgagcttgctccctttgacgtcgagtatgtcgtgagcgacctcaccttacccggccacatcaagcttctgaccaatattctgaccacgtggcgcagcactttccggctgtcgcgaaaccagactttcgcatccctcgtgcgtgacctgactttcgcattgacgccggaaccgcgcgaggcccagcattgcggcgaaccggttcagggacatcaccttcttgaaaccgcagtcgacccgatgctgggcgagatttcggccatttatggcatcacacccggcagcgtcacggttattccgccacgatttgtggtgggcaggcaggctcgcaatgcctggcagccatgccattttctgctggaagcagcgcaagacctgccgtcatcgctgctgctg

SEQ ID NO: 86485 - DNA, 612 bp, Glycine max
  Peptide Sequence Number=SeqID_178170
atgggatcaaatcaaacacctctgctcaagaaaatgttctatcaagtcaaaatcaagagcttagaggtcactggtttacgagagttggggcagttgatgggtcaacttcaacgcaagccttccgcaaagcctatgtattatgaccagcccctgaggtgcttcacatttgaggatttccagctagtgcagactgtggaagagtttcaagaaatcctaggatgcccgctaggaggaaggaagccatatcttttctcagggttctatccctccatggccagagttgccaaagttgttaaaatctcggcacaagaattggaccgggtgaagcaaaatagaaatggagtagttggagtaccacaaaagcatttggaagagaaggcaaaggcccttgcaagtcaaggcgaatgggcttctttcattgacatcttagcacttttgatcttcagaattgtcctatttccgaacatggaagggttagtggacctagaggcaattgacacgttccttgcctttcaccatagcaaggaaggcccggtcgtcgctattttggccgatatgtacgacatgttcgatcagagatgtgaaaagagcggcatgagaattgtttgctag

SEQ ID NO: 86486 - DNA, 570 bp, Glycine max
  Peptide Sequence Number=SeqID_178171
atggtcatctgcaccatttgtcgaagactcaatgtcaatcgaccgagactattaaagtctccacatcgtcatccagagacaatcaagtctgatgacatgaagagaccaacatggtcatctgcaccctttgttgaagacttaatgtctatcgaccaagattactttagtctccccttcgtcatccggagacaatcaagtccgatgacacagataatcaagtccgatgacacgcagagatcaacatggtcatctgcaccctttgtcgaagactcaatgtctatcgaccgagactattcaagtttccccatcgtcatccagagacaatcaagtctgatgacacacaaagaccaatgtggtcgtctgctcatttttttcgaatactcaatgtctttcgaccgagacaactttagtctccccttcgtcatagacgaatatggtcatctcccccctttggtcgaagactcaatgtctttcgaccgagactgttacagtccaccctttggtatccagagacaaccgagtccgatggcatgccgaggccgtaatggtcactcgcttttgttgttctga

SEQ ID NO: 86487 - DNA, 168 bp, Glycine max
  Peptide Sequence Number=SeqID_178172
atgtccactcaacaagaagctcaagctgaaatcataggtgatccagtagatcatgttcaaacaagatcgtcactaagagcacaaggacacactgcattgatctctaaaatggaacaaaaacacatcgatgaggccatgcaagatgacaactgggtgaaagtgatgtaa

SEQ ID NO: 86488 - DNA, 210 bp, Glycine max
  Peptide Sequence Number=SeqID_178173
atggtttctggggattccggggattctatggcttccgtaaaatttctgaaaaccttggaaaaatcgagtcgaagtccttccgtaacgctttcgaggcgtttccgtgagcaaatctgtgaagattttcctccgttcttcaccgttcttcatcctttcttcgttcttcaaccgcaaaatctaactgatcgttcacgctgtaacctcggttaa

SEQ ID NO: 86489 - DNA, 3000 bp, Glycine max
  Peptide Sequence Number=SeqID_178174
atgggggacaaggatcaaactctagaccacacggttatagaggctccgattccatgtcatgaatttgttttaaacttaacttgctgtagaggaactgaaatatggaggattgagaattttcagccagttgcattgcccaaatctgagtatggcaaattctacacgggagattcgtacatcatcttgcagacaactcaaggcaaaggaggcacttatttttatgatttacacttttggattggaaaggatacaagtcaggatgaggctggaactgcagccattaaaactgttgaacttgatgctgctcttggagggcgtgcagtgcagcacagggaaatccaaggacatgagtccgacaagtttttgtcatactttaaaccatgtattataccattagagggtggagttgcatctgggtttaaaaaacctgaagaagaggagtttgaaacacgtttgtatgtatgcagagggaaaagagttgtaagattgagacaggtcccttttgcaaggtcttcgttgaaccatgaagatgtattcatactagatactgagaacaagatttatcaattcaatggtgcaaattccaatattcaggaaagagccaaggctttggaagtcatacagtttctgaaagaaaaataccatgaagggaaatgtgatgttgcaattgttgacgatggaaaattagacactgagtcagactcaggtgaattttgggtcctctttggtggttttgctcccattgggaagaaggtaatcagtgaggatgatattattccagagacaattcctgctcagctttacagtattgttgatgttgagatcaagcctgtggaaggtgaactttctaaatcactgttggaaaacaacaaatgctatttactggactgtggtgctgaggtgtttgtctgggttggtcgtgtgacacaagttgaagaacgaaaatcagcctgccaagccgttgaggagtttgttgcaagccaaaataggccaaagtctacaaggataacccggattattcaaggttatgagccacattcatttaagtccaactttgattcttggccatcaggatctgctagtaccagtgctgaggaaggaagaggaaaagttgcagcattgcttaagcaacaaggcatgggtgtcaaaggaatgacaaaaagtacccctgtaaatgaggaaattccacctttgcttgaaggaggtggaaagatagaggtatggcgaatcaatggaaatgccaagaatgcattgccaaaggaggagatcggtaaattttatagtggagattgttacattgtactgtacacctaccactctggtgagcggaaagaagactacttcttgtgctgttggtttggcaaagacagtgttgaggaggaccaaacaacggctactaggttggccaatacaatgtctacctcattaaagggtagacctgtacagggtcgcatatttgaaggcaaagagccgccacagtttgttgctattttccaaccaatggtggttctcaagggagggttcagctctggatacaagaaactaatagcagacaaaggagtatcagatgagacatacacagcagagagtattgcacttattcgaatttctggaacttctatttacaacaataaatcagtacaagttgatgcagtgccatcatcattgaattccactgagtgttttgtcctgcaatctggctctacaattttcacttggcatggaaatcagtgttcctttgagcagcaacagctagcagcaaaggttgctgattttttacgggtggaaggagagaaactgaggttgggtacaacacacgtttttctccatgacaggcaatatttccgaagagatgatgaagctgttggatcaattaccattgttgaacaccttggaactggaaggctcgtgccaggagctactttaaagcatgctaaagaaggaacagaaagctcagctttctggtctgcactaggaggaaaacaaagttacaccagcaagaaagttgttaatgaggtagaggaggtttacaacttctctcaggacgacctgttgccggaggatatccttatacttgacacacatgcagaagtgtttatttggattggtcattctgtggaacccaaagaaaagcgaaatgcttttgaaattggccaggggctatctccacatgtaccactatataaagtaacagaagggaatgaaccttgctttttcacaacatacttttcatgggatcatgcaaaagctatggttatggggaactcatttcagaaaaaggtgtcactactctttggacttggccatgctgtggaggaaaagttgaatgggtcaagtccagggggaccaagacaaagagcagaagctttggctgccttatctaatgcatttggttcatcttctgagaaagcatccggtttggcacaagatagattgaatgggttaggccaagggggaccaaggcaaagggcagaagctttagccgctttaaactctgcatttaattcatcatctgggacgaagacttttactcctaggccatctggaagaggtcaaggatcacaaagagctgcagcagtagctgctctttcacaagttcttatggctgaaaagaaaaaatcaccggatggttctcctgttgctagcaggagtcctatcactgaaggtagtgctactgaaactaaaagtgactcctctgaagttgaagaagttgcagaagccaaggaaacagaggaacttccccctgagaccggtagcaatggggatttggaactaaaacaagagaatgcggaggaaggaaatgatggtcaaaggatgttcagttatgagcaattaaagactaaatctggtcataatgtgcctggagttgatcttaaacggagagaggcctatctgtcagaggatgagttcaacactgtatttggaatggcaaaagaagcattttacaagttgccaagatggaagcaagacatgctgaaaaagaaatacgaattgttctaa

SEQ ID NO: 86490 - DNA, 510 bp, Glycine max
  Peptide Sequence Number=SeqID_178175
atgtcatttcaaatgccacctagtttgaagcactttgatcagctcaatagtcaatactatctaatggtatcatttctaacatttgaactctctggagaagagtttatctcaatcaagaggaatggtgtagattggataattatctgttcaaacattggcatccacttcaatatgtggcattatacactcaatccttggaaggcaacctttgctaattttacgggtggcagaacctactgtgatcatgagagttgtttcttgtttggcatactcattgcaatgctcttcatgcagcaagctatcaaagtgtgtcctacatgccggcaggaagcaactggtacaaaggtagaggccacgtcactatttgaaaattttcaccaactcaaaagcaggtgctgggtgttgaagtgggtagcatttgcagaagccttccctgtggcccttgatgcatgctttgagaatctcaagagattaaatgatgttatagtgtattcaactctataccaataa

SEQ ID NO: 86491 - DNA, 60 bp, Glycine max
  Peptide Sequence Number=SeqID_178176
atggtggatgaccggggagatgaaagagaaggaggaattggtgttgatgggtcttcggag

SEQ ID NO: 86492 - DNA, 1110 bp, Glycine max
  Peptide Sequence Number=SeqID_178177
tcaaggtgtaccttttgagggcaccattgttgatgattggaaatttgatttttcaagtcatgatgcccgccgaatggtctgcaccaatcaggcagaaatgaccggcagattgcttaccggttcattgacttttgaatgttgcatcatgcattatctgattgtgagtattattcctcgttcatcaaatcttgctcaggtctctgaggaggacctaatagttatgtgggcattcttaactggtcgtcagattgactgggcccatctagtcagatccttctctattggtgctagagcagtcacctcttttggttactgtaaggaattggatggctcttgggtgaagaaagatgcccagccacagcctgccgatgagcgtatcccttcacctccacgacatgactcttcaacgcttctaaatgacgttttcacagagttacgaagcctccgagctcactttgatgaccgcttggataggatcgacacacactttaaagagatggacatccgtatcgatcagtttacagatgacatgagctacatacgccaagttgtaaaggatttgcaagatagtggaactcccaagagggtttcttggggactggacgtaggcaacggactttgccgaactatggatccccttcgatacagatgccctcagccaattcttgggccacccgctaatccgaggaagatcagcagtgcgaatacggccagaggaggagccagaacggcgcctacgaggcaccctttggacccaaaaaagtccaacagggcattaggatttccagcactgatcatgggcctcttccagttttatggagtaccagtcgcccccagcaaggcaccacaacagcctggggatgatcagcagcaggctgcaggtgctccaccaccacctccagattctacctctgatcacctaccgagattggagtggtatatacgacatgaggttgaccagcaggcagccaaccataggggtcagtttgtggctgtagtagcatggccaggggattggcccgaggatcagacaggacctgtctgtggtcctggaggtgaggacgaggctgaggacgatcaggacatggtggggctgatagatttcctcct

SEQ ID NO: 86493 - DNA, 513 bp, Glycine max
  Peptide Sequence Number=SeqID_178178
atgggttctccacctgcctccactactcctcctcctcctcctcctccttctcctccttctcctcctcgtcctcctcctacttcaggcgcatcggcttcgacgtctgccgtgaagcggacacgcaaagcctcacgcctacgatcgttgtccactagaccacctagtgttgagagaccagtggtgcatgttgatcctgctacagggaaggccgacggtccccacaagaagaaattaagaacatatttggggattgtggcacgtgataaggtggacatcacctacgagaactggaaggaggtccctactgctcagaaggacctaatttgggaggatattcagccgatcaggacggtgtcgaggacactgtctgtgacaaatacgacatcagcaaggaaaagtgggcccagttttgccagactcgcagagacccttcttgggaggatgtgcgcatcaaggcacaggccatccagaagcagaatactgcccccacgttttgtctcgtgggggttatga

SEQ ID NO: 86494 - DNA, 177 bp, Glycine max
  Peptide Sequence Number=SeqID_178179
atggctttctatgacgatcttcaagaaacaaatgtcttcattgatgaagaagatccaaggcctacaagctgtggaagcaatgtcttccaagattattttgatgatgccaaagaatcaagagtcaaacaagtttcaagattcaagaataatctagatcaagattcaagattcaagtaa

SEQ ID NO: 86495 - DNA, 468 bp, Glycine max
  Peptide Sequence Number=SeqID_178180
atgggatcgaatcaagcacccttgcttaagaaaaggttttatcgcgtcaaaattaaatgcccagaggttgctagtttgcaagaattagggcaattgatggatcaactccaacgtcaagctttccgcaagacatatggaaagatctgggacctggctatgatagaagtctctgttgaagctattgcgtcccttactgagtattacgatcaaccactaagatgcttcaggtttggggaatttcagttagtaccgactgtagaagagtttgaagagatcttgggatgtccgctagaaggaagaagaccatatcttttttttgggttctatccctccatggcaagaataacgaaggaggtcaaaatctcggcacaagaattggttcgagtaaaacaaagtagaaatggagtggtcggaataccgaggaagcacttggaggagaaagcgaaggctttggcagtgaaattctga

SEQ ID NO: 86496 - DNA, 213 bp, Glycine max
  Peptide Sequence Number=SeqID_178181
atggcacgtagcgtgtctgctccatgcccctattcaagggacctatatgggagggagctgacaaggcttttagtgataattcccaaggtggtcatatctcacttgatggtctctagaggtatcatccccttcgaagaacatattgcagcagtagggactactagcaacaatatgtcatcgaagagaaaaactctagatgagggttcactgtaa

SEQ ID NO: 86497 - DNA, 216 bp, Glycine max
  Peptide Sequence Number=SeqID_178182
atgtatatgaaatggccccgaggaagcttgcctcaaagagatctaggaaggataaagcggctgaaggaaccagttccgctcccgagtatgacagtcaccattttaggagcgctgaacaccagcagcgcttcgaggccatcaagggatggtcatttctccgagagcgacgcgtccagcttagggacgatgagtataccgatttccaggaagaaatag

SEQ ID NO: 86498 - DNA, 797 bp, Glycine max
  Peptide Sequence Number=SeqID_178183
cattgatggcgtcatcgaccctccatccccggtcagacgccacgtgaagtggaagatggcccgcacgaagaagacaggggagatgacgactgaggccgcaaaggaaattgctgagaagattgattcgtttgaggagcaggccacacagggatcgttcgtcccccatggacgtcaggatgttctggccgctgctattggacgtccagagcaccctggacgtgtccgtggtattggagctggtgtcaccatcaagcaatactttggatcggctccacggacgtcccgcaacgcttcctccctgcctcctaacgaattacaccagctgactcagcagatcagggaccagctagaggagtccatcacagagaaagtgacgaggcaggaaatgatcctaagaccggtgactctgacaggcacttcacaccttccttgcttggccgacacatctggtcaagtagttgtgtctccaccaaaaccacctccgaagcccgatccggaggtcgatgatccgctttatctgatgacattgaccatcccaaagcttttcttgaggccttatcaggttagatgggatgccaccgtgttcgggtccattcagaggtctgggcaatcgcagtttgagtctgaaagttacataaagagttggatgcagagttcacaacgcgatgtctatcttggagcctacctaaatgggccagacaactaccttaaggggattattaatagtgctttaaaaggtcttgataatgctccacagcctaaatcaaaggcttctgctaggtggactgccatcattg

SEQ ID NO: 86499 - DNA, 1127 bp, Glycine max
  Peptide Sequence Number=SeqID_178184
atgggaacaaatcaaaccggcaagaggttctaccaagtcaaggtcaaaagcccagataccaccagcatcaaggaattagggcggttgatggaacccctccaaatgcaagccttccgcaagacttacggaaagatcttagagttgaccatagcagaagtgtccatagaagccattgcatcactcacccaatactacgaccagcctttgagatgcttcacattcggagacttccaattagtaccaaccattgaagaatttgaagaaattctaggatgtcctctcgggggaagaaaaccatatctttcctccggatgtctcccctccttgagcagaattgcaactgtggtcaaggattctgcaagaggtttggaccgcataaaacagactcggaacggcatagcgggcctaccacagaagtacctagaagacaaagcgaggggtatggccaatcaaggagaatgggtcccgtttatggatgtgttagctttgctaatttttggggtcgtcctctttccaaacgtggatgatctatttgacacatttgatcgaaggtgcaagaagagtagcgcacggatcatctgttgcttacccgccctctgtgtttggttggtttcacacttgttccaacaagacacaagacatccatgtccgctcctgagccatcgctcgtgtactgaaaagaggagaatggattgggaccagctcttggccgggataggaggggttgtattaattacaatcccatcgctcgctataagacaactagggtaccccatgaggggagcaccaacggaagaaagcatgtctcctttccttgtgacggatctcggcgcacaaaattccaagactatacaaagaatccataaggcatgggaaaccccgttaaggaaagatcaagagcttagaggcattcgtaatggcatcattggtgggtaccacgaatggctgaaagttcgcatacgaggtttagattggctcgccaaggtaaaagtcgtcagcgaagagaattttgaagcaccggaagaagacgaagaagtccaaactctcaaaagcgagttaggaaaggcaaaactcgccaaggagaagttcagttggctgctacacacgttcggaaggagtggtgccgg

SEQ ID NO: 86500 - DNA, 957 bp, Glycine max
  Peptide Sequence Number=SeqID_178185
atggcaagacacaaggtcacacgcacacacacacacacacactcacgcaggcacaagggggaggaggggcttggtcgggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattgtgcgaatcaacgaagagccgacatcgaaggatcaaaagcacgtcgctatgacgcttggctgccacaagccagttatccttgtggtaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggatcgaccggccgaagccgaccttgggtccaaaaagaggggcagtgccccgcttccgattcacggaataactcccacttatcctacacctctcaagtcatttcacaaagtcggactagagtcaagctcaacagggtcttctttccccgctgattccgccaagcccgttcccttggctgtggtttcgctggatagtagacagggacagtgggaatctcgttaa

SEQ ID NO: 86501 - DNA, 1121 bp, Glycine max
  Peptide Sequence Number=SeqID_178186
gggtatggccaatcaaggagactgggtcccgtttatggatgtgttagctttgctgttttttggggtcgtcctctttccaaacgtggatggtttggtagacctagcagcaatcgacgctttccttgcctaccaccatagcaaggaaagtccggtggtagctgtcttggcagatctatttgacacatttgaccgaagaacggattgggaccagctcttggccgggataggaggtagaacaatcagttggttcccccgatggaaggaaggaaaagaaggagtccttttctcatgtggaagatacccaaacattccgctggtaggaacgagggggatctcggcgcacaaaattccaaagactatacaaagaatccataaagcatgggaaaccccgttaaggaaagatcaagagcttagaggcattcgtaatggcatcattggtgggtaccacgaatggctgaaagttcgcatacgaggtttagattggctcgccaagttaaaagtcgtcagcgaagaggattttgaagcaccggaagaggacgaagaagtccaatctctcaaaagcgagttaggaaaggcaaaacttgcccaaggagaagttcaagttggccgctacacacagaatgcaattaccgcaagagcccttgaacaagaaaccaagagggctcgcaaggaagagtatggctggaacaaatttcgcggagctctatggggtagcaatagtgaactcaagttgcgaagggaagaaagggaccagtcgcgagcacatagcatggttttgaaagaggagttagttgcctgttcaaggtccaaaagaagcttgtctcagcgtttatgcgagacggagaccaacatgctagctatcatcgccaagtaccaagaagagttaggtctagccgcggcccacgagcataggattgcggacgaatatgcccaagtatacgcggaaaaagaggctagaggaagggtgatcgactctttacaccaagaggcaaccatgtggatggatcggtttgctcttaccttgaacgggagtcaagaacttccccgattgttagccaaggccaaagcgatggcagacacctactccgcccccgaagagattcacgggcttctcggctatt

SEQ ID NO: 86502 - DNA, 555 bp, Glycine max
  Peptide Sequence Number=SeqID_178187
atgacaaaagacaaggttgatacctcaaagccctacactggggcaatgaagggcaccgtgcatgagcctcaagcgaacccaggggcagatcaaaagatacacaccctcacctttagaggactacacgtcctcgccttgagagggctgcacgcccacgcattgagagggctgcaagtcctcgccttcagagggcttcacgccctcgccttcagaggactacacgtccttgccttcagacgactacatgtcctcgccttcacaaggctacatgtcccagccttaagaggacagcacgtcctcgtctttagagggctacgcgccctcgccttcagaggacaacgcgtcttaaccttgagagggttgcacgccctagccatgagagggctgcaagtcctcgccttcagagggcttcacgccctcgccttcaaaggactacacgtcctcgccttcagagggctgcacgccctcgccttcagaggacgacacgtcctcgcctttagaggactacacgtcctcgccttcataggactacatgtctttgccttcagaggatag

SEQ ID NO: 86503 - DNA, 246 bp, Glycine max
  Peptide Sequence Number=SeqID_178188
atgtcaaatcataaaagcactaagtcagccctaaagaaccttgaggtccaggtgggacaattggccaagcagatagatgacaagtcatccaacagttttgtggcaaatacagaacaaaatcccaaggaggaatgcaaagctgtgatgacaagcagtaaaaggtttgtggaggctgaggatgaggatagtgttgtgcataagaagaaaactgctgacaagaaaggtaccgatggcaagaaaaataag

SEQ ID NO: 86504 - DNA, 985 bp, Glycine max
  Peptide Sequence Number=SeqID_178189
atgtcctccccttcagaggagtacatttcctcacctccagaggactacacgtcctcacctcaagaggactacacgtcctcacctccagaggactacacgtcctcaccttcaaaggactacacgtcctcaccttcagaggactacacgccctcgccttcagaggactacatgtcctcccctttagaggagtacatgtcctcaccttccaaggactacacgtcctcccctttagaggacttcacgttctcaccttcagaggactacacgtcctcacctttagagctatacgccctcacctttagaggactgcacgccctcgcctttagaggactacatgtcctccccttcagaggagtacatttcctcacctttcgaggaatacatgtccacgccttcagaggactacacgtgctcaccttcagaggactacacatcctcaccttcagagggctacacaccgtcacctttagaggactacacgtcctaaccttcagagggctacacgccctcaccttcagagaactacacgtccttgccttcagagggctacacgtccttgcctttagagagctacacgccctcaccttcagtggactacacgtgctcgccatcagaggactacacggcctcaccttcagagggctacacgccctcaccataaaaggactacacacccacgcctttagaggtgtacccgccctcgccttcagagggctacacgtccttgccttcagagcgctagacgccctcactttcagaggactacacgtcctccccttcagaggagtacatttcctcaccttccgaggaatacatgtccacgccttcagaggactacacgtgctcaccttcagaggactacacgggctcaccttcagagggctacacaccgtcaccttcagaggactacacgtcctcacctcagagggactacacgccctcaccttcagaggactacacgtcctcgccttcagagggactacac

SEQ ID NO: 86505 - DNA, 516 bp, Glycine max
  Peptide Sequence Number=SeqID_178190
atggcatccttcagccaccttcagtcgcagatgcaatctcagggacttgcagtgccttctgagcctctggttggtcctggtccctccggtcctcgagtgagcacaaaggggagttgtgttgatccctcaggaaacgatcctgagatcggtgactctgacaggtgcggcttgtacatagaagcagatcctgcccgcctggttgccatcaggagagtttatgagggatccactgttgttcataacactcatttgttgcttggccaagtaaaggtgagtgtggaggaggttagagatgcagatgctccaattcctgtacccactgatgaggtttccttagtggggcaggcacttcacaccttccttgcttggccgacacatctggtcaagtctttatcacagcaggtagttgtgtctccgccaaaaccacctctgaagcccgatccggaggtcgatgatccgctttatctgatggcattgaccatcccaagagcttttcttgaggccttatcaggttag

SEQ ID NO: 86506 - DNA, 47 bp, Glycine max
  Peptide Sequence Number=SeqID_178191
atggaggtttggatgacgccacttccggtgaaggaagataagtcagg

SEQ ID NO: 86507 - DNA, 612 bp, Glycine max
  Peptide Sequence Number=SeqID_178192
atggcccgcaccaagaaaactagccagatgacgtctaaggcagcaaatgaaattgctaagaagattgattcattagaggagcaggcgtcacagggttcctttgtcccccatggacaacaccttggtcgtgtgcgtgctgttagagccggtgtgacaatcaagcaatactttggaccggctccacggacctcccgcacttcctcctccctgcctcctgaagaactagagcagctgacgcaacaaatcagggaccagctggaggagtcgatcacagaaaaaggacttgcactgcctctagagcctgaggttggtccttcaactactcgtgtcagcacaaggaagagttgtgttgacccctcagggaatgatccagacacgggtgactcagacaaatacgagttgtacagggaagaaaatcctccccgcttggtttccctaggaaaagtttatgagggatcgacaaccgttcacaccatccctttgttgcatgatcaagtgaaggtcggtgttgaggagtattttaatgatgttagaccattggaagtagagagattgaaggcacttcacatccagtgggcaaagtattatctcaaagttagaaatcaaacttag

SEQ ID NO: 86508 - DNA, 809 bp, Glycine max
  Peptide Sequence Number=SeqID_178193
atgtcctctcaggggaagaaaaccatatcttccatccgggtgtctcccctctttgagcagaattgcaactgtggtcaaggattcagcaagaagtttggaccgcataaaacagactcggaacggcatagcgggcctaccacgggggtacctagaagacaaggcgaggggtatggtcaatcaaggagattgggtcccgtttatggatgtgttagctttgctaatttttgggatggtcctttttccaaacgtggatggagaatagattgggaccagcttttggctgggataggaggtagaacaattagttggttcccccgatggaaggaaggaaaagaaggagtcattttctcatgtggaggatacccaaacattccgctggattctcggcgcacaaattccaagactatacaaagaatccataaggcatgggaaaccccgttaaggaaagatcaagagcttagaggcattcgtaatggcatcattggtgggtaccacgaatggctgaaatcgtcagcgaagaggattttgaagcaccggaagaggacgaagaaagtccaggctctcaaaagcgagttaggaaaggcaaaactcgccaaggagaagttcaagttggccgctacacacgttcggaaggagtgtgccgggttacgggaagagaatgcaattaccgcaagagcccttgaacaagagaccaagagggctcgcaaggaagagtatggccgaaacaatttcgcggagctctatggggtagcaatagtgaactcaagttgcgaagggaagaaagggaccagtcgcgagcacatggcatg

SEQ ID NO: 86509 - DNA, 102 bp, Glycine max
  Peptide Sequence Number=SeqID_178194
actggaaggattgtccttgtgtggttcaaaacttgtaaagggttttttcaagttagtggaactctcaagcgggttgcttggggactggacataggaacaagg

SEQ ID NO: 86510 - DNA, 246 bp, Glycine max
  Peptide Sequence Number=SeqID_178195
atggatggggaaatcccagaaaagggacagtttcatacctttccacctacaagctttcaaggaaagatggatctctactatagtcatgacacttcaggctttgttctttctccgtcagatgagacgtgtgctcggcctcatcaccagaagttggagatcattggttttccatttgggtttggtggtgttgctggttttcgtataaccatcgccatatccttcgcttttggatggctattttcatag

SEQ ID NO: 86511 - DNA, 366 bp, Glycine max
  Peptide Sequence Number=SeqID_178196
acttatcaaggtaatccttgtggcgtctaccctgacttatcttccttcattggaagtggcgtctaccctgacttatcttccttcactggaagtggcgtctacccagacttatcttccttcaccggaagtggcgtctaccctgacttatcttccttcattggaagtggcgtctaccctgacttatcttccttcaccggaagtggcgtctaccctgacttatcttccttcaccggaagtggcgtctaccctgacttatcttccttcactggaagtggcgtcatccaaaacctccgtagcctgtatcaaacgatccgctcctactcaggttcacatcatctggtatcagagcttcggctcttgatacag

SEQ ID NO: 86512 - DNA, 714 bp, Glycine max
  Peptide Sequence Number=SeqID_178197
atgatgaaggatgcggtcaatggtcataactctgcagcacttgggctccactttctacttggttcttcttcttcctcagcttctcacaaaaaagcaggtgctgagaaattcgcccaagcacttgacctaacacgaggcaaacactttctgatattggtagactcatgtttggaaggtcatatttcaaatgatgatggaattgagatagtgagattggcttggcgctatttacaatatgaacctcgtgagaggccaaacgccttgtcacttgttccatcacaagttttgttgggcataccagatgagattgccccatcaaaggaagcagttccattgacaccttttggtgaagcttgttctagaagagatctcactttaatatgtagaattttggaaacactggggtacaaggatgatgaagatgtagccaatgagcttctcgtagaaagtctcttacccaccattagtgcccaaccaaataaaggcaaagcaccaaagtctctacaaacaaaactaattgatgcaatatctcttggagttaagcgcataagtatcttgagaggccatacctcgtcagttaattgcaacatctctagaatattatataaaagggaagaagctacacaggtagcaggagaggaaagccatttgaagaggaacaccttcaacaattttggtggacccgatatacatatacaaataagatatttttaa

SEQ ID NO: 86513 - DNA, 492 bp, Glycine max
  Peptide Sequence Number=SeqID_178198
atgatgttatttgtgcgttataacatcgtttttagaacaccgttgttgaactgcattattcaaggacacgatggtaatattattgttccagaatcaaaacttgtttcatccaccactctctcattctctctgcttcgccctcgatcccttcctttttccctcaaattccacacctccttctccttgaagtccccgacctccacctttcgcgccttctccgacgctgaggaggacgaagaagacgatgaagaagaagatcaagaccaagacaacgtttctgccgacgaatacgacgatgttttgggtgaggcttccgatgaggctgacgtgttcgctcggcatggtggattcaagtggcagagagtcgacaagctatgcaacaaagtcagggagtttggcgccgatctcatcgacgtcgatgagctcacctccgtctacgatctcatcggcgtcgatctcattgacgtcatttaccaaaggtggttgggttga

SEQ ID NO: 86514 - DNA, 321 bp, Glycine max
  Peptide Sequence Number=SeqID_178199
atgaaagatagaagaaatacaagtagtggggatgtctcctccacctttagaaacctcacaatctttcaaaatctcatccaaagttccgcaagatggcttcctcttcaaggcactcctgtcgatggacatgcgcttagcggaagaaaagctcgcttagcgcatcctgaaggtgaagacggtgtgcttagcgagttggccttcgctcaacacctctatacaactcatccttcttccaaaattgtccatgcgcttaaccatcagattgggcgcttagtgaatgatgcgcttggccagaagataagtggcttagcgagttcatga

SEQ ID NO: 86515 - DNA, 258 bp, Glycine max
  Peptide Sequence Number=SeqID_178200
atggagttcgttttctgcattttttctggaaaatgcgacgaacttgctaagcgcgtctactgtgctaagcgagttcatcaaaagtgtttgaatgagttttatgctaacttgtacatcccggaagaacaaagccctaagcaagtaagggtaagaggacattgtcgcaacctaccctttggcggaagggcgacgcgagggctcacgggtgcgtcttccaagggaggaaggcacgcggagtcgccaccaacgtttatttga

SEQ ID NO: 86516 - DNA, 312 bp, Glycine max
  Peptide Sequence Number=SeqID_178201
atgagtgaagtagaggaggtgcaagagcagatgaaggccgacatggaggccatgaaagagcaaatggccacaatgatggaggccatgatgagcatgaagaagataatggaagccaatgcagttgcagttgccgctaccagcgttgttgctaaggtgaacccgatgccctcatttgatattaaccaaatgaaacatccaacctcagatatggtaggcaaagatttgggaagtacgggcggcccccattatgcgcaaattcaaaacaagcatgccttcccaccatatggctacctcccaactgggatcctctag

SEQ ID NO: 86517 - DNA, 183 bp, Glycine max
  Peptide Sequence Number=SeqID_178202
atggttatgatccccaaaacaccaaatcaagaaactgtttctcctctcctcatccgaagagaaaacgaaagtcctataaggaagaaggtgatttggttgaagaaggtcattaaaccaattattcgtgaccgctgtaagatttcgttacgtgttgatcaagctctatggatccagatttattaa

SEQ ID NO: 86518 - DNA, 786 bp, Glycine max
  Peptide Sequence Number=SeqID_178203
atgagggaaatgggagtaatccgaagaaaaattgttacgagacaaaggttgacatatggagttatgtcctcaaatgtttatgactctaatgtgttattgatgtggaagggtcaggaatatttgtatttgaatcctgagtttcttttgaagagcattgatctctcaagtaatgatttaacaggtgaaataccaaaggaggtaagatatttacttgaattagtttctttgaatttatcaagaaacagattaagtggagaaattcttcctgagattgggaatttaacttcactagagttatcaagaaatcatttctcttgtgaagttccttctactctttccaaaattgatcgtcttgccatgttagacttatctaacaactatcttgttggaagaatcccctggggaagacagcttcagacctttagtgcctctacttttgaaggaaataccgatctttgtggtgaaccacttaacaaaagctgccctgtaaatggcacagcaacaaagcctcaaggaccagcaattcatgatgatgatgacaattcagttttctgtgaagcattatatatgagcttggggttaggattcttcacaggcttttggggcttaataggctgtccgggtcaatattttcagaggattcaaattctcactttcatggtgggcctacacatttccgatgagcatgttgagtgggaggatatacatgagcaacgtgcactcaacgtctttttggccgttggtgattgtgttctagttggcttccaggtgatcaacttctcttaa

SEQ ID NO: 86519 - DNA, 840 bp, Glycine max
  Peptide Sequence Number=SeqID_178204
atgactacaattttgggtattcacttaatcttgttaggtataggtgcgtttcttctagtattcaaggctctttattttggagggtggattgttagtgtggacgatttggaagatataattggggggcatgtatggttgggttccatttgtatacttggtggaatctggcatatcttaaccaaaccttttgcatgggctcggcgtgcacttgtatggtctggagaagcttacttatcttatagtttaggtgctttatctgtttttggttttattgcttgttgctttgtctggtttaataataccgcttatcctagtgagttttacgggcccactgggccagaagcttctcaagctcaagcatttacttttctagttagagaccaacgtcttggggctaatgtaggatctgctcaaggacctacaggtttaggtaaatatctaatgcgttccccgacaggagaagttatttttgggggagaaactatgcgtttttgggatttgcgtgctccttggttagaacctctaaggggtccgaatggtttagacttgagtagactgaaaaaagatatacagccttggcaagaacgccgttctgcggaatatatgactcatgctcctttaggttccttaaattccgtgggtggcgtagctacagagattaatgcagtcaattatgtttctcctagaagttggttagctacttctcattttgttctaggattcttcctatttgtaggccatttatggcacgcgggaagagctcgcgcagctgccgcaggatttgaaaaaggaattgatcgagattttgaaccagttctttccatgactcctcttaattga

SEQ ID NO: 86520 - DNA, 147 bp, Glycine max
  Peptide Sequence Number=SeqID_178205
atggcgatacatttatacaaaacttctaccccaagcacacgcaatggagccgtagacagtcaacatcgttgtggtaaaggccgtaatgccagaggaatcattaccgcagggcatagagggggaggtcataaggcgtctataccgtaa

SEQ ID NO: 86521 - DNA, 726 bp, Glycine max
  Peptide Sequence Number=SeqID_178206
cccgtaatcgcgccgccgcacccacggcaccgcctgcccatagttgaagcgcagcgtcagctccatctgcatgtccacgtggccggattcaccctggacgatgcgcaccacgtcgacccgttcttcgtcgtcgctgagcggcatgaaatcgtagacacgcaccgcgccggtggcggtctcgtggcgcgtttccagcacggccgtgtcgggcaggtagcggcgccggacctcgcccggccggcgcggcgccagcagccagcggccgtggctgtcgtcgccgagcagggcggcgaaacacgcgggggaatcgaaatgcggcaggcacagccagtcgatggagccgtcgcgcgcgaccagcgccgccgacagcaggttgccgatcacgccatagtcctcgatgggcttggacatgggtcagggcgcgtcccgcggctcgccgatgcggccgttgaccaccacgcgcgcgccggtggccgccagttccagggcgatgccacggccgatgccggaagtggcgcccgtgacgatggccacctgtccggacagatccgtttgccgcatgttgctctccttgcggcgggcgcgagcacgggctgtcgccaagccagggcacgcgggccgctgtcgatagcaaagggtcaggttagtcccgaacggacggcggttcaacccgcggccgccggcgcctggcgccggttcgctagccgatttctgacatttttctga

SEQ ID NO: 86522 - DNA, 348 bp, Glycine max
  Peptide Sequence Number=SeqID_178207
atgcaaaaacaacaagactccaaatctgaggataatggtgaaagcctgaatatttcaaggggaaggagtgaaaagaagggaacaagaggaaagaagtccagatcaaggtcaagggattcaaagaatggccagaaaacaaagttcaaatgctttaattgtcacaaaactggtcatttcaagaaagactgcccagacaagatcaagaaaggatctttggactctgctgacatagttgaagcctctgaaggagacaactacccctgcaaggtacaaggcattggaactgtgagattaaagatgtttgataatagagagtatctactgaaaaatgtaaggatattcaactag

SEQ ID NO: 86523 - DNA, 399 bp, Glycine max
  Peptide Sequence Number=SeqID_178208
atgtcatgtaaatctagagaaatcatcaactatgacaagagcataacatgtcgcaacgtgcccttttgcgggcgagcgagggcgaggctcacgggtgcgctttccaaaggaggaaagatgcgcggagtcgccaccaacgtttatttgggaaaacgtcgggaaaaccgaaggaaactggtcaaaatgaaaattctaagttcgggagttgtatttacgcttgaggaaggtattggcacctctcacgtcgacaaaagcggggcttttgctcctacgtaccctcctttggagaggaaatcagacctacgtagttcttctttatgcgtgaatcaagtggttcttttttacttgaaaggtgctcattttaaggcgttggaccttaaaaatgatccattttacttg

SEQ ID NO: 86524 - DNA, 225 bp, Glycine max
  Peptide Sequence Number=SeqID_178209
atggtaatcgattacagctttgtaaatcagttttggaaagaatgctggctactggtaatcgattacttccttctggatttagaagtagcagcaactctagaagaagagcctcgatcttctgaggcatcttctagttttcctattgtagggcattctcaaatagaacctgttgaagatacaatcatggctaaagagccaagaagagtaaccctagaagattatcaa

SEQ ID NO: 86525 - DNA, 341 bp, Glycine max
  Peptide Sequence Number=SeqID_178210
tgagaaaagctgtgattttggttggtgttttgggcagagttttctgcctttgccctgttttattggctgtgatagtttgtgttggtttaatgttgaattacttggatgttgggaagcttgggaggattgatggggacccggtgttgagagaaacgaggatatgggctacgtgggagtacgtgagcttagttggaggtgggcaacaggggatgagtggtacctggagatatgtcgctggggtcaggagaccttggggacgtcaggcgagctcctggcagtcaacagataaaaggaacaaggaccacacagcaaggaggcttgtggtggctggccagctatga

SEQ ID NO: 86526 - DNA, 255 bp, Glycine max
  Peptide Sequence Number=SeqID_178211
gggaggggggctgagtttaaggggttcagtatttcttgcactgagttttcacttgaaattggtgaggataagagaaagaagggaaaaaatccaagtcgaggtgcttctgtaacgctttcgagacattttcataagcgattctgtggaagttctttgtcgttcttcgttcgttcttcatcgttcttcgatcttcaaccggtttcgctgattgagctattagtcggtcgggtgaagattcaggttgaacgaaattag

SEQ ID NO: 86527 - DNA, 129 bp, Glycine max
  Peptide Sequence Number=SeqID_178212
cgcgggagtactgatgcgattgctgctcaggctctcaagcaagctattgagcgtttctctgttttgcggcgcaagctcctgcgcgcgcatatcggtgagcagctggtcccagctttttccctgacgtaa

SEQ ID NO: 86528 - DNA, 357 bp, Glycine max
  Peptide Sequence Number=SeqID_178213
atgatcatcatcaaaacaccaaaggaaatcgcatctacaccttctagtaggacctccaataaatctgagaattataaggaggaagcatggaagaaaacacagaagcataaaccaaagagggtggagagtgtcaacgctgatgcagaagcctttggtgatgactggaaaattctgattgctctatgcattgtgaagctgaagcaggaagaaggcataaatatgggtttaacaacaatgaacgtgagaaggcacagaagaaaagggtggtggatgatgaaactaccgacaaacatcagttggatgaagtcctatgaagatcctcctcattctcaaagaggggaacgagcaacaatttga

SEQ ID NO: 86529 - DNA, 426 bp, Glycine max
  Peptide Sequence Number=SeqID_178214
atgcataaggcattgcgattgaatgctccatttctatatccacacctagtcaccctcttccttcaacactttaacatccctcttgattctgaaccctatgttccaatcaagagatcctttctaataggtgcttcagtcattgcatccattggttatcaaaaagagcatgatggctcttgggtgaaaaagggtgctcgacatgttggtgaagaaggacatgatggagaagattcatctcttctttcaaagattttggacaggttcgatggtcttcaaacctttgttggtgaaaggtttgatactttggagttacaagtggacatgcgcttcaatgagatggagtcaagaatcaccaaggtcgaagaagatgtctcttatattcgttcaagctttgatctaccaccaccgccaccaccatcattttag

SEQ ID NO: 86530 - DNA, 287 bp, Glycine max
  Peptide Sequence Number=SeqID_178215
caaggtcatgccatcatgacatagggcacccagtggacccaaagaagtccaacagggtcctggggtttccagctctgattacgggcctttgtcagttctacggagtacccgtcaccccaaacaaggtcatcaggccccctactaatcgagctttcatcaataggtactgcgcccccaggcaggcagagggcgagacaccacaacagcttggggatggccggtggcgggcaacagacgcatcgccactacctctagagttcatctcagctcatccacagaaaggttag

SEQ ID NO: 86531 - DNA, 938 bp, Glycine max
  Peptide Sequence Number=SeqID_178216
atggattgggaccagctcttggccgggataggaggtagaacaatcagttggttcccccgatggaaggaaggaaaagaaggagtccttttctcatgtgggagatacccaaacattccgctggtaggaacgaggggttgtattaattacaatcccacgctcgctataagacaactagggtaccccatgaggggagcaccgacggaagaaagcatgtctcctttccttgtgagggatctcggcgcacaaaattccaaaactatacaaagaatccataaggcatgggaaaccccgttaaggaaagatcaagagcttagaggcattcgtaatggtatcattggtgggtaccacgaatggctgaaagttcgcatacgaggtttagattggctcgccaagttaaaagtcgtcagcgaagagaattttgaagcaccggaagaggacgaggaagtccaagctctcaaaagcgagttaggaaaggcaaaactcgccaaggagaagttcaagttggctgctacacacgttcggaaggagtgcgccgggttacgggaagagaatgcaattaccgcaagagcccttgaacaagagaccaagagggctcgcaaggaagagtatggccggaacaaatttcgcggagctctatggggtagcaataatgaactcaagttgcgaagggaagaaagggaccagtcgcgagcacatagcatggttctgaaagaggaattgattgcttgttcaaggtccaaaagaagcttgtctcagcgtctatgcgagatagaaaccaacatgttagctatcatcgccaagtaccaagaagagttgggtctagccacggcccacgagcatagaatcgcggatgagtatgcccaagtatatgcggaaaaagaggctagaggaagggtgatcgactctttacaccaagaggcaaccatgtggatggatcg

SEQ ID NO: 86532 - DNA, 673 bp, Glycine max
  Peptide Sequence Number=SeqID_178217
atgccggtcgctgactggcggccgccgatcacctcggcgcagcaggggtttcgcaataaagccaagatggtggtgagcggcagcgtggaaaaaccgctgttcggtatggtggcgcgagacggcgagccggtggatctctgcgcctgtccgctctatcccgccagcttcgcggcggtattcgacgtgctgaaaccctttatcgcccgtgccggtctgacgccgtacaacgtagcgcgcaaacgcggcgagctgaagtttttgctgctgacggagagtactcagggcggcatgatgctgcgttttgtcctgcgctcgcacagcaaactggcgcagctgcgcgccgcgctgccgtggctgcaacagcagttgccgcagctgcaggtgatctccgccaatattcagccggtgcacatggcgatactggagggcgaggaggagatggcgctgacgcctgagcaggcgctgccggaacgctttaacgacgtgccgctgtatatccgtccgcaaagtttcttccagactaacccgcaggtggcggctgcgctgtacgcaacggcacgcgactgggtggcggaactgccagtgcacagcatgtgggatctgttctgtggcgttggcggctttggcctgcactgcgccacgccgcagatgcagctgaccggcatcgaaatca

SEQ ID NO: 86533 - DNA, 144 bp, Glycine max
  Peptide Sequence Number=SeqID_178218
atgacttgggctaagcgtgtatccaccgctaagtgcatcttcagcgcgcttagcgcgatagaagaatctggcagagcatcaatatcaaggccacgtgctaagcgcgagatcagtgcgctaagcgtagcagttgttttcagctag

SEQ ID NO: 86534 - DNA, 279 bp, Glycine max
  Peptide Sequence Number=SeqID_178219
atggaaggttcccaacaaaacactcactatcctaaggaaaaattgcctaaaattattacacacaaatggaagtttggtaacctattggaggctcccaacacacttccaatgaaaggcctttttctttcaaaacttgaaagcaatgaagctcttaaggtgattggccccttgcttcttgactcaattcttcaagggatggcaccaatttcctatatggaaactcacaaacaaggaagcaaagagacaagcaataaccaaagaccaaaaaaaatgagatga

SEQ ID NO: 86535 - DNA, 225 bp, Glycine max
  Peptide Sequence Number=SeqID_178220
atggttaaggaggagtataaggagttaagtctctcctccaagaggttatctaagaaggaaagtcattttgcaataaagacaaacattaaagaaatttcccttcttagacaacctacacatcttctcctttgtaaaaggacacttgttagcattgccatacctcttgagcttgaggttattcctcaagtgttgagggaagaagcccagagtttcaagaagctctag

SEQ ID NO: 86536 - DNA, 243 bp, Glycine max
  Peptide Sequence Number=SeqID_178221
atggaggctagcctatgcattccaggcaggggttttattctgaacactaagggacaaccatggaagctcttcagaaaagatcttacaacccttgcccagacatggagtgtcttctcttactctaacctagctcctacctcccacacctcagatttgaacacagacagagctaggttggtctatggcttaatcacaaggatggacatgaacattggctgtttgatctctggacagataaccatg

SEQ ID NO: 86537 - DNA, 135 bp, Glycine max
  Peptide Sequence Number=SeqID_178222
atgaagttctaccagtatcttgcctacgtgaataagtgcacaagcacgataaaaacttcagccatcataggttcccccaacacaactgcagttctgtgttccctaccgaggcatttcaatgtacagacaagccag

SEQ ID NO: 86538 - DNA, 57 bp, Glycine max
  Peptide Sequence Number=SeqID_178223
atggtgagccatcatatgatgaatcccatgttagagccagagagacttagtctgtga

SEQ ID NO: 86539 - DNA, 501 bp, Glycine max
  Peptide Sequence Number=SeqID_178224
ctcaccttcagaggactacacgtcctcaccatcagagggctacacgccgtcgccatcaaaggactgcacgtcctcaccttcatagggctacacgccctcacctttagaggactacacgtcctcaccatcagaggactacacgtcctcaccttcagaggactacacaggactgcacgtcctcaccttagaggactgcacgtcctcaccttcagaggactgtgtgtcttcaccttcgtagggctacaggccctcaccttcagagggctacatgcccttgccatcagaggactacacgtcctcaccttcgtagggctacacgccctcaccttcagagggcttcacaccctcgccatcagaggactgcatgtcctcaccttcagaggactgcacgtcctcaccctcagaggactgcacgccctcacctttagagggctacgcgtcctcattttcaatgtgctccacatccacaccttaagagaatttaaggtcctctgcccttaa

SEQ ID NO: 86540 - DNA, 297 bp, Glycine max
  Peptide Sequence Number=SeqID_178225
atgatgacaaagaatgagttcaagatagaatcaagaacacttcaagattcaagaggaaagttgatttcaagaatcaacaatcaagattcaagagatcaagatttcaagaatcaagattcaagagatcaagattcaagactcaagattcaagaattaagagaaggcttagtcaagataagtatgaaaaggttttctcaaaaattgagtagcacatggatttttctcaaaacatgtttaccaatgagtttttactctctggtaatcgattaccagattattgtaatcgattaccagtag

SEQ ID NO: 86541 - DNA, 264 bp, Glycine max
  Peptide Sequence Number=SeqID_178226
atggagaagtctgaaaagaaaaatatcaatgaaaagaaattgaagaaagcatacattacatgggatgaaaacgatatggaatcttctgaagattcagaaaatgaagaaataaacctctgctttatggctaaaagttatgaaagtgatgaagaagtaacatcttcaaacaacttatctatttcttttgatgaattgcaagatgcatttgctgatctgcataaagagtcgattaaacttgcaaagaaaacaaagacatgtctctaa

SEQ ID NO: 86542 - DNA, 885 bp, Glycine max
  Peptide Sequence Number=SeqID_178227
ccacaccctggcaaagcggtctactgcaccgagaacaacccgccgttcgataacggcgtgctgaacgcgcagctgttgcagcaggcgaaaccgtacgtggatgacaagcagagcaaaacgttctggtttgatatccgcaacaccgaccgttctgtgggtgcgtccctctccggttacattgcgcagacgcacggtgaccaggggctggcggcagatccgattaccgctcacttcagcggtaccgcgggtcagagctttggcgtgtggaacgccggcggcgttgagctatacctgaccggcgacgccaacgactacgtcgggaaaggcatggcgggcggtctgctggcggtgcgtcctccggtgggttctgccttccgcagccatgaggcaagcatcatcggtaacacctgcctgtacggcgcgaccggcggtcgtctgtttgcagcaggccgtgcgggcgagcgttttgcggtgcgtaactccggtgccatcaccgtggtggaaggcattggcgataacggttgtgaatacatgacgggcgggattgtttgcgtcctgggtaaaaccggcgtgaactttggcgcaggcatgacgggcggttttgcatacgtcctggatgaagacggcgagttccgcaaacgcgtgaacccggaactggtggaagtgctggacgttgatacgctggctattcacgaagaacacctgcgcggtttgattaccgaacatgtgcagcataccggttcttcgcgcggcgaagagatcctggcgaactggccagcattctctgcgaaattcgcgctggttaaaccgaagtccagcgatgttaaagccctgttgggtcaccgtagtcgtagcgcagcagagctgcgtgtgcaggcgcagtaa

SEQ ID NO: 86543 - DNA, 504 bp, Glycine max
  Peptide Sequence Number=SeqID_178228
atgtgctgcgcgaggaggttggttgttgtctttctggcatttgatgtcttttttgccatcttctgtgttgtcttggcttgcttgattggcattgctctctgttgttgtttgccctgcatcattgctattctctatgctgttgcaggacaggaaggtgcatcagaagcagatcttagcatgcttccaaaatacagatttagaatattaagcgatgaggataagcctagtggtggagctggatctatggttcccatagaaaccagcagcgcttacttggcaaatgaacgaacacttctacctgaggatgcgaagatccaaagaggttactaccttgtacctgaggaatgttgtatatgcctttgttcatatgaggatggagcagagctgcatgctcttccctgcaatcatcatttccattcttcatgcattgtgaaatggctgaagatgaatgcaacttgtcctctctgcaagtacaatattctaaagggaaacgaacaagtgtga

SEQ ID NO: 86544 - DNA, 156 bp, Glycine max
  Peptide Sequence Number=SeqID_178229
atggacgaagatcaatgggcatattacagtacgatgtccgaagaagttgatatggattttcaagatgaacaagattatggtgtgaatgaaggacatgttgattgttcagacgcttttaatacttctcaggtcttcgcaacccgagaagatgtttag

SEQ ID NO: 86545 - DNA, 360 bp, Glycine max
  Peptide Sequence Number=SeqID_178230
atggaaataagaagcacgagaataagagacaagttgttcaacgagagactcagagtggtggagttagagaggctgagtggaatcagcaacttagacaatccagtctggaaggcctcgttagcatccttgttgttgagcagatttagtgccaacttcagccctagtgccaccagtgatgagaagaagaaaaagctaaacacttcaaagatgaggatctttttggctacatcaacgccgacgtcacagaaggagttgttctcgaggctgtgctggcccggggtggtgagggaaaggccctcaaagacgacgatcgtgaagagggagttcacattcaccagaccgtctagggctatcatgtga

SEQ ID NO: 86546 - DNA, 335 bp, Glycine max
  Peptide Sequence Number=SeqID_178231
gactcgcactgcctcctgaggctgaggttggttcttttgctgctcgtgtcaacacaaaggaaagttgtgtcaatccctcaaggcaggacccagaaacgggtgactcagacaaatttgggttgtatgccgatgacagtcttccccaactcattgcacttagaagagtttatgaggggtcgatgaccgcccacgatgttcctttgggcaatgatcaagtgaaggataagcaggtagctgagggaccgacaaaacctatagatatgctggatcctgacatcgatccgatgtacctgatgacattgaccattacccagcttttcttgaagtcgttgtag

SEQ ID NO: 86547 - DNA, 528 bp, Glycine max
  Peptide Sequence Number=SeqID_178232
atggctacaaacagattcttgtgtgaaacttgtgggaagggtttccaaagggatcaaaatctccaacttcatagacgtggacacaaccttccatggaagcttaagcaaaggacaggaaaggaagcaagaaaaagggtttatgtgtgccctgagaagagttgtgtccaccatgacccttcaagggctcttggagacttaactgggataaagaaacacttttgcagaaagcacgatgagaagaagtggaagcacattccaagacctatggcaccagagaatacaaatgtgactatggaactatgttttcaagaagaaacagctaggctaaatacagcatcagacataaacaccttcttagggggcaacattggttacaacataatgggaacatccctaggccctaacatggcaacccatttcccctcaattttcaagccagtttcaagcactaatgaaataagtaaccaaacatcttggggactacccctttggatgggtcaaacatcttctcaagctcaagaacaatga

SEQ ID NO: 86548 - DNA, 276 bp, Glycine max
  Peptide Sequence Number=SeqID_178233
atgactagaggcaatccatctgacttacaaccctttgatcctgagatagataggacatttcatagattagttagacaacatttagtaccttttgagcattctcagcattctgttattggtgattttgagcaatatagttttgaacactctgattttgcacattctgagaacatggcacaacttccaccccgtgagaggactctaagggaaatggctgcacctgatttcacctatgaaagcttgtgcatccaatactctgatgaggatgtcccatat

SEQ ID NO: 86549 - DNA, 282 bp, Glycine max
  Peptide Sequence Number=SeqID_178234
atgccttcaaaggttattttgatgatgccaaagaattcaagaatcaagagaaagattcaagagaagtttcaagtttcaagttttcaagaatcaagaatcaagaataatcaagaacaagattcaagactcaagattcaagaatcaagagaagacttaatcaagataagtatgaaaagacatgaagagtctataaaagcaaggctttgttttgtattgggatcctctagagtcgacctgcaggcatgcaagcttggcactggccgtcgttttacaacgtcgtga

SEQ ID NO: 86550 - DNA, 387 bp, Glycine max
  Peptide Sequence Number=SeqID_178235
atgttacgggactcaatcagacatccgagtaaaaagttattgtcatttgaatttggctcagaggttcaacattcaatttcgagcgtctcgatatattacgggactcaatcagacatccgagtaaaaagttattgtcatttgaattggctcagaggttcaacattcaatttcgagcgtctcgatatgttacgggactcaatcagacatccgaagcttcacacattcaatttcgagcgtctcgatatgttacgggactcaatcagacatccgagtaaaaagttatggtcgtttgaatttggctcagagcttcaacattcaatttcgaggcgtctcgatatcgttacgggactcaatcagacatccgagaaaaaagttattgtcgtttga

SEQ ID NO: 86551 - DNA, 705 bp, Glycine max
  Peptide Sequence Number=SeqID_178236
atggcgtctaggaaatgtaagagtatcggttcaagacccacaacacaatatgatacaaggagatttcactccttagatgcttggaaccggtacacggataatgtcctggggagaaacatctcgcctgagaggaaggtggagctctaccacaccgagttggatgattttaagactgaattggagaggcatttggctttggtgaaagagttctatgcaaacttatacagctctgagggcccttcaccaaagcaagccatagtcagaggctatttaatgaagattgatgctgacagtctcaacacattcctggagacacctgtggtatttccagagggtgagactttacccacatactccaggtactgcaggctgcccatagattacagagagattgaggctgccttatgcatactgagccgagggttcattttgaacgctaagggccatcctgggaggattctcaggaaagatttgactactttagcccaggtgtggagtgttctctcatactccaacctggcccccacatcacatacctctgatttgacagtggacagagctaggctgatcttttgcctagtctctcgcatggacatggacataggagctcgtatttctggccagatgacgtctatagcccagtctaacacttctagacttaggtttccttctctgatcaccgccctatatagagccagaggggtt

SEQ ID NO: 86552 - DNA, 507 bp, Glycine max
  Peptide Sequence Number=SeqID_178237
atgtttgcacattcgattaaaggctgccgtcccttgggacgggcgtgtggggtgctaataccttccccgtgcgtaaatacaactcccgaacctttcactaaaaagttcgtagatcgcgtcttttccgagaatgacgagttccgccaggagctcgagaggcgcagatggcataaagccttgaccaggcatcctaatggtcgcattgatgtggctctggtcaaggagttttatggaaatctatttgatctagaggataagtccccgaggcaggtcagagtgcggggcaagttgataaagtttgacggggagatgcttaatgcatttttagagacccctgtagttctagagcccgaggagcgctacttagcctattccaggttctgccacacgcatccagacccccaggagcttccttccaagcttttcactccagggcgcagttttgttcttaacgctgaaggagcgccctggaagctcctgaggaaggatttgactacattggtgtag

SEQ ID NO: 86553 - DNA, 504 bp, Glycine max
  Peptide Sequence Number=SeqID_178238
atggcaaaaatagcaaaagtggtcaagatctcagaacaagagctagaccgagtgaagcaaaaaaggaatggagtggtagggataccaaggaagtgcttggaggagaaggcggaagctctggccagccaaggagaatgggcagtattcatcgacgtattagctctgctagtgtttgcgatagtactattctcgaatgtatataggttggtggatctagtggccatcgatgcctttcttgcttatcaccacagcaaaaaaagcccggtcatcgctgttttgggggatacatatgatacgtttgacttgagatgtgagaagagcagtgcaagaattatctattgtacgccagctctttatgtattgttggtatcccacgtttttaatcatgaaggtagatctgtctgtcccctacaaggtcaccacatgtgctccggaaacggcaaagcaaattgggaagaactcgtggcaggcatgacgggaacgtccattagttggttcccatag

SEQ ID NO: 86554 - DNA, 333 bp, Glycine max
  Peptide Sequence Number=SeqID_178239
atggtggcccgggtgatgttggggcacggctacgagcccggaatgggtatgggcaagaacaacggcggtaggaccagcctgaacaaaggccagggcccgcagtcgggacaacgagccaaagaggccccgccatgccacatcagtaggagcttcataagtgcgggtttaagacgcaaaggtcaagtcgccgcgatatgcgatgatgactccctaaggagatcggatttggtacggccatgccctgccggtactaataccagggactcgaccgtcgatttcgagcaagaagcaagtcagacggaggatgaagaggataaggatgtagggaagtaa

SEQ ID NO: 86555 - DNA, 939 bp, Glycine max
  Peptide Sequence Number=SeqID_178240
atggctaagcaggatgaacaacggctattggtgaagattgccacgctttactatctggaaggacgaaagcagtctgatatcgcccaacttctctcgctgtctcagtcatttgtctctcgtgcgattacccgctgccaaaaagagggcgtcgtcaaaatcagcgtcgtgcagccatcgaatatctttctcaatctcgaaaaggggcttgaggatcgctacgggcttaaacaggcggtggtggtcgataccgaagaagaggccagcgaccataccatcaagcgggcgattggctccgccgccgcgcactacctggaaacccgcctgcggccaaaagatctgattggcgtctcttcatggagttcgaccatccgcgcgatggttgatgaggtccacgcgcaaaatctgaaggccagcggcgtcatccaactgcttggcggcgtcgggcccaacggcaacgtgcaggcgacgatcctcacccagacgctggcccagcgtcttaactgcgatgcctggctgctgccgtcgcagagcatcgaaggctccatggaagagcgcaatcgcctgctggccagcaaagatgtcgccgacgtggtttcacgctttgacgaggtcgatatcgccattgtcggcattggaattctcgaaccttcccagttgctgaaaacgtcgggtaactattatcacgaagatatgctgcaggtgctggcggcacgcggcgcggttggcgatatctgcctgcactactacgacaaatacggccagccggtgttacgcgaagatgaagatccggtgatcggcatggcgctggagaaagtcaaaaaatgtccgaacgtggtcgcgctggccggcggcaccgacaaagtcgcggcaattaaaggcgcgcttaccggcggctatatcgatgttttaatcaccgattaccccaccgccagactactg

SEQ ID NO: 86556 - DNA, 216 bp, Glycine max
  Peptide Sequence Number=SeqID_178241
acttatcaaggtaatccttgtggcgtctaccctgacatatcttccttcaccgaaagtggcgtctactcggacttatcttccttcattggaagtggcgtctaccctgacttatcttccctctttggaagtggcgtcatccaaatctctgtagcctgtatcaaacgatccactcctactcaggttcacatcatctggtatcagagctttagctcttga

SEQ ID NO: 86557 - DNA, 204 bp, Glycine max
  Peptide Sequence Number=SeqID_178242
atgatgataataaaagattatgacaaaggtgatgacaaaaagctcaaagatcaatcaaagaacaactcaagtgaatcaaagatcaatcaaagaacaactcaagtgaatcaaagatcaatcaaagaacaactcaaggaatctcgaaagaaggattggttccttcccttgaagaatttgatcaaggaacaaggggaaacaccttaa

SEQ ID NO: 86558 - DNA, 258 bp, Glycine max
  Peptide Sequence Number=SeqID_178243
atggacattctcaccctgggtcaaggtttatgggtttggtttggttcagggataaaaggggatgtcccatattatttccatgacacaaatgcaacaatgatgatttggaaattttatgcaaaactagtcatgcatgcacctatgtggacactcaagtgtcgaaaaatttttggtcatgtgattgttggaccttgtgacctcaataatcttaagagggataggcttagaatgcagaagaagcaacaacaatcaatttaa

SEQ ID NO: 86559 - DNA, 306 bp, Glycine max
  Peptide Sequence Number=SeqID_178244
atggtcattctgcgtcttgtatcaaccgagaggttccgctggcagggaggttcactggccgaatggtgtttcgctcgaacgaaattagtgtcttatctttacttcccttttatctccaataaaagacaagtaaagaggggcaactatcataccctaatttcgtccggggaccatccgttgttgggatgcgaccctcgtttgaccacttcgaggtacttggcacccatcgttaggcaatttgtgaagttccgtgacatgccggaagtcaaaagaaagcattgtagcacaatccgtgaagtttcgtga

SEQ ID NO: 86560 - DNA, 324 bp, Glycine max
  Peptide Sequence Number=SeqID_178245
atgaggggttgtattaactacaatcccgcacttgctataagacagttagggtacaccatgaagggagcaccggcggaagaaagcctctctcctttccttgtgagagatttcggaacgcaaagtttcaagcttatacaaagagtccacaaggcgtgggaaagcccgttaaggaaagataaagaacttaggggcatccgtaatggcatcatcggtggttatcatgaatggctgaaagttcgtacacgagggttagattggctctccaaattgaatgttatcaacgaggagaacttcgaagctccggaagaggatgaagaagtatga

SEQ ID NO: 86561 - DNA, 372 bp, Glycine max
  Peptide Sequence Number=SeqID_178246
atgcaagaagaaaatgaagaagaagattcagatgatgaagaagacttctcactctttgtcaagaagtttcagaaatttgtcaagagaagaaaaatagaaaggcgtcacaactttaacaatggaagaacatcacaagaaggctctcaagttcttagatgttacaaatgtaatcaacttggtcacatcaaagctaattgtccttcaaatgaagaatggcctgagaaaagtgataagaaaaggtatgatgaaagaagaaccaagaaggcctacattgcatgggacgacaatgattcatccgatggttcagaaaaggagatcaatcttctaaccaaggattatgagagtgatgaaaaaatatctcaagaaggttaa

SEQ ID NO: 86562 - DNA, 165 bp, Glycine max
  Peptide Sequence Number=SeqID_178247
atgtcaactgttcggtcaactgatgacatgaaacagaggcaaatgatgcacaagctgttcattaaagaaattgccacttggcggagagagggtgacacctttggatcagacccactggggatgacacttgggggcaatagagggttacaaattattcatgattga

SEQ ID NO: 86563 - DNA, 423 bp, Glycine max
  Peptide Sequence Number=SeqID_178248
aatgtgcctttcgtcatggtagaacaagctaataagatgttttatgttcaagatccttttgatgaaaggcacatgactacaccatccaactcccctcttcctcctccggagttagcagcaccttcattgtctacgtccaagaagacaagaaaagcaacacggctcaaatcattggctactagaccagttgggacagagaaactagtggttcatgtggatcctaccactaagagagtcgatggtccccatagaaagaaattaagaacatatttggggatcataactggtgataagttgttgggatacgaccctcgtttgaccacttcgaggtacttggcacccatcgttaggcaattcgtgaagttccatgacatgccgaaagtcaaaagaaaacattgtagcacaatccgtgaagttccgtga

SEQ ID NO: 86564 - DNA, 375 bp, Glycine max
  Peptide Sequence Number=SeqID_178249
atgttatccttcagccagatgcaatctcagggactcgcactgcctcctgagcttgaggttggcccttcagctgctcgtgtcagcacaaaggacaattgtgatgatccctcagggaacgatccagacacggtcaaggttggtgttgaggaggttagagatgcagatgctcccattcctgtacccactgaagaggttaagttagtggggcagacacttaacactttccttgcttggctaacacatcttgtcaagcgtttatcagaacaaggagttgtgggacccgtgaaacttgcagataggtcggatcatgatgtcgatgatcccctatatctaatgacattgagcatcccacagctttttctaaacccgttgtag

SEQ ID NO: 86565 - DNA, 1011 bp, Glycine max
  Peptide Sequence Number=SeqID_178250
atggcgaataaccttgacctgaatctaaaaccctcaaagccatacttagcagaaaacactggaatggtgcgtgtctatcgctatccaaattgctctgatgcaaatgttggttggggcatggaggctcatacagatagctcagtgttgtctatattgaaccaagatgatgaagtcagtggacttcaggtgctcaaagatgatcaatggctaactgtaaaacccatttccaacacgttgattgtcaaccttggagacatgatgcaggcaataagcgacgacagatacaagagtgtgacacacagagtgagtataaacaaacacaaagagagaatttcaatatgctactttgttttccccggtgaagacgttgtgattgagagttccaagtacaaaccctttacttacaatgagttcagagcacaagtgcaacaagatatcaaggccctaggctataagttggccaatccatcagcagatttggcattgtcaggggttggcttatttgcatttttaattcaggagattgggtcagagctaaaccgattgaatttccagggtttctatactgtgctacttgagagaaatgaagaactcattagtgtggcggctgttagggtctatgggaagaaggttactgaagtacctcctgttggtaccagaatagaatatcgtccacatggaatgtgtcacattttaatgaaaaaacttgaaaagaagctcacgcaattaggggtggaagggcttattttgcctgctgttcctagtgtgctagaaacatggacccgctcttttggcattgcaaagatgactaatcttgagagatctcaatttctggactacactttcctagatttccagagtgccatcatgtgtcaaaagctattgccgagtaatcaatctccagatccagtcttgttaatggttgctgtgctaacttcagtaagcctagtccagtatgtgaattatatccaagtagaagagattgacgaaggagggatgatggatcattaa

SEQ ID NO: 86566 - DNA, 372 bp, Glycine max
  Peptide Sequence Number=SeqID_178251
atgacggtgaaacctcggacacatgcagctcccggagacggtcacagcttgtctgtaagcggatgccgggagcagacaagcccgtcagggcgcgtcagcgggtgttgccggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccatctaaacatagggggcaccaccaccctaaggtaaactatccaaatgcaaatgtgtttgctagactgatagagataggacaaaggacaaacgcaaacccatga

SEQ ID NO: 86567 - DNA, 1752 bp, Glycine max
  Peptide Sequence Number=SeqID_178252
atggagacaagaggagatttccatgaccacaccaataagttcaatcagttgaatgcagatgataaactctcagatgaagagcaaacgttgttgttgttggcctcactaccaaggtccttcaaagctttggtgatcatcgctcttagagaaaatgagagaataatgagagctgaaaatgttgatgttgatgatgaacacaatgcaatagccgtggattctgcagacacatggcagtgttctgttgtgaagttattctttgaaaagcacccagggattcggaaaggacttctgatctttgtcctgctaggaacctgtatggcaattggggatggtgtgattagtcctttgttgaagtataagtatgagcatcatggcacacatagagttgcttttttgtttgctccagttgttgcaatatggcttttgtgtatcagcagtattggtatatacaacatattccactggaacccgaaaatataccgtgcactttgcccaatctacatggtgaagttcatcaaaacaattgggattgaagcatggttgtcattaggaggagtggtgctttcaatcacaggtgtggagaccatgtttgctaacttgggccatttttctgctctccctataaaggctgcattcctctctaggcatcatgaagacattcgaagaagtttctacaaagccatactaggcaagaatttagtgaagattattcatacttcaaccagaatatatgggaagatatacatcccagaagtcaattggatattgatgtgcttttgtttagctatcacaattggcctaagggacactaacgtgatagggctggcagtcatcactgttatgtttgtgacaacatgcttgatgacattagtaattgtgattgtgtggaagcaaggaataataaaagccattgcatgtttgctgttgttcggatcaattgaacttctttacatctcagcttgtatctgcaaggtccctgaaggagggtggatctcacttgtgctgtgctttatctttaattgtataatgtacacatggaactatggaacaatgaagaaacaccaattcgatgtggaaaacaaggtttcaatgaataggatgctatctatgggaccttccctcggtatggttcgtgtcccgggagtaggactcatgtactctaatctggcttctggtttccctgctatgtttggtcactttgttacaaacttgccagcattccatcaggtgctggtttttgtctgtgtcaaatctgttcaagtccctcatgcagtgaaactgaacggttggtcatcagtagggtcagttcaaaggagcttggcatgtttcattgcattgtcagagggggagagcatagaagaaccaacacatgaatggtctgcaaacgatggaaactcaaatgtggaagatcatgctgtttctctttcacaaaacacttctgataagtcatgttgtgaaaagtactcgctcccatcttcatgtgttttgcaggtaatgatgaatggtgataaccatcctgaaaagtctttctacaaagatgagtctctgcagattatgaaagctaaagaatttggtgttacctatatactaggccattcccttgcaaaggcaaagaactcatcttccatcctaaagaaatttgctatagatgttgtttttggatttctaagcaagaattgcagagagtttgatgctgttctggatgtttcccatacttctttgctagaggttggcataaaatactatgtctaa

SEQ ID NO: 86568 - DNA, 279 bp, Glycine max
  Peptide Sequence Number=SeqID_178253
atgggaggatacgtaggagcaagagcctcgcttttgtcgaccacaccgccttttgttgccatgactcaagagctggtgatacgcggagataccttatggttattcgcacctttttgtcatccagaggcggcgggcccgatgacaagcagagaccaagtttggtcattctgcacccatgatacgcggagataccttacggttatccgcacctttttgtcatccagaggcggcgggcccgatgacaagcagagaccaagtttggtcattctgcacccatga

SEQ ID NO: 86569 - DNA, 888 bp, Glycine max
  Peptide Sequence Number=SeqID_178254
atgcaagggctggtgatgctgattggcaccttcctgctgctgtttgccgtcatccaccgggcgggcggtctggcaacggcggtcaccaaactgcgtagcatcgatccgcagctggtgtcaccggaaggcgtcggcaacgtgatcaatccaactttcctcagttcgtttgccgtactggtgtgctttggcgtgattgggctgccgcataccgctgtgcgctgcatctcctacaaagacagcaaagcgatgcatcgcggtatcatcctcggcactatcgtggtggtgatactgatgctcggtatgcatctggccggcgcactcggccgcgcggtattgccggatctggcgattccggatcgcgtgatcccgacgctgatgatcaccgtgctgccaccgatggcggctggcgtgttcctcgcggcgccaatggcggcgatcatgtcgacgattaacgcgcagctgctgcaatcgtccgctacgctgatcaaagatctttacctgcgtatcgcgccgcagcacagcgagaacgaggcgcgtttgcggctgctctccggcaccatcacctttgtgctcggcctgctgctgctgctggcggcctggaatccgccagatatgattatctggctcaacctgctggcgttcggtggccttgaagcggtctttctgtggccgctggtgctgggactgtactgggagcgcgccaatgcggcgggcgccatcagtggcatggtggtgggagccggatgctatacgctgcttgccagcctgaaaatcgaactgtggggctttcaccctatcgtgccatctttgacattaagcctgctggccttcctggtgggtaatctgttcggcagcgcgcctgacgcacgcgatgctgccctggaataa

SEQ ID NO: 86570 - DNA, 253 bp, Glycine max
  Peptide Sequence Number=SeqID_178255
gatcagaacccagagatcgctgatctacgcgttcgtgtctcgcggcacggtgattctcgccgagtacactgaattcagtggcaacttcaacacaatcgcgttccagtgcctccagaagctccctgcctccaacaacaagttcacctacaactgtgacggctacaccttcaactacctcgtcgacaacggggttggggctagtttgaagttcggtgttgtgtttggaaatgaaatgaatttcgtgttgttctga

SEQ ID NO: 86571 - DNA, 889 bp, Glycine max
  Peptide Sequence Number=SeqID_178256
tccttgagttttatgccaatgcttggccaacagaggagggcgtgcgtgacatgagatcctgggtaaggggtcagtggatcccgtttgatgccgacgctatcggccaactcctaggatatccgttggtgttggaagagggccaggaatgtgagtatggccagaggaggaaccggtctgatgggttcgatgaggaggccatcgcccagctgctatgtataccggggcaggattttgcccggactgctgcagggaggcgagtgcgaatcatgcgcaccaacatgaccaccctgacccagatatggatgacgttgctcctcagcaacatcctgcccaccgatcataattccgacctccccatgccgaagtgccagctggtgtacgccatcctgacacggatgagcatccatgtggctcagttgatcgctgatgccatctatatttttgcaggtatggcgcccactaggcaccctttggacccagataagtccaatagggccctgggattccccgcactgatcacaggactctgccagtcgttcggagtccccgttgcacctaccaaggtgattcgggccgcccatcacccgggctttttattgagaagtactgtacccaaagacagggtcagggtgatgctccacaggccgcaggcgcgcccccaaccacctcatcaggctggccaggctggggcatttgacatggagcaggctccgcttctttttcatgccctactccagaccagttcagggcagaggttgcatggcccaggagattggcccgaggcccaagcaggagaggcacccccagaagctcccggcgatggagaagaagcccacgaggatgaggagatggccgatttgcttgacttcttgggagggagtggagatac

SEQ ID NO: 86572 - DNA, 534 bp, Glycine max
  Peptide Sequence Number=SeqID_178257
atgagtcatggcccgagaagaatgagaagaaaagctataaagaaagaagatccaagaaggcgtatgttgcttgggatgacaatgactcatccgatggttcggagaaggagatcaatcttctatccaaggactatggaagtgatgagaacatctctcaagaagattaagcaaaaagcaaaatctctcaaatgggtggaaccatcaaagaagcacaaaggttcttcaagtagaagccaacgacactccgaggctcaggatattccaattccttcctccatttcctcctccgcattgttctcatcagaaaaacaacgtatacggtacacaaatctcttctcctctcgttctatcatagaccctaagttcatagatatggatttcttttctaatgagagtttcaaatgcattcaagcatgtcaaaactcaaatctcattccttttatgtctctaaaattacctgtgtattctgaattggtaaaagctttttattctaatcttgaaattcaagaaagtaccttgatttcagaagtttaa

SEQ ID NO: 86573 - DNA, 204 bp, Glycine max
  Peptide Sequence Number=SeqID_178258
atgagtgagagaggaaaggtttggaggtttgggaatgggagagcaggacgcgtgggtaatcgattacaagtaatggtaatcgattacaggaggaggcagcctactggtaatcgattacatgaatactgtaatcgattacaggctatctgttctagtgtaatcgattacagtattcatgtaatcgattaccagaacaaggaatag

SEQ ID NO: 86574 - DNA, 102 bp, Glycine max
  Peptide Sequence Number=SeqID_178259
gtaggaaaaattcttctcaatgccctgttgtatccaggaatcaagacaaatctgcagaacaactctcttgtcgcaatattccatacttcggtaaggcattga

SEQ ID NO: 86575 - DNA, 527 bp, Glycine max
  Peptide Sequence Number=SeqID_178260
gtcaggaagctaggggagcttctggtaatcgattatcaggggatgtaatcgattatcaagcttcaaaagggaactggaagactgtggaggcctctggtaatcgattaccagtctgtgtaatcgattacacagaggaatgggtcactggtaatcgattaccagtgcccgagatgaaaagccttaagataccccttttacttgcatgtagtggttatgagacacattgtgttgcggcgcagcagcttgggagaccctcaaaggcaacacgaggtgccgatttcggggcacgatccgattcacggctacttcattgggtgcatccagatgaacccgcacgtacgcttcagcgcactgtgggagtggatactacccacgcctaccccatatcgtctaggggagccagtccaagtgatcgaggtaacgtcgtcccgaggaaggccttgaggaggatcttgaggagctaccctccgaagcctgctgcggatgctcttgattttctagagggtgatgaggatccccttccctga

SEQ ID NO: 86576 - DNA, 591 bp, Glycine max
  Peptide Sequence Number=SeqID_178261
atgggtgaagcagaggaggtgcaagagaagatgaaggccgacatggaggccatgaaagagcaaatggccacaatgatggaggccatgatgagcatgaagaagataatggaagccaatgcggttatagttgccgctactagcgctgtcgctaaggtgaacccgatgctcccatctggcctcaagcaaatgaatcatccaacctcaaatatggcacatatctctcaaaccatgggggagacacatgaaattccccaccacaatctagctgacttcgagccttggctcggatatgccactgaagggcaagcagttggtggtataccctttgaaaacactttggagggccctcagtttcgcccacaacaacaaccattgcattttgcggtgggaagagcccctcttgctatggcagaaatgggaaagaggaaaggctcagggccattgaaggagaacatttgcaaaaagggggacggatctttcaaagaacacgcccaaaaggtggagggatctggcggcccaggtggtacccccaatgatggaaagggagacgatgatcgtgatggtagacacattatcgatactctactatga

SEQ ID NO: 86577 - DNA, 132 bp, Glycine max
  Peptide Sequence Number=SeqID_178262
atggtagaaagtatgctaagtttggaaaggagtgatgtggttattggacgatggaaacatagagtgaaaagatcagttaaggtgcctgctaccagcaacaaacttgcggatatccctccccatgatcaataa

SEQ ID NO: 86578 - DNA, 490 bp, Glycine max
  Peptide Sequence Number=SeqID_178263
atggggacaaatcaaaacggaaaaagattttatcaagtcaagattaagagtctagatgtcaccagccttaaggagttgggacggttgatgggaccccttcaaaggcaagccttccgcaaagtatttacggaagctgttgtatccctcacccaatactatgaccagccattgcggtgctttacattgggggacttccaaatggtaccgactgttgacgagtctgaggagatattaggatgccctcttgggggaaggaaactgtatcttttcttcgggtttcttccctccttgagtaagattgcagctgtggtcggagattcggaaaaagagttggatcgcatgaagcaaactcggaacggcgtagtaggcctgccacggaaatacttggaaggcaaggcaagggatatggcaagccaagagaaatgggtcccgtttgcggatatactagctttgcagatctttggggttgtcctctttccgaacgtggacg

SEQ ID NO: 86579 - DNA, 315 bp, Glycine max
  Peptide Sequence Number=SeqID_178264
gtgagcatagttattagaggggtgtgtgtagctaagcttgagcttctcaaggaagcttctcaaggagcatcctcttcaagcttcttatccaaggcaattcttggtggtgaagctccttcttccttggctgattccctagtggatggtgccacccctctcctcttctcctttgccttccgctgtatctccatgggaaggagcccagagtatgaagaacctcgggatttgaggtcaaatcctttccaaggtggagaggatgatgcaatcctaccccccaagggtattggacagaagactctaggaggctttggctag

SEQ ID NO: 86580 - DNA, 189 bp, Glycine max
  Peptide Sequence Number=SeqID_178265
atgtgggtgcaaatagcacccaggcccacttgggccctccagaatattcctccagaaggctgttgcttctggaggaagcaacctggctcgcctgggggaggaagtgaagaagaaaagggttcagcccctttggcacttctctctctttcgaatttgcttggaaaaattgtttccgtgaagaaaatctaa

SEQ ID NO: 86581 - DNA, 1200 bp, Glycine max
  Peptide Sequence Number=SeqID_178266
atgccctcttgccctgtgcaacagcacgttattcaacagccagcagagctgacacaacatcaagacaggaaagatatttttatggttgatcaatctaaagcggcgcccattgaggccgaacagccggaaaaactccggcgcaacctgcataaccgtcacatccagcttatcgctatcggcggtgccattggcaccggtctgttcatgggctccggtaaaaccatcagcctggcgggtccgtcgatcatcttcgtctatatgatcatcggttttatgctgttctttgtgatgcgcgccatgggtgagctgctgctctccaaccttgagtacaaatccttcagcgactttgccgccgatctgctcggtccgtgggccggttatttcaccggctggacttactggttctgctgggtggtgaccggcatcgccgacgtggtggcgatcagcgcctatttccagctgtggttcccggacttctcgatctggatgagcgcactgctgtgcgtgtttgttttccttgccctgaacatcgccacggtaaaactgtttggcgagatggagttctggttcgccattatcaaaattgtcgccatcgtggcgttaatcatcaccgggattgtgctggtcagcctgcactacccttcgccgaacgggagccacgcggcgctgagcaatatctgggatcacggcggtatgttcccgaaagggctgagcggtttctttgccggcttccagattgcggtgtttgcctttgtcggcattgaactggtgggcacggcggcggcggagaccaaagatccgcataaagttctgccgcgtgccatcaacgcgatcccgctgcgcatcatcatgttttacgtgctggcgctgttggtgatcatggcggtgacgccgtggaaccaggtcatgccggatcgcagtccattcgttgaaatgtttgtgctgattggcctgccggccgctgccagcatcgttaactttgtggtgttaacctccgcggcctcctcagccaacagcggcatcttctccaccagccgcatgctgtatggcctggcggaacagggcgtggcgcataaggcgtttggccgtctctcggcgcgcgcggtgccgaccaccggcctgttcctttcctgcctgtgtctgctggcgggcgtggcgttgatctacctgattccggatgtgatgacggtcttcaccatg

SEQ ID NO: 86582 - DNA, 342 bp, Glycine max
  Peptide Sequence Number=SeqID_178267
atgcggatcgccgctaaggaaaatataggggtacgacttatcatcgcgcagcagcacgttgtagcgcggctgatacaacttgatgtagttgtgctccagcagcagcgcttcggtctccgtatgggtgaccgtgacatcaatattatggatgttgctgaccagcacttcggtcttacggcttcccacctgcgtgcggaaatagctgctcaggcgttttttaaggtctttggctttaccaacatagatcaccgtgcctgtcgcgtcatacatgcggtagacgccgggctgactggtcacggtgctgagaaaggctttaggattgaaaacgtcactcactactga

SEQ ID NO: 86583 - DNA, 307 bp, Glycine max
  Peptide Sequence Number=SeqID_178268
tgatcaacgggttcccatgaaccctaagagaataaaggtcattcctgagtggctcactccaccaacaccactcattgagttggtgagaaaccatgttccttcatgggaagatgcccaggaaatgggtgttgagggaaggagcccagagtatgatgaaactcgggatttgaggtcaaatcctttccaagctctagcttctcatctcaaggaggtgagcttagctattagagagcttctcaaggaagttttctcaaagaagcttctcaaggaagttttctcaagaaagcttctcaaggaagctacctag

SEQ ID NO: 86584 - DNA, 738 bp, Glycine max
  Peptide Sequence Number=SeqID_178269
atgaccggccctctcgatgagtcgatctcttgctttctcataaaggtggacccttgggtactagtacctatcacctttagaggactatatgtcctcgccatcagaggactgcacatcctcgcctacagagggttgcacgccctcgcctttagagggctacgcgtcctcattttcagtgtgctccatatccacaccttaggagaatataagggatcgcgcccacaagtcgcccagtgggcccgaagaagtccaacagggccctggggtttccagctctggttgcgggcctctgtcagtcctacagggaatcgcgcccacaaagacacccagtggacccggagaagtccaacagggccctggggtttccagctctggttacgggcctctgtaagtcctaccgggtgcccgtttcccccggcaaggtcacgtcatcatgacatagggatcgcgcctgcaagacaccaagtggacccgaagaagtccaacagggtcttggagttgtcaagctctaattacgggcctctgtcagtcctacagggcgcccgtcccacagcaagttcatgccatcgtgacataggcatcaggccccctactaatcgagctttcatcaagaagtactacgtctccaggcaggcgcagggcaaaacaccacagcagcctggggatggccagcagcgggcaacagacgcaccgccatcacctctagagttcacctcagctcatccacaaaaaggatag

SEQ ID NO: 86585 - DNA, 606 bp, Glycine max
  Peptide Sequence Number=SeqID_178270
atgggtgaccaagaggaggtacaggaacagatgaaagccgacatgtcggctttgaaagagcaaatggcttccatgatggatgacatgctagaaatgaggcaactaatggagaaaaacgcagccacggctgccactgttagtttggctgccgaagcagacccaactctcccagctattgcgcaccaccctatcccaaaacgtgtggcttacccttatggattgccacctaattacacaccgccagtcatacgtgatgacacgggtcatgtccctccccccatccttgaaggggagcctcctcgacagtcggacgaggtccacgaggatcgtcgagagcatgcccaaggagacatcgattcccactccccgttccctgtcgaggggccgacgcccaacgcactacctcagcccaacctcatgggagaacctcgaaaccccccagcacagtcgatattcttttccgcagaaggaccacccccagcagcagaagaaaggaggaagctcgatctcatcaaagagagattgaaggttattgaaggctttggcgactatccgttcgcagacatgactgatctttgcttaatatcgacgtcatcatccctctga

SEQ ID NO: 86586 - DNA, 624 bp, Glycine max
  Peptide Sequence Number=SeqID_178271
caccgaagagacgagaagtccaagctctcaaaagcgagttaggaaaggcgaaacttgccaaagagaagttcaagttggccgctacacacatccggaaggagtgtgccagattacgggaagagaatgcaactaccgcgagagcccttgaacaagagaccaagagggctcgcaaggaagagtatggccgtaacaaatttcgcggagctctatggggtagcaacagtgaactcaagctgcgaagggaagagagggaccagccgcgagcacatagcatggtcttgaaagaggagttagttgcctgttcaaggtccaaaaggagcttgtctcagcgtttatgcgagacggagaccaacatgctagctatcatcgccaagtatcaagaagagttacgcctatccacggcccacgagcatagggtcgcagacgagtatgcccaagtatacgcggaaaaaaaggctagaggaagggtgatcgactctttacaccaagaggcaaccatgtggatggatcggtttgctcttaccttgaacgggagtcaagaacttccccgattgttagccaaggccaaggcgatggcggacacctactccgcccccgaagaaattcatgggcttatcggctatt

SEQ ID NO: 86587 - DNA, 540 bp, Glycine max
  Peptide Sequence Number=SeqID_178272
atgcagatgccctcaagccagtccctgggtgaccccgctagtgttgaagaaggccaggagtgcgagtttagtcagaggaggaacagggctgatgggttcgacgaagaggccattgcccacctattatgcacaccgggtcaggatttctcccagaccgctgcagggaggcggtcattcggggttcccgtcactcctagtaaggcgatccgaccgccgatcacccgtgccttcattgaaaagtattgctcgcctaggcaggcacagggtgatgcatcgcaggccacagatgcaccgccaccacctcatcaggctaatcctgctggatcattaggcatggggcagtatctacaacacttggttcgccaacaggaggccaaccactgggggcagtttagggctgaggtcgcatggcccggagattggctcgaggcccaggcaggggaggctcctgcaggagctcccggcgatgtagaggaggcccgcatggacgaggagatgatgaacttgctcgatttcttgggaggaagcggagctacgtga

SEQ ID NO: 86588 - DNA, 234 bp, Glycine max
  Peptide Sequence Number=SeqID_178273
atggcatgcaacgtgtttgctccgtgcccctattttagggacctatatgggaggaaactaaaagggcttttagtgataattcctaaggtggtcatatctctcttgatggtctctagaggtatcatccccttcgaagaacatattgtggcagtagggactactagtaacaatatgttatcaaagagagaaactctagatgagggttcactgttatcaagcaagtcggagacctag

SEQ ID NO: 86589 - DNA, 195 bp, Glycine max
  Peptide Sequence Number=SeqID_178274
atggggaatccaaataggggagaagctactaaagctgctgagtaccagggggaaattgagaaaattttccgagtgatgacatgtctggagggtaaaaaagttgcttttggtacatatactctggtggaagaagttgagtattggtgggagaatactcgccaatgcttagaggctgaaggtcaagatgtgacctag

SEQ ID NO: 86590 - DNA, 267 bp, Glycine max
  Peptide Sequence Number=SeqID_178275
atggagagggaatggagcaattgctctcattttctctcttgcattggaggttgggttgtgtgggttgaaggagattttgtgaagcttagagatggccaaatattcttatttgtcgatctattcaatgctggaatcagacccgctattaatgtaggtatttccgtttccagagttggatcggcggctcaaattaaagccatgaaacaagtaactggtaaattaaaattagaatttgcacaattcgtagaattagaagctttttcctaa

SEQ ID NO: 86591 - DNA, 453 bp, Glycine max
  Peptide Sequence Number=SeqID_178276
atgacacttttcatcaagcagttgcttcccattactgatcaaaactgggctgttaaggtgtggcaaaaattgcaggctcaggtggacaaattatctgatgccagacttgaagaggccttctatcagaacacaaaggccttgcaatcatttcaatgtcttgatgctaacacatacagaagaagtatgattctgaaagcaaatatcttactggctaaacttcaatttttaaactttaaagctgccccattgctggatctgctggttagctcaacttggcatggcaattctccctgtagctcggggatccccgcggggactgtcccattcgggacctgcggtcggggaaaaatttcccacggggacggggatgaaaaacccccgcaactaattcagggacggggacgagggctatgctccccgccccgcaaggtccccgtatccccacgcatataa

SEQ ID NO: 86592 - DNA, 120 bp, Glycine max
  Peptide Sequence Number=SeqID_178277
atggatttgaaagtggagagtgtgttttacgcgtcaaatctggtgggagaattccaggcacgtaggaggtggggacgactaagaggagaagcaccaccgtggcagtgcctccctgattaa

SEQ ID NO: 86593 - DNA, 570 bp, Glycine max
  Peptide Sequence Number=SeqID_178278
atggaaaactctatctctctcctgggtggtaaattggatatatcctcagggaacaattcaggaaactctctgacaacagggaggtcacacatggaaacctttgtctctacttccagagataagcatcataccacaattttatcaaaacattttaacaatacatggttggaagataaccagtctatacccagaataacatcaatttggctcaaaggcaaacaaattagatcaatcaagaatgttctaccagaaatttccacaggacaattcaaacacacattagaagttaacacagaaccactagttggggtctctaccaccaaatccttatttaaagaagacacaaaaagcttaagtttccctacacacgaacatgatataaaagaatgggttgcacctgaatcaaatatcacaagtaagggaatcccatttatgaaacatttaccttggattagatatttggatttcgaagcttcgacaccgttaaggataaagacttttcccgtggccttcggatgtccagtttggtcattcagacccccaccattctgctccttcttaggatattga

SEQ ID NO: 86594 - DNA, 420 bp, Glycine max
  Peptide Sequence Number=SeqID_178279
atgcgcggcagtggtgtcaccgagcaggatggtgtcgctgccatctcacggcagtggccgtggtgggtggtacgaagcgacagagtcaacgaacggccgggttggaagtggcggttgattggacggaagcgaagaagtgtcagtggaatgggatcaatggtgtcaatcataaatgaaattgttttaggttggggatggtgggaagaagctatgggaagcgaagctggcatgggtgtgtctgttggtggtgacttcgcagaggaagaagatgggggtgatttgggagaagatggagtgggtgtaagaatgaatagtcgacaaaggatgacattgagcttggtagtcatctctagagtattggtggtcatggtggataggttttgggtgaggtggtacatgacctcttcagacggtccatag

SEQ ID NO: 86595 - DNA, 178 bp, Glycine max
  Peptide Sequence Number=SeqID_178280
atgttgcaacgtgcccttttgcgggcgtgcgaggcgaggctcacgggtgcgctttccaaaggaggaaaggtcgacaaaagcggggcttttgctcctaagtaccctccatcgaagaggaaatcaaacctacgtagttctttcttaagcgtgaatcaagcgattctttttactttgaggg

SEQ ID NO: 86596 - DNA, 405 bp, Glycine max
  Peptide Sequence Number=SeqID_178281
atggagtgtccctttactgtcaaagatgttaagccatatggagctatagagatagaggaccaatccaaagactacagcagagtagggaagaaggagacaaacacacaagagtttttatactggttcggcaacaacccgtgcctacatccagtccccaagcgacctgcagtccttgagatttcttttcaaccttgtaaaaatccttttacaagcaaagatccacaagggatgtaccctcccttgttctctttgaacaacctagtggatgtaccctccactagaactgatccacaagagatgtaccctctcttgttatcagtcaacaacccaagtagatgtaccctctacttgtaccacaaaggatgtaccctccaatgtgttaagacaaagttctcaggcggttag

SEQ ID NO: 86597 - DNA, 651 bp, Glycine max
  Peptide Sequence Number=SeqID_178282
gtcagagggtgcgaacacgcgaccgctagaggtcacgccgctcagccccgtgatattggttaccttggccgacaacgagctgatgtcagtggcttcttccttcctttcacttggaggcgcatacctccacagaactgtgtggctgttttggtatggaaacggaataggtctaactaccgagggggcctcgtagataaaccttctgggggtcgtcacgtctttcaacggcttggacctgcacgacctacccgactcgacggcattaaccgctccccctccatgattggcaagcgggtttgtttttacgttgggctggtcctctggaaacgtcagccatccggcttctatcaaatgttggacttgtgtttaaaggccaggcactgttcggtggagtggcccggggttttcccatggaggctggtagatctttccgggagatatcacagccatctggttggcgatgagggatggcaagagctcttcgtacgtcattgggatcagggtgaatgttgtcctcgggggaaagttccttatcgcgttggaaatagtgccaaagtgggcattgccggccgggcgagtcggggttggagccgtagcttggggggtctccctctggatgggcgcaggcgccctagcttgtacgggtgctga

SEQ ID NO: 86598 - DNA, 492 bp, Glycine max
  Peptide Sequence Number=SeqID_178283
atgaggggcatcgtgcatgagcctcaagtgaacataggggcagatcaaaagttctcacctgtcgatgtttttaaacaagaaaaagaaaaggggggacaaaccctagggtttcaatggattgatcaaacatcaaacgactccattgccgtcactccaaatggtcaagatggaccctcgggtactagtaccctggtcttcagaggactacacgtcctcgccaacagagggctgcacgccctcaccttaagaggactgtgtgtcctcactttcagaggactgcgtgtcctcactttcagaggactgcatgtcctcaccttcagagggctacacgccctcgccaacgtagggctacacgccctcaccttgagaggactaaacgtcctcgccttgagaggactacgtcctcaccatcagagggctgcatgccctcacctccagaggactacatgtcctcaccttgagagggctacacgccctcaccttgggtactag

SEQ ID NO: 86599 - DNA, 258 bp, Glycine max
  Peptide Sequence Number=SeqID_178284
atgcataagaaagaactacgtaggtctgatttcctctccaaaggaggtttccttcggtttttccgacgttttccacaaataaacgttggtggcgactccgcgcatctttcctcctttggaaagcgcactcgtgagcctcgccctcgctcgcccgcaaaagggcacgttgcgacactaggctatcatgaggaatcgaggtctagcagtccaggagacaacataggaactgatgtgtcatcattttctcatatttcttaa

SEQ ID NO: 86600 - DNA, 49 bp, Glycine max
  Peptide Sequence Number=SeqID_178285
ggtgagtgctgtgaaaattttctcggacgcccaaaatggactcggatga

SEQ ID NO: 86601 - DNA, 558 bp, Glycine max
  Peptide Sequence Number=SeqID_178286
atgaatcatttggttgatgccggatggggacgtcgggttcaccttagcaacaacgctggtagcggcaattgcaaccgcatggcttccattatcttcttcatgctaatcatggcctccatcattgtggccatttgctctttcatggcctccatgttggccttcaccttctcttgcacctcctctgctttacccattactctagctctaacacagatttccaacacggtccatgacatctttgtcaaggtgaaacaggaagtaacagggacatcaacagccctaaatgtgtttggcagtagacgaagcagcgatgtaacacgatccatcttttgccccaatttttgcaagatggttacttccatacttcaacttgactcgatgaaccttttcgtaaaagcgcgagcttggttcaaccccataacccagggaatggcaattttgatcgccaatacttcatcaacatttcataaggatgaaagactcgggaatacgcatgctatgcatggaaaatgtaattatgagattgagatgcccgaagaaacatcctttcttagttaa

SEQ ID NO: 86602 - DNA, 225 bp, Glycine max
  Peptide Sequence Number=SeqID_178287
atggaggctggatctttgagcttcaatgaggtccttcaatggagaaaaggtgagaggaggcgctatccactagggaataagccatggaagaaggagcttcgccaccaagaatgtgccttggataagaagcttggagaggatgcttcgatggaggaaaagaaagagagagagaaagagagaggagggagcacaaaattgaaggaggaaaagagggagagaagttaa

SEQ ID NO: 86603 - DNA, 300 bp, Glycine max
  Peptide Sequence Number=SeqID_178288
tcattcggggttcccttcactcctagtaaggtgatccgaccgccgatcacccgagccttcattgagaagtattgcacgcctaggcagacccaaggtgatgcacctcaggccgtagacacaccgtcaccacctcatcaggctgatcctgctgggtcattaggcatggagcgggccagggtttcgctccttttacgtacaggggaggcgcctgcaggagctcccgacgatgtagaggaggcccgcatggatgaggagatgacggacttgctcagtttcttgggaggaagcgaagccacgtga

SEQ ID NO: 86604 - DNA, 163 bp, Glycine max
  Peptide Sequence Number=SeqID_178289
atgactgtttatgtctttagcatgactgactacttgattaaatgtggaggaaagtgggataaaatggccgatactactggaaggattcctctttggataataggtactcgtaataactcacctgggatccactcgaattcgtcaaagaaagagtggatcccag

SEQ ID NO: 86605 - DNA, 381 bp, Glycine max
  Peptide Sequence Number=SeqID_178290
atggatatctgtgaagatactgacattcctgtaatattgggaagaccattcatgttgaccgcaagctgcatagttgagatgggtaagaggaagctggagttgggttttgaagatcagaaaattgattttgatttatttgttgaagacaagcctactccagaacaaaatgtttgcttacaagtaatggaaggaggtcaagaggttctgacgcgcaagcttcgcgctaagcgcatctttgttcatgcgctaagccgagtgtctcaagcgcttagtggccaacccttgcatctgaggctgatttggttcactaagttggccaaggctgagctaagccaacgtcaattcgatctgaattctgctaagctgcagtctgatcgctaa

SEQ ID NO: 86606 - DNA, 216 bp, Glycine max
  Peptide Sequence Number=SeqID_178291
ggaaagggaagaatcaaaagaattctcagactgagtccttttgaattctcttggaaagggagaagggagacacaaaagaattcaggcgaattttcacttgtagaagaacaaggtttgaaaaacaaaaaacttaaaaagctttttggcaaaggaagaagaagaaagatgagtagcaaaggtttcaagatttctcaaaagttgttcaagaagttctag

SEQ ID NO: 86607 - DNA, 288 bp, Glycine max
  Peptide Sequence Number=SeqID_178292
atgtccctcttgactctgagcccttttgttaaagtcaagagatctttctctatcggtgcgaatgtggtctcctcttttggataccgcaaagagagggatggttcttggcacattcttgatagattggatggtcttcacacctttgtcggtaagcattttgactccttggatagccgcattgatgccattgatgcacggtttgcaggaatggatacatgcatcactcagcttgaggaggatatgagttatgttcgtcagtgcttcgaccttccaccaccatcttcatag

SEQ ID NO: 86608 - DNA, 762 bp, Glycine max
  Peptide Sequence Number=SeqID_178293
atgaccgaccctctcgatgagtcgatctcttgctttctcataagggtggacccttgggtactagtatctatcgccttcagaggactacatgtcctcgcctttcgaggacagcacgtcctcaacttcagaggactacgcgtcctcgccttcagaggacttcacgtgctcgcctttagagggttacacaccctcgcctttagaggactacaagtcctcgcattcagagtactgcacgtcatcgccttcagaggactccacgtcctcgccttcagaggactgcacgtcctcacctttagaggaccacacgtcctcacctttagaggaccacacgtcctcgccttcagaggacttcacgtcctcgccttcagaggacttcacgtcctcgccttcagaggacttcacgtcctcacctttagagggctacacgccctcgcctttagaggactatacgtcctcacctttagagggctgcacgtcctcaccttcagaggactacacgtcctcacctttagaggactacacgtccttgccttcagagggctacacgccctcgccatcaaagaactgcacgtcctcgcctttagagggctacacgccctcaccttccgaggactatatgtcctcctcttcagagggctacacacccccaccttcaaaggactacacgtcctcacctttagaggactacacgtcctcgcctttacagggctacacgccctcgccttcagagggctgaacgccctcgcccatcctcgcctttag

SEQ ID NO: 86609 - DNA, 76 bp, Glycine max
  Peptide Sequence Number=SeqID_178294
atgacgcccatcaaccgtgccaccactgccaaaggcggccgtagcctactcgacgcggcgatcgtttggtatttat

SEQ ID NO: 86610 - DNA, 174 bp, Glycine max
  Peptide Sequence Number=SeqID_178295
atgtcttgcctagcgccccctaccccccgaccttcctctgccgaagtgtcagctggtatgccacccaccaggcaccctctagacccagataagtctaacagggcccaggggtttctggcattgatcacgggcctctgccagtcattcggggtcccgtcactcctagtaaggtga

SEQ ID NO: 86611 - DNA, 612 bp, Glycine max
  Peptide Sequence Number=SeqID_178296
atgacctgtagattactggccggatcattaacttttgataatcgcatcatgcactatatcattgttagaattttgcttccccggtcttcaaatttagcacaagcctctgaggaggatttgattctgatgtgggcttttctcaccggtcgtcagatagactgggcccatttggttcagtaccgactgcataaggcattacgggccaatgcacctctaccttatccacacttgataactttatttctgcgtcatgttcaaattctgcttgatgatgagccatttgttcaagtcaagcgttcctttgcaattggtgctagtgctgtgacttcctttggttaccgtaaggatcggaatggtcaatggctgaagaaagacgcactccctcctcaagatgagcatactccttcacctcctcctcagcgtgaagattcagcactcctgaatgaagtccttaccgaattacgaggtcttcgttcttatgttggtgaacgtttcgactcattggatacacgctttgccggcatggatattcgcctcacacaacttgaaaaagatgtctccttcatccgtacttgctttgatccaccaccaccgcctccatcatcctcttag

SEQ ID NO: 86612 - DNA, 264 bp, Glycine max
  Peptide Sequence Number=SeqID_178297
atgtcttttctggtttttccgatgttttcctcaaataaacgttggtggcgactcctagcgtattcctttcttggaagacgcacccacaagtcacgggtcaccctcccgccgaaggctcctatggagcttgtttgccttggatcttcttcatcaatggattcctttgcttcttggatgatgaatgatagcggaatggagaagaaagagagagaggagacgccacttcaaggagaagatgagtcgagaagaagctcaccaccatag

SEQ ID NO: 86613 - DNA, 216 bp, Glycine max
  Peptide Sequence Number=SeqID_178298
acttatcaaggtaatccttgtggcgtctaccctgacttatcttccttcattggaagtggcgtctacccagacttatcttccttcaccggaagtggcgtctacccagacttgtcttccttcaccggaagtggcgtcatccaaacctttgtagcctgtatcaaacgatccgctcctactaaggttcacatcatctggtatcagagcttcggctcttga

SEQ ID NO: 86614 - DNA, 309 bp, Glycine max
  Peptide Sequence Number=SeqID_178299
atgatgacaacaaaagatgatgacaaaagtgatgaacaaaaagctcaagtgaatcaaagaacatctcaagagaatcaagaacaagtcaagagttcaagaatcaagaagaattcaagactcaagaagaaagcctacaaacaagtatcaagattcaagattcaagatctcaagaatcaaatatcaagattcaagaatcaagaatcaagactcaagatctcaagaatcaagatcaagattcaagactcaagatcaagattcaagactcaagattcgagaatgaagaaaagactcaatcaagataagtattaa

SEQ ID NO: 86615 - DNA, 366 bp, Glycine max
  Peptide Sequence Number=SeqID_178300
atgtgcagtgccaccgattataaaactaaatcaattggagtttctgtgggagccttacatagcaaatgttatgtcagcgttgcctccaatttgtttggttggaagtgtagcatggctgaagttgcggagacattacagtacatgatgtctccacaagggaggaatacatggacagttgatgatttcgtgcctcatgtggagaaaataaccattttatcagaagagcaagagagaatcattgagcctgtgtcacatggtccagcaaaagagcatcaatttccatcacaagagcttcatactctccagtcaagtgttgaaactcacggcataggcagacgaagtcaagtgttgaaactcaaggcatag

SEQ ID NO: 86616 - DNA, 219 bp, Glycine max
  Peptide Sequence Number=SeqID_178301
atgtggaagttgcggcgtggccaacgcggtaaccagagggaacgagatcgtgaaagggctcaggcaagagctggtggaaagacaaagcagcctaagaatgatgggttgacccctgaacagcgaagggaaagggatgcaaaagcattgcaggagaaaacggcaaagaaagcagctcaggctgcaggagggaataatgcaggtggtggaggcaaaaaatag

SEQ ID NO: 86617 - DNA, 279 bp, Glycine max
  Peptide Sequence Number=SeqID_178302
atggagagacgccataacttcaacaatgggaagagatctcaagaaagttccccaacacataaatgctataagtgtaatcaacccagtcacataaaggcacactaccccacaaatgagtcatggcctgagaagaatgagaagaaaagtcatgaagaaagaagatcgaagaaggcgtatattgcatgggatgacaatgactcatctgatggttcagagaaagagatcaaccttctatccaaggactatgagagcgatgagaacatctctcaagaagattaa

SEQ ID NO: 86618 - DNA, 540 bp, Glycine max
  Peptide Sequence Number=SeqID_178303
atggaagaaggattttccaccaacaagccattgagaggcataaaatatgattactggaaggagcatatgatagctcactttgaatccattcatatagatcgatgtggtcaatgggcgaaggagcaaaaactcagattcctgctcaactccaaggctcgaaatgtgatgttgtgtgctctatcaaaggaggagtacatcaaggtacatagcttcagaagttccaaacaaatatgggacactctggttgtaacatacgaaggaacgtcacagaccacaagtaacaacactaagagcctaaaagtaaagaatcttaattctatgtcctttgaggaacttgatggaacccttaaggaagactttgataaagatgagctcgccttcatttctcgaaagatccacaagatgtggagaaatagaggtggcttcaagtggagaaactcatcaagaagaatgcccaaagaaaagaaagataaagacagaagctccataatttgctatggatgcaaaaagcctggacacttcaaatttgaatcctcataa

SEQ ID NO: 86619 - DNA, 759 bp, Glycine max
  Peptide Sequence Number=SeqID_178304
atgggtgccaaatacctcaaagtggtcaaacgagggtcgcatcccaacaacggatggtccccggatgaaattagggaaagcctcacgcctttcatcacacgaggttttagtgaccccaacgcgagggtacttcgaggagtctgcaaggcatgggatgcagtccaaaggaaggacaaagagcttaggggaaacgaaaatgggatcgtcggcggatatcgtaagtggctgagattccacacacaaggtttggattggctcccaaagttaatggctgtgagagaggaagaggccgaagctccggaagagagtgaggagccactgccgaagccttggagcaggaaaccaagagggcctgaaaggaagaacacgtctgaaacaagttttgaggagctttatggggcaacaacagcgagcttaagctctgaagagacgaaagggatcagtcgcgagttgaagttaagcgagacagaagggaaaatgttggccatcattgataaatacaaagaaaagttgaacctagcaacagctcatgagcataggctagtggacgagtacaccaaggtattcgcggaaaaggaagcaggggggagggtaatcgattcattgcacggaaaggcaatgatatggatggatagattcgcctccaccctgaatagaaatcaagagcttccccaactgctagctcgagccaaagcaatgacaggcatatactcggcctcgaggagattcactagctcctcaactactgtcagcaaatga

SEQ ID NO: 86620 - DNA, 207 bp, Glycine max
  Peptide Sequence Number=SeqID_178305
atgatgctagttagtgtggtggtggtggcggtagtgatagtgacaattgtcatggtggtgattgacaacagtggtgacaacaatgattacgataatggttgcaacaagggttatagtggtaataatgaggatgatcatgatagtgggagttggtgtgctgatgatggtggtggaatcggccattatagtagtgatggtaatgagtaa

SEQ ID NO: 86621 - DNA, 672 bp, Glycine max
  Peptide Sequence Number=SeqID_178306
atggtcattgatcagtcattgttcttttctttgactcatttacccagtcaaggtgcacctattgagggcaccattgttgatgactggaaatttgattattcgagtcatgatgctcgtcgcatggtctgcaatgatcaagctgaaatgaccagtagattgctggctggatcgactgggcccatttggttcggtaccgaatgcataaaggcattacgggccaatgcacctcttccttatccacatttgattactctgtttttgcgtcactttcaaattctgcttgatgatgaaccctttgttcaagtcaagcgttcctttgcaattggtgctggtgcagtgacctcctttgggtaccgtaaagatcgaaatggtcaatggctgaagaaggatgcactccctcctcaagatgaacgtactccttcacctcctcctcaacgcgaagattccgcactcatgaatgaagtcctctccgaattatggggtcttcgttcttatgttggtgaccgcttcgactcgttagattcatgctttgccggtatggacattcgcctcacacagcttgaagaggatgtcagatacattcgtcagagtttcgatcttccaccaccacctccgtcttctaagattttagtttctgattataagtctttaataagccgtgtattttggctg

SEQ ID NO: 86622 - DNA, 549 bp, Glycine max
  Peptide Sequence Number=SeqID_178307
atgttacggaaccttgtggattacataatcatcccctttttgacttacgggatgttacggaacctcactaattgtgcaatgatgcttccatttgatttccggtattcaattatctataactccacattatctacaaggtacaaatatcttctacctttatctctaattcaaataattatctctaagctccctactattatctataagtcaagaattatctacaaagctaacaatagcccctacaaacaaggactagcacccttgctcatctactataaatacaggttccatcaaacccctctgcacgtaatcatacacaacctgctctcacacactcatcacatggcaacaagcatgtgcccctctttttctctttcgctcatacgaggtcccccctcctgtcaaaggtaccctcaatgccgacatgtgaagtttgggaccccactctaccatgtcaaccttgatgtgccaagtgagaaagcatatggaatagagcttgatactaatggctacaagaggtatgcttttacacttccacttactgaatga

SEQ ID NO: 86623 - DNA, 693 bp, Glycine max
  Peptide Sequence Number=SeqID_178308
atgtatgacacgtttgaccagagatgtgaaaagagcggcgcaagaattgtttattgtacaaaggctctctatgtgtggctggtttcgtacctttttcaccaagaaggtaggccagtctgtccgctacaaggtcatcgcttgtacgctgagaaaggaaaggcgaattgggaccaactcttggctagcatggagggggtatctgttaattggttccctcgttggaaggaaggaagaaccaggattctgacctcgtgcgaaggatttccaaatgttcccttaatgggaacaaggggttgtattaattataatcccgtcctcgccatcagacagcttaggtaccctatgagaggagcgccatcagaggaaagcattgtgcctttcatcgcacagggtttcaatgaccccaacgcgagggacaaagaacttaggggaagtagtaatgggatcatcgacggctattgtaagtggctgagagtccgcacacaagccttggattggcttccaaagctaagggctacgagagaggaagaggccgaagctctggaagagagtgaggaggtacaagccctaaaggcggagcttgaaagagcctgggcagtcaaagagaagttcaagtcaacggccatcaaagtccgaagggagtacgttgaactaagggacgccaatatggccaccaccgaagccttggaatga

SEQ ID NO: 86624 - DNA, 430 bp, Glycine max
  Peptide Sequence Number=SeqID_178309
gtcttcctttttacctcatgcaagccaatgaccatcctcaactagaacctgttgttaagactccaagccaacctcagccttctcctctcatagcttcaactttgactaagaaaaggaaaagtgcatcggcaggcattaacattaatcctccaacatcttccaaacaggaatgtccaaacaaaagatttgttgacctaactgaggaacttgggtgtatcaagaaagagttagccgatttgactcccaaaagtactcttctaaatttagaactcaaagcacctccttttgttccttctacttcggttgctccatttgctgttattccacctatagcaatcatggactacattgtcgagattgttgtcaaagtctctactgctcatgctactgcaattgctcaaatgcttccattgttgccaccaacgttgat

SEQ ID NO: 86625 - DNA, 210 bp, Glycine max
  Peptide Sequence Number=SeqID_178310
atggtggactacacaccttcaagctttgcggatttcgtcttcgccggctgtcatacccaaatttcgtccgaggaccatatgtttggtgggatgcaaccttcgcttgaccacttcaaggatgttccaacagaaggcggtgccttctggtggaagcaacccagctcgcctgggcgagctgggtggcaaccacttccctcttttcccctataa

SEQ ID NO: 86626 - DNA, 432 bp, Glycine max
  Peptide Sequence Number=SeqID_178311
ggacataatatatcaggaaaagatctccgtgttcattgttccttaaatatcaacacagagacaggacgcttgtcagcaagaaggccaaatctgcagaatcaacctgctctagaaaaggatcgatacaaaatccgtcaagcattcattgctgcacccaagaattctcttatagttgctgattatggacagctggaacttaggattctggcacaccttgcagactgtaagagcatgttggaagcttttgaagctggtggagatttccattcaaggactgcaatgaatatgtacccacatattcgtgaagcacttgaaaaaaaggaagtgcttcttgagtggcatcctcagcctggtgaagataaacccccagttcctcttttgaagctgatgacgtcaaatatagtgaccaccagagtgctggcaggtgcatga

SEQ ID NO: 86627 - DNA, 243 bp, Glycine max
  Peptide Sequence Number=SeqID_178312
atgaagcttggattgattcggtttgatgagggatcaagaaggcgtaatcaagagagagttagaaaatttttgcaggatttagaagcaacagcaattccagaggaagaacctcaatcttttgaggcatcttctagttttcctattgtaggacattctcatttagatcatatcgaagaccacatcatggatgaagagccaagaagagtcaccctggaagattattcaagttctaatgtgccataa

SEQ ID NO: 86628 - DNA, 456 bp, Glycine max
  Peptide Sequence Number=SeqID_178313
atggcatccttcagccagatgcagtcccagattcagtcgcagatgcaatctcagggacttgcgctgcctcctgagcctctagttggtccctccgatcctcgagtgagcacaaaggggagttgtgttgatccctcaggaaatgatcctgagacgggtgactcagataggtgcagcttgtacatcgaagcagatcctccccgcctggttgccctggggagagtttatgagggatccactgttgttcataacactcatttgttgactggccaagtaaaggtgggtgtggaggaggttacagatgcaaatgctccagttcctatacccactgatgaggtagctgtgtctccggcaaaaccacctccaaagcccgatccggaggtcgatgatcctctttatctgatgacattgaccatcctagagcttttattgaggccttatcaggtagctgtttgttag

SEQ ID NO: 86629 - DNA, 198 bp, Glycine max
  Peptide Sequence Number=SeqID_178314
atggctctcactcatatccaaggaaggaccatgatgcaatcctatcccgcaagggcattgggtagaagactccaagtagattgggctagagatccaagggcaattcttggtggtgaagctccttcttccttggcttattccctagtggatggtgcctcccctcgcctcttctcctttgccttccgctgcatctctatg

SEQ ID NO: 86630 - DNA, 186 bp, Glycine max
  Peptide Sequence Number=SeqID_178315
atggaagaagatcctaagaagactctcaaattcttagatgctacaaatgcaatcaacttggtcacatcaaagaaaattgtccctcaaatgaggaatggccggagaaaagtgataagaaaagagaaagagatcaaccttctaaccaaggactatgagagtgatgagaacatctctcaagaaaattaa

SEQ ID NO: 86631 - DNA, 2646 bp, Glycine max
  Peptide Sequence Number=SeqID_178316
ctggcgcggtgcggtgctggcctcggcggtgatggcgtttccgctgatggtgcgcgccattcgtctggcactggaagcggtagacagccggctggaacaggcggcacgtaccctgggcgcgggccgctggcgggtgtttttcaccatcacactgccgctgactttcccgggcatcatcgttggcaccgtgctggcgttcgcccgctcgctcggcactgcggcgcggctgtgcgcggtggcgattgcgctggcgctgctgtcgctggtggcctcagagctgctggcgcgctggggccgcaagcggctgggagcggcctgatgctgaaaatcaacattgcgcaacagctcggtgagcatcagctcaacgtcgatgtggaaattccggccagcggcatcaccgcgatctttggcgtgtccggggcaggaaaaacctcattaatcaatgctatcagcggcctgacgcagccgcagagcggccagattgcgcttaacgatctatggcatggcgcccaaaatgaaagcgcagttcggggcgctggtgacgctgctgggactggacgcgctgctggatcgctatccggcctcgctgtcgggtggcgaaaagcagcgcgtggcgatgggccgggcgctgctgagcgcgccggatatcctgctgatggacgaaccgctggcgtcgctcgatctgccacgcaagcgcgaactgatgccctatttgcagaagctggcgaagcaggtggagattccgctgctgtacgtgagccacagcctggaggagattgtccagctggcgaatcaggtgctgcgcagcagcgtactgcgcgtgcaggtgctggagcagcatccggattacccgatgaccgcgctgtcgcttggcgatcagcacatctgggtcagccgggtgaatcagccggtgaaaagcgtactgcgcatccgtatcgcctcggcggacgtgtcgctggcgctgcagccgccgcaaaatacctcgatccgcaatatcttaccggcgcaggtggtggagctgctggagctggacgaccaggtcgaagtgaagctgcgcatcggcgtcagcgagctgtgggcgcgcatttcaccgtgggcgcgcgacgaactgaatatccggcccgatcagtggctgtatgcgcagatcaagagcgtgtcgattaccgcgtaacacaaaccggacgacagctcggtacgtccggtctgcggatcagcgcgttttttcgcgcttttttccggccaaccttactgatgccttgtgccgcgaccagcctggcattacagcacttcctggtagatcacctgcgcaatgcccggctcaaggttggtgccgatcactttgcgcgcgcgtgctttgatggcgtcatcggcattgcccatcgccacgcccagcccggcctgctccagcatgctgagatcgttgtaattatcgccaaacgccagcacgtcctgcatgctcagaccctggctcgccacccactgcgccaggcgtttgcctttgctgttgccggcctgggcgatgtcgacctgatcgtgccacgaccattcacacgccagacccagctcgcgttcggtgcgttcggcaaactgctgcagcgcgcgggtatccggatgcgacagggcaaatttccagatcgactgcgcgtcgtgcgccgcctgcgccagactcggcacctgcacaaacagcgggcgctgcgcttccggcagcgactgcgcccagttgagggtgcgcgtcacatggccggtcgcttcctgcggatcggcagccagcacccgttgcgcctggtaatcgtacaggtacgtgccgttacagcagatggcgggcgttgtcagctgcagcgcctgataaaacggggtgccgtcgaggtcaagggcgattacgcggtagctcattacactttccgtccggatcccgagagccagcagatccacgcctggcatgatgcaggaagatggcgcactgacgttattgcaggtcacggatgtggccggccaggtgcagccgatggtggtgagcccgaagaaagattttctctatgtcggcgtgcgtccgaatttcgcgtactggcgtaccgcattgcggccgacggtacgttaagcctggccggtgaagcgccgctgccgggcagcccgactcacatttctaccgaccgccagggcaactacctgttctgcggctcctataacgatgcctgcgtcagcatcagcccgattggcagcgacggcctgccgcaggcgccgctgcaggtgattaacgggctggagggctgccattcggcgaatatcgacctcagcaaccagacgctgtttgtgccggcactaaagcaggatcgcatctgcctgtatcagctgcaggcggacggcacgctggcgccgcgcgcgcagccgcaggtgaccaccgtagagggcgccggcccgcgtcatatggcgttccacccgaacggcgcctatggctatgtggttaacgaactggacagcaccgtcgacgtctgggcgctgaacaatgttaacggccaggtcgagcgcgtgcagagtcttgatatcatgccaccgggcttcagcgatacgcgctgggcagcggatatccatatcaccccggacggtcgctcccctgtatgcctgctgaccgcaccagcagcacgctga

SEQ ID NO: 86632 - DNA, 411 bp, Glycine max
  Peptide Sequence Number=SeqID_178317
atggcttctgacagcgccattcagccgctgatcgttggcgaaaaccgtaccgcgctggcgctgtcacagcggctggcgcaggccggttgctgggtgagcgcgatccggccaccaacggtgccgccgggcggtggcgcaggcatttggccgggcggccgcgcattacgaacagcatgctcagctgcagcgccagagcggcgaggcgctgctggcgctggcgccggccggatttggcccgcagctgctggatgccggctgcggcaccggctggttcagccgctactggcgcgatcgcggtcgccaggtctgcgcgctggatctgtctccggcgatgctgcaggcggcacgcgaacagcactcggcgcacgactatttacagggcgatatcgaccagttaccgctggcggataa

SEQ ID NO: 86633 - DNA, 547 bp, Glycine max
  Peptide Sequence Number=SeqID_178318
ggtcattcgaatgacgacacccccgccatctcccacacaggccgagattccttctgatgggacgtctaggaaaactagacaagccactcggctaagaaggttgacaacaagaacattggatcaagcaagggcaacaatcagcgtgaatccagcgactggtagaggattcggacctcacaaggatcagtttcacagttaccttagagttgtggcacgagacaagattccaattgttcaccctagctggaatgatgcaaaatttgacatccccaagggtgataatgccaaaaagaaggtgatgtcaacggtggcaacgcgttggaggcaatttaagtcggcgttgacaacaaaatatgtgtatggtaacactgacgggcaaccaaaagatgatcctttggttaaatatggcattgatgcaaaagattgggctgagtttgcaaaaatgaggcaaaccctacctggcaggggatacggaaaaaggcacaagagattcaaaagtacaatgactctccgcacttgttgtctaggggaggctatgagctgctag

SEQ ID NO: 86634 - DNA, 778 bp, Glycine max
  Peptide Sequence Number=SeqID_178319
atgaggggagcaccgacggaagaaagcatgtctcctttccttgtgagggatctcggtgcacaaagttccaagactatacaaagaatccataaggcatgggaaaccccgttaaggaaagatcaagaacttagaggcattcgtaatggcatcattggtggctaccatgaatggctgaaagttcatatacgaggtttagattggctcgccaagttaaaagtcgtcagcgaagagagttttgaagcaccggaagaggacgaagaagtccaagctctcaaaagcgagttaggaaaggcaaaactggccaaggagaagttcaaggctcgcaaggaagagtatggccggaacaaatttcgcggagctctatggggtagcaataatgaactcaagttgcgaagggaagaaagggaccagtcgcgagcacatagcatggttctgaaagaggagttgattgcttgttcaaggtccaaaagaagcttgtctcagcgtttatgcgagacagagaccaacatgttagctatcatcgccaagtaccaagaagagttaggtctagccacggcccacgagcatagaatcgcggatgagtatgcccaagtatacgcggaaaaagaggatagaggaagggtgatcgactctttacaccaagaggcaaccatgtggatggatcggtttgctcttaccttgaacgggagtcaagaacttccccgattgttagccaaggccaaggcaatggcagacacctactccgcccccgaagagattcatgggcttctcggctatt

SEQ ID NO: 86635 - DNA, 342 bp, Glycine max
  Peptide Sequence Number=SeqID_178320
atgagacctgatgaggttgttcttcctgagccaattatactagttattcatgatattgttgaagtaggtgagtcacgattgagacaggaggctactactcttgagaggacaccacagaccccagaagattcactctctccagggatggacctatcttttgctcagcaggtagcagatcctcctacgccagttcatgagagacaagcagatcctcctacacccatcatggaaatgctagaagaccctaccatgtcagtcctgagactgtcatccactcctccaactaccccagttttacatctgacagatgaggaggatatgcaggacacacagggcacatag

SEQ ID NO: 86636 - DNA, 344 bp, Glycine max
  Peptide Sequence Number=SeqID_178321
tgccaaacgggacacgactgtgtctgaatggcaaaaggggtgcggataaccgtaaaggtatctccgcgtatcatgtgtgcagaatgaccaaacttggtctctgcgtgccaacggacacgactgtgtctgaatggcaaaggggtgcggataaccgtaaggtatctccgcgtatcataatgaccaaacttggtctctgcgtgccatcggacacgactgtgtctgaatggcaaaggggtgcggataaccgtaaggtatctccgcgtatcataatgaccaaacttggtctctgcgtgccatcggacacgactgtgtctgaatggcaaaggggtgcggataaccgtaag

SEQ ID NO: 86637 - DNA, 459 bp, Glycine max
  Peptide Sequence Number=SeqID_178322
atgacaatgatagtagacacattaccagtattctactatggaaaaaggtgggctacacaccttcaaagctttgaggatttggtctttgccagtgaaaggatcgatgtgggtctgaaaaaaggcaaatttgatcatcctactaggacgactgagaaaactggggcaaataaagagggtgaggatgagggagaaacccatgctgtgactgccattcctgtacggccaagtttcccaccaacccaacaatatctttactcagccaataacaaaccttctccttacccaccacccaggtatccacaaaggccatccctaaatcaaccacaaagcctatctaccgcacttccaatgacgaagaccacctttagcacaaaccaaaaacaccaaccaagaagtgaattttgcagcgagaaagcctgtagaattcaccccaattccagtgtcctatgccaaacttga

SEQ ID NO: 86638 - DNA, 528 bp, Glycine max
  Peptide Sequence Number=SeqID_178323
atgttgctaagtagcaatgtcatctatatctgtgtaagagtggtcatgttggtgcgcatgatccgcactcgtctctttacagcggcacgaatgaaatcttgccccggtatgcatagtagctgtgtaatagcctccctctctggttgtgctcgcacagttggccctcctccaatatcagggggtggcccagaaccgttaaaggaaactactggccccttaccggaagcgcaagtctcggttaagcatttaaggatagaggaccttaattctcttaaggtgcggatgtggagcacactgaaaatgaggacacatagccctctaaaggtgagggcgtgcaaccctctcaaggcgaggatgtatagtcctctggaggtgagggcgtgtagtcctctcaaggtgagggcgtgcagccctctgttggcaaggacgtgtagtcctctaaaggtgaggacgtgtagtcctctgaaggtgagggcgtgtagccctacaaaggtgagggtaactagtacccaaggtgagggcgtgtag

SEQ ID NO: 86639 - DNA, 71 bp, Glycine max
  Peptide Sequence Number=SeqID_178324
aatctcgcaaaggtttcaaccgttcttcgacgttcttcattcgttcttcatcgttcttcgatcttcaacgg

SEQ ID NO: 86640 - DNA, 434 bp, Glycine max
  Peptide Sequence Number=SeqID_178325
ggaagctctctgcagggaagctgagtgtgaagtatgcaatcctgcataggattggcgctgcaaactgggtacccaccaatcatacttccactgttgccacagaatcttttgctgtcaaattacccattgccttccctactgtattgtgtggcattatgttgagtcaacatccaaatattttaaacaacattgactctgtgatgaagagagaatctcctctatccctgcattacaaactgtttgaggggacacatgtcccagacattgtctcgacatcagggaaagctgctgcttcaggtgctgtgtccaaggatgctctgattgctgaactcaaggacacatgcgagaaagcagctgaagaagaagaagaagcagctgagggaagagggaagatgcagcagaggatactgaaatcagatgatgatgattcctga

SEQ ID NO: 86641 - DNA, 1452 bp, Glycine max
  Peptide Sequence Number=SeqID_178326
atggggacaaatcaaaacggaaaaagattctatcaagtcaagattaagggcctagatgtcaccagccttaaggagttgagacggttgatgggacctctccaaaggcaagcctttcgcaaagtgtacggaaagattttagatttgaccacggcgaaggtatttacggaagccgttgtatcccccgcccaatactatgaccagccattgagatgcttcacgtttggggacttccaaatagtactgactgttgaagaatttgaggagattttaggatgcccttttgggggaagaaaactgtatcttttgtccgggtttcttccctccttgagcaacattgcagctgtggtcggagattcggcgaaagagttggatcgtatgaagcaaactcgaaacggcgtagtgggcctatcgcggaaatacttggaaggcaaggcaagggatatggcgaatcaagaggagtgggtcccgtttgcggatatactagctttgttaatctttggggttgtcctctttccaaacgtggatggtttggtggacctagccacaattgatgctttccttgcatatcaccatagcaaggagagcccggtggtagctatcttggcggacttatttgatacatttgaccgaaggtgcgagaagaacaacacacgaattgtctgctgcttacccgctctttgtgtgtggttggttttgcacctattccgacaagacataaggcacccgtgtccgcttcaaagttatcgctcgtgcatcgaaaagagaagagtagattgggaccaatacttggctgggataggaggaagcacaatcaattggtttcctcgatggaaggaaggaaatgagggacttctcttctcatgtggggactacccaaacgttccattgatagggacgaggggttgtattaactataaccccgcacttgctataagacagttagggtaccccatgaggggagcaccgacgaaagagagcctctcgcctttccttgtgagagatttcgacacgcaaagtttcaagatcgtacaaagagtccacaaggagtgggaaagcccgttaaggaaagataaagaacttaggggcatccgtaatggcatcattggtggttatcatgaatggctaagagttcatacacgagggttagataggctctccaagttgaaaattatcaacgaggagaacttcgaagctccggaagaggatgaagaagtccaagctctaaaatcagagttaggaaaggcaagactcgtcaaagaaaaattcaagttagtcgctacagatatccggaaagagtgtgtcggattacgagaggaaaatgcggctaccgcaagagccctcgaacgagaaaccaagagggctcgcaaggaagagcatgaccgagataaattccgaggagctttgtggggaagcaacaatgagctcaagctccgggagagaggaaagagaccg

SEQ ID NO: 86642 - DNA, 621 bp, Glycine max
  Peptide Sequence Number=SeqID_178327
ttactcagctggacatgaatgtcggagctcttatctctggacagatcatttcaatggaccagtctaactcctctagactcaggttccctactcttatcataattttatgtaggtctagaggagtcatttccgatagcttagcctttgaacgtttgagcccgatcattaatttggcctacattaggaaaaactgttggaacccagatgatccaatagttattattaggggggccagaagaccaagggcaaggccagctaaggttcctgctacatcaacagctcctcctccatcacgcatgacaacaactccttctaccctacctcctgcagattttcaacactccatcccgatggtagagcaatttaatgaatgggtagcttggccagggactcaacctcctcttcacaaagaagacgaagatcccgccactcaggaagctgcagcaacctctgaaaagtctcttgaagctactccagagcttccggcaccagtggcaaataccacttctccacagcaggcagtagacccttccacgcctgaggatcaaaccaccccagtcttgtctccgaacacctctcctatagctactcctgtacttcacttgtcggaagaggaggagg

SEQ ID NO: 86643 - DNA, 168 bp, Glycine max
  Peptide Sequence Number=SeqID_178328
atggcaaaatcaccctggccacaacagcaagggcctagtctctatgatcgaacaacgaagctggaagagactctagctcaatttatgcaggtatctatgtcaaaccagaagagcacggagtctgccataaagaatttggaagtccaagtgggacagttgtcaaaatag

SEQ ID NO: 86644 - DNA, 937 bp, Glycine max
  Peptide Sequence Number=SeqID_178329
catggacggtttggtggacttagccgcaattgatgctttcctcagatatcaccatagcaaggagagtccagtggtggctatcttggcggatttgtttgacacctttgaccggagcgcaatcaattggtttcctcgatggaaggaaggcaaggagggagtccttttctcatgtggggactaccctaacattccgttgttagggacaaggggttgcattaactataatctcgcacttgccataagacagttagggtaccccaagaggggagcgccaacagaggagagtctctcgcctctccttgtgagggatctaggcgcgcaaagtctcaaggttatacaaagagtccacaaggcgtggagaagtctgttgaggaaagacaaggagcttaggggcatccgtaatggcgtcatcggtggttatcatggatggctaagagttcacacgcaagggttagattggctctccaagttaaaagttatcgatgaggagaacttcgaagctccagaggaagatgaagaaggcccacaaggaggatatggccgagagaaattccgaagagcattgtggggtagcaacaatgagctcaagctccgaagagaggaaagagaccggtcacgggtgcatggcatgatcttaaaagaagagttagctgcttgcgcaaggtccaagaggagtttggctcaacacttggaagccacagagcaaagcatgctagctatcatagggcaatacaaggaagagttgaacaagtctgtgacccatgcacaaaagctagcggaggattttgcacaagtatacgccgaaaaagaagcaaaagggagggtgattgatgcattgcatcaagaagcgactatgtggatggataggttcgccttgaccttgaatggaagtcaagacctcccgcgtctattagccaaagcaaaagccatggccgaa

SEQ ID NO: 86645 - DNA, 405 bp, Glycine max
  Peptide Sequence Number=SeqID_178330
atggcttctccacctgcctcccctcctcctcctcctcctcttgctccttctgacgcatcggcttcaccaccatttggtgctgagagaccagtggtccatgttgatccttctaccgacaaggccgacgatccccacaggaagaaattaagaacatatttggggattgtggtgcgtgatatggtggacgtcacctatgagaactggaaggaggcggaatttgaaatcccagaggcttctgacagtatgacgaaaaggaagttacttcagactgtgggcgagagatggaggaagtttaaatcagacctcatgaggaaatgggcccttgcagccgatcaagacggtgtggacgacactgtctgtgagaaatacgacataagcaaggagaaatgggcccagttttgctag

SEQ ID NO: 86646 - DNA, 318 bp, Glycine max
  Peptide Sequence Number=SeqID_178331
atgaggtcactcccgctcaatcccaatccctacttaagtgccacaaacttggattctgcagtgactgacatcacatatatggtcatgcaacatgatccatcgcttgtctctccccttcttcttctacatgggagaaacattgaagccatcactgaaatcaagcaaatggggaattgctcaatgaagggtaccattggtgaatgtcaccactctattcgtgttatgtgtgacagtggtgccattttgcagttaaaagctcctaaaacagtggctcaagtgcttcaacactacccgggtaccactccattttgcagttaa

SEQ ID NO: 86647 - DNA, 366 bp, Glycine max
  Peptide Sequence Number=SeqID_178332
atgtttccctctcctctctcatgcctctttgtatcgtcactctccctctcactctctgtatcaaggtcagcctcttgcaacaagtacagagaagagccctttagaaggcacacattcaccaaggtgcaaaagtcgcacgtgggcgatgtcgcatttcttcacaaggtttttctcttcttggagcattggggcttgatcaacttcgacactgccccaccttcttcccatgcggatgaaaagtatgtagaggaggagtattgcaagggaccagtcactagagccatgagcatgaggctccaagaggattgggcaagagcttttgaagaaggccctagggttctcatgaaactcagggtagatttctga

SEQ ID NO: 86648 - DNA, 336 bp, Glycine max
  Peptide Sequence Number=SeqID_178333
atggctaatatttatgctccctgtgatttacaaggtaaaagacagctatggaaatctttgagtacaaggaagcttcaatctcaattgggtaaaggtattaagtgggcctctatcaggaatttggttaggaagcataagatagatcttctttgtttgcaagaaacaaagagggattccattgacagggcactttgtcaggctctgtggggtcactcagactttgattgggaatcgtttcctgcggacaatacatctgggggcttctctgtcttaaaggggtttcatcatgttggagggggtatggctggtagaaagtcagagggtagtggtggctaa

SEQ ID NO: 86649 - DNA, 435 bp, Glycine max
  Peptide Sequence Number=SeqID_178334
atggctactacacctgtgtggcctcctcctcctcctcctccttcacacacatcagcgtcttcgtctaccgtgaagcggacacacaaagcgacacctctacgatcgttggccactagaccacctggtgcagagagactagtggtcaacattgatcctgataccggcaaggtcgacggtccccacaagaagaaattaagaacatatttggggactatcgcgcgtgataaggtcgatgtcacatacgagacctggaaggaagtccttgctgctcagaaggatttgatatgggaggatattcaaggtgtgcgaaaaaagggacaagccatccagaagcaaaacactgccccccacgtgttgtcttgtgggggttatgaatatttagaagaaaaacttatgagtgagaaaacaaaaaagaaactggaggaaactgcctag

SEQ ID NO: 86650 - DNA, 345 bp, Glycine max
  Peptide Sequence Number=SeqID_178335
atgggggagacatatgaaataccccaccacaatctagccgacttcgagccttgcctcggatgtgccactaaagggcaagcagttcatgtgggaagtgcccctcctgctatggctgaaaatggaaagttggatcagatagaggaaagactaaaggtcattgaaggaagtggagattatgcctttgctaacctagaagagttgttcctagtgcccaatgtcgtcacccctcccaagttcaaggtgccggactttgacaagtacaaggagactacttgccctaaaaaccatctaaaagatgtattgtcggaagatggggtcatacagcaaaagatgagaaattgctga

SEQ ID NO: 86651 - DNA, 180 bp, Glycine max
  Peptide Sequence Number=SeqID_178336
atgactaatgcaaactgtccgcaagagtcattgcattcagtctcaaatgggaatctaagttgggtttgtgacaaccaagaaggattaggttttgagtacaccagccaacccactgcttacgaaaccagtagacctggcctcttgagtggacctcatgaaggagggtgtgtctatctgtga

SEQ ID NO: 86652 - DNA, 90 bp, Glycine max
  Peptide Sequence Number=SeqID_178337
atgcggacagggatcagcggaaagggatcaaacggacaaataggaagacaattagttttgaccgggacttatttgctacaggataggtag

SEQ ID NO: 86653 - DNA, 549 bp, Glycine max
  Peptide Sequence Number=SeqID_178338
atgaagaatcagtcccaggttcagtgttggtgccttgtaggggacttcaactgcatcagacacccagctgaaagagtgggaagcactctttgtaatccagacactaatcttatagctgaatttaacatggtcaatgtggaccttgtctgtatccaagaaaccaaaagggagaattttaataagagcatttgtcaggccatttggggggactcgactgctcagtgggattgtgttccttctgtgcaggctgctgttgttgttgtggggattctaagctggattctttctgtgtatggtaatttgtggcatgagtctcaaagggtgaggaagaggctacaaatgcaaggtataaaagggcctccaccttcttttctacattggaatctgcctaatatgcaaagaattcaatctcagaccaaagctgattccactttcaactccaaccattctgatcagttcctagcacatgactacactacaaccctcttcccctattttgaacactggaggaaacaatatggtacccttctcttacttttgatctattaa

SEQ ID NO: 86654 - DNA, 148 bp, Glycine max
  Peptide Sequence Number=SeqID_178339
ggagaaagattctttcggattagaagaacatattgggatagatctgagtggtaacactgattttatgcatattgtgttcaagaagacaggaaaggcttcagaagttgaagtaaaagatgtgaaattgaatcatccaaaggaagtttag

SEQ ID NO: 86655 - DNA, 740 bp, Glycine max
  Peptide Sequence Number=SeqID_178340
gtggtctggtagacaaggattgtagatgtaaggctttgcgtgtccgcttcacgacagacggtgaagctgatgcgtctgaaggaagaggaggaggaggaggaggaaaaggaggaggaggaggaggccaggcagaagctgtttcaatcccaaaaacaaatgagaacattcgcctgctctatgacactaaaggccgattccgtcttcattccatcagggatgatgaggcaaagtttggcccgaaaggtatcccatacctgaacacctatgatggtcgcaccatccattacccggaccctctcatcagggccaatgacactgttaagctggatctggagaaaacaagattgtcaatttttatcaaatttgatgttgggaatgtagttatggtaacaggtggaagaaacagggggtgtgttggagtgatcaagaatagggagaagcataagggtagcttcaagacaattcatgtgcaagatgcaactgggcatgaatttgcttctcgtatgggcaatgtgttcactattggcaaggggacaaagccatggatatccctagccaagggtaagggtattaagctgggttcaaattctgttaacattctagttcctatagattgtagtcccaaagggaagttggttgagatgaacactcagtgtgcacatgcagacaatggatgtggaagttgcagctatgaagataattccatgaatgagcctatacttaatagcaaacttgaagct

SEQ ID NO: 86656 - DNA, 417 bp, Glycine max
  Peptide Sequence Number=SeqID_178341
atggaaggagtgcaattgggatccattgggctttggagcatccacaacatgctggtttgtcaaaaagtgagtgactttttcattgccattgcatatttttccataccccttgagcttctttacttcgtgagctgctccaatgtcccctttaaattggtcttccttcaattcattgccttcatagttctctgtggattgacccatttgctcaatgcttatacttactatggccctcactctttccagttgtttctttctattactgttgctaagttcctcactgctcttgtttcttgtgccactgcaatttcctttcccacactcattcctcttttgctgaaaatcaaagtgagggagctatttttcaggcagaatgtgttggaattgggccaagaggctgggatgatgaagaaatag

SEQ ID NO: 86657 - DNA, 724 bp, Glycine max
  Peptide Sequence Number=SeqID_178342
atggtgcaaagcatgagcggccagccaccgcaggtgatcaccgctgacagcaatccgcaaatgttccagtttaaccatctgctgcgcgcgctgttccaggcggatgagcaggtactgcgcgagaattttgtgctcgatttccacgatgacggtggcgacggctggcagctgagcctgacgccgaaagcggcaccgctgaataagatcttcaaccgcatcgatctgcagggcgcggcgtatctcaaccgcattacgctggatgaccgccagggcgataaaacggaaatcaccctgagcgatacccgtacgcagcccggccaactgactgatgaagagcgagcccgttttgccgcagcgcacagcgtgctggctctgctgccgcagcagaatcttggccaggcaccggcggagattcagcagggctttatgcagcggctcgaccgccagctggtgtggctggtaagtgcgcctggtgcggacggtgacgccgccgccgcgtggttgcaggcgcagctccgggcactgccgatgctcagtgaggtcagcggcgcgctggatgatgatcagctgcagcgctggggaagctttgcttatcagcatcgcaacgggctgatcgatccgctgacgcgtgcgcgactgcagcacggcggcggcgcgcaggccgactggattctggcgcagctgttttcggcgtttgccggggtgagcagcaaagagcttgccg

SEQ ID NO: 86658 - DNA, 207 bp, Glycine max
  Peptide Sequence Number=SeqID_178343
atgttaggatttacaagcaattctcctcaaatttcagccagcccgcatcaattagaccttgcaccttatgctttagggccctacaatgctcaatggaatgccccggggctcctccatgataagcacacattgcgttcgagttgtatccttagagaaatggaggtggtgttcgtcattggaagtgcggtagacaggctttgtggttga

SEQ ID NO: 86659 - DNA, 531 bp, Glycine max
  Peptide Sequence Number=SeqID_178344
atggatctgttgattattttgacctacgtggcatttgcctgggccatctttaaaatattccgtattccggtcaaccagtggacgcttgccaccgccacattaggtggggtgtttattgttgccggacttattctgctcatgaactataaccacccatatacgtttacggcgcaaaaagcggttatttccattccgattacgccgcaggtgaccggcgtggttagcgaagtgaccgataaaaataaccagctaattaaaaaaggcgaagtgttatttaagctggatccaggccgttatcaggcgcgggtcgacagactgcaggctgacctggtgaccgcgacgcacaacatcgataatctgaaagcgcagctggcggaagctgtcgccaataccacgcgcgtttccgctgagcgcgatcgcctgtacaaagattatcagcgctacctgaaaggcagccaggcgaaggtgaatccattctctgaaagcgatatcgacaatgcgcggcagaactatctggcgcaggatgcactg

SEQ ID NO: 86660 - DNA, 156 bp, Glycine max
  Peptide Sequence Number=SeqID_178345
atgaggattccatttttacaggccaaggttcaaaaagcaaccaggcccacttgggccttccagggtgttccaatagaaggcggtgccttctggtggaagcaacccaacttgcctgggcgagctaggcggcaaccacctccctcttttcccctataa

SEQ ID NO: 86661 - DNA, 126 bp, Glycine max
  Peptide Sequence Number=SeqID_178346
atgcacgaatatgatgcaggaatgatatgcccattaggatgccatgaagagatgcaagacacaatcaaggaatatgccagagcagactttgtggctgattggatggtgggtaatgagaagggctga

SEQ ID NO: 86662 - DNA, 432 bp, Glycine max
  Peptide Sequence Number=SeqID_178347
atgttggcaacccatttcggataccgtgcaacggccagaaaaccagcgtcaaattgcttcttcacttcttcttttatcttcaaggatgtttcgggcttcatccttctcagtttctgctttaccggggaacactcgggttttagaggtttacattatgctcgttgcgtaaatgccggggcgttcctccactcgccaatttcccagctagaaatcaggagggcatggtcgtaccaaatccaatgtactcggaacatcatcttcgtatatcgcgaccacttgaccttcgtctcccagacccgcgcttacaaagcttctacttatgtggcagggcgggcttccttcactttcttgcctcaaccgcgagctttgaccaccgctctttctttccgcgatgcttctctttatatccgcctgagtgggtttatagcctaa

SEQ ID NO: 86663 - DNA, 219 bp, Glycine max
  Peptide Sequence Number=SeqID_178348
atggatacgcagatcgtagatgctctggccaagaaagggattgcgaagctcttccccattcagttttttattatgccatcaggggacagagatggttatatgagtgatcctgggcatgatctaaatgaaaggggttctgtttcttccttaaatgcacatagggagtctgtttttgtatatgtcagagcttttacaagaaaggaagctcagaagctgtaa

SEQ ID NO: 86664 - DNA, 99 bp, Glycine max
  Peptide Sequence Number=SeqID_178349
atgaaggttttccatcgtcttcatcgtctcgttcttcgtcgttcttcggtcttcaaccgaataaaatccgagcgatctttcacgcgtaaccacgtttaa

SEQ ID NO: 86665 - DNA, 917 bp, Glycine max
  Peptide Sequence Number=SeqID_178350
atggcctcagaatcagacgataattctgaaacagatctacaaaaacaaatccaaaaagccaaacagaccaaaatcgtctgtaaccaaaaaccaagccaatcattgactaaacaagaatcaacaccacaacccggtaacagttacatttcaaaaaacaaatttttcaatgttttacaaatggaaccagaatactgggacaagaatcctttcaaagcaaccgccaaagcattccccccgggattccattacaagccaatagccacaaacaaaacccgcaaattctacgaattcatcctaatagatacaaactcagtatctattaaacacttcaaagaccccaaagatccaaatctaaatacccattccacaatccaaatcttgaaggtgatgcagccacggcattatggctcaaacttaaaccaacccaaaaaattctctgcaccatttgaccctgcaggatataattattgggattacattgacgcctggaccaatgtgttctggcatcaaaatagtaaattcaagcattcatggctgatttacttcaaaaataatactgcatataattttccaaattggttcctccaatggtggaactacttcggaccaattccacaaatatttccagaagaagtccaacagggattcgaacaattcaacaagctctataatagcaaggaatcacgtattccggcagacttaaagtacttttccagttttgccttgtcatggatcttttcatggcaatacagatacgaaaaaactgaaaacaacaagcaatatccaccgttacagagacacgccgttgtaaaatggtggtcacaattcgatacttcaaaggctgctccagatcaagtcaagaactggttccagagcaatcctgagttccttaaacctgctgatccggagacatcttt

SEQ ID NO: 86666 - DNA, 144 bp, Glycine max
  Peptide Sequence Number=SeqID_178351
atggccgacagcgggcaacagacgcactgccgccacctccagagccctcagctcatctacaaaggttggagtgttgcctacgacctgtggtcaaccagcaggcgaccaagtccaaagccaaagggcacacctagttgctcatga

SEQ ID NO: 86667 - DNA, 255 bp, Glycine max
  Peptide Sequence Number=SeqID_178352
atgcctgctggtccggcttaccgcattaacgactgggcaagcatctacggtgtagtgggtgtgggttatggtaaattccagaccactgaatacccgacctacaaacacgacaccagcgactacggtttctcctacggtgcgggtctgcagttcaacccgatggaaaacgttgctctggacttctcttacgagcagagccgtattcgtagcgttgacgtaggcacctggattgccggtgttggttaccgcttctaa

SEQ ID NO: 86668 - DNA, 297 bp, Glycine max
  Peptide Sequence Number=SeqID_178353
atgactaaagcacgtcaaaagggggtacataaagaaaaagaaggagaagcttgccacccagctcgcccaggcgagctaggttgcttcctccagaaggcaccgccttctggagaacttcctagaaggcccaagtgggcctgcatgttagggaatttcacgggttgtgcaacaatgctttgttttgacttccggcatgtcacaaaacttcacgaattgcctaacgatgggtgccaagtacctcgaagtagtcaaacgagggtcgcatcccaacaacggatggttcccggacaaaattag

SEQ ID NO: 86669 - DNA, 588 bp, Glycine max
  Peptide Sequence Number=SeqID_178354
atgaatcatgtctggggtcttctggcgcatcccaatcaggagatgcgtgatatcaagcaggaaaacgagagcgtttcgcaccactacacccatcacgttctgctgatggcggcgatcccggtgatctgcgcctttatcggcaccacgcaattgggctggaacctgggcgaagggcagttcgtgcaactcaacatgctgaccggtattggtctcggcattctgttttacctgatcatcttaggcggtgtggcggtgatgggccgcgtcattcactggatggcgcgcgactatccgcagcgtcccagcatccagcgctgcaccgtgtttgccggctatgtggcaacgccgctgttcatcagcgggctggtggcgctctatccgctggtgtggctgtgcgtactggccggagcgttagcgctgatgtacaccggctatctgctgtacgtcggcatcccggtattcctcaacattgaccgtgaagagagcctgcgcttctccggctcgacgctggcgattggcgtgctggtgtttgaggtgctgctggcgctgacggtgattctgtggggttacggaccacgcttgttctga

SEQ ID NO: 86670 - DNA, 447 bp, Glycine max
  Peptide Sequence Number=SeqID_178355
atgaaacaacaaaatgagagtaacctggccaccgccgctgccgttagctcggttgccgaggtagccccgactctcttgactgctgtgcaccatcctattccaaacatggtgggaggagagggaagcacaccagggcatatcaacaacccatccggggtacaatcgagacatgtggtcacgttcctcccctcatcctcgaaggggaacctcctcgacatcctgacggggtccacgagaatcatagagagcatgctcagggagacgtcgactcctactccccgttacccgctgaggggccgcgcccaacgcactacctcaacccaaaatcacggaagagcctctaagccacccaacgcagccaatgtttttgtccgtgagaggaccacccccggcagcggaaggaaaggggaaactcgatctcatcgaagagagattgagggctgttga

SEQ ID NO: 86671 - DNA, 123 bp, Glycine max
  Peptide Sequence Number=SeqID_178356
atggcgctaaagaacaaagaagcagagcaaggaaccaagttctcaacttttagagagattagggagcttttgagtgattgtgaggtgccaagaggtggaggagacatcccccctcctgtgtaa

SEQ ID NO: 86672 - DNA, 1022 bp, Glycine max
  Peptide Sequence Number=SeqID_178357
tccaaatctcggcgcaggaattagaccacagaaagcaagttgaaaatggggtggttggaataccgagaaaatatttggaggcaaaagcaagaatcttggcaggtaaaggcgaatgggccctgttcatagacattctcgcactgttgatcttcggaggagtcctctttccgaatgtggatgggcatgcttgcccgctagaaagccaccgttcatgcacagagaaaggaggggcaaattgggaccaactcttagcaaacaaagaaggagcgtctgtcaactggttccctcgatggaaagaaggaagaaccgtagttcttatttcgtgcggaggatttctgaatgttcccttgatagggacgaggggttgcatcagttacaatcccgttcttgctataaggcaacttggctaccctatgagaggggcaccattagaggaagagatcgtgcttgtccgcaaggcatgggaggtgttgcaaaagaaggacaaggaactcaggggcagtaacaatgggcccatcggtggctatcgtaagtggttaaaagcacacgtgcaaggtttggattggctcccgagtttgagaaccgctaaaagggaggaagttgaggcactggaggaagacgaagaggtgcaggcccttaggacgaaactcaagcaagctcaaacaaccaagagggctcatagggaagagcacggccggaacaagtttcgaggggctctgtggggtagcaacaacgagcttaaactccgaagagaggaaagagaccaatcacgagtagacagtttgatcttgaaagaagagttgaaggcttgctcgaggtccaagagaagtttgtctcagcggttatgcgagacagagaccaacatgttagttatcatcaccaagtaccaagaagaattaaatctagccacggcccacgagcacaaagtggcggacgagtatgcccgagtttacatggaaaaggaggttagaggaagggtgatcgactcgttacatcaagaggcaacaatgtggatggactga

SEQ ID NO: 86673 - DNA, 228 bp, Glycine max
  Peptide Sequence Number=SeqID_178358
atgtacccatgtcaaaaatggcaggagaatgcttcccaaatgaataaaatggctccgagaaagctttccgcaaagagatctaggaaggacgccgcggctgaagggaccagtgccgctcccgattttgacaaccatcgtttcaggagcgctgagcaccaacagcgtttcgaggccatcaaagaatggtcattccaccgagagagaacacgtccagctcagggacgatga

SEQ ID NO: 86674 - DNA, 759 bp, Glycine max
  Peptide Sequence Number=SeqID_178359
atgctgctggccaagcagaccatacattcctccctaatccaacaacaacaacaaccccagaaacagccaacagttgaggcccctccacaaccttccctcaaagaacttgtgaggcaaatgactatgcagaacatgcagtttcagcaagagaccagagcctccattcagagcttaaccaatcagatgggacaattggctacccaattgaatcaacaacagtcccagaattctgacaagctgccttctcaagctgtccaaaatcccaaaaaagtcagtgccatttcattgaggtcgggaaagcagtgtcagaggacccaatttcccgtagcttcctcatcggcaaagacctatcaggaaggactatctcgtattcagaaaaggagagagcctctggctttgaatcagaaatctgtacctgtcgcaagggtttgtggtttgtgctcctctgttgaccaccatacagacctttgcccttccatgcagcaacctagagcaattgagcagcctgaagcttatgctgcaaatatttacaatagacctcctcaacctcagcagcaaaatcaaccacagcagaacaattatgacctctccagcaacagatataaccctggatggaggaattaccctaacctcagatggtccagccctcagcaacaacaacagcacctgctccttccttccaaatgctgctggcccagcagaccatacattcctccaccaatcaacaacagcagcaccccagaaacagcgatcagttga

SEQ ID NO: 86675 - DNA, 621 bp, Glycine max
  Peptide Sequence Number=SeqID_178360
atgcttggggatggaaatgaaggaatgtctacactacctggattgaatcagatacaatttgaagggttttgtaggttcattgatcggggcttaccagaagggctttttaagtttccaaaaattgaggatacagatcaagaaattgaatttcaattatttgtagaaacatatcaattattagaacccttgataaacgaaaaagatgctgtatatgaatcgcttacatattctgctgaattatatgtatctgcgggattaatttggaaaagtagtagggacatacaagaacaaactatttttgttggaaacattcctttaatgaattctctgggaacttctatagtaaatggaatatacagaattgtaatcaatcaaatattgcaaagccctggtatttattaccgttcagaattggaccctagcggaatttcggtctatactggcaccataatatcagactgggggggtagattagaattagagattgatagaaaagcaaggatatgggctcgtgtgagtaggaaacagaaaatatctattctagtttatcatcagctatgggttcgaattaagcgaaattctagagaatgtttgtatcctgaaatttcgtttctttcctaa

SEQ ID NO: 86676 - DNA, 516 bp, Glycine max
  Peptide Sequence Number=SeqID_178361
atggaggccatgaaagagcaaatggccgccatgattgaggccatgtatatcatgaaggaaataatggaaagcaatgcagttgtagttgccactacaagcgccgccgctgaggtggacccgactcacccatcgggcctcaatcaagtaaatcctctagtcttggatatggtaggtcagggaagagaagcattgggaagtacaagcggtccccatgttgtgcagagcaagatttctttcctaccatacggcttgcctcccaactattcaccacccaatgctgtaccggtgcccaatgaggatgtcaataactctgcacccatacccattaagagtcaacaacctcaatctaatcatgcacatgtctctcaacccatgagggagacatatgaagcaccccgagaccacaatctagccgacgtcgaacctcacctcggatatgccactgaggggcaagcagttggttgtgtacccctgccaaatacttttgagggccctcaatttctcccacaaccataa

SEQ ID NO: 86677 - DNA, 84 bp, Glycine max
  Peptide Sequence Number=SeqID_178362
atgattgtggtggttgcgctggtggcagtggttgggcttgtggccatggccactagtaagcaagatggcatagatatttgctaa

SEQ ID NO: 86678 - DNA, 564 bp, Glycine max
  Peptide Sequence Number=SeqID_178363
atggaggattggggaaactttcttcatcgaatccttcagaaggatttcgaggattctgctccaattaaagtgttcctcttggtgcaggggttcaacggcacacaacgatggcttgcggcggccaccggtggtcgtgggtggtggaggaggatcttgggggtactgaacattggtcattctgttggttaccaccacagaaatcacatctcaaaatttgttgaacttggtgagcttgatgtgctttctgtggtccaccttggtgatattgctgaggaacttggcctatctgctttgttaaggcctcaatttgttgcgtcaagattttgttttgagctagaatttcactctgagtgtgaagctccattataccttttctttcagtcagagcttatcatgatgactttgataattactagctgctgtggaagcaatgtcttccaaggttattttgaagatgccaaagaatcaagagtcaagcaaaatccaaagattcaagaatcaagtttcaagaatcaagattcaagattcaagaatcaagtttcaagaatcaagattcaagaataa

SEQ ID NO: 86679 - DNA, 168 bp, Glycine max
  Peptide Sequence Number=SeqID_178364
atgaacatcattgttttgtttctaggaattgctcgggatcttcaaagcatatcagatatgagggaaatgacccctaccatgcaggggaagaagaaaagagaatctaacaacctgaaagctgagagaaaaacaaagaagaagtggaaaattggagtcaaggtgctatag

SEQ ID NO: 86680 - DNA, 333 bp, Glycine max
  Peptide Sequence Number=SeqID_178365
aacaagttgttatctaagcaacttgaggcattgactgagacactaaggtgtgtcatctgtggtggagctcatgattctggatgttgtctccccaatgaagaaccaacagctcatgaagtcaattacatggggaaccaacccataaataattttaatgcaggtggatttcctggattccagcatggacaacaatacaaccaacaacagggacattggaggaaccaccctgggaatcaattcaatagagaccagggtggaccgtccacaaggccgcaacaacaaaggcctagtctctacgagtgtacaacgaagctagaagagactctagcttag

SEQ ID NO: 86681 - DNA, 1215 bp, Glycine max
  Peptide Sequence Number=SeqID_178366
atggcatccaggaagcgaaaggcccctgcctcaacatcccaagaaatattacctgagaggaatgtcatgctctattatacagagtttgatgagttcatagaagagttggagagaagaaattggcacaaagagttgacaaactttatggatggcagcattgatgttgcaatagtcaaggagttttatgcgaacctctatgatctagaggataaatcacctaagcaggtgagggtcaaaggccatttggtgaagtttgatgcagatgctttgaatacctttctgaagacctatgtgatcatagaggagggggaaaacttgcctgccaactccaggtttaggaaaggatttgagcttaatgctgatgggctgcccctgaagatcctgaggaagaatctgaccactcttgctcagacctggagtgttttctcattctctaacccggtccctacttcttatacatcagacattacactggacagggccaagttgatctacgacattatccagaagatggacatgaacttgggacatataatctcaagtcagatttccttgattgcacaacatgactcctctaggctgggtttccctgcacttatcactgctttgtgcaagaccagaggagtcacttctgactcattgacttttgagagccttagtctaaccattaatgtggcttatgtgaagaaaaattgttggaaccttgatgattccactgttactttcagagggccatgcaggaccaaggggaaaaggtcagaggctctcccatcttctgaggttccccctacgacatcaactccttccaccacagcacctgcttcttttacctcagctacttatgctccatcaccagctcagctaccaggctcaagcctgcagcctattatgagtgtggctgatttccttagtcaggtggcttggccaagagtccatccttctccttctggaggaggtgaggcttctgcagcccaagagcctaagccaacaaaggatgatgttcctcctaagccgtttatcattgagactgatccaattgctcaagaggaagtagcagctcaggagcctacttctccagttcctgtctctcgaactctagttccagatgatttgcagccatctgcactagcgtcagagccagaacagcccattgttcaggatccaccagctgctctagtgctggatctgaacaagcatgcagaagaccagcagtag

SEQ ID NO: 86682 - DNA, 228 bp, Glycine max
  Peptide Sequence Number=SeqID_178367
atggaagtgagggacaaggttaaaatccttccatatagggacctagatgagctagtccaactttgtataagagtggagcaacaacttaaaagaaagccttcttcaaattcttatggctctcactcttatccaaggaaggaccaagcccatggaattttgggggctgcaccttcaaaacccatggatgacgtcacattgcctctcaatgccccacaaagaaaaccatga

SEQ ID NO: 86683 - DNA, 297 bp, Glycine max
  Peptide Sequence Number=SeqID_178368
atgttgaggggagttttaaggagttccaagattcagaagtctacgagaaagaagaagaaagagaaaaagaagaagaaaaaggaggaaagagtgaagcagaggcgctaccgaatcacgaccgtgatcattccctacatcattcgcttgctagttgtacctcctgcaacagtcaatgatgacaaagatgatgacaaaaagctcaaagatcaatcaaagaacaactcaagtgaatcaagaacaattcaagagttcaagataataatcaagaagaactcaagactcaagaagaaagtttag

SEQ ID NO: 86684 - DNA, 222 bp, Glycine max
  Peptide Sequence Number=SeqID_178369
atgttatctgtatatcggttccaggcttccaaggatttgaatctcctggaagatgacatgccttgccaaacacaacccgataaagagactgatgtaagctccattggagcttgtaggcctaggatattcttcatcaatggattcctttgcttcttggaagatgaatggcagcggaatggacaaggaagagagagaggagatgccacttcaaggagaagatga

SEQ ID NO: 86685 - DNA, 1188 bp, Glycine max
  Peptide Sequence Number=SeqID_178370
atggctaccgcaccaaaagaaacttcagctcctggttcatcctctgtaccatcatctccatcatccaccaaagcaccatcacaccaggaacgacctgaattcaacatccaacccatccaaatgattcctggttcagcccctgttcctgagaaactggttcccaaacgacaacagggagtgaagacttctgaaaaccctagccttgcaacaagtcctagggaagtagacacggagatggacaagaagatccgcagtattgtgagtagcattttgaaaaatgcttctgtccctgaagctgatgaagatgtcccaacatcttccaccccaaatgtttctgtgcctgatgctgataaagatgttccaacatcttccactccaaatgctgaagccctcctttcacccagtgaagaggaatcaacagaagaagaagatcaagccacagaagagacccctgcaccaagggcaccagaacctgctccaggtctggacgaatcaaactatggcacagagaagagcacacaatcactcctaccacatccagatggagcaaagttgcaattccttcagaagaggaaagaaatttcctcatctgattctgatgatgatgtcgaactagatgttcccgacatcaagagagccaagaaatcagggaaaaaggtgcctggaaatgtccctgatgccccattggacaacatttcattccactccattggcaatgttgaaaggtggaaatttgtatatcaacgcagacttgctttagaaagagaactgggaagagatgccttggattgcaaggagatcatggacctcatcaaggctactggactgctgaaaactgtcaccaagttgggagattgttatgaaagtctagtcagagaattcattgtcaacattccctctgacataacaaacagaaagagtgatgagtatcagaaagtgtttgttagaggaaagtgtattagattctcccctgctgtaatcaacaaatacctgggcagaccaactgaaggagtggtggatattgctgtttctgagcatcaaattgccaaggaaatcactgccaagcaagtccagcattggccaaagaaagggaagctttctgcagggaagctaagtgtgaagtatgcctgcataggattggcactgcaaactgggtacccactaatcatacttccactgttgccacag

SEQ ID NO: 86686 - DNA, 135 bp, Glycine max
  Peptide Sequence Number=SeqID_178371
gtcgactctagaggatccccattggccgcttcaagatatttggcaccctttgtcacacaatatgtgaagtcccgagacgtgccgaaaatcaaaaggaagcaggcttacgcgatccgtgaaaattccgtgatgtga

SEQ ID NO: 86687 - DNA, 287 bp, Glycine max
  Peptide Sequence Number=SeqID_178372
caacgaggcccacttgggccttccaggaagttatccaaaaggcggtgccttctggaggaagcaacctagctcgcttgggcgagctggaaaatccaagccgaggcacttccgtaacgctttcgtgacgtttccgtgggtgatttcgcgaagattttcaaccgttcttcatcgttcttcggtcttcaaccaggcgaggctcacgggtgcgctttccaaaggaggaaagatgcgcggagtcgccaccaacgtttatttgtggaaaacgtcggaaaaaccgaaggaaaccg

SEQ ID NO: 86688 - DNA, 493 bp, Glycine max
  Peptide Sequence Number=SeqID_178373
ggaacttgagaggcggaactggcataaatccatgaccaagcagatggatgggcacatagatgtggccctagtcaaggaattttatgcaaacctgtatgatcttgaagaaaaatcccccaagcaggtccgagtgcgggggaagctgattaaatttgatgccacctctcttaatgcttttttggagacaccaccagttctagagccaggggaacagtatactgcatataccagagggcgcgccctggaagctcctgaggaaggatttgactacactgttctagtggagggtacatccactaggttgttcaaagagaacaagggagggccacttgatccaacagaatggagaaggaagagagagaggagacgccacttcaaggagaagatgagtctagaagaagctcaccaccataggaggccatggataagagcttggaggaagaaagagatgaatgaagggagaggaagagaagagcacaaaattttgtgctaa

SEQ ID NO: 86689 - DNA, 106 bp, Glycine max
  Peptide Sequence Number=SeqID_178374
atgtaccaagttactttgcttcagggaatagaagagaagactgcgaagttggaaggaagtgagaaggctctagttgcacggcatgaagctcgtcaagctgtagtag

SEQ ID NO: 86690 - DNA, 234 bp, Glycine max
  Peptide Sequence Number=SeqID_178375
atgcagaggaccgagtcacatcagaagagtactgatgcagcaatcaggaatctggaggtacaagtgggacaattagcaaaacaaatggctgaaagacccactggtagctttggagccaatactaagatgaatcccaaagaggagtgcaaagtaattttcactaggagggaaagtgttgagaaggaaaagagaattgaggaggatgtgcattgttccgctcttccgcgatgctaa

SEQ ID NO: 86691 - DNA, 114 bp, Glycine max
  Peptide Sequence Number=SeqID_178376
atggtaccctcaaaaggtgttgtggatgcttcagatggtccgtggcggcgatgggcagtagcagaggcggtggaggatgatccctttctcttcttcgatggctctaccatttga

SEQ ID NO: 86692 - DNA, 289 bp, Glycine max
  Peptide Sequence Number=SeqID_178377
gattgaggattttctccaccgaatcttcgaggaggattctgaggattccgctctgattaaagtgttcctcctggtgtgggggtccaacggcaagcaatggcagctcacggcggccaccggtggtcttgggtggtggaaaataaggcgttcagcgcacttcctctcggttgtagttgggcttagtgcagctttgggctgctcagcgcaattcccatcggttggagttgcgcttagcacgccatactcgcttagcgggagatcaaaacttattattttcaagatcccaaca

SEQ ID NO: 86693 - DNA, 183 bp, Glycine max
  Peptide Sequence Number=SeqID_178378
atggcgtcgttgctacatttgcctatcgtaagggcgttccatacctttgagctactttatgtcgacgacattgtcgatatgttggtggaattactcgagtgttggatctacaagcatttcccatttgttggttccgccttagctgctgaggattatgacgagaagagaccgcgtgcatgctga

SEQ ID NO: 86694 - DNA, 462 bp, Glycine max
  Peptide Sequence Number=SeqID_178379
atggcgcccactaggcaccctttggacccagataagtccaacagggccctgggattccccgcactgatcacaggactctgccggtcgtttggagtccccgttgcacctaccaaggccgcaggcgcgccaccaccacctcatcaggctgaccaggctggggcatttgacatagagcagtatttacggcatttggttcgccagcaggcggccaaccaccgagcacatgtacggacccatgactgtctgtaccagatgagccttagcatgcagagccagggctccacttctttttcatgccctactccagaccagttcagggcagaggttgcatggcccggagattggcccgaggcccaagcaggagaggcacccccagaagctcccggcgatggagaagaagcccacgaggatgaggagatggccgatttgcttgacttcttgggagggagtggagatacgtga

SEQ ID NO: 86695 - DNA, 261 bp, Glycine max
  Peptide Sequence Number=SeqID_178380
atacaacgtcttggggtagcaaagtgcccaacgtatgtatttaagaaggtgacacggaccctccgttggtttgttaaagagaggggatctagacagaatccgtgtgtgacgcatatgcgaaaggcgcaacacgggaattggaaaaatggcacgcggcgtgtttgcttcgtgcctctatttaagggacctatatgggagaaagctaaaaaggtttttagcgataatccccaaggtggtcatatctctcttgatggtctctag

SEQ ID NO: 86696 - DNA, 213 bp, Glycine max
  Peptide Sequence Number=SeqID_178381
atgccgatctccccctgcagaaggattgcgcccacaagacacccagtggacccagaggagcctaacagggccctagggttccagctcgggttccgggcctctatcagtcctacagggtgctcgtcccccccagcaagggatcgcgccccgcaagacaccccagtggacctcggagaaggtccacagggtcttggggttttcagctctgattaa

SEQ ID NO: 86697 - DNA, 2020 bp, Glycine max
  Peptide Sequence Number=SeqID_178382
gtcctcaccttgagaaggctacacgccctcgccttcagagggctgcacacccttaactttcgagggctgcacgccttcgccttcaaaggacaacacgtcctaaccttcagaggactacacgtcctcgccttcagagggctacacgccctcgcctttagaggactacacgtcctcgcaatcggagggctgcatgccctcaccttcagagtactacatgtcctgtctttaagaggactacacatcctcgctttcagaggactacacctcctccccttcagaggaatacacgtccgcacctttagaggactacacgtcctcgcctttagagggctacaagggctacacgtcctcaccttcagagggctacacgccctcactttcaaaggactacatgtcctcggcttcagaggactacacgtcctcgcgtttactgggttacatgtccacgcctttagagggctacacgccctcactttcagaggactacacgtcctcaccttgagagggctacacgctctcgtattcagagggctgcacgccgtcaccttcagaggactacacgtcttcgccttcagaggcctgcacgtccttgccttcaaagggctgcatgccctgcccatcagagggttgcatgccctcaccttccgaaaattacacgtcctcgccttcagaggactacacgtcctcgcctttagaggactacacgtcctcgccttcagaggactacatgtcgtcccttcaaaggagtacaggtcctctcgtttagagggctacacgtccttgcctttagagcgtacacgccctcaccttcagaggactacacgtcctcaccatgagaggactacacatcctcgctttcagagggcaacacgccctcgccttcagaggattacacgtcctcccttcaaaggactacacgtcctcgcgtttagagggctacacgtccttgcctttagaggagggcaacacgccctcgccttcagaggactacacgtccttgccattagaggggtgcacgccctcaccttcaaaggactacacgtcctttccttcagagggctaaacgtcctcagcttcagagggcttcacgccctcaccttcagaggactacacgtcctcgccttcagagggttgcatgccctcaccttcagaggactacacgtcctcgcctttagatggcatcacgctctcacctttagaggactacaggttctcgccttcagagggttgcacgccctcacctttaacggactacacgtcctcgccttcagaggactacacgtcctcgcctttagagggctacacggcctcactttcagaggactacacgtcctaaccttgatagggctagacgccctcgccttcacagggctgcacgccgtcaccttcagaggactacacgtcctcgccttcagagggctgcacgtcctcgccttcaaagggccgctcgccctccccatcagagggctggatgccctcactttccgtggattacacatcctcgccttcagaggactacacatgctcgccttcagaggaccacacgtcctcgcctttagaggactacacgtcctcgccttcagaggactacacgtcctcccttcaaaggactacatgtcctcacgtttagagggctacacctccttgcctttagaaggactacacgtcctcgctttcagagggctacacgccctcgccttcagaggactacacgtcctcgccatcagaggggtgcacgccctcaccttcataggactacacgtcctttccttcagagggctacacgtccttagcttcagagggttggacgccctaaccttcaaaagggactacacgtccttgccttcagagggttgcatgccctcaccattagaggactacacgttcttgcctacagaggactacacgtcctcaccttcagagggttacacgccctcgccttcagaggactacacgtcctcgcctatagagggcatcacactctcacctttagaggactacacgttctcgccttcagagg

SEQ ID NO: 86698 - DNA, 111 bp, Glycine max
  Peptide Sequence Number=SeqID_178383
atgtggaaattcttcatcgttcttcgtcgttcttcaccgttcttcatccgttcttcattcgttcttcgttcttcaacggttttcttttcttccgtttttaacgtgctttaa

SEQ ID NO: 86699 - DNA, 759 bp, Glycine max
  Peptide Sequence Number=SeqID_178384
atgaggggagcgccaacagaagaaagtctctcgcctttccttgtgagggatctaggcgcgcaaagtctcaaggtgatacaaagagtccacaaggcgtggagaagtccgttgaggaaagacaaggagcttagaggcatccgaagtggcataatcggtgttatcgatgaggagaacttcgaagctccggaggaagatgaagaagtccgagctctaaaattagagctagggaaggcaagactcgccaaggagaagttcaaatcagccgctacacacatctggaaagagtgcaccgagttacaagaggaaaacgcggccactgcaatagcccttgaacaagaaaccaaaagggtccgcaaggaggaacatggccgagagaagttccgaggagcattgtggggtagcaacaatgagctcaagctccggagagaggaaagagaccggtcacgggtgcatggcatgatcttaaaagaagagttagctgcttgcgcaagggcagtacaaggaagagttgaaacagtctgtgcccatgaacaaaagctagcggaggattttgcacaagtgtacgccgaaaaagaagtaagagggagggtgattgatgcattgcatcaagaagcgactatgtggatggataggttcgccttgaccttgaatggaagtcaagacctcccgcgtctattagccaaagcaaaagccatggccgaagaacagatgaaggccgatctatcggccttaaaagatcaaatggcttccatctcggag

SEQ ID NO: 86700 - DNA, 399 bp, Glycine max
  Peptide Sequence Number=SeqID_178385
atgaagctcggattgggcctcctcctacccacgagggttcatgtcccagtttataatggatcgaccttcttgagcccgatccaatccaggatcctgatcgtcgtcactgttgccgtcgtcgtcgccaacgacaatggtggtggttgcaacagtgatcatggtggtgacaacaacgatgatgaatgtcataacgacaaagataatggtggtgatgacgatgacaattatagtagtgggaatccagcaagccaacctgtgggcatattttgtgcattgggtcgtggatacgtcgccgtcgctgcacaatctccaaattgcaagaagacaagaggagggcactctactacagtactactcttattctttgatttctgttttactttacatgacaggaactaa

SEQ ID NO: 86701 - DNA, 1911 bp, Glycine max
  Peptide Sequence Number=SeqID_178386
atgtccggtcccctcgatcgttttgccagaccttgctttgaggggttttcgggcagtgatgagaagaaggagaggagatctgacttcgagtactccgaggatgaaaggaggaccaggattggatccctaaaaaagaaggcactcaatgcatcctccaaattcaaacacactcttagaaagaagagtagcaggaggaaaagcgatggacgtgttagctccgtttcaattgaggacgttcgcgattttgaggagctccaggccgtcgacgcctttcgccaatccttgatcatggacgaattgctccctgaagcctttgctgattaccatatgatgttaagatttttgaaagcgaggaagttcgatattgaaaaggcaaaacatatgtggactgacatgctacaatggaggaaggagtttggtgctgatactattatgcaggattttgagttcaaggagttagatgaagtcgtgaagtattatccacatgggcatcatggcatcgacaaggagggaaggcctgtttatattgaaagacttggaaaggtcgatccaaacaaacttatgcaagttacaactttggataggtatgtgaagtaccatgtgcaggagtttgagaaagcttttgcaatcaagtttcctgcttgctctattgctgccaagaggcacattgattccagcaccacaatcttagatgttcacggagtgggccttaagaactttacaaagtctgcccgggaactcattacccgattgcagaagattgatggtgacaattaccctgagactctttgccaaatgtttattataaatgctgggcctggatttaggctgttgtggagcactgtcaagtcttttctcgatcccaaaacaacttctaagattcatgttcttggaaacaagtatcaaagcaaattgcttgaagttatagatgccagtgagttgccagaatttctgggaggtacctgcacttgtgaagatcagggaggttgccttagatctgataaagggccctggaaaaaccctgatatattcaaggttatatgctgttcttggaaaaaccctgatacattcaagatggttctcaatggtggagcatggcggtcaaagcaagttgtaaaagttcttaacaatgaaagaaaggttattgtgtatgccaagccaggatacccaacggtaaaaggcagtgacacatcaactgctgaatcagggtcagaagccgaagatatatcctctccaaaagcgatgaagagttattcacaccttacgctgacccctgttcatgaggaagctaagatagtaggaaaaacaagctatgccagcaacttgtctgggtatgatgaatatattccaatggtagacatacctgttgatgctggttggaagaagcaagcatctctacagaggtcttacacctctaaaggagcacctcctcctcttgacactcagaaaactcctgatgggcttcaagctcggatgtgggtagcactgtctgtcttcttcttgaccgtattaactcttttacgtcaagttgcataccctgtgaccaagaaatttcctgcattatcttctaatgatgataagagtacttcaaaaccacttcctgatacagcaaacatggatgttcttcctccttcatcaactcctacagaggaaaatctccttccctccatgctgaaaaggttaggtgagcttgaagagaaggttgacacactccaatctaagccatctgagatgccttatgagaaagaggaattgttgaatgctgctgtatgccgggtggatgctttggaagctgagttaattgctactaaaaaggctctgtatgacgcattgatgaggcaagaagagctgcttgcttacattgacagacaagaagaagccaagttgcggaaaaagaagttttgctggtga

SEQ ID NO: 86702 - DNA, 849 bp, Glycine max
  Peptide Sequence Number=SeqID_178387
atggcatcctctcctttgaactcaaaatctggctcccatggtcgctcaaatagcttgccctctagaccacaccctctcattctcaaatgcaatgaacacttggaaagcttaagggcttccaatgaaacctcttcttccttatcaaatcttagacataaggtaggaggattgcaagatctgattgagtgtgttgaaaaattgattcagcttcctctcactcaagatgtctttctccatgagtgtcaagagaattgggtggatgaacttttggatggatccttaaggctcttagatgtgtgtacttcagccaaagaagctttactgcacacaaaagaatgcacacgtgaacttcaatcaatcattagaaggaagaggggtggtgaagtggagttgacagcagaggttaagaaattcttaacatctaggaaggtagtgaaaaaggcaatctccaaagccttggcaaatttgaacagcatttcaaagagttgcaacttctcatctaccgcagacaaagatcaccgaacagtggctttgattagcttattacaagacgtggaagtggttacactttcaacatttcagacactgctgcaatttatctcaggatcaacacgatcaaagtcaaacaactggctttcaatttccaagctaattcagcccaaaagagtgggttgctcgctagttgctgatgaaagtgaatttgcccaattggatgcagcattgcagtccttcgtatctttgcagtctctcctcagtcacaacctttcatctattcagtgttttctaagccatgtcgaaaatttggagatgtacattcaggatctagaaatcggagttgagcacctctaa

SEQ ID NO: 86703 - DNA, 234 bp, Glycine max
  Peptide Sequence Number=SeqID_178388
atgatcaaacctgcagctgtggttatggggacccgaggcagaagcttgattcaaagggaagtattgctttcaccactgttgttattgttccaggaaaagatgatggagatgcgtcaatcgtctagtggaattgtgttgagtcaaggagatgacatctccaatcttattcgactaggcttttacgagcatattgaaggcctttatccaaccgtctggaattgtttgtatacctag

SEQ ID NO: 86704 - DNA, 219 bp, Glycine max
  Peptide Sequence Number=SeqID_178389
atgcacttgcaatttgcaaagtatgataaggatacccctgagcgctggtacaatgtagccaaagcagttggtggtaaatcagaagatgatgttaagagacactgtcagatactcttggaggatctcaggcacattgagtccggccatgttcccattcccatttacaaatcaacaccaactacctttcctctttcaacaacacgtacaggaaggttgtaa

SEQ ID NO: 86705 - DNA, 2979 bp, Glycine max
  Peptide Sequence Number=SeqID_178390
atggcttctgcttgtgtgaccctgaaagccaatacccatttagcaaactctgagaaaggctttcttggagaaagaataaaaggtggcttcaacaacagtgccttggtgatgaatcagttggctatacgttctagaagccacaagagggtgaaacatggtgttggtgttgtatcttctgttctcacatcaaacaatgccaaagaatcactgaccttgcaagtgccttcctttctgagaagaagagctgatccaaaaaatgttgtttccatcatattgggaggcggacctgggacacaactctttcctctcaccaaacgtgctgccacacctgccgttcctgtgggtggatgctacaggcttatagacatccctatgagcaactgtctcaacagtggcatcaacaaaatatttgtgctgacccagttcaactctgcatccctcaaccgccacatcgcccgcacctattttggaaatggcattaactttggggatgggattgtggaggttctggcggctactcaaacaccaggagaggctggaaagaattggttccaaggaactgcagatgctgtgaggcaattcacttgggtatttgaggatgccaagaatacaaatgttgagaatgtgttgatcttggctggagatcatctatatcgaatggattacatggaccttgtgcagagtcacgtggatagaaatgctgatattacagtttcatgtgctgccgtgggtgacagccgtgcatcagattatggattggttaaagtagatgacagaggccgcatcattcaattttcagaaaaacctaagggtgatgatctgaaagcaatgcaagcagatacctctcttcttgggttgtcatcccaagatgcattagagtcaccatatattgcatctatgggggtttatgtattcaagacagatgttttactcaatcttctgaaatggagatatcctacctcaaatgacttcggatctgaaatcatccctgcagctgtgagggatcacaatgtccaatcatatttttttggagactattgggaagacattggaacaataaaatccttttacaatgctaacttggctcttactgaagagagtcacaagttcgaattttatgaccccaagattcccatttacacatctccaggattcttaccaccaacaaagattgacaaatgccggattgtggatgctattatctcccatggatgtttcctgcgggaatgcacagttcaacactccattgtgggtgaacgttcacgcttggattatggcgttgaggtcctggacactgtaatgatgggagcagactattaccaaactgaatccgaaattgcttctctgctggcagaggggaaggtcccaattggtattggaaggaataccaaaattaggaactgtattattgacaagaatgcaaagatcgggaaagatgtcatcatcgcaaacaaagatggcgttcaagaagcagatagaccagaagatggattctacatccgatcaggaatcaccatcataatggagaaggcaaccatagaagatggcactggtagctgtttgcaatgctgtgttacaatgcagaaagcagcagaacaccccatcgttgcgttaggatgcatgaatgcacgcggtaaatggcaatgcccaatgccacgtggcaagatcagggcacaggtgacaatgcaatctcggaaaattgcggacgtgttgaacgtctcggatggtggtcgtgggttagaaaacaaggaaaagaacctcagttcaaacctccacaatgatcatgataaccaaaaccaacacgtgcagattgattctggctctgccctccaacaatttcttgatcacatacccattagtgcaatagctggcataaaaaattcacctgctggagacagtataagggatgcaattcatgcgttgtacaaaaaggatatattttctgcagcaattgtggatacgtcagactcccatgcgggcagcataaggttttcagatcgttatattggtctcattgattttacaagcatggttctttggtgccttgaggaatttgataagataaaaaatgataccatggaaaatcatctcatggatttagagaacgatggccttttctccatcctggatcaggttcctcagattgggctaaccaaggttagcgagttggccaagtcattcctctgggaaccatttttcccagtaaacatggatgacacggttttgcatgctttgctacttctctctaagcatcgggtgcacgttttgccggtcatacaggaacctcaagctggactcatcggttatgttacacagaatgcagtagtccagcaccttcttcaatcaagtgaactagagtggtttgatagcattgcagataagaacatatcagatttccgatttgaaagccaagaaaatcctagttgtgtatatggggaccaaactgttgcaaatgctttagatttgctctggcaaaaccaaacttgtgcagttgctgttgtagatcgacaaactaagaagctcgtgggtaatgtaaggaacggcgacgtttataatcttgtaaagaataatgacctcctaagaaatagatcgattttaactgtgaaagaattcattcacatagagactgacaaagtagtaactgaacaagccattgaacatgaccatggggctttactcacagcaggaagtctccgtctgaaaaacagcttcatacccagaatggacttgcccgttgccaacaaggaaactgaaacgctcaagcaaataatggagcatacgactgagactaatagcagtttcagctttctgatcaatgataatgagcaagttacagggttgctcacactaagagatataattctgcagtttgcaccaccaaatatgaattctagcattaatggaggtgggtttttcgaatttgccttggagcaaagtggatgtcaggtgaaaaatggaactatggttcgtaatcattga

SEQ ID NO: 86706 - DNA, 3975 bp, Glycine max
  Peptide Sequence Number=SeqID_178391
atgaacacgagagatcatcagatgccgaaaaaatttaaggctctcctcaaccaaaactttgagatccaatctgaaaagattctcaaaaccaaggaacaaattcttgaaggttctaaacatgattgcgaaaaatctctcgttaagaatactcacaccaccatattagaagattttgaaccaatatcaagtgttccaatttacagaaatgatgacatttatgctaaggaagaaaataaagttgtaaaaaactttgaaccaagacctaatgtttcagcttatggtgacaatgatgttgatgctaagccaaagaaaaatgtcatcaaagactttgaaccaagacccaatgtttcagcttatggtgacaatgatgttgatgctaagccaaagaaaaatgtcatgaaagactttgaaccaagacccaatgtttcagcttatggtgacaatgatgttgatgttaagccaaagaaaaatgtcatgaaagattttgaaccaagacccaatgtttcagcttatggtggcaatgatgttgatgctaagccaaagaaaaatgtcatgaaagattttgaaccaagacccaatgtttcagcttatggtggcaatgatgttgatgctaagccaaagaaaagtgtcacgaaagattttgatccaagacccaatgtttcatcttacaatgacaatgacattgaagcagtggaagaaaagaaaatcatgaaagattttgagccaatacctaaagtttcaacttatggtgatgatgatgttaatacaaaggaaaagaaaaaagtcatgaaagattttaaaccaagacctaacgtttcagcttatggtgacaataatgttagtgcaaaagaaaagaaaaaagtcatgaaagattttgaaccaagacctaacgtttcagcttatggtgacaataatgttggtgcagagaaaaagaaaaaaatcatgaaagattttgaaccaagacctaatgtttcagcttatggtggcaacaatgttgatgaagaggcaaaaaagaaagtcacaaaagattttgaatcaagacctaacatttcagcttatggtaacaatggtgttgatgcaaagaaaaaaaagaaagttgtggacaatgacaacattgatgctcagggaaagcctccagaggattttgagcctaggccaaatatctctacttatgatgaatatggtaagctaactgacaaatctgatatgttctcattcggtattatgcttttggagctcgtaacaggttggcgcccagtggacaacactggggaatatgaagtcgactggccgcttgtgaagaaagacgatgaccgcgacgacgaagctgagtattccccctttctgggacttgaaaaggggtctgttcttcaggaggccagggtttttaatgaccctcaactagatgctaggagatgttcacaggttattacaaaactcctatacctacttaatcagggagagacgtttacaaaggttgaagccacagaagttttctttgctgtgactaagcttttccagtctaaagatatgggattaaggagaatggtctacctgatgataaaggagatctctccctctgctgacgaggttatcatcgtcacaagctctctcatgaaggacatgaacagcaagattgatatgtaccgagcaaatgccattcgagtgctgtgtcgtatcactgacggaaccctcctttcacaaattgagaggtatttaaaacaagccattgtagataaaaatccagttgttgcaagtgctgctctagttagtggcattcatctactccagacgaatcctgaaattgtaaaaagatggagcaatgaagttcaggaagctgttcaatcaagagcagcccttgtacaatttcatgcactgggtttgctacatcagatacgacagaacgatcggctagcagttagcaagctggttaccagcttgacaaggggaactgttcgctcacctttagcacagtgccttttgatccgttacacaagtcaggttattcatgaatcaggcaatacacagtcaggggaacgccccttctatgattatcttgagagttgccttcgccacaagtcagacatggtgatttttgaagctgccagggcaataacagagctcaatggcgtaacaagccgagaattaactccagcaattactgttcttcagcttttcttaagttcgactaagccagtcttgagatttgctgctgtccgcaccttgaacaaggtggcaatgacgcatccaatggcagtcaccaactgcaacattgatatggaaagtttaatctctgaccagaacagaagcattgctacccttgctattactacacttttgaaaacaggaaatgaatctagtgtggatcgtcttatgaagcagatcacaaatttcatgtctgatattgctgatgagttcaaaattgttgttgttgaagcaataagatcattgtgcctgaagatgaacttcctgagtaatattcttagggaagaagggggttttgattacaagaaggcaattgtagattcaattgtgattctcattagagatatccctgatgcaaaggaagtggggttgcttcatctttgtgagttcattgaagattgtgagttcacttatttgtccacgcagatacttcacttcctgggaatcgaaggaccaaaaacatcagacccgagcaaatatattcgttacatttataatagagtacatcttgagaatgcaattgttagggccagtgctgtgagcacactggcaaaatttggtgctgctgttgatgtgttaaagccccgcatatttgttctgctaaggcgatgtctttttgacagtgatgatgaggtccgtgatagggctacactttacctggacacacttggaggtgatggttcagttgttgagactgataaagatgtaaaggacttcctgtttgggccatttgatatcccacttgtcaatctggagactagtttgaaaaactatgaaccttcagaagaaggttttgacattaactctgtgcccaaggaggtcaagtcccagccacttgcagaaaagaaagcccctggtaaaaagccaactggtttgggtgctcccccatcaactgcagatgcatatgagaggatgctttcgaccatttcagagtgtgcaaactttgggaagcttttcaagtcctcagcacccgtggagctcactgaagctgagacagaatatgctgttaatgtcattaaacacatttttgataggcatgttgtgttccagtacaactgcacaaacacgataccagagcaattgttggaacatgttattgtgactgtggatgcttcagatgctgatgaattctcagaggtgttctccaagcctctcaggtctcttccttatgattcacctggacagacttttgtggcatttgagaagccagagggagtgccaacagttggaaaattttctaacattctgaaatttattgtcaaagaggttgacccaaccactggtgaggctgaagatgatggtgtcgaagatgaataccagctggaggatctggagattgttgcagcagattacgtgttgaaagtgggggtgtctaattttaggaatgcatgggaaagcttaggccctgattttgagcgagtggatgagtatggtcttggtcctagagagagcttggctgaagctgtaaacactgttatcaacctacttggcttggagccttgtgagggcacagaggaggttccacccaattcaagatcacacacatgcttattgtcaggtgtattcatagggaatgtgaaggtgcttgtacggctgtcttttggacttgatggtccaaaggatgttgcaatgaaactgtctgtcagatcagaggatgaaacagtcagcgatgccattcatgagattactagcaagtatcgcgtcgggtttattgcgatacaccttcctcataatgatacttcatttttcggtgtagtcaatgtaagatga

SEQ ID NO: 86707 - DNA, 825 bp, Glycine max
  Peptide Sequence Number=SeqID_178392
atgccaacttggcgatgcattcaactcttcatttatttcttagcgtgggcctcacttatatgctcccctacaagctcttcacttgctgattcaatttcaagtccggtgcatgctaaacctttttctcccgtcaacaaatttctgatgcagtcctattatgacagatacatcaatttacacgatttggattttgaaaaatttatgtctcaagaagtcccttatggttcgtgtgataaccttaattttgtgttgagattgtcagatctaaagcgcactcttattggtgaagagttcagtgatatagctgtctttggtgacacaaatctggagctgccttcattcttgtccaatcgttctgctgttgaaattcacttgcttgttgatccaaatatattgcaagagccaactgatattaacatggagcttccattgcatgctcgatatcaacctctgaatggaagtgggtactcggcaattgaatttggtgcaccggatatggtagtgcgctgcagcacaaaagaaaagatggaaaatcacaattgcttctttaaattggaaaaagatgatgctaatctgtatggtgctcatattgtttggagaataccttctggaataaaggcacatgctggtcttttatatggaggtcggatgaagacccagtttgggatgaggctatattacaagcaggtggcgggcaatggatatgctgtggataaatcggaattttgggaagtggttaccgacagcaataacgacgtgcagaaacagattgtgcatttaggatccggatccgtgcagttatcagacttttcagagtctaaataa

SEQ ID NO: 86708 - DNA, 240 bp, Glycine max
  Peptide Sequence Number=SeqID_178393
atgaagggtgaggatgaggaggcatctttgggttggtttgcttttgagcctgaatggtatgacacaaactatacaaactttgctcattgtgaggctcagtctgtttctctatttgttcaatacctttcaaatatgaaaggagataccgtccaagttggttcaaaaggaaatggacaagaaaatggaaacactttggctgatgcggtaataattctatgtctagcattaacatctgcttag

SEQ ID NO: 86709 - DNA, 159 bp, Glycine max
  Peptide Sequence Number=SeqID_178394
atgtcgtcaccggctcaatattcaaccgctgaactccacgagatgttggcaccagctcagcattcaacctctaaactccatgaggccgagaaactgggtctggtccatatcattgggcttgtggtctcacaactagaaatggccaagctcattaattag

SEQ ID NO: 86710 - DNA, 765 bp, Glycine max
  Peptide Sequence Number=SeqID_178395
atggctgctaattacaacaacaatatcattagtgctgctgctgctgctgctgctttcatgacacctgcagccctacacctccagccccagtccgacgacgacgacggagaaggacccttctccacccagcggcgccctcgcgggcggcccatgggctccaagaacaagcccaagccacccgtcatagtcacgcgcgacagccccaacgtcctccgctcgcacgttcttgaggtctcctccggcgccgacgtggtggagagcctctccaactatgcgcgccgccgagggaggggagtgtccgtgctcagtggctccggcacggtggccaacgtcgtgctccgtcaaccggccgggagcgtcctcacgctccacggccggtttgagatagtttccatgacggggacggtgctcccgcctccggcgccacccggttcggacgggttgtcggtttatctgtcaggggcgcagggacaggtggttgggggcgtggtggtggcccctctggtggcttcgagtcacgtggttttggtggctgcttccttcgctaacgccatgttcgaaaggttacccttgcccttgaatcagcatgatgatgatgatcaagttctgcaagaggcaccacgtggcgtcatgggaactgaacaggtggcagatggaaggaactatcccttctccgcgtcgctgcagggtgaagtatttggatggggtggaactggaactacatcatcaacatcaactgcaccacccaaaactcatcctttctag

SEQ ID NO: 86711 - DNA, 897 bp, Glycine max
  Peptide Sequence Number=SeqID_178396
atggcgttcatttggcggttctgtggtgtgtctctatgcaacttcacagcctctaatgcccagaaaggtccttctccttctctgcccataaccttggacttggagcatcatataacaaccccatctttactttcttccatcgaagaagaagaaggacgcgcggttaataggagacaacttattcttcacacgccagtagctgcagcagctgcatttgcagtcccaaatgcattggcactcaatgatgtgtctgaggatgttcgtgtctacactgacgatgagaacaagttcaagattgagattcccgaagagtggcaagtgggaacaggagacggagaatctagtgggtttaaatccataactgctttctacccaacacaggcatccaattccaatgtgagcgttgtgatcacagggctgggaccggatttcaccaggatggaatcctttggcaaagttgacgagtttgctcagactctagttagtgggcttgacagaagctggcgaaaacccccgggtgtggctgctaaactcatagattgtaaatcatctaatgggatttattacatcgagtatttgctgcaaaatcctggtgagagtcgcaggtatttgtattcagctattgggatggcatcaaatggttggtataacagactgtataccgtgacaggacagtatgtggaagaggacacagacaagtatgcttcaaaagttcagaaggtcgatgaagtgacttctaagttatgcattgaaattcagcttccacttggtttctgcagcttgattgaatatgcttatcaatcaagcgttcaatcatcagtgaatcagtcgcaaccgtttggttcggttcctattctcatctgtcggatttacgaatgtctagagaaagatctatga

SEQ ID NO: 86712 - DNA, 761 bp, Glycine max
  Peptide Sequence Number=SeqID_178397
ggtaccaggaatggaggaatggtaacggaatgaacaagttgatggtgaaatttggtaatggaattgatggaatcgtgtttgagttgttgggcgcaagagcgccaattggagattcgatttctgatgctaatgcgatttctagtggcagcgctactgcaattgctactaatgtagaggcatggctgcaatttttcaatttggaacacttacgcgaagagaaagagagcggaagtgcagtgtccaaacagacgccatgggaaacggtggtggcaatggcaactcaaatgaagcggtggcgccgagctggaactcgccggagccgggatcccgccgcacttgtcgcagcgagaaaccaccagaatctgacggcaggatggacaggaggaatgcgatctgagccaggcgtcgatgcagctgacgtggaagccatgtccgcactgaggaagcactcggatttcgtctccggctgcgaactcggtgaggcagatcgcgcagtcggcgaacttgacagcggattcggcggaggcggtgaccttggggagggagcggaggaccttcttcttgacgcctttgttggcggaggcgggaggaggctggggagtagcgttggaggaggagaggcggaggcggcggagacagccgcagcgggtgacggcgacgaggccgaggatgcagatgagagcgcagaggagggcggcgaagatgacgacgaagtcggaatcgacgacggcggagtccgtggccgagtttcgctcgcctaa

SEQ ID NO: 86713 - DNA, 633 bp, Glycine max
  Peptide Sequence Number=SeqID_178398
atgtcgatgtcgatgtcaatgttgtatatgtgtctcttcacactcacactcgtcgtcggaatgttatctatgctatctgatgccgttgatgacaaatgtgccgcctgcaaagccgtcgcggaggagctagagattgggctttccactgagaggccacgaaatcacttggatatgcgccatcgcttagactccaaaggccagcgtgaaggaaagctaatcgattacagagttagcgaactaagagtcgttgaacttcttgatggcctttgcgaaaagatgcaagattatacactcaagatagatacaaatacctatgaatggttcaaagtggatagctgggataacctcacaacaaataagcaagaagctcgggcatattcaaaagatatatcttcttattgtggaaggttacttgaagaaacagaggatgagtttgctgaattgatcaaaaaaggatctgttaaagtgggaggtgtgagcaaagttctttgtcaagatttgagcaagcattgcagtcaaatgaggttgtatgttctaaagataatattgttgtttattgattgtgaacattctaacatgcttttagcatttactgaagtgaccttccttctggcctatcctcctagtatatag

SEQ ID NO: 86714 - DNA, 321 bp, Glycine max
  Peptide Sequence Number=SeqID_178399
atggagagacttccaaccatgaatgcacatcactctatgtcttctttgtcccttgaagcaaaggcctgcggactgttatgcctttcattttggcaaatgaagaaatttgcagttgaagagccatctcttgactctccatcgtatgctttaaggaaactgtgttcaattaacacaactatactcgatatggtgcttaacattgatttctgtaaaccttacccttgcatatgcaaagaggctgtttccggattcgaacccatgaccaacaagtcaccaaggcacaactttaccgctgcatcagggctcgccctcgattattga

SEQ ID NO: 86715 - DNA, 477 bp, Glycine max
  Peptide Sequence Number=SeqID_178400
atggcagtggtttctattgaagaaggggagaaatggaagaaggagaatgagaaaaaggtggtgagacttgctgtgaataagaagggagccgccaccaaggctaggaaacccgccggcaaggggaaggcagcgaaagaccctaacaagccaaagaggcctccaagtgctttcttcgttttcatggaggagttcaggaaggtattcaacaaagaacatcctgaaaacaaagcagtgtctgctgtgggcaaagctgctggagcaaaatggaagaccatgtctgatgctgaaaaagcaccttatgtggcaaagtctgagaaaaggaaagtggagtacgagaagaacatgagagcctataacaagaaacaggcggaaggtcctactggtggggatgaagaagaatctgagaagtctgtatctgaggtgaatgatgaagatgatgatgaggaaggcagtggcgaggaagaggatgacgattag

SEQ ID NO: 86716 - DNA, 2673 bp, Glycine max
  Peptide Sequence Number=SeqID_178401
atgatgggagatggtggtgtgatatcatctgctgctaccatgatggaagctccaccacctgatggaacaacaacaacttcaatggattttgattacatgggtgagcttttcttagatgggtgctggatggaggcctctgctgatggatctgatttcttgctgcaaagtccttcattttccaataccctctttgacccttcattctcctggcctgccttggagaccaaccacaatgaatcccaggttgctgcttttgggagtcaacaagaaagtcataataacaacatggttagtgttgttgctggtggtatcagaaggtggtggtttgcacccacacacactcccacacctagtccaggacctgggccttctataatggagaagctaataagggccctcatgtggatcaaagattacaataggaacaaagatatgcttatacagatttgggtgccagttcataaagagggtaggccgattcttgcagccgatgatcttctgttctcgcttgaatccaagtctctgaaccttgccaagtaccgcgaaatctctgtgacatataagttctctgcagaggagagtgactccaaggagttggcgtggggattgcccggtcgagtgtttagggacaaggttcctgagtggactcctgatgttagattctttaaaattgatgagtatccaagagttgaccatgctcaagagtatgatgtgcgtggaacgttggcagttccaatctttgagcaaggaagcaagacgtgcttgggggttattgaggttgtgatgactactcagcagattaactatggccctgaacttgagagtgtttgcaaagcacttgaggctgttgatcttagaagctcaaaacaattaagtattcagaatgtgaaggcatgcaacaggtcctatgaagctgcactacctgagattcatgaggtgctgagatctgcttgtgaaatgcacaaattacctttagctcaaacttgggtcccatgtgtccaacaaggcaaagaggggtgccggcactctgaagataattatctactctgcatatctcctgtggagcatgcttgctatgttggtgatccttctattaggtcatttcacgaggcttgcactgagcatcacttgttaaaaggtgagggtgttgctgggggagctttcatgacaaaccagccgtgcttctcagatgatataacttccttaagcaagaaagactatccaatgtctcatcacgcgaggttgtttggattgcgcgctgctgttgctatacgccttcgaagcatctataatagcacagatgactttgttctagagttcttcttgcccgtagattgcaatgacattgaagaacagagaaagatgcttacttcattgtccaacattatacaaagggtttgtcgcagcttgcgcgttataagagaaaaggaattggaggaagctaacttgtcagttaatgaagtgatagcccttgcagacagtggatttactagggatgaaatttgttcggaaccccaacaaaaagggatggttgcctcattggatactgaagaaaaatcaagtgaaacaatgggtagaaaattctctgaaccaaggcagcaacaagaaagtcctattttaaaaggaaaccttgactgtgttagggagtgttctacgtctgttgagggtaacttatcaagtccgggaacaagtaaaactggagagagaagacgggttaaagcagagaaaactataactttgcaagttcttagacaatattttgctggaagcctaaaagatgctgccaagaatattggtgtttgtactacaactttgaaaaggatctgccggcagcatgggataaagcgttggccttctcgaaagatcaaaaaggttggccactccttacaaaaacttcaacttgtcatcgactcggttcaaggtgcctctggtgcatttcaaatcaattccttctattcaaacttcccggatctagcttctccaaatttatcaggaactggcttcttctcaactttgaatcaaagtgataatccaaactcaacaagcacgcagcctgaacatggctcattgagcccagaaggtgcatcaaaatcaccctcttcgtcgagcagccagagttccatttcaagccattcctgctctagcatgtcagagctacaacagcagcacacaactaacattgccagtgacaaagatcctgccacggttggtgaatattctgctgatgttgtgttgaagttgatcagaaacgaggcaaagcttaaaagccttagtcaagatagagcaaagctcttgccaagatcactgagccaggaaacacttggtgaacacccgaaaactcagtatcaactgcctttattgaaaaccagtagcagcaaggtggattctcacagagtaaaagtcacatatggagatgagaaaacccggtttcggatgctgaaaaattgggtctatgaagatcttctgcaggaaattggtaggaaatttaatgtgagtgacatgagcaaatttgatgtcaaatacttggatgatgattgtgagtggatactactcacttgtgatgctgatttagaggagtgcattgatgtttgtcaatcttccgagagtggtaccatcaaacttagtctacaaccttctagtcatagtgtgagaagttctttagaatttagataa

SEQ ID NO: 86717 - DNA, 1632 bp, Glycine max
  Peptide Sequence Number=SeqID_178402
atggccccattacccaccttccacctcaaggaagcacaaattattggagactttaatggatgggatggttccaaccaccagataaaaaatcagtttggtgtttggagtattaagatccctgatactgacggaaattcagctataccacacaattcaagagtgaagtttagatttagacacggggatggagtttgggttgatcgcatctctgcttggatcaaatatgccactccatacgatggtgtctactgggatccacccctttcagagaggtatcaatttaaatatcctcgtccaccaaagccaaagaccccacggatatatgaggctcatgtggggatgagtagctctgaaccccgcataaactcttacagggaatttgcagatgagattttgccccatatttgggcaaataactataatacagtccagctgatggccgtgatggagcattcctattatgcatcatttggatatcatgtaacaaatttttttgctgtgagcagtagatcaacccctgaagatctaaagtatccgatagataaggcccatagcctaggtttgcaggttttgatggatgttatccatagtcttgctagtaataatgttactgatggactcaatggctttgatgttggccaaacttcgcaagattcttacttccatactggagatagaggctatcataaattgtgggatagtagactctttaactatgctaactgggaagttcttcgtttccttttatcgaatttaagcaacagatgtggtgctgtagtctatctgatgctggctaattgtctgatccatagtattttgccagatgcaactgtcattgctgaagatgtttctggcatgcctggacttggtcaaccagtttctgatggtggaattggttttgactatcgtctagccatggcaatccctgataaatggattgattacttgaagaacaagaacgactatgcatggtcaatgaaggaaatctcttggagtttgacaaataggagatacactgagaaatgtgtttcctatgctgaaagccatgaccaggcttctcctattgttgagcaagggatttatcttcagaagatgatacacttcataacaatggcattaggtggagagggctaccttaatttcatgggcaatgagagtggattgatttcccaagagaaggcaatggatggagtaatgagaagtgcaggcgtcagtggaattggtggatacagatcacttgagatacaagcagtgtgttgcttgtctgagatatatgttataattttgtttttggaacttgtgcagttcatgaatgcatttgacagagcaatgaacttgcttgatgataacttctcattccttgcatcaacaaaacagattgtgagcagtgcagatgacgatgacaagcgaggagatctgatatttgtgttcaattttcatccagagaatacatatgaagggtataaagttggatgtgacttgcctggaaagtatagagttgtattggatagtgatgcttgggaatttggaggacatggaagagtaaggagccctaatctctctggcggtcaattggtacttgtgagcagcagtgagatttggggtgtgtggatggggttgggtaataactaa

SEQ ID NO: 86718 - DNA, 438 bp, Glycine max
  Peptide Sequence Number=SeqID_178403
atgaaacaaaaaattgagggggcagtgttccaatcatatttgtcactgtttgtcgcattgcatccacaacctaatcaccaacaaaagtttcattcactgacagggggtaatactgaatttgaaagagtaagaaaaagaagtaccaaagtgccattagggggtttggagtcgccagcactggcggggttggaattgtcattattggaggaatcgtatgcttcaactctgagaccaaatcttcctttgggctttaaatttctggaaaagctaattgatgagaccgaacgagatggaaaggacacgagagaaatcgaagaggacgaagtggaagttgaagaagaagaaactaaattagctatgacggagacagagaggtttcagacttggcctttgaagtggagcggcattcttcacagggatgatgaggttcacacgtga

SEQ ID NO: 86719 - DNA, 420 bp, Glycine max
  Peptide Sequence Number=SeqID_178404
atggccagaacacgaggtttaggtcgtgccataggtagatttgtaggcagagatagagctgctggcgaggatgctggcgatgttcccgagaggcgtaggcctactgcctcagcccgtaggctacgcgttcatcagatgactacggagggacgtgatatggctgaggacgtcgctgacatgactgatgatgtccctgagcagcctacggaggcacctgagatgcgtgcggacgcacaaggtgctgatagtggtgaggggtcagatggtgatgatgctgcagagggattccctggtggtccacgtgacccgtcagtgctcacatcatttgccgagcatgttgcacatgccgtgtggagtggacaggaacgtcctgatttgaagttagtgtcacatgggaggaagctgagtgggatcctctag

SEQ ID NO: 86720 - DNA, 1809 bp, Glycine max
  Peptide Sequence Number=SeqID_178405
atgaagaaactcgaaagtttttcaagcattcatcagttagatgtttgctgtcaccaagatatgccagcagttgttggcactctctttacacatcatcagaaatgtgtgatagtggatactcaagcacacggtaataatcggaagataactgcatttataggtggtctagatctttgtgatggccggtatgatacacccgagcatagaattttacgtgatatcgacactgtttatcaggacgattatcataatcccacgttttgtgcgggaaccaagggtccaaggcaaccatggcatgatttacattgcaaaattgaaggccctgctgcatatgatatactcactaattttgagcagcgctggagaaaagccaccaaatggtctgagttgggtcggaaactcaagagagtatctcactggaacgatgattctttgatcaagttagaacgcatcttttggattcttagtccttcggaatcaactccagttgatgatcctgaactatgggtttcgaaggaagacgatcctgaaaattggcatgttcaggtttttcgatccatagattctggttctttgaaaggattccctaaggatgtagttgttgccgagactcagaaccttgtttgtgcaaaaaatttggtcatagacaagagtattcaaacagcatatatacatgcgatcagatctgctcaacattttatttatatcgagaatcaatattttattggatcatcctttgcttggccagcttacaaagaagcaggttttggcagaatattgatgcttactcatagtaagagcgttggtgttcataaggttcggggatcctttcgctgcacaagatcggaaccaacaggttgtcgtatcttgggagaggagcgcaatcaaattttcccacgagtgcaatggggcgtttttttctctaaggatagcatttacgcgcttcaacccaggctatatctttctttccttaatttatttttttcgtgtgcttattgtgctgataacctaattcctgtggagttggcactgaagatagtcagtaagataagatcgaaggagagattcacagtttatattgtcatcccaatgtggcctgaaggttccccttcttctacttcagtgcaagagatactcttttggcagggacaaacaatgaaaatgatgtatgaaatcatagctctggagttaaaatctatgcagcttgatagtcatccacaagattacctcaatttttactgtcttggaaaccgagagcagttgacaactgaagtttcaagttcaagtaattcaccttcagataatggcgaaacggtttcagcctcacaaaagttccgacggtttatgatttatgtacatgccaaaggaatgattgtggatgatgaatatgtaattcttgggtctgccaatataaatcaacgatctttggctggatccagagatactgagatagcaatgggtgcacatcaaccgcatcatacatggagtcagaaaaagaggcatccacatggtcaggtatatgggtatagaatgtctttgtgggcagaacacatggaaaccatagaagcttgcttcaaggagcctgaaagcttggagtgtgtgaaaagtgtgaacaagattgctgaagacaactggaagaagtacacagctgatgactatactccattgcaagggcacataatgaagtatcccgtgtgtgtaaatgcctatgggaaggtaaagtccttaactggatttgagtctttcccagatgttggtggcaaggtgcttggctcccggtctacccttcctgacgctctaactacatag

SEQ ID NO: 86721 - DNA, 1935 bp, Glycine max
  Peptide Sequence Number=SeqID_178406
atgggctgcaacacctcgagacttgaccggctaccggcggtggccctgtgccgtgaccgttgcaagttcgtggacgaagcgcttcggcaaagctacgccctcgctgacgcccacgtggcacacatggaggccctgaaaacactaggacccgctctcctctgtttcttcgacggtttcgacgattccgacgaaactagtgttcgaattaaggaaaccaaagtccctgtcgccacgaaatctccaccccctcgctccccttcttcccttagttcggactcagacgatgcaaacgttcttttgcattccgaatcagaaaccgaagacgcggaaaaagaagagttccaattgttcactcgcgcgcgttatgattacgcgcactcggctcgttaccctccgttttctccgccgcgtggctattccggctcgaagccgccgtctccgccgcctccttccggctccgcctgggatttccttaacttcttcgagccgtacgagaagtaccacgtgccgtattttcctagcggcggtgatgctgacggggcagagaaggacaaggggaaggttgagaaacgtgacgagtttaaatccaagggagaaaatgaagaagtgaagaaaaagaagggtgattcgaaggaaaagaaagtggtttcggagaaagaggaagttgtttcagtttcagagcaatgtagtgactctgcgagagtgaagtcagggaaaggtttctccgaggcaatgaaagagattcaggttctgtttgagaaagcatcggagtcggggaaccccgttttggaaatgctggacgttgggaaactccgttaccatcgaaaatttgacctcaatccggaatcctcgttgcttgggcggagaatgggttctgggtatgaaggagacaagggtcatagttacggtaatctctgctctactctgaaaaaactatgtatgtgggagaagaagctgtatcatgaagtcaaggccgaggagaaattgcgcatgcttcatcagaaaaagtgtaagcagttgagacgtatgaaacaaaaggatgccaatgcacagaaaattgattctgttcaaacttttgttgggattttatctacaaaaatgaaaatttctatacaagtagttgacaagatatccattacaattagtaagttgagggaagaggagctgtggccgcagatcaacagattttttctcaagtttctcggaatgtggaaagacatgcaagaatgttacaaatgccaataccagcaaattgttgaagccaaaactttagatgcctcatcgttaaacacaaagcctggcaatgctcatattgatgcaacaataaaactcaaatctgaggtacagaaatggaatttgagcttcttagattggattcacgcccagaagtctcatgtgaaagccttgaatggttggctagtaagatgtctattatacgaacccgaagaagtacccgatgattcaactcccttctcacctagcaagattggggcaccacctgtgtttgtgatctgtcacaaatggtcgcaggcagtggataatctctcagagaagaatataatcgaagccgtaaatgggttcatgctaagagtgaatgagctctgggaaaagtatattttagaccttcaacaaaaactaacattggacaaagaatttgagagaaaggtaaaaatgttggagagggaagagcaaaagatgcacaaagtgatgcgggctcatgagaaaaagatggttacagttggcagagaagaatctgatgcactgttacgtggagatgctgtgcaccatgctgatgtcgttgacactactaacctacaatcaggtttgaagcagatctttggtgccatggagaagttcactgactccactgttcgcttatatgaagaactttgccaacaaattaagcaagaggagaaaccaacaaaaattaactag

SEQ ID NO: 86722 - DNA, 468 bp, Glycine max
  Peptide Sequence Number=SeqID_178407
atgtcaaccataaacaaggaccatatcgtcgatgaatcgaaccgttcagaaaccaaactagtcgaagaggaagaggaagaggaagacttacagaagcttctagtccctgacgtgcagaatcttcctctgatccctccttccgccgttgaaaccaactttgccacttacttcgccctagattttatgaagccagctcacgatcagtacgtttaccgccacgccaatggcttgtgcgtgattgggttggctccttcccacgttgctttcaaggatgaaggtggaatcacagccgttgatttcaatgttggaaagtctgatcgcagcgggatgaaagtcactggaaagcggaagaaggcttacagagaaggatacattgctattatcatgccaaaacctgctgattggctcaaggtcaaggcttccctagttagccttcaggagtacaagaaattgagggaagtcaattga

SEQ ID NO: 86723 - DNA, 726 bp, Glycine max
  Peptide Sequence Number=SeqID_178408
atgaagagcaaaatcttgaaggcactgccaaaagcagtttcagcagtcacggtgacatttcaaaaccatccattcagcccaggcagggaccacaaatcaaagcctatcgtatccatgattccccatgaagctagaagaaaaacccatgatagaggcaataataacgacattgatgaaatttattctcaagaacccacttcaccgaaaatctcctgcatgggacagatcaagcacaagaagaaacaaatcgaaaaatcaaagtccaagagcaagtccatgacaaaagaagcgaggaatgttgctagcaaacaaacatcctcagcttccagagacatagagccaaagtctgatggaaggaaatccaacgcttctgcgcctggagatattaacaaggatcgtgctcttgctgacgcagcacgtgcaccgcgcgtgagtcagatgagaaggttttcaagtggacgtgacgctcttggtgattttgattggaaggtggctcaggtggcgccagatgaagaggaaattgattactattcggatcattacagagtggatagtgatggcgatgaagaggaacagattattatccctttttctgcaccccttttggttggtgttggagttggtcatgggggtgtgcttaatttgaagccacgaatagaaattaacctgtggaagagaagaaccatggctccacctaggcctcttcaattggacagagcaaactga

SEQ ID NO: 86724 - DNA, 135 bp, Glycine max
  Peptide Sequence Number=SeqID_178409
atgtgggagttcgcgtcgcaaaggaagctagagaaggaccagtggctagatatttcattggcatttgttggcttgatgtctcatgagtcccatcacatcttcccctggaaacttgaaatggattctgccgtttag

SEQ ID NO: 86725 - DNA, 651 bp, Glycine max
  Peptide Sequence Number=SeqID_178410
atggattctttaatggcttctcctctaccccttggtattcttgttctacgttgtttcatgttactgttaatggtttcttgcaaagcgaagggtttggtggaacttccaccaaatgttacggttccagcagtgttggtgttcggagattcaataatggatacggggaacaacaacaacaacatgcaaactcttgctaagtgcaacttcccaccatatgggagagatttcgaaggaggcatcccaactggtcgatttggtaatggaaaggttccatcagaccttgtagctgaagaattgggcattaaggaacttctgccagcatatttggatccaaatcttcaacccagcgatctcgtcactggtgtctgctttgcatccggtggttcagggtacgatcctctcacatctaaactagcgtcagctatatcgttgaccggtcaaatagacttgttcaaagaatacataagaaaactaaaaggactcgttggagaggacaaaacaaacttcatcctagccaatggtattgttcttgttgtggaaggcagcaacgacatttccaacacatactttttgagtcatgctagagaagtagaatatgatattcctgcttacactgacttaatggtcaagtcagcttctaatttcttaaag

SEQ ID NO: 86726 - DNA, 522 bp, Glycine max
  Peptide Sequence Number=SeqID_178411
atgagaggggtgaagagagcaatgtttgtaggcagagccctgagaagcaattccaacagcggcgtgtctccccatggccatggctgcttgaccccatcaaatccaaatccaaatccaaatccttctgtttctgttactgggtttagatacctttctgcttatgctgctgccacgtctcttgtccaagacgctctgaccaaggccttcaaacccaaagaacttgcctctttcaatactaggcctgtaaatcccatcaacaagaaggagatcaagtggtccgactacaagaaggtgcctatcctcaccgttgatggtcaacaaatggtcgactcttcagacataattgataaattgatcaaaaggatacatccagattatgacctaaatgcacaagaagagaacaaacccatccaccatctcaagtcaggtagagatataatagagcacgccctgattgggaaatggttttctgagatggatcttgcagtaggacagtcttctagggtgagtgagcatagctag

SEQ ID NO: 86727 - DNA, 198 bp, Glycine max
  Peptide Sequence Number=SeqID_178412
atggcgactgaagtgaaaacacattctggagagagggggaggggtgcagaggtgtcccgcccttggagatggcgggataggagagagggggtggtcccgcccttggagctggcgggacaggtgagagagggcggtaccgccactggcggttgcgggacagggggagagaggatcccgcctttcgagctggcgggatag

SEQ ID NO: 86728 - DNA, 1000 bp, Glycine max
  Peptide Sequence Number=SeqID_178413
gattcctgaacacaagggatgggttgtccctgtgtggttcagactttgtaatggattttacaaagatagtggaaatctcaagtggcctatccctcttaagattattgaggccacaagatccaacacaggctacgaaacatttcatgcacagtcatcatctgagcccagcgttggccagtttgatgaagaggagcccattcttgttacttcctgtatgcagttagattctgaaaactcagatagggaagttttgtccttgtcaaaaccagagcatcagagtgctttgcaggaatcatttcatgcacgctcatcgtctgaggctacacttgaccagtccgatgaagagcctactctggatacttcctgttcacggttggattctgaaaaatcagatagggaaatttcaacttccttgtcaaaagtagagggtcataatgctttagaggttgaggctgggagcaagatacaaagtgaatcatttcatgcacactcattctctgaggccacacttgaccagtccgaagaagagcctacacttagtacttcctgtacacagttagattctgaaaaatcatatggggaaatttcaacatccttgttaaaagcagagtatcataatgcttttggggttgaggctgggagcaagataccaaatgaatcgttcgtttcgtcatcattaacaaaagatgacattttggatcctttgtctccccaagatgtttcatctactaaaacacgtaaccttgtgggtgattcacgtggtaagattggtgtcgatagctcccgcaaacctcctaagccaaaaaggacactcgtgccttcttcatccatgttatcaagggatttgagtacctttgatctctgtgacgaatctgagaaattaaaggggaatcggggcacaaggaagttacctgcacctgatcctaagagatcaaatggtagcatctctctgctccacttgctgcaaagtagaaaaagtaatcttcatcgactagcttag

SEQ ID NO: 86729 - DNA, 162 bp, Glycine max
  Peptide Sequence Number=SeqID_178414
atgtcgtccatatccaatcaaccacatttgtaccctagcatgagccatgcttgtagggctgacagccaacgtttatacaagatatacgcaagtgaggaatttgtcacgattgcacactacaaaagcttgctgttaggaaatagcaatcttgatacaaattaa

SEQ ID NO: 86730 - DNA, 843 bp, Glycine max
  Peptide Sequence Number=SeqID_178415
atggtctttgctcctggattttgtccaatgcagtcggatgacttgcccaaaatgttggtccaacaccaacagtaccaagagcatccacccaccgccttcgccctcaaacataacagaattctagtgaagtggacgcgaagaaacgaagcttccaatcttatatctaaaccctctcctttgtccaatccatctcattcttctctccctctctctcacattcactaccagccagctatccttgttcgctgtttccactttggaagaaacacaaacatgaacatggaagatggtgtcatgctggtcagaaaggccgagatagacacaagggcgccattccggtctgtcaaagaggctgtctcgttgtttggtgagaaagttttggccggggaagtttatgcaagtgctaacaagctcaaaaagatacagagtggagcaaatgaaaacggcgttgaattttcgagaattgaaagcgttgaagccgagttagatgagacgcgggaaaacctgcagagggcaaaggaagaaagcatggaagagctagaacgtacgaagcaagagctccgacaattgaagcaacgggaaacacagaagcacccagaggaatctgaaatcgaagatgtaaagtttgtggagaacttaacgacgtttggagtgaaaagttcgagattcgacgaggataagatggagttccaaaagaaaaggtgcgtgacgttcgcgaacccgcaacacggggttgaaaagttggaaaggcacccttctctcaggaagaagaacaagaagtcgctcattcctttcattggagccatcttttcaaggaaaaagggaacccaagaaattccatga

SEQ ID NO: 86731 - DNA, 152 bp, Glycine max
  Peptide Sequence Number=SeqID_178416
atggagatggagatgaggccacccatgggtaaaagtaaaacacccctctctagtctctacaacagggattactttgcaaaacactacaagttcctccttcatgtgacgatggagattattgacccaaacagaccacgaggaacgcgttccat

SEQ ID NO: 86732 - DNA, 1441 bp, Glycine max
  Peptide Sequence Number=SeqID_178417
atgggggaaaggatggagtgcactgctgaagcttcagtaccaaatcttgaacttgtagagcttaaaaacagaagcctaacactttcattctacatccacttgctctctttcttgctcatcaaaatcgtgaatgacaatttgattttcttccatgctttgtcttgtgcagaaattgagtcatcacctgttcgctgtcttgtgtctgatgtaaaacatactgcttgtggcggtgacttcactgtctggttatcttccgttgaaggagcttctatactgtatggtttctggataaagattgcattcagttttcttgattctcggactgctgggcttccacagtatgggcagcttgggcatggaacagataatgagccacgtcctcgagcaattgctgctcttgctggggaaacaattgttaaagtggcatgtggaacaaatcacacagtggctgtggataagaatggctttgtctacacgtggggttttggtggttatggaaggctaggacatagggagcagaaggatgagtgggtcccacgccgtgttgaagtttttcaaaatagaaatgttttgccgcctgattcagtcatatcagctggttctgtgaattcttcatgtactgcaggtggagggcagttgtatatgtggggaaaattaaagaacactggtgatgactggatgtatccgaagcctctaatggatttaaggttgtatacttgtactttattccatggcaatatgcaccattttgttggggctgattcctcttgcataagttggggacttgctcagaatggagagctgggatatggacctactggacagaagtcttcagctgtacccaagaaggtggatttacttgagggtatgcatgtaataagtgttgcttgtggtatgggtcattccatggttattgttgatagagcaaatgttgctgatcgacttgaccagcttgatatatatgatgggaaagctgttggtgaaggtaatgaggccgtaaacacaactccagtgcctaagcaggctgcgaaaaagggtgcaaaaggagctgctgacaattcgaagaagaggaaacaattgaaagattcatctgagtcagaggaggaagaggatgctgaagaaagtgaggatagtgaggatgaaattaatggtgaggttgaggcaaaaaggcctcgtagttctggtaaaggccgaggtaaggctccgaaaaaggcgggggccaagggaaaaggcgctaaggaaaaaggttctggccgtggacggggtgggactgctgcaaataaaagcagttctaaatctcctcaggtgaaaactgttgggtatatcgttcttaacacatgcacatgtgacactgcacagagtggtgaaagctcactagcgattcagaacggaagcgtgagggatgagaagggatccaaattccaaaagcattctgtgacct

SEQ ID NO: 86733 - DNA, 1584 bp, Glycine max
  Peptide Sequence Number=SeqID_178418
atggcacttcctaagtccaacgccaaactcactcttgttcttctttttcttgttttcattattaattcaggaagcgcccacaattacaaggaggcattgtccaaggcaatcctattcttcgagggccaacgttcgggtttcttgccgcaggaccagagacagacctggcgcgccaattcggctcttggtgacggctggacctacaagctcgacctcaccggcggctactacgacgccggcgacaacatcaaattcgggtttccgatggcattcaccaccacaatgctgtcctggagcgtcatcgaattcggagacatgatgcctcccaatgaacaccgaaacgcgctgctcgcaatccgttgggctaccgattatttgctcaaaaccgtttctcagccaaaccgcattttcgttcagaatgcgaaatttcatttattttccatttggattcctaatccagacgaatacatcaccgacgcgccaaggatggcagtgggtgatccaatctctgaccacaattgttgggaaaggcctgaggacatggacacaaacaggacagtgtatgctgttgatgctccaaacccagcttcagatgtagctggtgaaactgctgcggcactagctgctgcatcaatggcttttcgttcatcggatccttcttattcagagactttgctacgaaatgctgctaaggcctttcaatttgcagatacctataggggtgcctacagtgacaatgctaatgttaggagtggtgtttgcccatattattgtgacttcgatggttatcagatagacctaaaggaagtgtacaaggacgaattgttatggggagccgcatggctaaggagggctactcaggatgaaaatttcctcaactacattcaaagcaatggcaaaacccttggtgctgaagacaatataaatgagttcggttgggacaacaagcatgctggccttaatgttcttgtctccaaggaagttctagatggaaacgtaatgtctcttgaatcctacaagacttcagcagagagctttctgtgcacgctcatacccgaaacatcaagttcacatatagagtacactcccggtggactaatatacaggcctgggggcagcaacttgcaacatgcaacttcaattgcattccttgaattggtttacgccaattacctatctcgcacttcacaaaccatcaattgtgggaacgtctatgttaacgcacaaacacttcgccagcatgctaagaagcaagttgattacattttgggagataacccaatgggtatgtcgtacatggttggttacagcaacaagtatccgcagcatattcaccaccgtggctcctctttaccctctatcaaggaccatcctcaattcattgcctgcaaagaaggttcaatctacttcaactcaagcaatcctaatcctaatgttctcgtgggagctattgtgggaggaccaggtgaagatgatgtgtatgaggatgatagggctgattttaggaagtccgaaccaaccacatacattaatgcaccatttgttgggattttagcatactttgttgctaatcccaacccttga

SEQ ID NO: 86734 - DNA, 192 bp, Glycine max
  Peptide Sequence Number=SeqID_178419
atggtgataaaaaaatggtgcttcaattctgagcgggtttctcattgtggggttctggagttcattgcagatgaagggactatatatatgccatactgggtaggaccagaggaactgaaacattatgaatacctggttaccagtagaatggttgtccaagtttctagtttcttgatgcatgctagtttttaa

SEQ ID NO: 86735 - DNA, 255 bp, Glycine max
  Peptide Sequence Number=SeqID_178420
atggcaaaggcaaacaacctccaagtcaaaccctgcacgacgtcgtatcaaatttggaccagaccgtcccaacattgggccttttctcatttttcactctgggcttttcatctaattgtgcctagtataactggtttgaaagaagtgaaatcatatactaggcatttgaaagtccaagtacccaaggaagaagtattgttcattttgggacttgatggcccggttttgccaatagaagatgccttggtgggttga

SEQ ID NO: 86736 - DNA, 1893 bp, Glycine max
  Peptide Sequence Number=SeqID_178421
atggaggaaagctcctcaaccttgtcgcgtactcatagacacgctgcggcttctctgtttgctctcgcatttcaccgctctcaaattcatcaaattcgcatctctggaactgcttctgtttcaaataaccccgagctttggattaagcacaattctgatttgctttgcccaatttttaggttccttggagtggatgatcagtcctggcatggcctagaggcaactgccacttcctcttcccaactcgggcatcaccttggatctttcttgcaattgctgtcagaggaaggtgatgctactactcctgaaggattggataaagaatccgcgttgagcaaagccattgatgcctcggctatgagcatgaacgatactactcctattgccgattctccaagtggtgaccatggactcaacactagaagccaagatgatgtatgtgaaattatggagacctcagctttgctgcctctaaagaaacaaccttctaatacactagaaattgcaaggtttgaacaacctttggcggaggcgaaccttatcggttacgagaagaaaatggcagttctttacgcacttgttgcagcttgtgtagcagatactgacaagtcaaggcagggctatgatgctcgtcaccgtgtggctctgcggttgcttgctgtatggcttgatgtcaaatggaatgaaatggaagcaatggagtctatggttgctttttctgtaatgaattctgtgaataaaaaaggtgccaaggaagaagaatctgtaggttcagaaaccagctgggataaatggaagcgtggaggtatcataggagcagctgctgtaactggaggaaccttaatggctataactggtggcttggctgccccggcaattgctcatggattgggtgctttggctcctacactaggcggcattgttcctgccattggtggtggatttgctgctgcagcaaccgctacaggatctgctgttggatctgtggctgttgctgcatcatttggagctgctggagctggccttactgggagtaagatggctacaagaattggaagtcttgaggaatttgagttaaaaggtgttggaggcattaatgaaggccacctagcagttagaatctccatttctgggcttgcatttaaggagaaagatttcatagaaccttgggaaggtctcaatgataacatggagaggtacgtgctccaatacgagtctaaaaatttgattgcactgagcacagccatccaggactggcttacttcactaattgcaatccagttgatgaaagacggtgccatgctgacagtattaagctcacttctgacagctctagcatggccagcaactttagttgcttcattcgatattattgacagtaaatgggcaattgcagtggacagatcagacagggctggtaaggtgcttgctgaagtgttgttgcacggcttgcaaggaaacaggcctgtgacactagtaggtttttcattgggagcccgtgttattttcaagtgtctccaatgtttgtctgaatccaaaggagacaatgctggaatagtggaaagggttgttttccttggagctcccatctcaattggagaggaaaattgggaggcagctagaaagatggtggctggaaggtttgtgaatgcttactcttccaatgattggacgttaggcataactttccgtgccagtttactctctcatggattagctggaatccaacctgttgatgttcctggggttgagaatgttgatgtgacacaacttatagaaggtcactcttcctacttgcggatgacacaaaaaatactggagcagcttgaattggacaactgttgtgctgttttcaaaagtggacaagaaaatccacaggaagaaaagagttag

SEQ ID NO: 86737 - DNA, 1323 bp, Glycine max
  Peptide Sequence Number=SeqID_178422
atgggaatgtcacgtgctcaggctcatcgcaacgatcgtcacgtgtttttttgcggagatggtcgacggagaggacgccggcgatgctgctacggtggtgaggcggacggaaacggaaggagtaagagaggaggaagtgggactggttatgttcaagagcatgttaacattggctctgatcctcctggctccaaagtgagatggttccgttcatccaaatcattgctgttgatcaacatggatggggtggatcaagcagacctgatttcacatgcaaaagcacaggcatggttcattgattcttttgatgaatggagaaaagccaaaaacttgagcaattttatactacttggacattcttttggtggttatgttgctgccaaatatgcgctcaagcaccctcagcatgtacaacacttgattctggttggatctgctggattttcatcagaatcagatgcaaagtctgagtggattacaaggttttcaacaacatggaagggaacagttttgaaccatctacgggaatcaaatttcacacctcagaaacttgtcaggggtttaggtccttggggtcccaacattgtccccaagtatacaagtactaggtttggtacacattcaactggggaaatactgactgaagaggaatcagcattgctgattgatatatgggataaatgtgcccaccactttcatatatggtttccaagactggatgaattatcaaggtgcccaagaagctcgcaagcatatgaaggttccatgcgaaatcatcagggttcctcagggtgggcactttgcgttcttgacaatccaactgccttccattcagctgttttttatgcttgtggaaggtttcttacacctgatccagacaatgaatctcttcctcaaagggctaacctctgcatagagccctttggcagcgacgagaatgacgaagatgaggaggaggaaggggtggttgagatttgtgtccctgaccgtggcaacacacacaacagaaagggagaagagagtgcgtggtgcttgttaacgggaaggtgggaagttgtcatgggaaggggaggcaacgtggtttctgctgttggtggaggcggcgtggtttctgctgttggtggtggcttagcagaggaagaagttgggttgtttgtcttgggaagcagaggcggcatgggtggtgacttcgctgaggcagaagatggagagcgttgtttaggtaccatggtattcaatatccgaataatggtatcaagtttggaagtaatggaagtttggtctgcagcaatggaagtttggtctgcagcaatggaagtttga

SEQ ID NO: 86738 - DNA, 2095 bp, Glycine max
  Peptide Sequence Number=SeqID_178423
atgggagctctcgcttcattcgccccttggatttccgaggacgaccttcttctcaagaactccgttgagacaagtgcaatattcttgttcaaggctggtgcttcattagaatcgcttgcgaaaggtgcagtgcagttttctcgaaaatatagtattaaagagatacaggatcgatggtattctctcctctatgatcctgtcatttctgcagaagctgcggcgaatatgacaaacttagagctttcagctttgcctctcccatcaaagttctataggtttggacattccaaagaacggaaagttgtttctgctacaagaaagtctgacagtgttcgcaatttgtattatgctaggcgcaaaagaatccgcaatagcatgttaacttccatggacttaagttttctagttgattcagaaaatggtaattatgcagcgcatggaagtgatcctttatctggaaactgcatgcctgaaggtggaacttcaaatcatttttcaagtcttgatccttctcagtatgcttttcctgaaaatgtgatggatgataatgttgcttctgatagagttgctgctggtgtgttttgccatggagttgacaaggcagttgcagagaatttccctgccaagctaaagagtgtacttaaggaagaacctcagatttttgaaggcaatatgcctttggatggagttgttgaggatttggatgttcctaatgaattggctatagatgggtggattggagatgatggtttagagagaatgcctttgtccgcattgaatcatatcaacaatgaccctggaaatatgtgtcctgagtttgatgaaaacaatgtatttgattcagagttagagtgtggaacatcatttaacttatcttctcgtcctgaaatgtcagtctggggaacagatgagagcattcaagaacatgatttgccatgtgatggttttagtgatcctattgcttgtggggatgcttatttggaagaactgtccaattctctcctccacttcagtagtgaggaagaacaaattctgatggatgttgatggagaagaagggattgaaaaatcttactttggtggcctgacttcactcctacaaaattctacaaatgatgttaattcagatcagatttctgaaaaggatgaaacagagtcactaatggcctcacaggcacatgttataaatcagtcagtttcatgtcacaaagaattggatgacaacctagggtcaagctctagtggtttacaagtagttcccaaattagagttccaaatgtcatcttctgtcgcggctacagacccccaatttcctgatctaattaatgaaagtatgtcctgttcaataaacaccgagcaccaagaaattccagaaaatgatgacgtttttctaccatttgatgtgcctcctgtcatatttcccccttcatcaaaattaatttttaaagtatccaataaaccaatttcttcatctgttattaagcatagagatagtgaaagaggtaaaactttgatgcatgtagaaaagaaagactctgtagaatctcatgcatcttttcagatgatggaatctccttgcttcccaggacctgttggtggttctaaggtagaatgtgagttgcctgctaatcatgcaccacacacagtgtctaggagttctgttactgtttctggtggcttaggtggaaatgaagctgcaaacacaacagatgcttttttgcatgctaataaaaaggaagaagctaccaacgttggcttggcaaaggatccaaacaatcatgtggcaaattctttcatgaagaaatcagctgttgattctaaagacttcagaaatcatccccaacctaatggttttagcatgaagactgaacaagatttagccttgccacttcaagattaccagttgcaacgtgctgaactgggatcctcagatgttcttgagtcagagctggtagcaaatcctccaacattagatgaggaagagcaatatatagagagtgatgaggagcttccttcttattctgacgtagaggcaatgttacttgatatggacctggatcctgatgatcaccaggattcgtattataatgaggaag

SEQ ID NO: 86739 - DNA, 516 bp, Glycine max
  Peptide Sequence Number=SeqID_178424
atggcaacccaagctttacgacccgagattgagcttgtggttgacgacacgaccacctccaacgttattagccacagcaatcacgaaccaacctcgttgatggtcgcaaagcgctccttaacgtccctaaattctatactaacaaaattccatgcaggttacttcagaataagcctctccctcggtggccaagctttgtggtggaagacactgatcgaatcaccaacacacgacgtcacaagcgctctacgacgcttgctttgcacgcttccttcctcagcttttcttgcactgtggatggtaaaggcggatttcttgcaccctgtacgagttaactacctcttcgctccgtggatttcatggcttctgttgcttcaatcagcgccattcgtggcgccgaaaacaccgacgtatttggttatgtggtgggtgttcgcggtgccggtggtggtgctggacgtgaaattctacgggcaggtggttcacgaaagtgaagaggctttttatcgacggtag

SEQ ID NO: 86740 - DNA, 345 bp, Glycine max
  Peptide Sequence Number=SeqID_178425
atggggagttgctacgtgcacccagcattattgctggggcacccagcaaacagtgaagtggcgaaactgcccttcagcaattattcttccggaagaaggttcttccggaagaataatttgtgtcttccggaaaaactcacagacaatttccggaagaacgtcatccggaatgtttccggaagaagcttcttccggaagaattccagtgtcttccggaagaagcttcttccggaagctgtgttttactgcgctttctttctttcttcttccgtttgctttgtttcttcttccgtttgctgttgtttcggtggtggtcccttcagcagtctgttggtggtccagtga

SEQ ID NO: 86741 - DNA, 759 bp, Glycine max
  Peptide Sequence Number=SeqID_178426
atggcacgtaggctacggttgtttaaggaacaaatgacgaaagcaggtgtatcgccctcaacgtggtcaacaagagacaatcattttgatctggaacatttggaggttaaacttgaagaacttgaagctgagctcctcgagattaatgcaaataatgaaaagttacaacacacttacaatgagctattagagtataagcttgttctggagaaggttggagagtttttctcttcagcaaaaaataaggctgtagctcagcagaaagagcttgaatttcagacaactgttgaagggtctattgacagtccattattattggaacaagaggagacgacaacaaagcaaattaagctgaggtttattagtggacttgttcatagggaaaaatcaattcctttcgaaagaattatatttcgtgctactaggggaaatgtgtttctcaaacaggctgtgattcaacatcctgttcttgatcctttgtcaggagagaaggttcataaaaatgtatttgttgtcttttattctggagaaagagttaaaagcaaaattctgaaaatatgtgatgcttttggagcaaatcgttatcctttctcagatgacttgagtaaacaatttcagacgataagggaggtatacgtaatttttccttttaggttcttgattagctttaagttgttgttaagcgctaaatgcttcagattgctgcatcttgagaatttcttgtcgaatattaaaaagaactacatatttgatatgtag

SEQ ID NO: 86742 - DNA, 1053 bp, Glycine max
  Peptide Sequence Number=SeqID_178427
atggctgactcagcctcagcctcagcctcttcttccagaatgtggtgctccatccccgaaaggtttcagctgcatgcggccatgttggccctgcagtttggctatgccggcttccatgttgtctcaagagctgcccttaacatgggcattagcaaacttgttttcccagtctaccgcaacattatcgcttttctcttgctcgttccttttgcctacttcttggaaaagaaggagagacctgccattacattaaacttcctcttacagttctttcttctggctcttgtcgggatcgagcaagtgcggctgaaccgaaaggatgggatatcgaaggtggcgggaacgatattctgtgtggctggggcaacggtgattacactatacaagggtccaacaatatatagcccaactccacctctacacagtgagagaccagcagtagttgactttggaacactctcactgggagatgcaaaggggaaaaactggacccttgggtgcctctacctcatagggcattgcttgtcctggtctgcttggcttgtgctccaagcacctgtactcaagaagtacccagctcgtctctccgtcacttcctatacatgtttctttggactcatccaattccttgtcatcgctctcatcgttgaaagggatgcccaggcttggattttccaatctggtggagaagttttcactattttatatgcgggagtggtggcatctggaatagccttcgctgtacagatatggtgcattgacagaggtggccctgtgttcgttgccgtgtatcagcctgttcaaactcttgttgtcgctattatggcttccattgctttaggcgaagagttctacttgggagggatcataggagcagtgttgatcgttgtgggactgtactttgtcttgtggggtaaaagcgaagagagaaagtttgcaaaggaacatgctgctattacgtccaccccagagcacagtggcatcaggtcctcaagccatgccaaaacatcactcactcagccacttctcccttcatctacggagaatgtctga

SEQ ID NO: 86743 - DNA, 744 bp, Glycine max
  Peptide Sequence Number=SeqID_178428
gttataggaaaactgagcgaggggaaggcatctcatgttccgtatcgagattcaaagctaacccgcctcctgcaatcttctcttagtgggcatggccatgtttcacttatatgcacagtaactccagcatccagtaacacggaggaaactcataataccttgaagtttgccagcagggcaaaacgagttgaaatatatgcgtcacgtaataagattattgatgagaaatctctaattaagaaataccagagagaaatttcagtcctcaaagtagaacttgatcaactaaagaaggggatgctagttggtgtcaatcatgaggagattttgaccttaaagcaaaagttagaagaaggtcaagtgaaaatgcaatcaagattggaagaagaggaggaagccaaggctgctcttatgagtaggatccagaggctaaccaaactcattctggtttcctcaaagaatgcaattcctggatatctaactgatgttcccaaccatcagcgaagtcactctgttggcgaggatgatattgaaaatgagagtcagaaagattcttctgcagtgtcatcagatcagtttcatgatggtagacataaaagatcatctagtagatggaatgaagagttctccccagctagcagtactgttactgaatcaacacaagctggtgaactgataagtagaacaaaattgacagtggtaaaccatcatcccttctccatcacaaaatctgttatctgttaa

SEQ ID NO: 86744 - DNA, 273 bp, Glycine max
  Peptide Sequence Number=SeqID_178429
atgattctgactcgtgtgatgttccatcctgcttgtatagacatgactgtggaagaagccaaaagacttgaccacttcttttgtgaaagttgctctgctgaaggtcaaaaaaagttgcaaaactctcattctgcttctagacactcagatacaaaggtggatactaaacgccgtcgtaggggccagacaaacacagagacaaagttatctagtaaggtaggcaatgatctagagtttctatacaccgataatggcgccgtgttgttggcgtga

SEQ ID NO: 86745 - DNA, 777 bp, Glycine max
  Peptide Sequence Number=SeqID_178430
atgcctttaaccggaagagttgctgcagtcagagtcacaggaacgaaaatattcatgctagtaatgtatgataaggaaaagactgctgcacatctcaaactcaagtatctcaagtatgatgaggagcaagtaggtggtggagcagggccagaaagggttgtgtttagtgatatgtctttgggagtaaaggatcagatgcaaagggtgaggcaaggcgaagaagaagtagcatcagggggttcaaagtgccaagactgtgggaaccaagccaagaaggaatgttcatacttacggtgcaggacttgctgcaagaacaaaggttttcactgccaaacccatatcaagagcacttggactcctgtggatcataggagacgccactttcagggtcagggaggagatcatcatattcctcaaaaccaaaaccagatcaacccatattcaggtttagagttgagatttccggctgctacgaattcgatggctacatttcggtgcattcacgttcgttctatggatgatgcggttaatgaaatagcgtatcaaacatctgtgaacattggagggcatgtatttagtggactactatatgatcaaggccctgagtaccaaagaggtcatcaaggtgagagttccacgggctttgttgataagcagcagaataataataataataatctggatagtagtggtgcaagtgcaactcaccaagagtacccgtttcccctttcttccttcaggcccggtatgccctatttgacatacccaagatcttag

SEQ ID NO: 86746 - DNA, 771 bp, Glycine max
  Peptide Sequence Number=SeqID_178431
atggcacctcacagctcgcctcttgaactcaatcacttcgccgaggtcggtaacaaagttgccgatgctgccggagaaattattcgcaaatacttcaggaaaaacttcgacgttattcacaaacatgatctcagtccagtaaccattgctgatcaatcggctgaggaggctatggtttcaatcatactagacagtttcccttctcatgctatttatggagaggaaaatggttggaggtgtaaagaaaagaatactgattatgtttgggtattagatcccatagacgggacaaagagctttattactggaaaacccgtatttggtagtctcgttgctcttctacaaaatggcaccccaattcttggcataattgatcaacctgtgttacgagaaaggtggatcgggataactggaaagagaactacactgaacggacaagaaatatctacacgcacttgtgcggacctttctcaagcatacttgtataccacaagcccacatctgttcagtggagatgcagaaaaggcattcatccgtgttagaagcaaggttaaaattcccttatatggttgtgactgctatgcatatgctcttttgtcttctggttttgtggatcttgttgttgagtctggtctgaagccatacgattttcttgcactgatacctgttattgaaggcgctggaggtgtcataactgattggaaaggagataaactgttttgggaggtttctccactttcaatcccaacatgtatggcgcctttgctctag

SEQ ID NO: 86747 - DNA, 240 bp, Glycine max
  Peptide Sequence Number=SeqID_178432
atggaagagatgcttctaagagctaatgtaagagattatggaagatttgatcctccaccacgtctcgttcgaccccctggtatccctggtggaagtgatgcaaagaagccgccgccggacgcccttaggcaagagaattggtttcaacacgatacaagaaaggcttacgagacatttggcaacggcttcttcatggttacgtttgatcacgatgatgataggatgaaggcccttggctaa

SEQ ID NO: 86748 - DNA, 735 bp, Glycine max
  Peptide Sequence Number=SeqID_178433
atggtgaacctggtggcagcacagaggccattgttacatggcctcatgaagatggcaggggtgaggccctacacggtggagattgagcccgggaccgtgatgagtttctgggtcccttctgaaacacttacgaagccgaagaaaaaaaacgagaagcccagaatcagctcgaagcccagcaggcccgcggtggttctggtgcacggctttggcgccgagggaatcatgacatggcagtatcaagttggcgccttgacaaaaaaatacgcagtctacgttcctgacctcctcttcttcgggggctccaccaccgacaaaccccaccggtcgccggcgtttcaggcgcagtgtgtggtggcggggttgaggaagctcggggtggagaagtgcatagtggttgggtacagttatggggggatggtggcgtttaagatggctgagatgtacccagaagtggttgaagcgttggttatcacagggtccattttggccatgacggactccatcagcgccacctcactgcaagagctagggttttcttcttcctccgagctcttgttgcctacttctgttaagggtctcaaggcactcttgaccgtggcttcgcacaagaagcagtggtatcccaatcgtttgctcaaagattatctcgaggtatacgtatacttgtgtaacccttactcttggattttcatctttactactacttactccttgtataaaagtacaaattaa

SEQ ID NO: 86749 - DNA, 669 bp, Glycine max
  Peptide Sequence Number=SeqID_178434
atggggatgatagaaaagtttgaagcttctttacaaactttacgaggacccaacgttgatattacaatggaagcacaagaaatccaggtaggtatcggactacttgtgctccaacagctttctggtatcaatggtgtttttttctattctagcaagatatttgcaagtgcaggaatttcttccagcgatgctgctacatttggacttggagctatgcaggttgcaattactgggattgctacttcgttgttagacagaagtggaagaaggatgcttctaatactatcctcctccataatgacacttagtctcctccttgtagctgcggcattctatttggagggtgtggtaacagatgattctaacgttcatgaagtattggcaatgctctctgttatggggcttgtggctttggtcattggattttctctaggcgttggaccaataccctggatcataatgtctgagcaacctgatgatcgatcatgtgcatttcagattcttccaccaaatatcaaaggctttgctggcagtgcagctacctttttgaattggttcactgcatctgtaatcaccatgactgcaaatttgctcttacattggagcagttcaggtcctctctccctctctgtctttatttattcgattgcctgcatgcatgctatttag

SEQ ID NO: 86750 - DNA, 1245 bp, Glycine max
  Peptide Sequence Number=SeqID_178435
atggctgccttccatggctgccactcgctgtacagagcttccatggacgccttccatagctgccactcgccaaaggaagcttccatggctgccgaggaccgccttgaggccgccttggccaaccttgctgcccgctcaacgccgcctcgaatcctcactggatgcctttctcctaagattgcctcggcgactcggccaccactacccttcttcctccctgcaatcaccaccgtcgctgcccttgctgttcaagccaactccgtcacccacgcttaccgcacccacgaccatgccaactccgccgctacccccgctgctcacgaaagccccgtcctcctccgcacaaccacacccacgtcagctccgcctcccttggctgttttccgccatcccaaactcaaaacagtcgcacccatagctccgctgccgcttcctcgctttcatttgaacaaccgccacatccggctcaatcatccattgcctttatcactccgcaccgcccaccgttgttaccgtcacgtccattgtcgcgacatcccttacagcaatgacatcatcctacttgatgatgctgccgtcaagcatcagattcgtccgccgccacacccgccaccacatccaaaatacaccctcaccatgttccgctactctatgttacgccctcaccatggttctttggagttaccaacctcttccctcccactagacacgttctataatcaaccaataatgaaacctttaaccattcttcactcccacatggattcctcaactaatccaccaactcgttttgtcttaatgcaatgggtgggtcttgcgccggaagcgtccacttgggagaaatgggatgatttttgtcactcccatcactttgaggacaaggctcaaatgaaacctcaaagcgtaccgacgtctaccttggttagatggattccactgccaccccaattcgttaaggttaatacaaatggtagttcttttggtaatcctgggccttctgggtttgggggagttgtgatatatcatcctcatgctacaatcattgctgcaattcgttccctgatacacaccaattggaatctcactctcaatcaaacgctaaggcaaggaaacacagttgctaactatttggctaaggaaggagcaaaatctatagctcaattctcgtccttgcatgcttgtcctgctggtctttatcatagtgttgctacagatgtagtgggaacaatgtaccctaggcaataa

SEQ ID NO: 86751 - DNA, 558 bp, Glycine max
  Peptide Sequence Number=SeqID_178436
atggcagcagaatcatcagagggcgaagaagaaaccaagttaagcggaggtaaccaattgctcatagttgacgatgacttaacggaaatgggaaagaaagccgcttggagcgtgagttcctgcaaacccgtcactctttcggtgtttgctttcagatccgacggagggcaaccccatttagttaacattcagtttcagaagaaagttagacttcaattaattgtgctgtacgtggatttcaagcttgacgagagttacacgccgagcaaagtttccatccgtgccggtgatggttttcacaacttgaaggagattaagaccgtggaactcgtgaagccaactggatgggtttatctttccttgtctggagttgatcctagggatacctttgtgaatactttcatgttgcaaattgctgtgttgtcaaaccatctcaatggaagggatactcacgtgcggcagatcaaagaaccctatcccacatcagccattccaatttacttcaagggaattcatcacctactcttctataagatgagagtttatggaaggatttga

SEQ ID NO: 86752 - DNA, 285 bp, Glycine max
  Peptide Sequence Number=SeqID_178437
atgataatcagaggtggagatgggggaactacttcaaggtcaggagaagaaggtggattcaccactggagattgtgggttagctggctctggatctacctacaaagccaactcttgcatactatgcatgataataaactatcctcggaataagctttgtagcatagtgactaaagttagtgagctttggacatcttgtcctatggctacggacggaggagctggagtggatgatgaagggatgtcctccattctagctctttttcccgatgccatctgtaactaa

SEQ ID NO: 86753 - DNA, 483 bp, Glycine max
  Peptide Sequence Number=SeqID_178438
gtcgactctagaggatcccctctgtttaacagcctgcccaccctggaaacggctcagccggaggtagggtccagcggctggaagagcaccgcacgtcgcgtggtgtccgcctctggtcgatggaacaatgtaggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgtgctctgaatgtcaaagtgaagaaattcaaccaagcgcgggtaaacggcgggagtaactatgactctcttaagcgaaaccacagccaagggaacgggcttggcggaatcagcggggaaagaagaccctgttga

SEQ ID NO: 86754 - DNA, 255 bp, Glycine max
  Peptide Sequence Number=SeqID_178439
atggtggcaggaaatacaaccatagaaaaacctagggaagaatggagtgaagaagagaagagattagtacaatacaatttaaaagccaaaaatataattgcatctgctttaggaatgaatgagtactttagggtatcaaattgtaaaagtgcaaaagatatgtgggataccctacaagacatgcagaagaggttcacacatataattaatcatcttgcatctttaggaaatttttttccaaatgaagatctttag

SEQ ID NO: 86755 - DNA, 303 bp, Glycine max
  Peptide Sequence Number=SeqID_178440
atggggtcatgtcaaacgccttcgcttaaaaaaaggttctatcaagtcaaggtcaagagcctaggaatcaccagtctaaaagagttagggcagttgatgggtcagctccagcgacgagctttttgcaaagcttacggtaaaatctgggacctaaccatggcagaagtctccacagaggccattgcctccctcgcccagtattatgatcagcttttgagatgcttcacttttggggacttccagctatcacccatggtggaagaatttgaagagatcctaggatgtcctctaggggggaagtag

SEQ ID NO: 86756 - DNA, 138 bp, Glycine max
  Peptide Sequence Number=SeqID_178441
gctcactctggtgccagcggagtcctaaaagcaacatccgctgatccctggtcggcatcgtttatggttgagactaggacggacgaggaggccgggcgcacggggcgccgtggtcaatcccctccctcccgacggtag

SEQ ID NO: 86757 - DNA, 630 bp, Glycine max
  Peptide Sequence Number=SeqID_178442
atggcattcttgggagagataagcagtcagacagttgtgaactccacattaggttttatttttccaaatggatccattgttcacaacgacagtggtgtttcctttcaagcttccactccagttcccattcgagtacctaacgggtgtgattttcaaacgttaaaaaccagaatacacaatacccttaagctaaccgacaagcaatttttggatgaaatttactaccgacagcctttcacatatgcaggtaatcaattccggtttcaatgtatgcaactgaaagatgatgctgatgttaacacaatgttaatgtgtaatcatgaattttcgtttgttggtccgattgagttattatgtagcattgctaaaaccccagatggtattttaaacttacttcaagctactatgacccctacttatgatgccctactatattacaatgggaggtggaacatgtcacgccaaaatgagtttgttggttactcgttcacaggaaaaaatctcaaaaagtttgacattcccaccggatgtaccatggatgaactgaaggatttgatcaagcaagttgcgcctactgagattcccccttacttcctagagagtggaaaaatcaaaaggatctctacttag

SEQ ID NO: 86758 - DNA, 330 bp, Glycine max
  Peptide Sequence Number=SeqID_178443
acagagaccaacatgttagccatcgtcagcaagtaccaagaagaattaaatctagccacgacccacgagcataaagtggcggacaagtatgctcgagtgtatgcagaaaaggaggcaagaggaagggtgattgactcgttacatcaagaggcaacaatatggatgaaccgatttgctcttactttgaacgggagtcaagaaattccccgattgctagccaaggccaaagcaatggcggacacctactctgcccccgaggagatccacgaacttctcagttattgtcagcatatgatagacttaatggcccatataattagaaaccactag

SEQ ID NO: 86759 - DNA, 696 bp, Glycine max
  Peptide Sequence Number=SeqID_178444
atggagcaaaacatgctagctataataaggcagtacaaagaagagttaaaccagtcattgaaccatgagcaaaagctagtagaggacttcgcacaagcatatgccgagaaggaagcaagaaggagggtgattgatgcattgcatcaagaagcgaccatgtggatggataggttctccttgaccttaaatagaagtcaagacctcccacgactactagccaaagcaagggccatggccgaaggagtgcaagaacagatgaaggccaacatgtcggccttaaaagatcagatggcttctatcacgaaagccatgctaaaaattcaaaaatcaatagaagacaatgctacggcagccacttccaatatagctagggaagcggaactggtgctacaacccgcaatgaacttgggccgggacagaagtgtgacgggtttcaatcggaggtatagtcctcaagcctacccttatggtttacctccaaacttcactccctgtaccgctccagacgatttgagccaagcccctaccttcgaggggcaactccctcctcatgccgactttcctctgcaggaagatgatgaagaagatgcccatttaggccctctacttcccccaagggaatcggccccccatgagttgccccaaccaaacataatccgccatgccccgtctcaatccacacccgttaaggaactc

SEQ ID NO: 86760 - DNA, 228 bp, Glycine max
  Peptide Sequence Number=SeqID_178445
atgtccgcaagggtccagtctatagccttcttatgcttcttgagaactgacaacaacttctcctcttgctcatcagcaagggagacagatataatcactggaaaactcttgctatcatccaaaggtaaaacaccaccaccaggcatgcaatcaatattcactctcagattcactctcagcatcaaattcagacatatgatcaagtacaatttcagactcaatgcatga

SEQ ID NO: 86761 - DNA, 387 bp, Glycine max
  Peptide Sequence Number=SeqID_178446
atgtcttgcctagtgatcaaaactccgaccttcctctgccgaagtgtcagctggtgtatgccacccaccaggcaccctctaaacccagataagtctagcagggccctagggtttccaacattgatcacgggcctctgccaatcattcggggttcccgtcatgcctagtaaggtgatccgaccgccgatcacccggggcttcattgacaagtatagcacgcctaggcaggcgcagggtgatgcatcgcaggccgcagacgtactaccaccaacaggcggccaaccaccgggggcaggtgcagatacaccagtgtctctaccagctcagcctcagtcagcagggccagggtttcgttccttttgcatgccctactccagatcagtttag

SEQ ID NO: 86762 - DNA, 600 bp, Glycine max
  Peptide Sequence Number=SeqID_178447
atggcgcgcagagacaaaatttggtcattctgcaccctttgtcatccagaggcgtcgggcccgatgacatgcggagacaaaatttggtcattccgcacccctttgccattcagacacagccgtgtccgatggcgcgcagagacaaaaattgacacagccgtgtccgatggcgcgcagagacaaaaattggtcattatgcaccctttgtcatccagaggtggcgggcccgatgacacgcggagacaaaatttggtcattccgcacccctttgccactcagacacagtcgtgtccgatggcacgcagagacaaaatttggtcattctgcacccttttgtcatccagaggcggcgggcccgatgacacgcagagacaccttacggttatccgcacccttttgtcatccagaggcagcgggcccgatgacacgtggagacaccttatggttatctgcacccttttgtcatccagaggcggcgggcccgatgacaagcagaggccaatgtggtcattctgcacccttcgtcaatcgcggccgacaagcccgttgacacgcggagatttacatcatcttccgcactcacaagatctgtcatactga

SEQ ID NO: 86763 - DNA, 501 bp, Glycine max
  Peptide Sequence Number=SeqID_178448
cgctgttcatgtgtcctccattatcaagcgcgaagcctctggtgactgggaaacacgttcttctgttgttttccggatcggttccttcgccaaatataagaaaaaagaaggagtagagacgagagtcgtcatcacggaaagggcaggacggacgaaatcagtgtcctatctttgctttcctcttatctccgatgagagtcccgagacgtgtcagaaatcaaaaggaagcaggcttgcgcaatccgtgaaattccgtaatgtggcggaaatcgaaaagagtaaaaaggggggggtacaaatagcaatctggcccacttgggccttccagatccttcctccagaaggctgttgcttctggaggaagcaaccttgctcgcctgggcgagctggaaaatccaagccgaggcgcttccgtaatgtttccgtgagtaattacgcgaagattctcgaccgttcttcaacattcatcgttcgttcttcgttttcttcagtcttcaacgg

SEQ ID NO: 86764 - DNA, 406 bp, Glycine max
  Peptide Sequence Number=SeqID_178449
gtcgactctagaggatccctcaggggataacgcaggaaagaacatgactataaagataccaggcgtttccccctggaagctccctcgtgcgctctcctgttccgaccctgccgcttaccggatacctgtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttga

SEQ ID NO: 86765 - DNA, 54 bp, Glycine max
  Peptide Sequence Number=SeqID_178450
atggggacaaatccaaacggcaaaaggggacttccaaatggtgccaagtattga

SEQ ID NO: 86766 - DNA, 612 bp, Glycine max
  Peptide Sequence Number=SeqID_178451
atggataatgaagagggcatgcaggaacagatgaaggccgatctatcggccttaaaagatcaaatggcttccatctcgaaggtcatgttaaaactccagaaaactatagaggataaagtcacggcaaccgcctccagtacagttagggaagtggagccgatgctgcagcccgccttaaatccaggccgagacagaaacacggcagtgtttggtcgaaggtatatcccacaagcttatccttatggcttgcctccggacttcactccccgtgccacctcggaagatttaagccaagcccctactttcgaggggcagctcccaccttatgacgactatcccgggcaagacgataaggaaggagatacccatctcggtcccctgctccacctcaaagattcgtccccctgtgaattacccaaaccaaacatagtccgccatatccagacttcacccacacccgtaaaagaatctgttcccttcgtggaagataagggaaagattgaggcgcttgaagagaggttgagagcagtcgagggcctcagcaattacccattctcggatctagcggacttatgtctcgtacccaatatcgtcattcctcccaagttcaaa

SEQ ID NO: 86767 - DNA, 267 bp, Glycine max
  Peptide Sequence Number=SeqID_178452
atgtcacccgacttcatgggtcaggatgacaaaggtgctgaagacgatgtaagtctctgcttgtcaacggcaatcgtttgtgcggataacagcttgggtatcttcgcatctcacccgacttcacgggtcaggatgacacaaaccgtttgtacggataaccgcttgggtatctccgacatgtcacccgacttcatgggtcaggatgacaaaggtgctgaagacgatgtaagtctctgcttgtcaacgggtttgcttgcccctgattga

SEQ ID NO: 86768 - DNA, 213 bp, Glycine max
  Peptide Sequence Number=SeqID_178453
atgcctcaccaaaagaggaaaactctagatgaggtttcattgtcatcaagcgagtcggagacccaacatgatcacatatcgacctccactccctatagctcacacagacccaggtatagggcccaatatctcaaagtgtgtacaaaaagtatgggtgtcatatgtgaacggagcaacataagaattacccaaccctacctacaaaactactag

SEQ ID NO: 86769 - DNA, 432 bp, Glycine max
  Peptide Sequence Number=SeqID_178454
atgaggactttgagtcctctgaaggcaaggactttgagcccttacaaaggtgaaggcgaggactttgagccttctaaaggtgaggaccttgagtcctttgatggcgaggactttgagccctctaaaggtgaggaccttgagtcctttgatggcgaggactttgagccctctaaaggtgaggactttgagccctctaaaggtgagaactttgagtcctctaaaggcgagaactttgaatcctctgaaggcgagaactttgagtcctttgatggcgaggactttgagccctctgaaggcgagaactttgagtcctctgatggcaaggactttgagtcctctgaaggcgagaactttgagtcctctaaatgtaagaactttgagtcctctgatggcgaggactttgagccctctaaaggtgccaataggtactag

SEQ ID NO: 86770 - DNA, 382 bp, Glycine max
  Peptide Sequence Number=SeqID_178455
atgactagaggcaatccaggtgacttacaaccctttgatcctgaaatagataggacatttcatatattagttaggcatagtgtgcatcctgattaccctgaacattttgtaccttttgagcatcctgagcattctgttattggtgagtctgagcattctgtggttggtaattttgaacatcctgattttgagcattataattttgaacattctgattttgaacattctgaaaatatggctcatcctccacctcgtgagaggactataaggaaaatggctgcacctgatttcacttatgaaaacttgtgcattcaataccctgatgaggatgtcccatatgttcttaaaactggactgatccacttgttgcccaagtttcatg

SEQ ID NO: 86771 - DNA, 129 bp, Glycine max
  Peptide Sequence Number=SeqID_178456
atggataagagcttgaaggaaggagaaaatgagtggagggagagggagaaaaggagcacgaaattttgtgcctcaaataagcccactaatccaagatcaagtccaagattctccactaagtgtgcttag

SEQ ID NO: 86772 - DNA, 345 bp, Glycine max
  Peptide Sequence Number=SeqID_178457
gggaggagcttgccacgcagctcgcccaggcgagcaaggttgcttcctccagaagcaacaaccttctggaggaagaatctggaaggcccaactttcgaagaagttacgaaaactcacggattgcgaaaaatacctccttcaatttccgtcacatcacggaattttcacggatcgcgaaaaagccatttggggcaggggaagctcgcccaagcaagccaattgcttagctctgaaggtataagcttgcccaggcgagctggttacctaaggttgaagatatttcatggcccaggtgagctagatgctagcttgggcgagcttgggccagaaaattccataaaatga

SEQ ID NO: 86773 - DNA, 519 bp, Glycine max
  Peptide Sequence Number=SeqID_178458
atggctcgtggcggtcactggtggtcagtgggggtggaggaggagcttgggggtgttggaggagggtttaggggaagaggaggaggaagaagatggctattttacgttgctggacgcgcgaaaagcctagatagctgcccacccattcagatgaagttgggaggggggaacattgaggattcagagcatgctcatggtgcaatcgtcaaaggatatctctacatgaagatcgtgaaaaatgcaatcatacgcatagaaataatccctcaaaggaaccaccttagcaacctcttcggcacgaagatgaaaatgactaaaatcgtcatcaacaaaggggtcccagtggaagctgatccagctcaaacccttatggattacctcactcctactttgagggaatctaataccatcacacttcctaatctacctaaggaagtcacatttgacttgaagcatggattcctacagatgttggagaacaacccattcaatggtgttgctcatgaaaatcctatgtag

SEQ ID NO: 86774 - DNA, 588 bp, Glycine max
  Peptide Sequence Number=SeqID_178459
atgcctcaggagcctctggttggtgcctcaggtcctcaagtaagcacaaagaagagttatgttgatccatcaggaaacgatcctgagacgactgactctgacaggtgtggcttgtacatcgaagcaaatcctgcttgcctggttgccctgggaagagtttatgagggatccactgttgttcataacactcctttgtttcctggccaagcaaaggtgggtgtggaggaggttaaagatccagatgctctcgttcctgtacctactgatgaggtttccttagtggggcaggcaattcacaccttccttgcttggccgacacatctggtcaagtctttatcacagcaggcaactgtgtctccggcaaaaccacctcaaaagccagatccggaggttgatgatccactttatctgatgacattgaccatcccagagcttttcttgaggccttaccaggttacatgggatgccaccatgttcagggtctttaatccaaacttctcgctctacataaagcatgaagacctctccgaaattgcacatggtggtcaatgtctcagcatatcagtgttacagttgtggattctataa

SEQ ID NO: 86775 - DNA, 366 bp, Glycine max
  Peptide Sequence Number=SeqID_178460
atgactggagtctgtgttggagttgaaatgagaggtgttggagttgtggaaaaagaaggagctgctgtctctagtggtgctgaagtagtggggacctctgattttttacccccggccttccttggccctctaaatgtcactgttggatcatctagattccaacagttcttcttaatatatgccaagttaatggcagggctcaggctctccagggatctagaatatgattggactcctctggccttgcatagagctatgatcaaggcagggaatccaactctggatgaatcatgctatgttgttagaaagatctggtgggagattaggtaccccacattcatatccatcttcataataatgccatag

SEQ ID NO: 86776 - DNA, 294 bp, Glycine max
  Peptide Sequence Number=SeqID_178461
atgggcccgaaatctaccctaagactcataagaaccctagggccttctcttgcatctctggcccaatctacttggagttttctatccaatgcccttgcgggcgatccgccaataataaggatcacatcatctgatgagaatcccaaagctgcccaaatacagggacctatgacaaggggtaggaccaaacagtcaaaggataccctccaacaaatggtggcagccatacttgacaaggcccaagtggagaaggacgaaggctcagaggcactcccaaaaatcttgattgcttaa

SEQ ID NO: 86777 - DNA, 693 bp, Glycine max
  Peptide Sequence Number=SeqID_178462
atgtcgaacgcggtgtcgtttacgctcccttctctcaacaaccctcagctaaacgctctgaatagccctaacaaagcgcgtctgcgcctcggcctgagaagccgggtcgttgcgtcgtgcatagagaggaagaggtttctgggaacccggttccgaccgatcgggtcggaccgaatccggttacttcaatcgtgtcggttgccgaagccgagggtggcggtgcggtcggcattctcggccgtgccggagaagccactggggctgtatgatccggcgatggacaaggactcgtgcggggttgggttcgtggcggagttgtcaggcgagagcagccgcaaaacggtgcgtagcgggttgggttgggtttggtttggtttttggtggatgtggtgtggcgtggcgtttatgaatgaaggtgacggacgcgctggaaatgttggtgcggatgacgcacagaggtgcatgcggatgcgaagccaacactggagatggtgccgtgttcttatgaaagttgtagattttgagcttcctccacaagaaaaatatgcagttggcatgtttttcttgccaaagtcagaaaaacgaagggaggaaagcaaaagaatatttagtaagttttccttcgcagtgaacagtactgcactgcgctgctgcccttgtatggcagccttcccgacgcccttttgctggtga

SEQ ID NO: 86778 - DNA, 369 bp, Glycine max
  Peptide Sequence Number=SeqID_178463
atggcagaatcgtcaaagaggcacaagggcttatcatcctcctccaccactgccgacctctgctgccacagtccttccggtgaccttccggcaccacccaatccatctttttcctcactgcactctctcactctattttccactgatgtccaacgtgagagatattactcatcattctcaaatcgtgatattattgaccctaaataccttgactctgaactctttgagggagaaaacattgattgctatcaagtgtttcaaaattctgaacaagtggatttcatgattaagaaattgccctattaccctgaattggttcgagtgttttataacaacttggaaattcatgaaggagtgatattttcttaa

SEQ ID NO: 86779 - DNA, 729 bp, Glycine max
  Peptide Sequence Number=SeqID_178464
atgacacatcaactacatgtcctcgccttcaaagggctacacgccctagcctttagaggactacacgtcctcgccttcaaaggactacatgtcctcgccttcagagggctacacgccctcaccttcagatggcttcacgccctcgcctttagagggctgtacatcctggccttcagaggtctacatatcctcgccttcagagggctacacgccctcgcctttagagggctacacaccctcttcttcaaaggactacacgtcctcgccttgagaggactacacgtcctcgccttcagagtgctacacgtccttgctttcagagggctccacatctacgctttcagagaactcaagttccttggccacccccctgatctcggaggagggccaactgcgcgagcacaaccagaggaggagactatcgcacaactactatgcatactggggaaagatttcacccagccgctacaaggagacgagtgtggatcatgcgcaccaacatatggacgatgttgttactttgcaaccttcttcccagcaaccacctctccgatctccccttgtcaaagtgtcaactgggatcgtgcccgcaagacacctagtggactcgaaaaagtccaacagggccctggagttctagctctgattacgggcctttttcggttctatggagtgaccaccactccgatctccccttgccgaagtgtcagctggtttatgccatcatga

SEQ ID NO: 86780 - DNA, 156 bp, Glycine max
  Peptide Sequence Number=SeqID_178465
gaaaaggaaaggagaagcttgccacccagctcgcccaggcgagctcagctcgcccaagcgagctcggttgcttcctccagaaggcggtgccttctggagaacttcctggaaggcccaagtgggtctggttgctatttgcacccccctgtttactaa

SEQ ID NO: 86781 - DNA, 1447 bp, Glycine max
  Peptide Sequence Number=SeqID_178466
atgaacttggaaaaattggagtcagttctgaatggaaaagcgacagctgaactcaaaagtgattttgtagtacaaatttcaacacggcatgccataccatctatgcaggtaattcgtcagcaactaaaaattgctcgcatgactcaggatgggtacgaacgacttttaaagtacctatgtccgaacacacaagtagattgtaccgaccctaatcaaaataaattaattcagatctttggtctatttgaaactatctacaatttaaccattgatgcctatcagcaagcaccaggttcagtgcacgaacaagaagtttattttgattcaaaactcagtccatgggataaaactgatttgttgatgagtattgccccgtctatgcgcggtaaaattgaccagtattttccaaaaaggttaactaaaaaattttttaatctcacaccaacgtcaccactagaaaacttggttgtttgggatgaagaaagcgcaaataccattattcccaaacgtctaaaatcaattaaaacagactttgaagaagataagagaattgacgatctacgtaagcgtattcgtgtcacctcaccctggcgagcgcttttatctgaagataattattgggtgttgtcacaactagcgcatcagcctgactttacgccaaagattaaaaatatggtcttaaagcggatgcgagaaatagaagaaactgaatcgcaaaaagttggtacaaacactattgagcttggcttgattttaaatgcagttacaaaagaacgcgtggtcgatgctaaatccagagtgcaatttttactagacgaatctataagcagttctagctatgatgagtggaaggccccattattacgacttagcgctaagcacaagttgtttcaaaatgacatagaaggagcactcaaggattttaaacaagcacttaaagcttgcgatgagtgtgcatttggaggtcttcgtggtgagatagcaagagacggattcgcaaccgagctgatcttaaaagggtttatccaaaataaccaagaaatttattaccgcaatatgttggcctttatggaatggcctgaaggacatgtttcatttgaaaatgccgctgttgaatgtgaggagtttttctgggataccctttatcaaccatactctggcattgcgccaatagtctgcatttcaaaaaaacaatatcaattaatcattgaagaaactacagaaatcatatttcaagcagactggaatgggttaaacgaatggtttaagaaaaacgctaaacaatatcgcaagttaaatattaaagatgccagacgaaatagcattttgctttcatggttaaagctttaccaaaacctcaataaaaacaagtatcgattgagtttggaaattgcacacgagctggcaagtgagttggagaaatatgaagcaatgcttgaaaactggc

SEQ ID NO: 86782 - DNA, 499 bp, Glycine max
  Peptide Sequence Number=SeqID_178467
agtgggataccgttttccttacccacagaggcgcagtgggaatacgcagcacgtaaccgtggacagtatgtagtaatagcgactgatgacggcacgttgagagtcaatgaaaaatcgggaaaaggcgagaattttgcaactgatgaagatcgagaacaagccggtgaacctaatggaatactcccttcattaattaacttccctgttgataaatactctccatctcctttaggtttgtacaatatggcagataatggaaaggagtgggttatggactggtatgaccctgactattactccaaatcacctaaaaaggatcctcagggaccgactcagccagtaatcaaaagtaaaagcaaaaatcaatacttgaaggtattacgtgggggagacaaccctgtccctggcgtcaagtttggaggtaaagaagtgtcctgtctgggggataaagtgtcttgccctgaacatggtgatacatacatagcagaaggtgatgaag

SEQ ID NO: 86783 - DNA, 582 bp, Glycine max
  Peptide Sequence Number=SeqID_178468
atgtcgcaaggccaagcagttccgtttgctgggaaatggcaccgttttacagtcaggaacgacggagagaaggtggttccagaaccacaaggtgacgccgaacacacagaaatctgggaatcggaggtgatgatccctttcgcagtggaaaggacagtttacgctttcggtggacctctgccagaccaagagtcactctcgagttcaatgaacaagcccatagggattacctaccttgggcttgatcgagtcgaacaagcgtatgaggatttctggaagacatatggcatctttgacttgatacaattctctcgatctggtcctgaatatcgaccagaaatgctgatagcagctatgcactttttcgagtcttctaccaacacctttcaatttaaatgtggtatgatgacccctactctcttagatgtagccgccctcacaggccttaggcctagcggagaaacgtatgaccccactaattctagtgacaatatcaagctagtatctaaggagaacaccttttccaaatacatagctgaacacaaaggatccgtcgaagaggaggtttctgatgaagagcac

SEQ ID NO: 86784 - DNA, 775 bp, Glycine max
  Peptide Sequence Number=SeqID_178469
acatcctgcgccggacgtcggcaccaacgccaaagtgatggcctggatgatggacacctactccatgaaccacggcaccaccatcaccggcgtggtcaccggcaagccaatccacctcggcggctccctgggccgtgagaaagcgaccggccgcggcgtgttcgtcaccggcagtgaagtggccaagcgtcttggcgtgcagatcgaaggcgccaaagtggcggtgcaaggcttcggtaacgtgggcagcgaagcggctcgcctgttcgttggcgtcggcgcgcgcgtcgtcaccatccaggaccactccgccaccctgtttaacgccgacggcatcgacctggccgcgctgaccgaataccagaccaagcacaagcagatcgccggctcccctggcgccagcgagatcgaaagcgaagcgttctggtcggtcgacatggacatcctgatccctgcggcgctggaaggccaaatcacccgtgagcgtgccgagatcctcagcgccaaactggtgctggaaggcgctaacggcccgaccttcccagaggcggacgacattctgcgctcccgtaacatcaccgtggttccggacgttatctgtaacgccggcggcgtaacgatcaacgccaaaatggaccgcatcatgaccgatgctatcgttcatgtctgcgataaagccgccgagaaagcctgttctctgcgtaccgcggcctatatcgtcgcctgtgagcgcatcctgctggcgcgtaaagatcgcggcatctatccgggctaa

SEQ ID NO: 86785 - DNA, 227 bp, Glycine max
  Peptide Sequence Number=SeqID_178470
gacaatgtgggttctgtggggttcgagcgacgacaatatgggttttccggcagtgtagggggttctgtgggttccaacgaggacaatgtggattttccggcagtgttgggggttctgtgggttcgaccgacgacaatgtgggtgtcgagggagcggtttccggcagatttcaggcgggaggagaaagagaacaacaatttcaggcaggaggatgacaaagagaaaag

SEQ ID NO: 86786 - DNA, 459 bp, Glycine max
  Peptide Sequence Number=SeqID_178471
atggataatgaagagggcgtgcaggaacagatgaaggccgatctatcggccttaaaagatcaaatggcttccatctcggaggtcatgttaaaactccagaaaaccatagaggataaagccacggcaaccgcctccagtacagttacggaagcggagccgatgttgcagccctccttgaatttgggcctagacagaaacacgaccgtgttcggtcgaaggtatagtccgcaagcttatccttatggcctgcctccggacttcaccccccgtgccaccccggaagatttaagccaagcccctactttcgaggggcaactcccaccttataaagactatcccgggcaaaacgatggggaaggagatacccatcttggccccctgctccacctcaaagatccgtccccacatgaactaccccaaccgaacatagtccgccatatcccggcctcacccacaccc

SEQ ID NO: 86787 - DNA, 429 bp, Glycine max
  Peptide Sequence Number=SeqID_178472
atggcctgcaccaagaaaactgggcagatgacgtctgaggcagcaaaggaaatcgctgagaagattgcgtcacaggaacaccctggccgtgtgcgtgctgctggagtcggtgtcaccatcaagcaatacttcggatcggctccacaaagctcctgcagttcctcctccatgcctcctgaagaactcgagcagctgactcaacaaatcagggaccagctggaggagtcgatcatagaaaaaccagatgtagtcccagttgcaatcacagatccaatcacagagacttcactgcctccagagcctgaggttggtccctcagctgctcgtgttagcacaaaggggagttgtgttgatccctcgtcgaccgttctagagacgggtgactcaaacaaatgtgggttgtacatcgaagacaatccttcccgcctg

SEQ ID NO: 86788 - DNA, 438 bp, Glycine max
  Peptide Sequence Number=SeqID_178473
atgggttctccacctgactccactcctcctcctcctcctcctcctcctccttcagatgcatcggcttcgccgtctgtcgtgaagcggacatgcaaagcctcacgtctacgatcgttgtccactagaccacctggtgctgagagaccagttgtgcatgttgatcctgctaccgggaaggccgacggtccccacaggaagaaattaagaacatatttggggattgtggtacgtgataaggtggacatcacctacgagaactggaaggaggtccctactgctcaggatgttctcgccgctactattggacgtccagagcaccctggacgtgtccgtgctgctggagtcgatgtcaccatcaagcaatactttggattggctccacggacatcccgcaatgcttcctccctgcctcctgacgaattgcaacagctgacctag

SEQ ID NO: 86789 - DNA, 117 bp, Glycine max
  Peptide Sequence Number=SeqID_178474
atgggggttcttttcacccttccctcacggtactacttcactatcggtcacccagagtatttagccttgcaaggtggtcctgctgatcacacggatcacgtgcctcatgctactcgg

SEQ ID NO: 86790 - DNA, 216 bp, Glycine max
  Peptide Sequence Number=SeqID_178475
atgcaggtgttggaagcaaccatcaaagccaccacagagaagaagatggagctggaacggctgatcaaaaggctctcagaaagtggcattgatgatggagaagcagttgaggaagaagtagaagcagccgaggaagaagaagatgctgcagcagaggaagaggaagatgcagcagaggatactgaatcagatgatgattctgaagccaccccatga

SEQ ID NO: 86791 - DNA, 267 bp, Glycine max
  Peptide Sequence Number=SeqID_178476
atggtggcacaggagatgctcaggcacggttatgagcccggaatgggtctgggcaatgacagccatgggaatgccgatgtggtcgacattagggggaacccgtacaaatatgggttagggtatgaactcgggaaaccgagaagaaggaatacaccgtcaagactccgggtagatagggcatggcccggccatgctagccagtgtttcacaagtgccaggataatgttcgaagaagaggtggcggcaataggagaggagtctccataa

SEQ ID NO: 86792 - DNA, 249 bp, Glycine max
  Peptide Sequence Number=SeqID_178477
atgggaaaatccctcttccatattaagaacataaaaatcaacaggaaaaataagttcaccaacccgaaccagcacatcctctatgaaacctgcggggtaagcaacacttctgtagaagaaaagcttcatgatgatgacaaaggtgatgacaaaaagctcaaagatcaatcaaagaacaactcaagtgaatcaaagatcaatcaaagaacaactcaagtgaatcaagaacaattcaagagttcaagataa

SEQ ID NO: 86793 - DNA, 1119 bp, Glycine max
  Peptide Sequence Number=SeqID_178478
atggggaattggcgaacagcgctgcgcaataaacttcgcggggctccagactcgaagcgctacgcaataacttcgcgcggctctagactcgaaggtggaggacacatgaacagcgctaggcaattaaattcatggattcttgctttagcctccaaatactttcttggtattccaaccaccccattcatagacgttctcgcagtgttgatcttcggaggagttttctttccgaatgtggatgggttggtggacctagcagcgatcgacgcttttctcgcctatcatgaccacaagcaaagcctgatcgtcactatgctagctgacctacaccttcgaccgaaggtaaggcatgcttgctcgctagaaagtcaccgttcatgcatagagaaaggaggcgtgaattgggaccaactcttagcaaacaaagaaggagcgtctatcatctggttccctcgatggaaagaaggaagaatcgaagttcttatttcgtgcggaggatttctaaatgttcccttgatggggacgaggggttgcatcagttacaatctcgttcttgctataaggcaacttggctaccctatcagaggggcaccactagaggaagagatcgcgcctatcatttcacgaggtttcaataaaaccaacgtggagacacttcagaaggtccgcaaggcatgggaggtggtgcgaaagaaggacaaagaactcaggggcagtaacaatgggtccatcagcggctaccgtaagtggttgagagcccacgtgcaaggtttggattggctcccaagtttgatacccgctaaaagggaggaagttgaggcaccggaggaagacgaagaggtgcagacccttaggacagtgctccagcaagctcaaacagtcaaagaaaggttcaaatcagcagctctgaagatccgaaaggagaatgtcgaactgagagatataaatacagctaccaccaaagccttggaacaagaaaccaagagggctcgtagggaagagcacgaccagaacaagttccgaggggatctgtggggcagcaacagcgagcttaagctccggagagaggaaagggaccaatcacgagtagacagtctgatcttgaaagatgagtcgaag

SEQ ID NO: 86794 - DNA, 396 bp, Glycine max
  Peptide Sequence Number=SeqID_178479
atgaggctactacttcaccttcctctagtgaaaagtgaagaagcaaaaggggaagaatctagtgaagagatctacccccaagaagaaggacaacctttaatggttaaggaggagtgtaaggagacacttgttagcattgccacatctcttaggcttgagtttattcctcaagtaaaggagttgttggatgagggtttggttagcaagagattaaatccttgtgctttgttggtgcccaaaataggggttcccatgaaccctaagagaataaaggtgattcctgagtggcctactccaccaagtagatcctatcccgcaagggtattgggtagaagactccaagtagattgggctagagatccaagggaaggccctagggttctcatgagccttagg

SEQ ID NO: 86795 - DNA, 375 bp, Glycine max
  Peptide Sequence Number=SeqID_178480
atggcagcgcaattgatccatgatcgcgttgtgatggagtgcctagagggtgtttgggagaccctcgaaggcaatgagaggtgccggttccgtggcacaattcgactcactgctacttcattagtacatccggaggaacccgcacttgagccggttcaagtgatagaggtgtcatcctctgaagagaatcttgaagaggacctagaggagttacctcctgaacctgctatggacgcccttgacttacccgaggatgatgaagacccactccttaatgttgattcttcagaggatattatgtcagcatctgaggcagactcaacagaggagggtggccctggagggacagcaaatagtgacgactcttcatcatag

SEQ ID NO: 86796 - DNA, 192 bp, Glycine max
  Peptide Sequence Number=SeqID_178481
atgggtgaagtagaggaggtgcaagagcagataaaggccgacatggaggccatgaaagagcaaatggccacaatgatggaggccatgatgagcatgaagaagataatggaagccaatgcggttgcagttgccgctaccagggctgttgctaagtgtccaaagacaaatccagaatccatatatctaggctaa

SEQ ID NO: 86797 - DNA, 771 bp, Glycine max
  Peptide Sequence Number=SeqID_178482
gtcgactctagaggatcccacttgcccatggattacaaagagattgaggctaccttatgcataccaggccgagggttcatcttgaacactgagggccatcatgggaagattctcaggaaggatttgactactctagctcaggtgtggaatgttctctcatactccaacctggcccccacatcacatacctctaatctgacagtggacagagctaggttgatctttggcctagtctctcgcatggacatgaacataggagctcttatttttaggcagataacttttatagcccagtctaacacttctagacttggatttcctactctgatcattgcactatgtagagccagaggggttgtctctgacaaccttacttttgagcgcctgagcccagtggtggaacctccaggatctattccttcagttgagcagttcagggagatggtagcctggcccgggacccaaccttctcttcgcagggaaggtgaaggttccacaacccaggaaggtgagacacatgtgagacaggtagctgctgccactcctgagagatctcttgaggccacttcagagcctcctgcaccagtggtggacctaccctcacctcagcgtacagcagacccctccactcctattctaaagatactagaggacccgaccacaccagtcctggctatggacacttctcctccagctactccagtacttcatttgacagatgaagaggatgttcaaacacaggatacccaggaccagtcacaggaattctaa

SEQ ID NO: 86798 - DNA, 843 bp, Glycine max
  Peptide Sequence Number=SeqID_178483
atggaggccataaaagagcaaatggccacaatgatgaaggccatgatgagcatgaagaagataatggaagccaatgcggttatagttgccgctattagcgctgtcgctaaggtgaacccgatgctcccatctggcctcaagcaaatgaatcatctaacctcaaatatggcacatatctctcaaaccatgggggagacacatgaaattccccaccacaatctagctgacttcgagccttggctcggatatgccactgaagggcaagcagttggtggtataccctttgaaaacactttggagggccctcagtttcgcccacaaccacaaccattgcattttgcggtgggaagagcccctcctgctatggccgaaaagggaaaggtggatcatctaaaggaaaggctcagggccattgaaggaggtgaagattatgcctttgctaacctagaaaaagttgttcctaatacccaaacatggtcattcccaagttcaaaggtgctggactttgacaagtacaaggggactacttgtcccaagaacaatctaaagatgtattgtcagaagatgggggaatacgcaaaagatgaggaattgggggagacattccttccaagaaagtcttactggggtagctgtaacctgggggacggatctttcaaagaacacgcccaaaaggtggagggatctggcggcccaagtggtacccccaatgatggaaagggagacgatgatcgtgatggtagacacattatcgatacactactatggaaagatggtgggctacgcaccctcaaagctttgcagatttggtcttcgccagtgaaaggatcgatgtgggtctga

SEQ ID NO: 86799 - DNA, 219 bp, Glycine max
  Peptide Sequence Number=SeqID_178484
atgtttatgcaaagatctcctacaggtactttagttcctttggacttagaaatagaagctacactaagaacgagcagggttgagaggagaaggaaactgttgcaagacaaaatagttgtgtccattgttgaggaggagactcatttttctgattcattatcacatgattcaccatcatcaagggaatccgctaatcaccattctgaagttgttaccatg

SEQ ID NO: 86800 - DNA, 506 bp, Glycine max
  Peptide Sequence Number=SeqID_178485
aacgtcgtgagacagttcggtccatatccggtgtgggcgttagagcattgagaggacctttccctagtacgagaggaccgggaaggacgcacctctggtgtgccagttatcgtgcccacgagcctccggtagcacagccgagacagcgatgggttctctgccccagcggggatggagcgaaagaagttttgagaattcaagagaaggaaccacaccaatccatcccgaacttggtggttaaactctactgcggtgacgatactgtaggggaggctggggagaggaaatgttcccattttttaggatactccggggaacagatatccagtggagatgacggggtggggcctgtagctcagaggattagagcacgtggctacgaaccacggtgtcgggggttcgaatccctcctcgcccacaaccggccaaaaaagggaaggatttttccctctgggggtaggaaaatcatgatcgggctagcggacccaaagctatggaacttgtga

SEQ ID NO: 86801 - DNA, 443 bp, Glycine max
  Peptide Sequence Number=SeqID_178486
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgtttgtagagaaagggtttccaaaatctggcaagtgtgagtgtaactgctattacactcacttaagcagttttcaacactttcgcttagcagaacgctgcactaagtgttcgcggctggcaagtataccggatcgcacaagtagtataaaacgagaacgtgttggtcttttgatggaagcttgcttgtgggccttctatggaggctggatctttgagcttcaatga

SEQ ID NO: 86802 - DNA, 273 bp, Glycine max
  Peptide Sequence Number=SeqID_178487
atggatattctaatgatacttcaaaatcctcatcagaaagatgaatggcagcggaatggagaaggaagagagagaggagacgccacttcaaggagaatgagtctagaagaagctcaccaccataggaggccatggataagagcttggaggaagaaggagatgaatgaagggagagggagagaagagcacgaaattttgtgctctaaaagagctctgaaatctgaacccactaatccaagatcaattccaagattctccactaagtgtgcttag

SEQ ID NO: 86803 - DNA, 1005 bp, Glycine max
  Peptide Sequence Number=SeqID_178488
atggttaccacacgatccggtctcaagcgagagtcactcctggaaaatttcaatcctcctccgacgaccatgatagacaatgatactctccaccaactccaagtccgcattgcaaagatggtacaccaccacaaggaggaactcagaaaattgaaggccgaccacaataagttggaggcttatgtgagacgcccccaagaggatgaacactgtaaatttatggatagttcgtcgatagcctatgcaagaaacctcccagcagcatggacgagttatgagaacaagccaaatgttacatttagatggaagaaatgtcaaggttcaaaaatgaagttccacaggctggacaaaagcgtgagaaaggagaaagtagtacaaggaccgatcacacaagtcgaacaaatggcacaaataggggcgacgcgaggctcacgggtgcgtcttccaagaaagaaaaatgcgcggagtcgccaccaatgctggggggacaagcaccctgtaggactgacagaggcctgtaaccagagctggaaaccccagggccctcaacctcatccatatctgtctaagagtggtcatgttggtgcgcaagatccacactcgtctcgttgtagcggcacgggtgaaatcttgccccagtatgcattgtggctgcacgatagcctccctttggttgtgctcgcacagttggccctcctcagagatcaagggggtgaccaagggattgataaagggaaactactggcccctcacctgggagcgcaagcgcagatgtggagccctcggaaagcgaggacgttcagccctctaaaggaaaggacgtgtagtcctctgaaggcgagggcatgtaaccctctgatggcgaggacgtgtagtcctccgatggcgaggacgtgtcgtcctctaaaggcgaaggcgtgtagccctttgatggcgaggatgtgtagccctccgaagatgaggacgtgcagtcctctaaaggctaggacgtgtagtcctttaaag

SEQ ID NO: 86804 - DNA, 159 bp, Glycine max
  Peptide Sequence Number=SeqID_178489
atgatcatgaataattggtttaatgaccttcctgatgcaatcctccctaggaagggaccagtcactagaaccatgagcaagaggctccaagaagattgggctagagctgctgaagaaggccctagggttctcatgaacctcaggggctccatattgtag

SEQ ID NO: 86805 - DNA, 426 bp, Glycine max
  Peptide Sequence Number=SeqID_178490
atggatgaggatcctctagccactagatggaatccattaagaggtatctggtgtgaccttccaatcaaggagaaaccgaatgagctacaaatgaacattgtcatctggtgtccatatgaggagcacaagcatgtgaggccctttgtaggtcagacactttactttggcttcattagatgcaagactaacctgaggccttatcttttggaaagggtactaaggcaatttggccatccatatatcattcctctaggcaatgttgtgtcgcttgggggtccttgggcttgtagctctaattatatgccttggttttacaagctttcacaccaagtggagactatgtaccaggtggagactactcttgccaggaaaaaggatgacaaggatggtggcaagggtgacaagaaggatgccaaagacggttga

SEQ ID NO: 86806 - DNA, 507 bp, Glycine max
  Peptide Sequence Number=SeqID_178491
atgactggaaagggaaggagaatggaagagttgggaaggggtttagaagggggagagaaggtgggtggtggtggtggggtgggatctggtggaaggaaggaagaagaaggaggggtggaaaattttgaaatgagagacagaaggtactgggtcagccagggcaacaaatggtgcgacttttgcaaaatttatatatcaaacaaccctggaagcatcaggaatcatgagcttggccaacgccacaaagataatgtttccaagaggctagctgctatgagaaaagataatattgctaaggagaaagaacagaaagaaacagctcgtgccattgagcaaattgaagcagtaagggtttcacacttattttatattaatcatgctgatgctgcattcttcatacttattcatgataatgatatcactggtataatcatgaacaattcattcatccatagcgttttaccctctttattcacaccacaaagcctattgaagttattgaagtga

SEQ ID NO: 86807 - DNA, 201 bp, Glycine max
  Peptide Sequence Number=SeqID_178492
atggatgttaaacattttgaggtggtcaaaagaaggtcgcatgccgacaaacaatggtcctcggacgaaattagggatgaactaagggatttctacaaggccaagaagttggagaaacaaccaaggattcttcttccaaattcatcaaggaagttagtgatctcatgtggattatattcttcgaacataacccttttttga

SEQ ID NO: 86808 - DNA, 378 bp, Glycine max
  Peptide Sequence Number=SeqID_178493
atggcttattttagttctaagacacctaaggaaataaataaatcaagctttacataccctgtgttaggaagattcgataaattacactcagatagggaagctcagatgatagaaggagaagattctaaatctgatgaagatttaatcaaggcaaaggatgccactaatgatcataagcagtttgaagcacctaatgagactgatcaagatcttcaaattcaccctcaacatcagaatttagcaccagttgaggggactaattggacaagtcaaaactatccaaagcagcccaaaacaacaacacccaaaaggcataaagacaaatcaaagctcctgaaagatatggctttgatatactgtctcatgcactacaagtag

SEQ ID NO: 86809 - DNA, 1542 bp, Glycine max
  Peptide Sequence Number=SeqID_178494
atgaagaaacaaggaattgaagagaatagactccaactactaagagacataagtggagctttcaggcctgggattttaacagcattagttggtgtaagtggtgctggaaaaactaccttgatggatgtacttgcaggaagaaaaactggtggttatattgagggaagcatcagcatatctggttatccaaaaaaacaggcaacttttcctaggatcagtggttattgtgaacaaaatgatatccattccccaaatgttacagtctacgaatctctggtgttttctgcttggctgcgtctcagtaatgatgttaataaggaaacacaaaagatgttcattgaagaaattttagagctggtagagctccacccagtgaggcattttatagtaggccttcctggaataagtggcttatcaacagagcagagaaagaggcttaccatagctgttgaattggttgcaaatccttccattatttttatggatgagccaacaactggtcttgatgctagagctgcagcagttgttatgcgtactgttagaaatacagtagatactggtcgaactgttgtctgcacaattcatcaaccaagcatcgatatatttgaaaattttgatgagagaggtggacaagtgatatatggtggtcctcttggtcgaaattctcagaatcttattgagtactttgaggctattgcaggagttcctaagattaaagatggatgtaatccagccacatggatgctggagatctcttctcctgttgttgagtctcagcttaacgtagactttgcagaattatatactaagtcagacctttatcaaaagaaccaggaagttattaaggaactctgcacaccagtaccaggaacaaaggaccttcactttccgtctaaatactcacagtcatttgttactcaatgtaaagcttgcttctggaaacagaactgctcctattggaggaatccacagtataatgccatcagattcttcaccacaatagttattggtatcatttttggactaatctattgggacaaaggaaaaaagacgcaaaaggaacaagacctgttgaatctccttggagccatgtatgcagctgtttttttccttggagcctccaatactaacagtgttcaacctgttgttgcaatagaaagaacagttctctatcgtgaaagagctgctggaatgtactcagaattgccttacgcaattggtcaggtagccattgaagtaatttatgttgcaatccaaagtctagcctataccattctcctctactggatgattgggtttgaaccacgggttgaaaatttcttgtggttctactacttcatattcatgtgctttatgtacttcacactgtatggaatgatgactgtagctctgaccccaaactatcaaattgctgcacttgttatgtcattcttcatcaacttctggaacctgttttctggttttgttatcccaagaacgggtcaggcaaatggaaaagggatgttgaaaattaaagaatatagagttacaacttggtcatga

SEQ ID NO: 86810 - DNA, 282 bp, Glycine max
  Peptide Sequence Number=SeqID_178495
atggggacaaatcaaatcggaaaaagattctatcaagtcaagattaagggcctagatgtcaccagccttaaggagttgggacggttgatgggacctgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgaacttttaagtgaaagttcgggagttgtatttacgcatgggaagtattag

SEQ ID NO: 86811 - DNA, 667 bp, Glycine max
  Peptide Sequence Number=SeqID_178496
atggataatgaagagggcgtgcaggaacagatgaaggctgatctatcggctttaaaagatcaaatggcttccatctcggagatcatgttaaaactccagaaaactatagaggataaagccatggcaaccgcctccagtacagttagggaagcggagccagtgctgcaacccgacttaaattcgggccgagatagaaacacggccgtgtttggtcgaaggtatagtccgcaagcttatccttatggcttgcctccggacttcaccccccgtgccaccccagaagatttaagccaagcccctacttttgaggggcaactcccgccttatgacgactatcccgggcaagacgatgaggaaggagatacccatcttggccccctgctccacctcaaagatccgtccccacatgaactaccccaaccgaacatagtccgccatatcccggcctcacccacacctgtaaaagaatatgttcccttcgcggaagataagggaaagattgaggcgcttgaagagaggttaagagcagttgagggccttggcaattacccattctcggatttggcggatttatgtctcgtgcccacatcgtcatccctcccaagttcaaagtaccagactttgataagtacaaagggacgacatgtccaaaagggcatctccggat

SEQ ID NO: 86812 - DNA, 411 bp, Glycine max
  Peptide Sequence Number=SeqID_178497
atggccgaccagcaggctaccaagtccaaagccaaagataagcaaaagtactatgtccgtgacaaacaagtcatcaggcgtccagctcaagacgttaaagaagcgctactaggaggcaacctaggtgagaatgtcaatccttaccctcggaagcaaaaaaagaaaggaaggaaattcccagtcaaagagtgggagaaagcgaaaagaaaagaaagaaaattcccagtcaaagagtgggagaaagcgaaaaggaaagaaagaaaatttccaatcaaaaagtgggagaaaataaaaagggaaaaaggaaaatttccaatcaaagaaaaaagggaggaaagaaaattcccgatcaaggatcgaaagaaaacagaagaaatgtgcagaaaggtcgttggaccagacaatatctga

SEQ ID NO: 86813 - DNA, 240 bp, Glycine max
  Peptide Sequence Number=SeqID_178498
atgtcttctgcgtatcccctgattctgtggataaccgtattaccgcctttgagtgagctgataccgctcgccgcagccgaacgaccgagcgcagcgagaaacagctatgaccatgattacgaattcgagctcggtacccggcaacaatcttatttcatggttcagcaagaagcagaactgtgtgtccctatctactgcagaagccgagttttgcagcaggaagcagctgttcacaactag

SEQ ID NO: 86814 - DNA, 330 bp, Glycine max
  Peptide Sequence Number=SeqID_178499
atgtcatcgggcccgccgcctctggatgacacaagggtgcggataaccggtcagtatgacaaagattatggggcggtcgacaaaagcaaggctcttgctcttacatatcctccaatgaggaactcagacctacaagatgcctacatctccggaaagggcgcagatgaccatattggcctccgcttatcaatcacactcgaggtgcggataatcgtaaggtgtctccgcgggctacccgctcttgggtcatggcaacagaaagcggtgtggtcgacaaaaggaggctcttgctcctacgtatcctccaatgaggaactcagacctacgtag

SEQ ID NO: 86815 - DNA, 362 bp, Glycine max
  Peptide Sequence Number=SeqID_178500
cgcagataccaaatactgtcttctagtgtagccgtagttaggccaccacttcaagaactctgtagcacgcctacatacctcgctctgctaatcctgttaccagtggctgctgccagtggcgataagtcgtgtcttaccggcgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttga

SEQ ID NO: 86816 - DNA, 579 bp, Glycine max
  Peptide Sequence Number=SeqID_178501
atggctccgaaaaagctttccgcgaagaggtctaggagagacgccgtgactgaagggaccaatgccgtccccgagtttgatagccactatttccagagcgccgagcaccagcagcgcttcgaggccatcaaaggatggtcgttccacagagagaggtgcatccagctcagggaggatgagtacacagattttcaggaggagatagctcgccgacattggacgtcgctggtgactcccatggctaagtttgaccctgaggttgtcctagagttttatgctaatgcttggcccacagaggagggagtgcgagccatgcagtggattccttttgatgcagatgcccttagccagtttctgggtgactcgctagtgttggaggaaggccaggagtgcgagttcagtcagaggaggaacagggccgatgggttcgacgaggaggccattgccccactgttatgcgcaccggggcaggatttcgcccggaccgctgcagggaggcgggtgtggatcatgcacaccagcatgaccacctttgacccagatgtggatgacattgctgctcagcaatgtcttgcctag

SEQ ID NO: 86817 - DNA, 269 bp, Glycine max
  Peptide Sequence Number=SeqID_178502
gaatccattgatgaagaagatcctaggcctacaagctccaatggagcttacatcaaagcttttcctctagttgctctgttagggtttccaagcattagagagaaagagaatggattggagcctcaattttattgtctctgtgcgaggggcatttttttctctacaaacattattttgcaaatcccaacggtgggaatatgcggaaatgagttccgaagaggaagaagcgataacgaatttgaaaggaagaaagagcgcagagacgtatc

SEQ ID NO: 86818 - DNA, 609 bp, Glycine max
  Peptide Sequence Number=SeqID_178503
atggaaaccgggccagaagaggccaaagcacctggcaccgtcagcaaggcgctgggaaccgtcaccggcatcgccgcaagaatccagcagtttcccatggtggcgcatctgatacgcgcaaccgagcgctttaatgaccgcatggggaaccagtttggtgccgccatcacctatttttccttcctgtcgatgattccgatcctgatggtgtcgtttgccgcagccgggtttgtgctcgcctcacacccgacgctgctgcaggatatcttcacgaaaatcctgaataacgtcagtgacccgaccctggccagcacgcttaaaagcaccatcaataccgctgttcagcagcgtactacggtcggcatcgtcggtttgctgatcgccctttactccggcgtaaactggatgggcaacctgcgcgaggccattcgcgctcagtcgcgcgatgtctgggagcgaaagccgcaggatcaggagaagatttgggtgaagtatctccgcgactttgtttcgctgattggcctgctggtcgccctcatcgtgacgctctccattacctcggtggcgggctcaggcgcagcagatgattatctccgcgctctatcttga

SEQ ID NO: 86819 - DNA, 1104 bp, Glycine max
  Peptide Sequence Number=SeqID_178504
atgacgaaaacaaccagggtaatctcctggaccgcagggattttcttgttgttgattgtggtcgtcgtcatcattattgcgacgtttgactggaaccgccttaagccgaccatcaaccagaaagtctcaaccgagctgaatcgccccttcgctatacgcggtgatttaggagtagtgtgggagcctacgctggctccgctcgcgctcttcaccaaaacggtctatctgccgtggatcaagctgcagcagcccgatgcgcgcctgatccgtctctccgaaaaaaacaacaactggacctttaaccttgccagcgacggcgaaaaagatccgcatgcccggccctcgccctggtcattccgtctcgacaatattctcttcgatcgcggacggatcgccatcgacgataaagtcagcaaggcggatgtggagatcctggtcgatccgctcggcaagccgctgccctttagcgaggtgacgggcacgaaagccaaaggcgacaccgcaagcgtaggggattacgtctttggcctgacggcaaaagggcgctacaacggccagccgctgagcggaaaagggaaaatgggcggtatgctggcgctccgcagtgaaggcacgccgttcccggtgcaggcggatttccgctccgggaacacccgtgtggcgtttgtggggacggtcaacgacccgatgaatatgggcggcgtcgatcttcagctcaaatttgccggtgattcgctgggtgagctgtatgaactgaccggcgtactgctgccggataccccgccgtttgaaacggacgggcacctggtcgccaaaatcgacagcgaaaagtcctctgtttttaactaccgggattttaacggccgcatcggcgacagcgacatccacggttcgctgacctacaccaccgggaaaccgcgccccaaactggagggggatgtcgagtcccgtcagctgcgactcgccgacctgggaccgctgatcggcgtcgattccggcaaagggacgaagtcaaaagaggtgaagaaagatctccagccagccgggaaagtactgccctatgaccgctttgagacggataagtgggatgtgatggacgcggac

SEQ ID NO: 86820 - DNA, 236 bp, Glycine max
  Peptide Sequence Number=SeqID_178505
atggctgcccgcaaggttaaactttctggaaagcctggaccattatgtccaatgaagtataaaagactagaaaaagaaattcattttgatcaatggactcccatttggtgtggtgataacataggtctgagatatgaggtccacatgccaaagaaaaatagaaggagatctgtagatgaggacaatgtcacaggacataggctaaagaggaaattggttgagtttacatgtggaag

SEQ ID NO: 86821 - DNA, 192 bp, Glycine max
  Peptide Sequence Number=SeqID_178506
atggcttgcacccatatttcggattcaacaagcaattctcctcaaatttcagccagcccgcatcaattagaccttgcaccttacgcttcagggccctacaatgctcaatggaatgccccggggcttctccatgacaagcacacgttgcgttcgagtcgtatcctcgaaaaaatggagattgaggacacctag

SEQ ID NO: 86822 - DNA, 846 bp, Glycine max
  Peptide Sequence Number=SeqID_178507
atgccgcagggccatatcccgaacgagcagtacaccaaaactcagccgcactcggtagaaatgccaaacattggcaatcagaaactgaccgagtcagacatgtggggtgctacgccgtttgaccagctggcttgccgtattgcttttaaaggcatgcgttatgacggcctgttcaccgtgccggacaccgatgtttcgctcagcttcccgggctcgctcggtggcatgaactggggcagcatctcgttcgatccgaacaaccagtacatgttcgttaacgatatgcgtctcggcctgtgggtgcagatgattccgcaggacaccaccaaatcggctgccagcaacggcggtgaggccatcaacaccggcatgggtgcggtaccgctgaaaggcacgccgtacgcagtaaacaaaaaccgcttcatgtcgccgctgggcattccatgccaggcaccgccgttcggtacgctgtcggccatcgacatgaagacccgtcagattgtgtggcaggtgccggtgggtacggtgcaggataccggtccgtttggtatcaaaatgcatgcgcagatgccggtcggtatgccgacgctgggcggtacgctggcaacccagggcggtctggtatttattgccggcacccaggattactacctgcgcgcctttgatagctcaaccggtaaagaagtgtggaaagcacgtctgccggtgggcagccagggcggaccgatcagctatgtttcgccgaaaaccggcaaacagtacatcctgatctccgcaggcggtgcgcgtcagtcaccggatcgcggtgattacgtgattgcttacgcgctgcccgacagcaagtaa

SEQ ID NO: 86823 - DNA, 416 bp, Glycine max
  Peptide Sequence Number=SeqID_178508
cgggtctctgcaagtcgttcggggttcccgtcacacctagtaaggtgattcgaccgccgatcaccagggccttcatagagaagtactgcacgcctagacaggcgcagggtggcgcacaacaggccccagacacaccgtcgccacctcatcaggctaatccagctgggtcatttgacatggagcagtatttacgacatttggttcgccagcaggcagccaaccacagggcgcatggtttcgctccttttccgtggcctactccagatcagttcagggcagaggtcgcatggcccggagattggcctgagccccaggcaggggaggcatccgtagaggctcccggcgatggagaggaggtccgcatggatgaggtgacagatttgttcgatttcttgggaggcagcggagccacgtga

SEQ ID NO: 86824 - DNA, 171 bp, Glycine max
  Peptide Sequence Number=SeqID_178509
atgttgatcatggctagaacacgaggtttaggttgtgccataggtagacttgtaggcagagatagacatgatgaccatgatgcagctgatgttcccgagaggcgtaggcctactacctcagcccataggcaacgggttcatcagatggctgcggaggacgtgatatgttga

SEQ ID NO: 86825 - DNA, 375 bp, Glycine max
  Peptide Sequence Number=SeqID_178510
atgtcatcaagcccttcgactgctccagttgacgaagaagttggtgatcgtatagaagacatgctacgtgaccacaactatttgttctccacccaagggaaaacacgtgcaatgaagacaataaccagttcttttgaaggcatgtctaatcaaggtgcacctcggtgggttgaacccaagactaatgtgcaaagcggagggtttgagtgcggatattatgtcatgcactggatgtggtgcatcgtgactgccggtttgaaggatgactggcacaagtggttctctgatggctcatcgttagacgtggaggccatcacatcagttcgacagaaatgggcaacttactttttatcttttaggaaaagaagttgttaa

SEQ ID NO: 86826 - DNA, 519 bp, Glycine max
  Peptide Sequence Number=SeqID_178511
atgccggttattgccgctgccgccgaagctgctgctgtgccgccatcgagagccgaaggcggcgatgcagtttcgaatgaaacaattgtggcgtcacgccgttcatggaatatgccgtttgcggccagaccgccggtttcggatgcacggaaaaccgtggaggagtttcccatgatcaggcgggacaagaccagccagcgcgaaacgcgccagcataatcccaatggcgtggaagctgtcgccgatctgattgccagcggtaaggagaagcgcatcgtggttgtctctcccgaaggtgacaaggcatcggcggggacggtgcgtctgttgcgtgaattcgcggatcgcggcaagcgggcgattctcgtggatatgactgctcagggaaccgtaggtctggccatgctgaatgatcgggcgcattgccgatggacctgcttcggtggtgatgagcattgtcgatccggacgacaagggcgtcgcgctcgccgcgctcgacctcgaccagggtggttatga

SEQ ID NO: 86827 - DNA, 531 bp, Glycine max
  Peptide Sequence Number=SeqID_178512
atgggaggtaccgcttccatccccataaaccaagggagtacggcgttgcccccagtagaatttcgtaccgagcctccacagccccgttcatctttggccggtaggggggagtctgtatcgacaaatcaactccctcttgatgaatctgactaccacactcctcgtgacattagtataagaagccgcttcgacccatttggtaaggtaatctattgccacaagaatgaagtggtgaccattcgatgctttgggttagatggccccaatgacatctattccccacatggaaaaaggccaaggagcagacataacattcagaggatgtggcggaacattgacattgtcctcgtatgcctgacatttatgacacttccttacatgagcgcagcaatcgctttccatagtgagtcagtaataaccggccctaaggatttttctggccatagcatgcccattggcatgtgtcccaaaggaaccctcgtggatctcctcaatcatgaagttcacctctttggcatctacgcatcgtag

SEQ ID NO: 86828 - DNA, 168 bp, Glycine max
  Peptide Sequence Number=SeqID_178513
atggagtctcacaacttccctgaaaaatgtgccatcttgctaaacctatccaccaccataaagatagagtctacacctctttgggttctaggaagcccgaggacaaagtccatactattgtctacccaaggtgtagatggtatgggtaagggtgtgtatagcccatga

SEQ ID NO: 86829 - DNA, 210 bp, Glycine max
  Peptide Sequence Number=SeqID_178514
atgtcgcaacctacccttcggcgggagggcaacgcgagactcacgggtgcatcttccaagaaaggaatacgcggagttgccaccaacgtttatttcgaggaaaacgtcggaaaaaccggaaaagacgtggtctacgaacttttaggctttttaaatccacgtctaaccaataaaagcgaaaaagaccatttcaaggcgttggacctttaa

SEQ ID NO: 86830 - DNA, 2997 bp, Glycine max
  Peptide Sequence Number=SeqID_178515
atgactcttgaagatttctttaccttgtctgagatgaaagatgggctcacagcaccttctcgggtgcaggagctggtctctgtgatgcaaaaggagaaagatagtgaggttaaaaatgctgctgatgtgacaaggcagtgggctgctgttgcaagcactattgctgctacagagaataaagattgccttgatctttttattcaattagatggactttgcttcattaatagatggttaaaggatgcccaagattttggggttgatgcaaacgacagcttcgttgaagaatcaatcactgcaatgttacgtgcagttgaaaagctgcatatagacagtgagaagtcaatgtcttcaggaattcgcatcactgtaagtaatcttcttggccatcatagtgctagggttcaggatagagcaagaacgttgtttgacagctggaagggagttggaaatggtgatactgaatctcatgatgtggaacttgctaaggttgacaattcaagtgacaagattgtcagggaggaaacacagccatctgctgcaaatgaagctggcaatgataatgatcctgcatcaggactaattggaagtgagaaatctctgttgaaaagctcggataatttaccggtacatagttctgataatgtgctccagttatctgccagtgtggaatgtattgacatcaaagtgggatcggaaaaccatgttgctggtgttccatcttctgctcaagaagttgctcccgctcatgaaggattgcctatatgcactacaggtgagaccacttcggctggaacctgtaactttcccattccaaatcaaagcagttttgaaggacagtcagatgtggtacagttaagtgacttagctaaagtggaaaagcaggagcaaaacattaatgaccctccagaaaaattaggagcaccagagatctgttctgtgtcctctaataagccagagtctgagcctgtttccatggttgcttgcgaagcaaaagcaccagagtctgtgaaaaacccagctttagagcaaaatgttgaacacaatgaggatgatgtttgtcgtaatttaactaattctgctagtatgaggacacctgcatctgataggagtggggaagatgatgtaactagcattacacaagtttttaaagctacagaaaatgataatgattgttgttctaatgcattgcagggcgcatcagtcagtgacagtaacttgggaaagactgaggtgttagacgtgtctgtctttggaacagaatatgtcacagcatcaaaggaaggcaagggccatgaagaagatacatcaattggttctgattctagtaaacccggaatagatttcagaagctctaacataattgacaagagaggttctgacaatgaacttgactgtggcattgtggatgctttagaatttgctcgaaaaattgctcaggaagttaatagagaagtcagctgttcttcagaaaaagtctcagaacacagaatcaggcaaccatgcagtccagattctgtaagaaaagaggacgagctcactcctgtcccacccaaggaggtttcctccagacaaagccatgctactgaggcatgttcaatggaggggcatgtgagtattttagacaacaatgaggctgagccggaatgcagaccctatgtggtgtccttagaggtgactgaaaaagctcaagattcaggaggtaattcagagaaacgactctgcggctttgatctcaatgaagttggtgctgatgatatggatgtttctgtaaatactatgtctaccccaataccagttgtctctgcttcaaggcctgcaccaactcctgggttgactggggcccctttgcagtttgagggaacacttggatggaaagggtcagctgccaccagtgcctttcgacctgcgtcgcctcgtaaaaattgtgataatgataggaatctttctgttgatatgaactttgatacttccaagcagaggcaggattggcttgattttgatctaaatgtggctgagggtgaagaaggcaatgtaaaacctactgctgaatcttcaggcaggccttctgggcaatcgtcatttgaatttagtcctaaaaaatcaagcaggcttgaatttgatttgaacagtaccggtgatgatggtgacacccaaccttcagatcaaagaatggagggacaactctttcttggaagaaatggctgttggagcccatcccctgcatcgtcgtcctcatcaatgcagccatctgttagaaacattgatttgaatgacaggccgtgccttcaaaccgatttggtagaccagggccccattaagtctgcccatcttatcaatgcatttggttctaaatcatcaaatgctcctgttatctctcttctgggtgccaaggtagaagttggtaaaaaagaatgtgttcctcaaaggttgtctttgcagaatggcaaggctactgaacctgcaatagaactaacaatgtcaagagcaggtagcgttttagggatgaccccaacagtacccttcaatcattcatctgtttttggctataatggagtggcgtcagcatcagtgacacccgcaatgtctttttcatcagccatgtacggatcaggtggcacaattccatacatggtggactcaagaggagctccagttgtccctcaagtgggtggatcttcatcaactgtcctttcatcttactctcagccaccaatctttatgaacatggctggtacacaacttggtctgaatggatttggaccttcacgtcctaactttgacctgaactctagcttcatgattgagggtgggaatagagacacattggctgcaaggcaatttttctttcctgttcagggaagggctgtggaggagcaagtaagatccatgccgcaaccctccagttcgggggttagtgggaaacgaaaagaaccagacagtggtttggaaccctacccatttatctacaaaaatccgcaacctccatggaagtag

SEQ ID NO: 86831 - DNA, 927 bp, Glycine max
  Peptide Sequence Number=SeqID_178516
atgagaggggtgaagagagcagtatttgtaggcagagccctaagaagcaattccaacaccgccgtgtacggtgttggtgccacccttcatcgagatcgaatggctccccatggctgcttaaccccatcaaatccaaatccttctgtttctgttactgggtttagatacctttctgcttctgctgctgccacgtctcttgcccaagacgctcagaccaaggccttcaaacccaaggaacttgtcctctttcagtaccaggcctgtccattctgcaacaaggttgcagcgtttctggactattatgatattccattcaaagtggttgaggtgaatcccataaacaagaaggagatcaaatggtccgactacaagaaggtgcctatcctcaccgttgatggtgaacaaattgttgactcttcagacataattgataagttgatcaaaaggatacatccagattatgacctaaatgctgaagaagagaagaagtggcgacagtgggtggataatcacttggtgcatgtcttgtcaccgaatatatatcggaatgttcctgaagctcttgaatcatttgattacatcaccacccaaggaaatttcagtttttctgagagattagtggcaaagtatggtggggctgcagctatgtattttgtgtcaaagaaattgaagaagaaacacaacatcactgatgagcgtgcagcactgtatggagctgccgaacaatgggttgatgctttgaagggccgaaaatttcttggtgggttggatcctaatttagcagatcttgctgtgtttggtgttcttagacccatccgccatctcaagtcaggtagagatatgctagagcacacccggattgggaaatggttttctcagatggatcgtgtggtaggacagtcttctagggtgagtgagcagagctag

SEQ ID NO: 86832 - DNA, 1107 bp, Glycine max
  Peptide Sequence Number=SeqID_178517
atggagttgtggaacgtggtgtttgtgtgttgtgttttatgttacagtttttgtcacactgcggaggctatcgttaagctacgaggcaatgaaacaataccagcattgattttgttcggggattcgatagttgacacaggaagtaacaataacctaataacggggcttaagtgcaattttcctccttatgggagggatttcgagggtgggataccaacaggaagattcagcaatggcaaggtcccagctgacttcgtaggcatatatgctagtcattcattcgtatacgaagcggaagaattgggaatcaaggaatatatagcaccatacacgagtcctgctttgcagcctggtgatctcctcaggggagtcaacttcgcttctggtggcacgggatatgatcctttgaccgcacaactagtgtcagtcataccgttatctgagcaactagagcaattcaaagaatacataggaaagcttaaaggaaattttggagaagcaaaaaccaacttcatcttgtccaaaagtttagtacttgtggtatcaagcagcaacgacattgccaatacttattttgcaactggagtaaggaaactgaattatgatgttcccaattacactgatatgttggtgcaacaagcctcttctttcgttaaggaattatatggattgggggcaaggagaataggagtgtttggtgcacctccactaggatgtttgccattcgtgcgagcattgtttggaggtctacgaagactgtgctccgaagaaataaacatggcatcaaaattgtttaactctaaactatcttcagagctgcacaagctaaaccaaagtttgcctcaagccaaggtggtgtatatccatatttacgactctttgctcaatatcatccaaaacccaaccaaatatggatttgaagttgctgacaaaggatgctgcggcacagggactgtagaggcggcttttctgtgtaatatgttagatccaacaacctgctcagatgattctaaatatgtgttttgggacagctaccatcccacacagaagacataccagattcttgttggtgaaatcctcaacaaatatacaagcaacttctcttga

SEQ ID NO: 86833 - DNA, 1922 bp, Glycine max
  Peptide Sequence Number=SeqID_178518
atattgccgagcgttttggcatcccggttgcgttggtgatcaatgccaaagccatggcgcagacctttgccgcgattgcttacggcttatatgcattcaggcccgcactcaaacgtgccggtgtgattgccaaccaggttggcagtgacggccatgccaagatgattaaagaagcgctgcctgctgacatcccctggctgggcgccatgaaattcgacgcgcaactgagtttgccagagcggcatctgggcctgcacctagcacaagaaatcacggatattgaccagcgcatagaagctgctgcgcaacttctggggccagacataccattgcctccggccgtgcagttttcagcgccagaacagccagccatcacaccattactgcaaggcaaaaccattgctgtggccaaagatgctgctttctgtttcacctaccaggccaatcttgatttgctcacaacactgggggcaaacattacttttttctcgccattgcatgatgcgcaattacctgcggcagatgcttactggctacctggcggctacccggaattgcatctagagcaactgcaacataaccacagcatgcgcgaaagcttgcatgccactgccgtggcaggaaaacccatattggcagaatgtggtggcatgctcgcactgggcgaacgcttgaatggtcaacccgtgtttggtttactgccgggtcacagtgacattcaacccaagctacaaggcctgggcacgcaacatgccacgtttgcaacgactgacgacaacgcggccagcataggcgcgcacacgtttcactatggcaaatttgaaaccgacctgccagtgattgcgcaaggcaaaggcaaatatggcatggtttttcctgccatgagtttcgcctatccggatgccgataaagcggccatttataaagtgattgccgagcggcgcgacatgcggcattttttgccaacgccgattgcgcctgaattattgcaaaaactactgcaagccgcccatcacgcgcccagtgtcggcctgatgcagccatggcgctttatccgcatcagcgatgccaccttacgccaagccatccacgcactggtcgacgaagaacgcaagcacacagcgcaagcgattggcgaatatgaaaacactgcccgcatggccgaatttatgcgactgaaagtcgaaggcattctggattgtggcgaactgctggtagccactttgtgtgaccagcgggaaaaatatatttttggccgccgtacgctgccggagatggacctggcctcagtcagctgcgccattcaaaacctgtggttggccgcccgcgccgaaggtataggcatgggctgggtcagccttcgccattttgtgcctgggctatgtgaatacgttttacaaatcgcccatgctggtagaagagggctgggcgacggaaaagccactcagcgagatgctgatggaaaacggctggcagccacaaggaaacacacaggcgtgaagcgctggccacaacgcatcgtctgcctgaccactgaaacggtagaggtgttgtaccttctgggtgagcaagaccgtattgtcggtatttctggctttaccacgcgcccggccattgcccgcaaagagaaacccaaaatcagcgctttcaccagcgccaatattgagaaaatcctgacgttgcagcctgacctggtactgtgtttctccaacttgcaggctgacattgcagcctcactgattaaagccggttgccaggtgcatgtgtttaaccagcgcagcctagacgaaaccttgcaaatgatactcaccgttggcgacttggtcggggccagcgacaaagctgagaaactggtaggaacttaccaggcacaactgactgccgcgcgccagcaagccgcagcttggtcacgcaaacccaag

SEQ ID NO: 86834 - DNA, 703 bp, Glycine max
  Peptide Sequence Number=SeqID_178519
cggactagacgtcctcgccttcagaggactagacgtcctagccttcagaggactagatgtcctcggcttcagagggctgcacgtccttgcctttagagggctgcacgccctcgccttcagaaggcctcacaccctcgccttcagaggattacacaccctcaccatcagaggactacacgtccttaccttcatagggctacacgccctcaccttccgaggactacatgtcctcaccttcagaggactacacgtcctaaccttcagaggactacatgtcctcgcctttagaggacaacacgtcctcgccttcgccttcgtagggctacacgccctcaccttcaaaggactacacgtcctcgccatcagagggctgcacgccctcaccttcaaaggactacacatcctccaattcagaggactacacgtcctcgcctttagatggcttcacgtcctcgccttcagagggctgcactccctcgccttcagaggactgcacgtcctcgtcttcagaggtctacacgtcctcatcttcagaggtctacacgtcctcatctttagaggactacacgtcctcgccttcaaagggctacatgtccccacctttagagggctgcacgtcttcgccttcagagggctacgtgctcttgccttcagtgggatccatatccgcaccttaagagaatttaaggtcctctacccttaa

SEQ ID NO: 86835 - DNA, 171 bp, Glycine max
  Peptide Sequence Number=SeqID_178520
ggagaccagtcagggtcacgctgttttggcgagaatgctcaaatcatgcgggatcgacataggcttaaaggggcactcaaactgagtgtatttacccccaaggcctacactccgaagagtctgttagggtctctccctcctgattcaggtccaacccagaaaacattttag

SEQ ID NO: 86836 - DNA, 899 bp, Glycine max
  Peptide Sequence Number=SeqID_178521
atggtccgcacaaagaaaacagaggagatgacgactgaggccacaaaggaaatcgctgagaagattgattcctttgaggagcaggccacacagggatccttcgtcccccatgggcatcaggatgttctcaccgttgctattggacgtccagagcaccctggacgtgtccatgctgctggagccggtgtcaccatcaagcaatactttggatcggctccacggatgtcccgcagctcttcctccctgcctcctgaagaattgcaacagctgacccaacaaatcagggaccagctagaggagtccatcacagagagagtgacgcggcaggtcatggcatccttcagccagattcagtcgcagatgcaatctcagggacttgcaccctctggaaacgatcctgagataggtgactctgataggtgtggcttgtacatagaagcagatcctgcccgcctggttgccatggggagagtttatgagggatccactgttgttcataacactcctttgttgcctggccaagtaaaggtgaatgtggaggaggttacagatgcagatgctccagttcctgtacccactgatgaggtttccttagtggagcaaacacttcacaccttccttgcttggccgacacatctggtcaagtctttatcacagcagctagctgtgtctctgacaaaaccacctccaaagcccgatccggaggtcgatgatccgctttatctgatgacattgaccatcccaaagcttttcctgaggccttatcaagttagatgggatgccaccgtgtttggggtctttaatccagatttccccctctacataaagcacgaagatctctccgaaatcgcacacggtggtcaatgtctcagcatatcagtgttacagttgtggattct

SEQ ID NO: 86837 - DNA, 381 bp, Glycine max
  Peptide Sequence Number=SeqID_178522
atgactaatgcaaactgtccgcaagagtcattgcatttagtctcaaacgggaatctaagattatggaaatctatccactattgctttaagtctgaaggaccctgctattgtgaaggagaggatggaacgttttctgcaggcatcacagttatgtcagcagaacaactcttggagtttgcttggggtttggccaacaacaagaaaccctttttgtggatcattaggcctgaccttgtcatcggaggttcagtgattttttcatctgagtttgtgaatgaaactaaagataaaagcctcatagcaagttggtgtccacaggagcaagtgttgaaccatccttggtggattcttgacttattgtggatggaactcaaccactga

SEQ ID NO: 86838 - DNA, 671 bp, Glycine max
  Peptide Sequence Number=SeqID_178523
cgcaggacatttaccacggcgatttcagcagccagtcgggctaccagtgcgcgaaagcgatgttgcagagccagaatggctatccgccggcgctgctggtggcgaccgattcgatcgcgatcggcgtgctgcgcgcgctgcacgaacacggcattcaggtgccgaggcagatcgcgctgatcagcgtcaacgacattcccaccgcccgctttattttccccgccttgtccacggtgtcgggagacgtgacgtgaataattgggaaaacattgaaaaacagtcggagcaccggttggcgccgcgcgcgagcttcttcagctacgcggacgccgggcaggcgctgagcttcgatcgtaacgccagccggcgtttccaactgctgagcggccgctggcgctttcgcttcttcgagcacccggcgcaggtgcccgcggcattttaccgggagccgatgaacgactggggcgatatggcggtgccgggcatgtggcagctggaagggcacggccacctgcagtacaccgatgagggcttcccgttcccgatcgacgtgccttacgtgccgaccaataaccccaccggcgcctatcaacgccactttacgctcgacgccggctggcaagatcagcaagtgctgatcaaattcgacggcgtggaaacctacttcgagt

SEQ ID NO: 86839 - DNA, 294 bp, Glycine max
  Peptide Sequence Number=SeqID_178524
atggtaaaaaaaatcatacgaaaagaaaaagggggatacgaaataactatagtggatgcattggatgggcgtgaagtgattgatattatacctccaggaccagaacttcttgtttcagaaggtgaatcttcaaactgtgatgttcagcatctaacaagtaatccaaatgtgggtggatttggctcagggggatgcggaaataggagctttgaatgtggggctgttcttattttaccggaaggttttgaattggcaccccccgatcgtatttcgctgagattaagaagaagatag

SEQ ID NO: 86840 - DNA, 779 bp, Glycine max
  Peptide Sequence Number=SeqID_178525
tacctaccgccttaagagggctgcatgccctggccttcagaggactgcacgtcctcgccttcaaagggctacacgtccttgccttaagaggatttcacgtcctcgccttaagagggctacacgtcctcgccttcagaggactacacgtcctcgactttagagggctgcacgtcctcgccttcagagggctacacgccctcaccttcagagggctacacaccctcaccttcagaggacttcacgtcctcgccttaagagggttgcacgtcatcgccttcagagggctacacgccctcaccttcagagggctacacgccttccccttcagagggttacacgccctccccttcaaagggctacacgccctcaccttcagaggactgcatgtcctcgccttcagagggctacacgtcctcgccttcagagggctaggactacacgtctttaccttcagaggactgcacatccttgccttcagaggactatacatcctcacctttagagggctacacgccctcgccttcagagggttgcacaccctcgccttcatagggatagatgccctcaccttcaaaggactacacgtcctcgccttcagagggctacacgccctcgccttcaaaagactacacatcctcaccttcagaggactgcacgtcctcgccttcagagggctacacgccttcgccttcagaggactacatgtcctcaccttcagagggctacacgccctcacctttagagggttgcacgccctcgccttcagtgggatcctctag

SEQ ID NO: 86841 - DNA, 522 bp, Glycine max
  Peptide Sequence Number=SeqID_178526
gtcgactctagaggatcccacattattatgtctgagggtaccattgttgatgactggaaattcgattattcgagtcatgatgcttgtcgcatggtctacaatgatcaagctgaaatgaccggtagattgttggccgggtcattaacttttgataatcgcatcatgcattatatcattatcgactgggcccatttggttcggtaccgaatgcataaggcattacgggccaatgcacctcttccttatccacatttgattactctgtttttgcgtcattttcaaattccgcttgatgatgaaccctttgttcaagtcaagcgttcctttgcaattggtgctggtgccgtgacctcctttgggtatcgtaaagatcggaatggacaatggctgaagaaggatgcactccctcctcaagatgaacgggagatgcttgccgcccagctcgcccaggcgagccaggttgcttcctccagaagcaacaaccttctggaggaatcttctggagggcccaagtgggcctgg

SEQ ID NO: 86842 - DNA, 1400 bp, Glycine max
  Peptide Sequence Number=SeqID_178527
atggataatcaaattcacattgaaaattacaaaattcaaaaacctgagtcgtgggcgggaagtgtagacgatcaacagcttattgaaaagataagagaatcggatttctctaataaacaaattaatgaagggcgggattattgctattttctggacaagatttattacacgagcaatgcggaaagcaatgagtatgtatgcatggcttatacccttaacgaaccttccaatctggagagggcttcagtaattgatgtagtggtcgaagaaaatgaggtttaccatattcatagaatcagtgtattacgagaaggtgttttgatcgataaaataccagatacaaaaattaaggttctggatagtgaaaatcaaagcagcggaggcatcttaagcagtaataagaagattaatattacaataaaagatctgaggctttatgatattctgatccttgaagattccagggtaaaggcttttaccgatcgggattttttaaggaaggaattttctaaatacgtatgggtaagtcctgataattattgggcttacggaagttatcagttcacttttgttaatgaacgtgaagagccggttgcctataaaaaggtatttttcagagatgagcagggaaatgttttaaaacctgaaactcatcatctgaagaaaggggagcgtttcgtgatccgggaagaaaattacatcaatcctgtagatgccagccgtgagatttttcctttcattgattttgcaacagaaagcaactggaaagatctttccaattatatcgctcctatatatgaagagatctataataagtcctcattaaaagattttgctccaaaacttgtcgaaaaactggatgcaattagtaatcaggacgagaaactccagtttgccattgaatacgttcagaataatatctattatatattcaatgctgatgaaatgaatggtcacaagcctcaggaaccgtcagtaacttacgagaataaacaaggggactgtaaggcgaaatgtgttttgctgaaagttgttttggattatattggggtcgattcatccgttgttttggttaattatcatacggattattatatcaaatattatttgccttcgttgctttcattcaatcatgtggttgtgaaaatcaattataaaggagaggaatatttcatagatgctacaatccgtgatgagttcgggatgattgaaaacaggggctttatttattttatgcactatctggaagtgaagcgagatcaggaattacagcagagaaaaccattccgctatccatactattgtatagatgaaaaagtagagttcaatgcagaaaataagaccgggaaattaaaactaacaacggtatacaaaggcaacagggctaacgctatgagaag

SEQ ID NO: 86843 - DNA, 366 bp, Glycine max
  Peptide Sequence Number=SeqID_178528
atggcaagagctggtgacaatggtggtgtatatcatcaactggacgaatctcatcgcttatttctggacgcgtggactacacaaatgcaacgtttgttgaaccgtaacaaagaagagccctacagacgaatagccaaatcttcctcatttactcttaaacctctatcccctagagaagtgtgtgatgaccaaatcagaatgagagaaaagagagaacaagagaaagaaaatagtgaggcaccacaaaggaatatgaaaaagacgagtgatacacccgaggaaaagagtgatacacaagagagagagaatttaaagatgtctttcccaaggagattcctcatggactgccaccttcaagaagcatag

SEQ ID NO: 86844 - DNA, 414 bp, Glycine max
  Peptide Sequence Number=SeqID_178529
atgtcctgcccaatgatcataactccgacctccctctgccgaagtgtcagctggtgtatgccacctaccaggcaccctctagacccagataagtctatcagggccctggggtttccagcgttgatcacgggtctctgccagtcattcgggtttcccgtcacacctagtaagggggtagtgcatatacatgagtgtctctaccagctcagcctcagtcagcagagccagggtttcgctccttttgcgtgccctacgccagatcagttcagggctggggttgcatggcccggagattggcctgaggcccaggcaggggaggcgcttgtagaggctcccggcgatgcagaggaggcccgcatggatgaggagatgacagatttactcggtttcttaggagggaatggagccatatga

SEQ ID NO: 86845 - DNA, 240 bp, Glycine max
  Peptide Sequence Number=SeqID_178530
atgactccaaaacaagtcacgtacaacattatcatccttcagcctatgccagtgaatatactagtcttgatcaagcagcatcataagttgttgcctttcagtgttactccctcttatggaagaacagtaagcctatactacccactcctttcacaagctatcaacaaaaatgaggctcttcctcaaacaccggtattggtgtctgacctcattataatggcaacaaatccaatgtcatga

SEQ ID NO: 86846 - DNA, 444 bp, Glycine max
  Peptide Sequence Number=SeqID_178531
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagcagttcgctccaagctggactgtatgcacgaaccccccgttcagtccgaccgctgcgccttatccgggtaactatcgtcttgagtccaacccggaaagacatgcaaaagcaccactggcagcagccactg

SEQ ID NO: 86847 - DNA, 450 bp, Glycine max
  Peptide Sequence Number=SeqID_178532
atggctccgaagaagctatccatgaagaggtctagaagagacgccgcagcagaagggcccagtgccatccccgagtttgatagtcatcgtttccggagcgccgagcaccaacagcgcttcgaggccatcaaaggatggtcgttccacagagagaggcgtgtccagctcagggaggatgagtatacggacttgcaggaggagatgggtcgcagatgttggacgtcgctggtgactcccatggctaagtttgaccttgagatagtcctagagttctatgctaatgcttggcccacagaggagggactgcgagacatgtgttcgtgggtgaggggtcagtggattccctttgacgcagatgccctcaaccagttcctgggtgacccgctagatttggaggaaggatttcgcccggactgccgcagggaggcgggtgcggatcatgcatactag

SEQ ID NO: 86848 - DNA, 1004 bp, Glycine max
  Peptide Sequence Number=SeqID_178533
gaaattgctccgaaaaagctttccgcgaagagatctaggagggacgccgcggctgaagggaccagtgccgctcctgagtttgatagccaccgtttcaggagcgccgagcaccagcagcgtttcgaggccatcaaaggaaggtcgttccacaaagagagacgcgtccagctcagggacgatgagtacacagattttcaggaggagatagctcgccgacattggacgtcgctggtcactcccatggctaagtttgacccagatatagtcctggagttttatgctaatgcttggcccacagaagagggagttcgggacatgcgatgccctcagccattcctgggtgacccactagtgttagaggaaggccaggagtgcaagtttagtcagaggaggaacagggctgatgggttcgacgaagaggccattgcccagctattatgcacaccggggcaggattcgcccggaccgctgcagggaggtgggcaccctctagacccagataagtctaacagggccctggggtttctggcattgatcacgggcctctgccagtcattcggggttcccgtcactcctagtaaggtgatccgactgtcgatcacccgggccttcattgagaagtattgcacgcctaggcaggcgcagggtgatgcaccgcaggccgcagacgcaccgccaccacctcatcaggctgatcccgctgggtcattaggcatggagtggtatctacaacacttggttcgccaacaggcggccaaccaccgggggcaggtgcagatacatgagtgtctctaccagctcaacctcagtcagcagggccagggtttcactccttttgcgtgccctactccagatcagtttatggttgaggtcgcatggcccggagattggcccaaggcccaagcaggggaggcgcctacaggagctcccggcgatgcagaggaggcccgcatggataaggagatgatgaacttgctcggtttcttgggaggaagcggagccac

SEQ ID NO: 86849 - DNA, 643 bp, Glycine max
  Peptide Sequence Number=SeqID_178534
atggcagaaccatcaaagaagcgaaagggcacttcaagtcggagtcaacgacattccgggtcacaggaaacgccaattccttcctccattccctctggatcattgttttcatcaaaggaacaacggatacagtacacaaacctcttttcctctcgttccattattaacccaaaattcatagatatggatttcttttcaaatgagagttttgaatgctttcaagcatttgaaaactctaatcttatcccattcatgtctttaaaattacctatttattctgatctagtcaaagtcttctattcaaacttagaaatccaagaaggtaccctaatgtctgaggtttatgggattaagatggtcattgaccagtccctattctatgatttaacccaattgccaagtgaaggtgtaccatttgaaggtgcattgattgacgattggaagtttgaattttctgtgcatgatgtccgccggttggtttgcaccaaccaagaaaatatgaccggaaggcttctttccggttcattggcttttgaaagccgcatcctccattttctaattgttcacatcttgcttccgagatcttcaaaccttgcacaggtttctgaagaagatctcattgttatgtgggcctttcataaag

SEQ ID NO: 86850 - DNA, 576 bp, Glycine max
  Peptide Sequence Number=SeqID_178535
atgactcaagagctggtagcccgcggagacaccttacggttatccgcacctcgtcattcagtgaccccaagtgtgattgacgagcagagaccaatatggtcatctgcgccctttccagagatgtcatcaatttccgatggagacttttcaagtctcacaagttatccagaactacgtaggtctgagttcctcattggaggatacgtaggagcaagagcctcgcttttgtcgaccataccgccttttgttgccatgactcaagagctggtagcccgcggagacaccagaccaatttggtcatctgcgccctttccggagaggcatcattttccgatgatacgcggagacttttcagtctccagttatccagaactacgtagtctagttcccttttcattccagaggcggaggcccgatgacaagcagagaccaagtttggtcattctgcaccgccttgtatcatccagaggcggcgggcccgatgatacgcggagatacccgagtggttatccgtataaacattcttttgctatctgtaagaccagaacgcttgatagcatgcagaggctgacatag

SEQ ID NO: 86851 - DNA, 409 bp, Glycine max
  Peptide Sequence Number=SeqID_178536
atggagcttacatcatctggtgtcgcccgtgtcatcctcttcgtcgcaactcctctattcacagttcataacattcgtgatgcaatcctaccccgcaaggtagagcaacaacttaaaaggaagtctacttcaaaattttatggctctcactcttatccaaagaaagaccaaggtcaaggcatcttaggggtgacaccttctaagcccaaagatgataaggggaagacaatagaaaagcaactccttaaggctagtatgcaggagaagactagctccatggagtgctttaaatgtcttggaagaggacacattacttctcaatgccccaccaagaaaaccatgattatgaggggccaagacatttatagtaaccaagatgatgttactacttcaccttcctctagtgaaa

SEQ ID NO: 86852 - DNA, 219 bp, Glycine max
  Peptide Sequence Number=SeqID_178537
atgggtgcgtcttccaagaaaggaaaatgcgcggagttgccaccaacgtttattcgaggaaaacgtcggaacaaccggaaagaccgaagaacgatgaagaacgaacgaagaacgatgaagaacggtgaagaatcttcacgaaatcgctcactgaaacgtctcagaagtgttacggaagcgcttcggcttcgagagaatcctaaataccaaaaaggctga

SEQ ID NO: 86853 - DNA, 228 bp, Glycine max
  Peptide Sequence Number=SeqID_178538
atgtcctccattttatgttttgtaggacttcaaggtcctttgtttgtgtttggcaccggttgtagtgcaaggcccaggggtcgctcagggttgatgattgattgtcagattcgaaaacaaaagccacaaggaaagtggcaaaatggttattttctggaactttctagacctaaactcacccaggccaacatttggctcacctgggccatgggaaagcttcagccttaa

SEQ ID NO: 86854 - DNA, 198 bp, Glycine max
  Peptide Sequence Number=SeqID_178539
atgaagttatttggtggcccaagcgagctagaggctagcctgggcgagctaaggtctaggaaaaccaaggaaaagacccttttgccccctttttttgaaggaggtagaatcatagtaactgggacaagttttccagccggggatgcaacggaaggttgcaccctcccgcgaaggcgagaagagctaggttccctgtaa

SEQ ID NO: 86855 - DNA, 528 bp, Glycine max
  Peptide Sequence Number=SeqID_178540
gacttccagctagtgccgactgtgaaagagtttgaagaaatcctgggatgcccactgggaggaaggaagccatatcttttctctgggttctatccctccacgacaagagttgccaaggaaagggaaaaggcttggcaaatcaaggcgaatgggctttcttttattgacatcttggcgcttttgatctttggagttgtcctctttccgaatatggaagggttagtggacctagcagcgattgacgctttcctcgcctttcatcatggcaaggaaagcccggtcgtcgccattttggccatgattctatcttcatgcgaaggatgtcccatgagaggagtgccatcagacgaaagcatcatgcctttcatcgcacgaggtttcagtgaccacaacgcaagggtactccaaggagttcgcaaggcatgggatgcggcggcagcaatagtgagctcaagctctgaagaggtgaaaggaatcatcacgggtcaaaggcatgatcttgaaggacgagctaaaggtttgccttag

SEQ ID NO: 86856 - DNA, 1031 bp, Glycine max
  Peptide Sequence Number=SeqID_178541
atgaagatgaaatcactcgcgctgctggtcaccttagccgccgcgccggcttttgccgccccgttgcagttagacgtgtataacccacaggaacagggaatttttccggtctcgtcgacgctggtctccggtccgcatgaagcgattctgtttgatgcgcagttcagccccaaagatggcgagaagctggtggaactgattaaagcgcgcggcaagcagctgacccacatcgtgatcacctcgggcgatccggatttctacttcggtcttgagccgctggtgcaggcgtttccgcaggccaaaattgtcgcctcgccgctggtagtggaacatatcgaagcgaccaaagatgccaagctgcagtactggggaccgcagatgaacggcgctgcgccacaccagctgtatgcaccgcagattacccaccagacgcggtttagcgtcgatggtgagcgcatcgagctgcgccatgcggcagaaaaatcagcctacgtgtggattccctccagtaaggcaatactcggtggcacagtggtggattcaggcattcacgtctggaccgcggacacccagaccgcagccagccgtgcagagtggcgtcaggtattgcgagaaatgcagcagttgaagccgcaggtggtgatccccggccactatctgggtgcgcgtccggcgggcgataaagcggtcacctttacgctggattatctgcaaagttttgagcgggcgctgcaacagcacaaaggctccgcggcggtgattcaggcaatgaaacaggcgtggccaaccttagcggatgtcagctcgctggagctgagcgcgaagatgggttttcagctcttccgccgcctggcgaatcgcggtgcggaccgccggcacctcgctcagcggattgagcaggccgtagtcatgaatcagaccgttatagcgcgtcacggtgacatccacaccggcggcatccagtttgcgaccaaaggcttcaccctcatcacgcagcacatccagttctgccgtctgaatcagcgttggcg

SEQ ID NO: 86857 - DNA, 279 bp, Glycine max
  Peptide Sequence Number=SeqID_178542
atggaagaagcggaaaaggagatcttggagaccttcaggaaagtagaggtgaacatacctctgctagatgtcatcaagcagattccaagatatgccaagtgtcgcaacctaaccttcggcgggagggcgacgcgagaatcacgggtgcgtcttccaagaaaggaaaatgcatggagtcaccaccaacttttattcgaggaaaacgtcagaaaaaccgaacaggaaatcagacctacgtgtcttctgacagcgatagcggtatctctagcggttccctga

SEQ ID NO: 86858 - DNA, 321 bp, Glycine max
  Peptide Sequence Number=SeqID_178543
atggtgcgttacgcaccttcaagctttgtggatttggtcttcatcgatgaaaggatcgaagtgggtctgaaaagaggcaaatttaatcatcctgcttggatgaatgagaaaattggggtaaatgaagagggtgagaatgaaggagaaacccatgctacgattgtcgttcctacatggaaacttcccaccagccaaacaatgtcattactcagccaatatcagcccttctcattacccaccacccagtcattcacaaaggccatccctaaatcaaccacaaagcctgtctaccacacttccaatcacgagcaccacctttag

SEQ ID NO: 86859 - DNA, 231 bp, Glycine max
  Peptide Sequence Number=SeqID_178544
atgcgatctttgcttgaccgcttcaaggggaaagagggtagagcaaattcgttcaaccctcctggtatctgggattcacttaaaattagtgagaaaaattgtttccgtgaagaaaatccaagtcgaggcgcttccgtaacactttcgagacatattcgtgggcgatttcgtgaaggttttccaccgttcttcatcgttcttcattcgttcttcatcgttcttcggtcttga

SEQ ID NO: 86860 - DNA, 180 bp, Glycine max
  Peptide Sequence Number=SeqID_178545
ccggtgtccattgagcttgaagctcttatctgtggattcacttttgatctcaactgtaccataaggaaaaatgatcaagctgatgttttgatgatgccaaaggatcacatgcgtctcaaagctttattcaagacaaagaaattaaagatattcaagatggatgatcaagacagtttttag

SEQ ID NO: 86861 - DNA, 126 bp, Glycine max
  Peptide Sequence Number=SeqID_178546
atggcctttgtggataactgggtggtgggtaaggaggaggaatggcagtcacagcatgggtttctccctctttctcaccctcttcatttgccccagttttctcagtcgtctaagcaggatgattaa

SEQ ID NO: 86862 - DNA, 462 bp, Glycine max
  Peptide Sequence Number=SeqID_178547
atggcgttccagcggcgcggtgaccgtggacgccatggttgccgcatcggcaccagattggctggcgtgcacgaagatcaccggaatctcgatgttcggcagtgccgacacgcccaggcgcaggtagcagatcaggccgaccatgaacaggccgatggccagcagcgcggtgccgatcgggcggcggatgaaggggccggacaggttcatcatcaccggcgtggtgtacagggtcaccagctgcgacagcagcaggccgccgacgatggcgatgcccagcgggcggcgcagctccgagccgatgccggtgcccagcgccagcggcagcgcgccgagcattgccgcggcggtggtcatcatgatcggacggaagcgcagcaggcaggcccggcagatcgcttcatgcgcattggcaccggcgcggcgcgcctcgatcgcgaagtccaccatcatgatcgttga

SEQ ID NO: 86863 - DNA, 315 bp, Glycine max
  Peptide Sequence Number=SeqID_178548
atgaccacctcacacagaatatggtcactcgctttcgttgtcaagactatcaaagtcccgttatcatccagagacaagaaagtccgatggcatgcgaggacgatgatgttccttttgctatctggagacaatcaagtccaatggcacgcagatacaaacatagtcatctacttcccttgtcgaaagactcaatgtctatcgaccaaagctactagagtctcccctgctatcctgagacaagcaagtccggtagcatacggagaccatcacggttatccatttttatcgattttaagacaccaaggcttttgttga

SEQ ID NO: 86864 - DNA, 279 bp, Glycine max
  Peptide Sequence Number=SeqID_178549
tcttcagtgcttcattcacaaccaaagtcaactgtgggaactcctgcatatattgctccagaagtattgttgaaacaagagtatgatggcaagcttgcagatgtctggtcatgtggagtaacgttatatgtgatgctagtgggagcatatccttttgaagatcctaatgaaccaaaggactttcgcaagacaattcagtattccattccggacggtgttcaaatatctccagagtgtggccaccttatctcaaggatctttgtttttgacccagcagag

SEQ ID NO: 86865 - DNA, 423 bp, Glycine max
  Peptide Sequence Number=SeqID_178550
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatccagctgggaaattggcgggtggaggaacgccccggcatttacgcaacaagcataat

SEQ ID NO: 86866 - DNA, 369 bp, Glycine max
  Peptide Sequence Number=SeqID_178551
atgggtgaagtagaggaggcgcaagagcaaatgaaggccgacacggaggccttgaaagagaaaatgaccacaatgatggaggccattatgagcataaaggagataatggaggttagtgcggcttaccaaacccgtgctagagctagagtaatgagtgaagtagaggaggtgcaagagaagatgaaggccgacatggaggccatgaaagagaaaatggccacaatggtggaggccatgatgagcatgaagaagataatggaagctaatacgattgtagttgccgctaccagcgctgttgttaagtgtctatgcctatatgttcttggtagaagtaggaatagtgggggcaagatatacgggataggctaa

SEQ ID NO: 86867 - DNA, 478 bp, Glycine max
  Peptide Sequence Number=SeqID_178552
gcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccgtcatgcgccggttaaggctaaactgaaaggacaagttttggtgactgcgctccctccaagccagttacctcggttcaaagagttgggagctcagagaaccttcgaaaaaccgccctgcaaggcggaaactgccggaaatcgtcgtggtattcactccagagcgatgaaaacgtttcagtttgctcatggaaaacggtgtaacaagggtgaacactatcccatatcaccagctcaccgtctttcattgccatacgaaattccggatgagcattcatcaggcgggcaagaat

SEQ ID NO: 86868 - DNA, 357 bp, Glycine max
  Peptide Sequence Number=SeqID_178553
atgcctcgtagatcttctctggcgaccttgcctgccgatatgacaatgatgatggcccgggagatgttggggaatggttacgagcccggaatgggtttaggcaaaaacaacggcggcagaaccagcctgataagcaccagaggaaaccgtgggaagtttgggagctttataagcgtgagactaagacacgaaggccaagtcgttgcaatatgcgaggatgactttccgaatgggtcagatctggtaataatacctgggaaccgatcatcgatttcaagcaagaaacggatcagacggagagtgaagaggacgaagatgtgggacttccccggagttggagaagatagtcgcccatga

SEQ ID NO: 86869 - DNA, 180 bp, Glycine max
  Peptide Sequence Number=SeqID_178554
atgaattgggttcgttggaaacaaatctattcgaccgatgtaagcaatgcattcggggaagtagtggaggttatcggccttgccccaaatgacgagccagacagagggtttgatgtagaaggagcggaggaaggcagggtcgagggcgtcgggggtggcgatggcatgccaccgatctag

SEQ ID NO: 86870 - DNA, 468 bp, Glycine max
  Peptide Sequence Number=SeqID_178555
atgggtggtggtgcatggccgttcttagttggtggagcgatttgtctggttaattccgttaacgaacgagacctcagcctgctaaatagctatgtggaggtaaccctccacggccagcttcttagagggactatggcccgcttaggccacggaaagtttgaggcaataacaggaattcctagtaagcgcgagtcatcagctcgcgttgactacgtccctgccctttgtacacaccgcccgtcgctcctaccgattgaatggtccggtgaagtgttcggattgcggcgacgtgaacctgcggaaggatcattgtcgatgcctcacaatcagattgacccgcgaacttgtttattcatctaccgtcgggagggaggggatgaccacggcgccccgtgcgcccggcctcctcgtcctcgcgacaaacacaaaccccggcgcttcgtgcgccaaggaactcaaatctgttaa

SEQ ID NO: 86871 - DNA, 213 bp, Glycine max
  Peptide Sequence Number=SeqID_178556
atggagggtacatcctatgtggtacaagtagagggtacatctacttgggtgttcaaagagaacaagggagggtacatcccttgtggatctttggcttgtaatggatttcacaaggttgaaagaaatctcaagaaccagttggttgcttggggactggataaagtctttgctttcaacgatggcaacttcaaagatggtgtagaaccaaaatag

SEQ ID NO: 86872 - DNA, 444 bp, Glycine max
  Peptide Sequence Number=SeqID_178557
atggagaggaaggtgcttgcggatggatgggatgctactgatgggacggggaccaagcgaggggaagcaggggctggaacggcgggtagctctgggtcaatggctgaggctggtaccggtggtgcaaatgcaaagcctgctgttggtgctacttccactgctggtgttggtggatcgactggaggatctaaaactgttcctgcctgtgtctccaccacccatgctgctggtgggggttatgcttcaatgggttccgggctgttcctatcgatcttcctccctcacgaggctctcgatcctgagggtcagaagcacgatcacgaagatactagtgggggtgcttcttctggctcagatgctgctggttctgaaaccggtagtggtggtgtgagctgggtcttggtcatgaaagacagaaacctctctaaaggcggaatctcgacg

SEQ ID NO: 86873 - DNA, 597 bp, Glycine max
  Peptide Sequence Number=SeqID_178558
atgtcgactccgccgcccatgctacctccgtcgcccatgccgactccgtcacccatgccgactccgtcgcccatgccacctccgccgtccatgctgcctccgcttcccatgctaactgcaccttcgtgtcctgcacccgtgcaaccattccttccaccattgtcgggtccacttcatataactgttcttcatctgcccaatctcggtcttgttcgcaccaccatttccttcaacaagctcttcagcattgttcctctttatggaactgccatggctgcatacaagctccaactagttgcctttgcattatgcacaattgctaaaccaggtgcaattagccggaatagaccttgggatcccggtctcatctctcttatacctctggaggcactgattcctcgaaaaccagatatccttggcacgaagcacctaacatttgatagcaattcaggggtgcagtcaaaagtcaaccaacaggaggcgcatatagttagaagcaagcccaaaagaaacaacaatacactagcttacctgaaggattttgctgagtatgcattcgaatcttccttcccagcaccagaatctgcagtgccttag

SEQ ID NO: 86874 - DNA, 434 bp, Glycine max
  Peptide Sequence Number=SeqID_178559
atgagtgcttctagtactagtcaagctaaagaacaagatgatgataccaaacctttatggacctatgttacaaagataaaaagtgtagttggtggtggaaattatgagataaaatgcaatatttgtgattttacctttaatgggtcttacactagagtgagggcacacttgttgaagatgacaggaaagggagttagagtttgtcaaaaggtaacagttgccaaacttatagatttgaagaagatagacaatgaggctacattgagggtggagaggtcaaaaacaaaatatgtgtcattgcctccggtttctactcaacaccaaatggatacaaacactcttggtgttgatccaaaaacgagaaagacatcatctgtagaaaatgcctttaatttgcaagctagagagacacttgatcatgaaattgctaggat

SEQ ID NO: 86875 - DNA, 318 bp, Glycine max
  Peptide Sequence Number=SeqID_178560
atggaggcgcttgtgggaagaagaaggagaagacacagaacggcagaagaggtgtcttcctgttcaaccgcgtccggtgacggcggaggcgacggacaccgcgtcgcaccggagtcgtacgcgcatgcgtgtctggaagccaccttctccgagctggcgcacgatgcggaagcagttctcgttgatccaaacatcacctccgccgttcacggagtcggcgcgcgacgtggtgccgtagggggcggagttgatgttgtgttggttgttgttgacgattttttcgattgttggtatagagttgagaagaatgcagcgtaa

SEQ ID NO: 86876 - DNA, 267 bp, Glycine max
  Peptide Sequence Number=SeqID_178561
atggaactagctctttctttggagaagttgacaaatgagaaacttctgcatgtggcagatcgtaacaatgatcctcaactagcagacttcattgagagcgagttcttgtatgagcaggttaaatcaattaaaaagattgcagagtatgtgactcaactgagattagttggaaagggtcatggtatgcaaatatcctcttcatctagccaaaaagtgtgtggcactttgatcaaaggcttcttcatgatgaagatctataatctttga

SEQ ID NO: 86877 - DNA, 783 bp, Glycine max
  Peptide Sequence Number=SeqID_178562
atggctcaagtggtcctcaaaagtccgactataaatgagtatatagtcaaagaagacgatgatgaacctacggaggtcgggaaggaggcaatgagtgaggggttatcgagatatggaagtaagcactcgcaccctgtttccgtattaaacgacgaagctgaggcggggtatggagataggagcaagatcagtgtccccttggaactcgacgagggtcttgagccattgaacaccgatgaccacattggcaccacaaatgggcagtacgtggaggattacctcctcttcatctgcaatgaggagaaacacgtgagaggcacacttatgcccgcgatggaaccgcttatcgcagcaaaagagaagaagggggccttgctgacggcaacgagggagtggaggactattgaccatgacccagggagcatctgtcaagaagcttctcctcctgaagtcgggctaacctcaaagcatcgatgggatcgtcatactaggacggtgcgaaacgcgtctatagagcttggaggaaaattggccaagaatggcgtggtactcgaagaattggttgatcttaaagatccaaccaaggggatctgtgccatcaaaacagatggagtggcagtagaagatgaaggtgaagggaaggaggcttcgggtggagcgagtttatggatttattcgccaagcttcagggtcatggtgtgtaaggtttcactcaacgataactggtgggtattgagtttagcaatggcgtcctccaaactgtctaaagaaaccttcgacctg

SEQ ID NO: 86878 - DNA, 678 bp, Glycine max
  Peptide Sequence Number=SeqID_178563
atgcttcaaattgtggacattgctttcaacaattttagcggcaaactgccaggaaaatttttcggaacttggaaaagaaatgtaacacataacaaagatgaagctggaccaaatttcatagagaagaaatatttactatacacaaatgtatattatcaagatagtgcgagtgtgacagttatcaacaaaggtcaagagatggagttggttaaaattttaacaattttcacatccattgatttgtcgtcgtccaaccattttgaaggacctataccagatgatttaatggatctcaaaattctccatatcttcaacttgtcaaacaatgatctgtctggtgaaatcccatcatcgataaataacttgaaacaattggagtccttagacctttcacagaactctttgagtgtgaacctaaagctaaaaagcttcgagaaatggaatgctcctgaggagaactgtagagaaggacggcgaggaagattgaagttcttttcggagaaagaaaaccaagaaacacaacaaccacaccccagagaagaaccctcactgtgtcgtcgtggtgttgccagggaaggacgcagggggccgtcaatttcttttgttgttgtggtgttgtcagagcataagcccgttgaggccgcgcgacacagagtggagaagaccatgaagtggtaa

SEQ ID NO: 86879 - DNA, 290 bp, Glycine max
  Peptide Sequence Number=SeqID_178564
aaccttacggattacataatcatcccttttttgccttccggaacgtaacgaaactttacggattgcgcactaacacttcctttgaatttctggcatgtcacggaacttcacgggttgtgctacagtgcttttcttttggcttcctgcatgtctcggaacttcacaaattgcctaacgatgggtgccaaatacctcgaagtggtcaaaacgagggtcgcatcccaacaaccgatggtccccggatgaaattagggtatgacaaatatcaacaaatacaaagtaattggtga

SEQ ID NO: 86880 - DNA, 492 bp, Glycine max
  Peptide Sequence Number=SeqID_178565
atgtgggcttttcataccggccgacaaattgattgggcacacttagtacgatatcgcatgcataaggcattgcgattaaatgctcctttaccatatccacatttagtcactcttttccttcaacactttaacatccctcttaattatgaaccttatgttccaatcaagagatccttcttgatcggtgctgctgtgattgcatcttttggttaccgtaaagagcgtgatgactcttgggtaaaaaagggtgctcaacccaatgatgatgaaggacacttaccagtaggagaggattcctctctccttcaaagtattttggacaggtttgatggacttcaaacctatgttggtgaaaggtttgatgctttggaacaacaagtggacatgcaattcgacgagatggactcaaggatcaccaaggttgaaggagatgtcactttcatccgcacatgctttgatctaccaccaccaccaacagcagcatcatcttag

SEQ ID NO: 86881 - DNA, 549 bp, Glycine max
  Peptide Sequence Number=SeqID_178566
atgagtcatcattcatctagtgttaatggtgagggtactagtcataaagaccctctatctagaatcttagatgagttgagttccctcaagttatggaaagaaaaactagaaaaaagaaaaaggaaaagagatggaaggcataggtcacatcttagacctcactcccataggagagaaaaggaaataaagcctcaagaggctaacattaacctcccatacttccatgggaaggacaatgtagaggcttacttagattgggaaataagggtagagcaacaacttaaaaggaagtctacctcaaaatcttatgactctcactcatacccaaagaaagaccatggtcaaggcatcttaagggtagcaccttctaagcccaaagatgataaggggaagacaatagaaaagcaaccccctaaggctagtatgcaagataatactggctctataaagtgctttaaatgtcttggaagaggacacattactactcgatgccccaccaagaaaaccatgattatgaggggccaaggaatttatagtagccaagatgag

SEQ ID NO: 86882 - DNA, 492 bp, Glycine max
  Peptide Sequence Number=SeqID_178567
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcgggtttaccgggtgtcattccgctgttatggccgcgtttgtctcattccacggccctgacactcagttccgggtaggcagttcgctccaagctggactgtatgcacgaaccccccgttcagtccgaccgctgcgccttatccgggaactatcgtcttggagtcccaaccccggaaagacatgcaaaagcaccactgggcagcagcaactggtatttgatttagaggagttagtcttgaagtcatgcgcccggtttaggctatactga

SEQ ID NO: 86883 - DNA, 306 bp, Glycine max
  Peptide Sequence Number=SeqID_178568
ctgtccctcctgtcagctactgacggggtggtgcgtaacggcaaaagcaccgccggacatcagccgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaa

SEQ ID NO: 86884 - DNA, 330 bp, Glycine max
  Peptide Sequence Number=SeqID_178569
gatgtgcgcaagaaggcacaggccatccagaagcagaatactgccccccacattttgtctcgtgggggttatgattatttggagcaaaagctcctggttgagaagatgaagaagaagctggaggaagctgcacagttaggaactgttgatggcatcatcgaccctccatccccggattcctttgaggagcaggccataaagggatccttcgtcccccatggacgtcaggatgttcttgccgctgctattggatgtccagagcaccctggacgtgtccgtgctgctggagtcggtgtcaccatcaagcaatactttggatcggctccatga

SEQ ID NO: 86885 - DNA, 300 bp, Glycine max
  Peptide Sequence Number=SeqID_178570
atggagaacaacgatggtttttggtggctaatggtggttgtgggtgatggagaaagtgcttggaacattagaaatggctttggaagaaagaaagaagaagaaatgacgtttttcctaagctacacgaaagcaaaggctgaaatcgtggccaagtgtcttgtcaagctgcagaccaaatttcgagaagatccaacggttaaagaaggctgggtagtgtttttaccgaggcagctacatgtagcttcctcaagaagcttcattaagaggcttcttcaagaagcttccccgtggcttctttga

SEQ ID NO: 86886 - DNA, 201 bp, Glycine max
  Peptide Sequence Number=SeqID_178571
atggaggattgccttgagggtcctcacttaggcaatcatgtaacacaactccaaactcgaaaatggaggacacatgaacgaaaacgcaattcatgggctctgaaaaaggggagaatggaggatttccttgaggttcctctcttaggcaatcatgaaacacagctccaaactcgaaaatggaggacacatgaacagccctaa

SEQ ID NO: 86887 - DNA, 276 bp, Glycine max
  Peptide Sequence Number=SeqID_178572
atggtggcgactccgcgcgtattcctttcgtggaacacgcatcccgcgagtcacgcgtcgccctcccgccgaagggtctccgacttgcttgattacagtgaaccctcatctagagtttttctctttgaaaacatattgttgctagtagtccctactgctgcagtatgttcttcgaaggggatgatacctctagaaaccatcaagagagatatgactaccttgggggttattactaaaagcctagttagctctctcccttataggtcccttaaatag

SEQ ID NO: 86888 - DNA, 195 bp, Glycine max
  Peptide Sequence Number=SeqID_178573
atgcgtgttagcagctcaacagtgagtgacccttctttcttaggagaccccaccgttcctccttccgagggcaaggatggaaattctcatcctaggtcaaggtttatggtgagttcagattttggctcaaggcttgtagaacgactggacatgatgtatgtcagagtgttggtttggccaacgtttcaaggataa

SEQ ID NO: 86889 - DNA, 471 bp, Glycine max
  Peptide Sequence Number=SeqID_178574
atgaccatgattacgccaagctcgaaattaaccctcactaaagggaacaaaagctggtaccgggccccccctcgagctgctcggtgtacgagggatagggatagggctggaagtcgatgcgccgcttggtgccagccatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagggggggcgggtgtggtggttacgcgcagcgtgaccgctacacttgccagcgctga

SEQ ID NO: 86890 - DNA, 630 bp, Glycine max
  Peptide Sequence Number=SeqID_178575
atggatacaatctgctcatgtccggcgttcaatgcaggacgaagcatatggttgcctggttggttaaacgctgttaatgagaatagtaattctctattcttaacaatagggcctggagacttcttggttcatcatgctattgctcttggtttacatacaactacattgatcttagtatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccgggcggtgcttttgccgttacgcaccaccccgtcagtagctgaacaggagggacagctgatagaaacagaagccactggagcacctcaaaaacaccatcatacactaaatcagtaa

SEQ ID NO: 86891 - DNA, 383 bp, Glycine max
  Peptide Sequence Number=SeqID_178576
tggatggcataagaaatcagttgagccacgtgaatacttacctatgttacgatggcatgaccttgctgggggggaatgggcacccggagggactgacaaaggcccacaaccagagctggaaactccagggcactgttggacttctccgggtccacttggtgttttgtgggcggggagatcggcattgtggtcgccgggcggaatgttgctaagtagcaacgtcatctatatctgtgtaagagtggtcatgttggtgcgcatgatccacactcgtctctttgcagcggcacaggtgaaatcttgccctggtatgcatagtagctacgcgatagcctcctcctctggttgtgcccgcacaattggcactcctcaaggatcagagg

SEQ ID NO: 86892 - DNA, 365 bp, Glycine max
  Peptide Sequence Number=SeqID_178577
tgtgccagcgactacatcgactagttcttctgcatttcgcatccattcatgacaccgggccagccatcagatcctcgggcagatggtcatgctacgtagcccagagttgccactccggatccagacatagatatccgtccgatcacggagccaacagcaccgtcgacatctgcaaggtccgatgtggccgagccgagacatgcaatgaagcttgccatgcgattgcggagaggttggagagccatctcaacctaggggtggtcacgccagacacatcgacacatgagctgattgccaagagtgtcacacaagaccagctagtttatgttaggtctcgatgcaagcggcacacagatcagtcgtag

SEQ ID NO: 86893 - DNA, 270 bp, Glycine max
  Peptide Sequence Number=SeqID_178578
atggaggtttacaattatgaaagtgatgagaacatctctcaagaacgaaaaacaaggagaaaaaacatgatcctcatctttgaagatctagacactttaatcttgaaaaagaaccatcgaagaaggggaaaggcacttcaagttggagtcagcggcattctgggtcacaggaaaccccaattcctccctccattccctctggatcattgttctcatcagaggaacagcgtatacggtacagaaacctcttttcctctcgttccattataa

SEQ ID NO: 86894 - DNA, 303 bp, Glycine max
  Peptide Sequence Number=SeqID_178579
atgaagatcatgagtttcgttgctggtaatcgattacagacatatggtaatcgattacatgttgaaaattcaaattcaaaacctttttcaacagctatttctcaaccctgtcttctggtaatcgattacacttcctggtttacccgtgcatggatccttcgattcataggaggtgtcctctttgttaacaaaagcagtagcagagtttccttaaggtacctacaatttttacgtgactttgaacagtgcagcacgtatgcgtggggacctgccgtacttgtgtatttatatagagagatatga

SEQ ID NO: 86895 - DNA, 250 bp, Glycine max
  Peptide Sequence Number=SeqID_178580
atggagagaagccataacttcaacaatgggaagagatctcaagaagtttctccaacacttaaatgctataagtgtgatcaactcggtcacataaaggcaaactgcccctcaaatgagtcatggcccgagaagaatgagaagaaaagctataaagaaagaagatccaagaaggcgtatattgcttgggacgacaatgactcatccgatagttcggagaaggagatcaaccttctatacaaggactatgaaa

SEQ ID NO: 86896 - DNA, 300 bp, Glycine max
  Peptide Sequence Number=SeqID_178581
atgcgaggttaccttatggttacccgcaccttttgtcacccaggggcaaacgagcccattgacgcgcggagactaatatcgtcttctgcaccttttgtcatccagggacagcgagtcaggtggttttactctcgtcgtccgaaaacattcaagcccaacgacgcgcgagattcttctttgctggccagggatgatcgagtgcaatggcgtagggaagtgtcgtggttgtccaactttgtcgctttcaagacactgaagtttgttgacgcttctgatgccttttcttttctttctgaatga

SEQ ID NO: 86897 - DNA, 300 bp, Glycine max
  Peptide Sequence Number=SeqID_178582
atgggggagaatacatgtcacactcatttcaggacttcttgcaatccaatggcattgtatcccaaaggagaaccatctcctaaacctctcttgacctacagcagacgtagcactgcaaaccaaaatcaacagacagaacctcaagggccccctcaagataattccttggctgctgatccagtagaagaaccagaaccagctcctccaagacgcagctcacgcattattaagcccccagacaggtatatccattccatgacagcctcattatcctctattcctatccccttcctcttatag

SEQ ID NO: 86898 - DNA, 423 bp, Glycine max
  Peptide Sequence Number=SeqID_178583
atggaaggggagcaggatactcaatggggtgagaatggaccaagagattcaagatggacttcaaactcaatggggtttggaagttctgctgcgtgcaagcaagcactggtgctaagcgcacaacacgctctaagcacgaaaacatgcatctacgctgagcgagcagagcgcgctaagcaggccgacgaggatgaggaggagggagaggaaggtgaggttggaggggcatggctggctgcgaaaggaggtgtcggcgaaggcaatgaggagagaggtgatagatggaaagacaatgaaggtgtcaaagttggcatggcagaggagattggtgttggtaaagatggtgagataaaagatgagtgtggtggggaagaattttttggcaatggggaggatgaaggggtcgtggtggagaaaccttaa

SEQ ID NO: 86899 - DNA, 456 bp, Glycine max
  Peptide Sequence Number=SeqID_178584
atgacatttgatgttgcaccactgacagcggccgagacaaggtttgcgagatgctttggcataggtgtttttgagaaggatctagagatcatgcgaggtcttggtttgagacaccagggaggtcacttcattagagagagtggtgaggagaacaccatatataaggcggtcctgtcgacgccaggtttggtaagcaggattctgagttgttaccggaagaaaagatccatctggatattggaggagatcatagccatcaaggagagcttcaacttgttgtttccaattaggataattgttgggaagaagtttggtgacattggtgaaagtgatgcaagcaaggggtttggatggctcatgggggttgggaatgaaggagttgttgtcggccatgggaggcaagggtggggaacgacgtccttaattgaagaaatagggaatgggtggatcgtttag

SEQ ID NO: 86900 - DNA, 1803 bp, Glycine max
  Peptide Sequence Number=SeqID_178585
atggatcttggggtggtgggtttggagggggtggtgggttcagaaagtggttgtgtgtttggttcttctcttgtttcagatcctgagacaaagcacaagtggtacggatctggtttgctcaagcaagagagatctgccatagctactgaagatgatgagtggagaatttccaaagttgctaaaactgatcatgacatgtcttcagcctccaaagcaatgctctttcagcaaagaaacaactctttgttgagatctaataatgcaactctcttctctgatggtcatcaccaatcacaaatgttgagcttctcttctccaaagtcagattctttgttgatagataaggcttcctcaaatgccacattgcctttttcttcccaccaattgtctagctacaccagaaatacaggttacaattcaggaagcataagcatgcatggggctttggctagtgtgagagggccattcactccatcacagtggatggagcttgaacaccaagccttgatctacaagtacatcacagcaaatgttcctgtgccaactcatcttctcattcccatcagaaaagcacttgattctgttggcttctgcaacttctcagccggactcctcagacccaactcattgggatggggaggtttccatctaggattctcgaacaatacagaccctgagccagggaggtgtaggagaacagatggaaagaaatggcgatgttcaagagatgccgtagtagatcagaagtattgcgagcggcacatgaaccgaggacgccatcgttcaagaaagcctgtggaaggccaatcaggccatgccctcaccaccaccaccagtaatacacctaatgcttcctccaactctgtggtgcctggcaacaacaacaacacctttgcacacaacaatgtgcaccaccctattcctcctcattcctctccggtcaacaccatcactaggatgtttacaagcaacaaagagaataataacagtaccagtgagaggatgcaggaccctgcacttcccatgcttcctcccactcttgagctgaaaccaaaggagaacaatcctttcatgattcataaacaccaaatcccatctgatgaatactcaagtaggaacaacaatgagtttgggcttgtcacttctgattctttgcttaacccctcagagaaaagaagctttacttcttcacaaaagaatgattcttctgagtcccaacaacaacattccctcaggcacttcattgatgactctcccaaaccacagtctaatcatcatcatcgttcgtcgtctatatggcctgaacttgacaacatgcagtcagacaggactcagttatcaatctccataccaatatcttcctcagatcacttcatgtcattcactacttccttgccctcgaacgagaaactcacgttgtcaccacttaggctttcaagggagttagaccccattcaaatggggttgggagtgggaagtgcccccaatgaagcaaacactaggcaagccaattggattccaatcacttgggagagttcaatgggtggtcctcttggagaggttttgaaccttagtaacaataacaacagcaatgctagtgatcaatgtggcaagaacaacaacaacacttcagctctcaacctcatgaaagatggatgggacaataatcctccatcagggtcatccccaactggggtgcttcaaaaatctgcatttggatcactttccaatagcagtgctgggagcagtccaaggggggcagagaacaacaaagaaggtgccaccttgtgcaatgccttgtaa

SEQ ID NO: 86901 - DNA, 89 bp, Glycine max
  Peptide Sequence Number=SeqID_178586
atgggtaacatccaacacgtaacacgtaaagagttaaagaatcaaggtcgtcatgaaaaccatccaagcatctcaaacatggcaagata

SEQ ID NO: 86902 - DNA, 238 bp, Glycine max
  Peptide Sequence Number=SeqID_178587
ttaccgtacattcattgttcttttgaacgggataattgatgttctattttcttgtatgcaaggaagatctactgcagaagcagtagcaactccagaagaagaacctcgatcttccgaggcatcttctagttttcctattgcagggcattctcatatagaacctattgaagacccaatcatggctgaagagccaagaagagtaaccctggaggattattcaagttctactgtgccataa

SEQ ID NO: 86903 - DNA, 246 bp, Glycine max
  Peptide Sequence Number=SeqID_178588
ttctacggagtgcccgtcgcccccaaaaaggtcatcaggccccgtactaaccgagctttcatcaagaagtactgcgcccccaggcgggcgcagggcaacacaccacagcagcctggggatgaccggcagcaggcaataaacgcaccgccgccacctctagaccccttcagctcatctacaaaggctggagcgttgcctaagacccatggccgaccaacaggcgaccaagtccaaagccaaagataa

SEQ ID NO: 86904 - DNA, 775 bp, Glycine max
  Peptide Sequence Number=SeqID_178589
atggggacaaggggttgcatcgattacaatcccattcttgcgataaggcaacttggctacctgatgagaggggcaccactagaggaagagctcgcacttgtcatttcacgagggttcaatgagaccaatgtggagacgcttcggaaggtccgcaaagcatgggaagtggtacaaaagaaggacaaagagcttagaggcagtaacaatgggccaattggtggctactgtgagtggttgaaagcccatgtgcaaggtttggattggctcccaagtctgagaaccgctaaaagggaggaagttgaggcaccggaggaagacgaagacgtgcaagctcttaggacagaactcaagcaagctcaagtagtgaaagaaaggttcaaatcagcggctcttaagatccgaaaagagaatgccgaactaagagatataaatatagcaaccaccaaagccttggaacaagagaccaagagggctcgtagggaagagcacggccggaacaagttccgaggggctctgtggggcagtaacagcgagcttaagctccggagagaggaaagggaccaatcacgagtagacagtttgatcttgaaagatgagttgaaggtttgctcaaggtccaaaagaaacttgtctcagcgattatgcgagacagagacccacatgttagccatcgtcagcaagtaccaagaagaattaaatctagccacagcccacgagcacaaagtggcggacgagtatgcccgagtgtgcgcggaaaaggaggctaaaaggaagg

SEQ ID NO: 86905 - DNA, 382 bp, Glycine max
  Peptide Sequence Number=SeqID_178590
atgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccagcgtttccccctggcggctccctcgtgcgctctcctgttcctgcctttcggtttaccggtgtcattccgctgttatggccgc

SEQ ID NO: 86906 - DNA, 666 bp, Glycine max
  Peptide Sequence Number=SeqID_178591
gcactagaatctattgcctttagaggactacacgtcctcgccttcagagggctacacgtcctcgcctttagaggactgcacgccctcacctttagaggactacacgacctcaccttcagaggactacatgtccttgccttcagagggctacaccccctcgccttcagaggactacatgtccttgcctttagagggctacacgcctttgccttcagagggctacacgcccttgcctttaaagggctacacatcctcgccttcagaagattccacgtcctcaccttcagagggctacactcccttgcctttgtagggctacacgccctcaccttcagagggctacacgccctcgcctttagagggctacacaccctcaccttcagaggactacacgtcctcgcctttagaggactacacgtcctcgcatttagaggactacacatcctcgccatcagagggttgcatgccctcgccttcagaggactacacgtcctcaccttcagagcactacacatcctcgccatcagagggctacatgccctcgcctttagaggactgcacgtcctcaccttcagaggactacatgtcctcaccttcaaagggctacacgccctcgcttttagagcgctacaccccctcgccgtcaaaggactacacgtcctcact

SEQ ID NO: 86907 - DNA, 261 bp, Glycine max
  Peptide Sequence Number=SeqID_178592
atggttatgaggggccaagacatttatagtagccaagatgaggctactacttcaccttcctctagtgaaagtgaaaaagcaaaaggggaagaatctagttgtcataccctaatttcgtctgaggaccattgtttgatggcatgcaacctttgtttaaccgcttcgaggtacttggcaccctttgtttcacaatatgtgaagttccgtgacatgccggggatcaaaaggaagcattgttacaaaatccgtgagtttccgtaa

SEQ ID NO: 86908 - DNA, 62 bp, Glycine max
  Peptide Sequence Number=SeqID_178593
atggcgccaaaaacatgttcgcttctagcaagtgcaccggatcgcacaattagtataaaacg

SEQ ID NO: 86909 - DNA, 306 bp, Glycine max
  Peptide Sequence Number=SeqID_178594
atgggtttctccttcattctcaccctcttcatttgccctagttttctcattcgtccaagcaggatgattaaatttgcttcttttcagacccgcttcgatcctttttcgggcgaagcaaatccgcaaagctttgaagttgcatcctatccggagccatatcagaattgtactgatgatgtaagctccattggagcttgtaggcctaggatcttcttcatcaatggattcctttgcttcttggaagatgaatggcaacagaatggagaaggaagagagagaggagacgccacttcaaggagaagatga

SEQ ID NO: 86910 - DNA, 708 bp, Glycine max
  Peptide Sequence Number=SeqID_178595
atgagtaggagggcgcggcggtcgctgcaaaacccagggcgcgagcccgggcggagcggtcgtcggtgcagatcttggtgcctgcccaccctggaaacggctcagccggaggtagggtccagcggctggaagagcaccgcacgtcgcgtggtgtccggtgcgcccccggcggcccttgaaaatccggaggaccgagtgcctcccacgcccggtcgtactcataaccgcatcaggtctccaaggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgtgctctgaatgtcaaagtgaagaaattcaaccaagcgcgggtaaacgcgggagtaactatgactctcttaaggtagccaaatgccctcgtcatctaattagtgacgcgcatgaatggattaacgagattcccactgtccctgtctactatccagcgaaacacagccaagggaacgggcttggcggaatcagcggggaaagaaagaccctgttgagcttgactctagtccgactttgtgaaatgacttga

SEQ ID NO: 86911 - DNA, 435 bp, Glycine max
  misc_feature (22)..(22): n is a, c, g, or t
  Peptide Sequence Number=SeqID_178596
atgactaagaaaagtatgcgancgggaaatgtcgatgtgtatggattcctcgagccacagtccatacagagatatgggcaattgcaatttgaatcagaaagttatattaagaattggatgcagaaattaaagagggatgtgtacctaggagcctacttgaatggtgcacattgggaaatggtcgtcattttgcctatggaaaatattgtcatctggttttgttcgttgcataataggccagacaactacctcaaaggaataattaacggtgctttgaaaggacttgacgatactccacaaagtaaatccaaggctggtgttaggtggattgttgttaaatatttcaatgatgctagaccattagaaccagagagattgaaggcgtttcgcatccaatggacaaagtattattttaaagttaaaaatgaaacctag

SEQ ID NO: 86912 - DNA, 669 bp, Glycine max
  Peptide Sequence Number=SeqID_178597
ttacaagcgattattggcaatcctgattggtttggtcgtggtagtagagtcattatcacaactcgagacgaacatttgttagcgcttcataatgttaaaataacatataaggtgaaagagttgaatgagaaacatgctcttcaattacttactcagaaggcttttgagttggaaaaagaagttgatccaagttaccatgatattttgaatcgagcggtaacttatgcttccggccttccattagctttagaagtaataggttccaacttatttgaaaaaagtatagaagaatgggaatctgctctaaatggatatgaaagaattcctgatataaagatctatgcaatacttaaagtaagctatgatgctttgaatgaagatgagaaaagtatttttcttgatattgcttgttgcttcaaagattatgaattggcagaggtccaagatatactttatgctcattatggtcgttgcatgaaatatcatattggggtgttggttaaaaaatctcttataaacattcatcggttacataaggtcatcagattacataacttgatagaagacatgggtaaagaaattgtccgaagagaatcaccaacagagccttggaaacgtagtaggttatggttccatgatgatataaatcaagttttacaagaaaataag

SEQ ID NO: 86913 - DNA, 524 bp, Glycine max
  Peptide Sequence Number=SeqID_178598
atggcagtaatggtggcccgggtaatgttggggaatggttacgagcccggaatgggtttaggcaaggacaacggcggcataactagtctgataagcgccaaaggaaaccgtgggaagtttgggttaggctataaacccacacaggcaaatataaggaaaagcattgcaggaaggaaaagtggaagtcaaggctcacgattaagacaagaagacgaaggaggccctccctgccacataagtaggagctttataagcgcgggtctaggggacgaaggccaggtcgttgcaatatgcgaagatgattcgccaagtgggtcggagttggtacgaccatgtcctcctggtttccgactaggaaattggcgagtggaggaacgcctggacatttacgcaacaagcataatcgccagatccgatgatgagttcttcgaaggtacgaatacctgggacccgaccatcgattctgagcaagaaacgaatcaaacggaggatgaagaggacgaggatgtgggacttctcccaga

SEQ ID NO: 86914 - DNA, 546 bp, Glycine max
  Peptide Sequence Number=SeqID_178599
ggagagattggcattgcggtcgctgggcagaatctggcacgggtgaaatcttgccccggtatgcatagtagctgtgtgatagcctccctctctggttgtgctcgcacagttggtcgtcctccaatatcagggggtggcccaggaaccgtgcggatgtggagcacactgaaaatgaggacacgtagccctctaaaggtgagggcgtgcaaccctctcaaggcgaggatgtatagtcctctggaggcgtgtagccctctgttggcgaggacgtgtagtcctctaaaggtgagggcgtgtagccctacgaaggtgaggacatgcagtcctctgatggcgagggcgtgtaaccctctgaaggtgaggacatgcagtcctctgatgacgagagcgtgtagccctctgaaggtgaggacacgcagtcctctgatggcgagggcgtgtagccctctgaaggtgaggacatgcagtcctctgaaagtgaggacacacagtcctcttaaggtgagggcgtgcagccctctgttggcgaggagtgtagtcctctga

SEQ ID NO: 86915 - DNA, 417 bp, Glycine max
  Peptide Sequence Number=SeqID_178600
atgaccatgattacgccaagctcgaaattaaccctcactaaagggaacaaaagctgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcggcggcgggtgtggtgttacgcgcagcgtgaccgctacacttgccagcgctgatgtccggcggtgcttttgccgttacgcaccaccccgtcagtag

SEQ ID NO: 86916 - DNA, 168 bp, Glycine max
  Peptide Sequence Number=SeqID_178601
atggtgtatcagaaaggcgtaatagcaactttaatgaatatggttaggagtttatataaatggattcaaagacatcttttgaactgtggacaaataggacactttaaggcctctgcatcaatgtttggggttgcagcaaataatagtttatccgaaagaattgaatga

SEQ ID NO: 86917 - DNA, 414 bp, Glycine max
  Peptide Sequence Number=SeqID_178602
atgcagatggcagatagaggcagaggtggtggtcgtagaacatttaatcgtggtacaagacgtggttttagtttgggagtttcaattaccaccaacccttccccttcatccattcacatatcaacctcaaagtcgatgtcaattcccactacccctgttagagatgcttcaccttcaacaccagatgattctgttacacctgagtacccaccagatccaaattgtgaacatattgttgatgaaaggcctttcattcgtgcatataaaggagagtttcaaccaacatatgggtgttctaatatcatatcaaatatcattagggcaaaatttgatgaaccagcatcaagcttatcgataccgtcgacctcgagggggggcccggtaccagcttttgttccctttagtgagggttaa

SEQ ID NO: 86918 - DNA, 270 bp, Glycine max
  Peptide Sequence Number=SeqID_178603
atggccaagttcgaccccgagatagtcctagaattctatgctaatgcctggcccacggaggaggaagttcaggacatgtgctcatgggtgagggccataggaggaacagggccgacagtttcgatgaggaagccatcgcccaactgtaggcatactggggcaggatttcgcccgaaccgctgcagggaagcgaatgcagatcatacgcaccagcatgaccactttgacccggacatggatgacactgctgctcagcaatgtcttgcctag

SEQ ID NO: 86919 - DNA, 360 bp, Glycine max
  Peptide Sequence Number=SeqID_178604
atgttggtgctgactcccacacattttcctttttggaagactctcctttggcttttcgcccgcattcctgtcaaaggtgaaagtgaagaagcaaaagaggaagaatctagtgaagaaatctacccccaagaagaaggacaacctttaatggttaaggatgagtgtaaggaggtaagtgtctcctccaagaggttagctaaaaaggaaagtcattttgcactaaagacaaacattaaagaaacttcccctcttagacaacctccacatcttcgcctttgtaaaaagacacttgttagcactgccacacctgttgggcttggggttattcctcaagtaaaggagttgttggataagagtttg

SEQ ID NO: 86920 - DNA, 585 bp, Glycine max
  Peptide Sequence Number=SeqID_178605
atggagagaagtatgatagatgctgctagtggtggagcccttggtgatatgactcctgttgaggctaggaatttgattgagaagatggcttccaactcccaacaatttagtgccagaaatgatgctattgtcattagaggagtgcatgaagtagccacgaattcatcttcatcagctgagactaagaagcttgaaggtaaactagatgccttggttaacttggtaacccaactggccatgaatcaaaaatctgcacttgtcgccagactctgtggtttatgttcctctaccgaccaccacacagacctttgcccttctgtgcaacaatctgaagcaattgaacagcctgaagcttatgctgtaaacatctacaatagacctcctcaacctcagcagcaaaatcagccacaacaaaacaattatgacctctccggcaataggtacaatctcgggtggaggaatcatcccaaccttagatggtcgaatccttcacaacagcaacaacaacaacaaccttatttttggaatgttgttggcccaagcagaccatacgttcctccaccaatccaacaacaacaacaatag

SEQ ID NO: 86921 - DNA, 966 bp, Glycine max
  Peptide Sequence Number=SeqID_178606
tggttcttccggaaacactccgaagaagggttcttccggaaaggtcttccggaactttgaaacttcttccggaagtgcgcgtcttccggaagaagtgttcttccggaagacgtttggttacttccggaagaacacttcttccggaaactttccggaaaacgttcttccggaacttccggaagaacccctaacgggttccattgctatgctaaggttccattgctatgctaacagtgatgcacattacaagctaagggtaaggggaaggggaactaacctgttcgcggagaagaagaagaaagccttggcgcgcctcgcggagaagaagcttcacggagaagagaagaagcaggttccgggagaagaagaagctgttccgggagagaagaagctggcaaaatggtactttcaatcaattgctgggtgcaccagcaatattgctggtgttactcctacagttacaaacgttgggcctccaagcacgtatgtagtgaatactcacgggccaaaggggattaaggttcttgttcaaccatgtccgttgacttttaagagaagggtcatgctaggtgcacccagcaattcattgaaagcattctctcttttcacttctctcttctgcgaaagcttcttcccttctctcttccgcgacgagcttcttctccgtgaggcttctccggcagcccttggacccatttgcattcgagaagacgccggaaaaaatggcgacagcgtggtgacggtggcgccttccggaagacccgttagagattcttccaaaacttccgaaaccactgaaacgtcttccagaagtactggtcttccggaaaggttccggaagaagtggttcttccggaaacattctggaagaagggttcttccggatgacctttcagtggttccggaagcactttctagaagaccccttcttccggaatgtttccggaagaaccacttctgccggaa

SEQ ID NO: 86922 - DNA, 576 bp, Glycine max
  Peptide Sequence Number=SeqID_178607
atgaccacttttacatggatatggatgacgttgctatttagtaacattctgcccggcgaccacaatgccaatctccccctgcagatgtattggttgggatcgtgcccacaagacgcccagtgggcccgaagaagtccaacagggtcctggggtttccagctctggttacgggcctctgaatcgcacccacaaagacacccagtggacccggagaagtccaacagggccctggggtttccagctctggttacgggcctttgtagtcctacagggtgcccgttccccccggcaaggtcacgtcatcataggaatcacgcccacaaaaacacccagtggacccggagaagtccaacagggccctggggtttccagctctggttgcgggcctctgtagtgctacagggtgcccgttccccccggcaaggtcacgtcatcatagggatcgcgcccgcaagacacccagtggacccgaagaagtccaacagggtcttggagttgccaagctctaattatgaacctctgtcaattctacggagtgcctgtcacctccagcaagggcatcaggccccttactaa

SEQ ID NO: 86923 - DNA, 462 bp, Glycine max
  Peptide Sequence Number=SeqID_178608
atgattgagaaaaagatgatgttgggcgataaaagcaaaaacctaagcaagatgctcgtggtgaagcttaggggatgtgttgaacaccaagatattgtaaaaaaagactatgaaacttttgcacaaaaatggtcgaaaaatgtcattcatggccgaagggcattacctaatacttataatgaccatcatgaatgtgaaaactcatctttggaatgtcatgggtcagattcgagattgatggaagctcaaggatggaagcttggtggtaggatatttggcccaaaacacgcagggcatctggggcaaaattactcgacaaagcatttaagctatgctgagtcgaataggcctctatttctggtgatgggttggattccacatcgccttaaaatggcaacaactcaccccaagtcttgtttatgtgggttatcaaggtccttcatgacaatcacaaagaaatga

SEQ ID NO: 86924 - DNA, 107 bp, Glycine max
  Peptide Sequence Number=SeqID_178609
gtgtcgagggaaggagcccagagtatgaagaatctcaggatttgaggtcaaatcctttccaaggtggagggaatgatacaatcctagcccacaagggcattagatag

SEQ ID NO: 86925 - DNA, 444 bp, Glycine max
  Peptide Sequence Number=SeqID_178610
atgggtgctcatttggagtatgagtttatgtacatggtcgaaggggtacctaagaagtggtttcttcaatttagggatctcatctacttagagtttaatcacgttgatgggggatgtttggtcatgtcaatgacggttgactttaaacatgcatggtcaaagattgctgtcgttttggaaaacggcgtcgctttcgaagatgccgtcatcgaagacgacgcggtcgccaatatcgcgattttcagagtgagcgttctgtttagtggggaatttgagggattgaaagtggcggggagcagtggcggaagggaagatagagagggaagagaagagtacccgcaaagagaggagcgccgctggtatggagaaaggagagggggtgagtacgagcacagagtgagtacgagcaggtttttgggggaatttcatatgactcagttttag

SEQ ID NO: 86926 - DNA, 270 bp, Glycine max
  Peptide Sequence Number=SeqID_178611
atggtacctgaaacactgccatctgaggagcttgctaagctgagagcattacccaagagtattgtaccaattattcaccccaatcagctccctgaggctgatagttttatctttggcttcccaacaagatttggaatgatggctgctcagtttaaggcttttctagattcaactgaagaactgtgtaaaacacaacggcttgcaggcaaatccgctggaatcatcaccagcaccagttcccaaggtggtggacaagagactacagtgtaa

SEQ ID NO: 86927 - DNA, 273 bp, Glycine max
  Peptide Sequence Number=SeqID_178612
atggctaccatggcagaatggcatgatgaagattttgccaaccgccataggaagaggagcgaggtgggacacatcaatgcgcagtgtcgtttggaaatgtatcttcgggcatgggagcttgcgtttggtggtcgaatgaaggaagagaagagaagaccactctctctctccttgagatttatgaactctgccactgccaaggagtcaaggactgatgccggaggggttcacagtgatcttcaatggtcacgaacccaaataaagacgttgtaa

SEQ ID NO: 86928 - DNA, 351 bp, Glycine max
  Peptide Sequence Number=SeqID_178613
atggagatgttttatagatgcaacctaaacatgtttcagaacatgtttggaatgaggaacccagacagaaaattacatatcaaacgagctgtccccatctatcaaggacaagaagaaataccagaggaaattattcctctgcttcgacaatctggattttattggataatgaagatggggcccgagacacacacgtttcacttgagatgcggagagactacgattactcttcaagatgtgtcagttttgttaggtcttcgtactgacggggcaccattaattggtcagactaatcttgattgggctgaattgtgtgaagaattgttgggagtcccccccataggaaggtga

SEQ ID NO: 86929 - DNA, 321 bp, Glycine max
  Peptide Sequence Number=SeqID_178614
atgtaccctccactaggactgatccacaagagatgtaccctctcttgttctcagtcaacaacccaagtagatgtaccctctacttgtaccacaaaggatgtaccctctaatgtgttaagacgaagatctcaggcggttaaacctttgatacttgctgaatgggaatacaaaagaattctcaggtgggagaagggagatacaaaagaattcaggcggttagtcctttgttcttttgggaaagggagaagagagacacaaaaagaattcagatggttagtccttggcgaattctttttgtcaaagggttatgaaaaagaatga

SEQ ID NO: 86930 - DNA, 312 bp, Glycine max
  Peptide Sequence Number=SeqID_178615
atggatgctatgaataggggattgcgtgatgccaatgggtcacttagcaaacaaaatgtagaacgaataatacttcctcaactcaatgcaaaaactaaattccctaaaacttatagtcattatttgagtcggatgaagtggtttcgaaaccagtataacatgatgtcaacccttatgcgcaacaactctggctttggatgggacccaattggaaaaactttcactgctcatgaggatgtatggaaagattacttaaagatgtcaccggaagaacgctcatcttggataaactttaagttagggaataattaa

SEQ ID NO: 86931 - DNA, 303 bp, Glycine max
  Peptide Sequence Number=SeqID_178616
atggaatccatttatgaaaaagatcctaggcctacaagctccaatgtagcttacatcactttggctcacctgggccaccaaatagcttcatggcgaagaaaccagctcgcctgggcgagttcactgcttcaggggtgttttaaggggttccaaggttcagaagtggagagaattgagagaattgagagaattaagaaagaagaagaaagaagaggaaacaaagctgaggcgctaccgaatcgcgaccgcgatcattccctacatcattccttgttcggtgttcttcgtgcgaccattggttag

SEQ ID NO: 86932 - DNA, 455 bp, Glycine max
  Peptide Sequence Number=SeqID_178617
acaaccaatagatactcaaagtcctacactggggcaaggagaggcaccgtgtgtgaacctctacccctagggaaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 86933 - DNA, 453 bp, Glycine max
  Peptide Sequence Number=SeqID_178618
atggatgggctagtggatctagcggcgattgatgcttttcttgcttatcaccacaacaaggaaagtctggtcattgttgttttggctgatgcctattacacgttcgaccaaagatgcgagaagagcagcgcgagaattttctgttgcatgcctgttctttatgtatggctggtctctcacatttttcatcatgaaagtaggcccgtctgtcccctacaaggtcatcgcatgtgtgctgagaaagggaaagcaaattgggagcagctcttggcgggtatggtagggtcgtctgttaattggttcccccgatggaaggagggaggggttggagttatgtgctcatgtgaagggtttccaaacatccccttgatgggaacgagggattgtatcaattataatcccatgcttgccataagacaaataggctaccccatgagaggagcgccatcataa

SEQ ID NO: 86934 - DNA, 353 bp, Glycine max
  Peptide Sequence Number=SeqID_178619
caccgccggacatcagcgctggcaagtgtagcggtcacgctgcgcgtaaccaccaccccgcgcgcttaatgcgccgctacagggcgcgtcccattcgccattcaggctgcgcaactgttgggaaagggcgatcggtgcgggcctcttcgctattacgccagctggcgaaagggggatgtgctgcaaggcgattaagttgggtaacgccagggttttcccagtcacgacgttgtaaaacgacggccagcggtttgcgtattggcgctagcggagtggtatactgggcttactatgttggcactgatgagggtgtcagtgaagtgcttcatgtgcaggagaaaaaggctgcaccg

SEQ ID NO: 86935 - DNA, 174 bp, Glycine max
  Peptide Sequence Number=SeqID_178620
atgtcactcgatgggaaccttaggttgcaatttttggctaggaataatttcaacatgaataatacagaaaaaggggttcccatgaactctaagagaataaaggtcattcctgagtggtctactccaccaagtgttgacgaaaaagcccagagttttaaaaacctcaggatttga

SEQ ID NO: 86936 - DNA, 287 bp, Glycine max
  Peptide Sequence Number=SeqID_178621
atgggtgccaagtacctcgaagtggtcaaacgagggtcgcatcccaacaacggatggtccctggacgaaattaggggctctcagtatcacccacaaccacacccctcacattccaaagcagttaaaacccctcatgctatggcagaaatgggaaagttggatcatctagaggaaagacttagggccattgaaggaggcgcaggttatggctttgttaacctagaagagttgttcctagtacccaatatcatcacccctcccaagttcaaggtgccagactttgacaa

SEQ ID NO: 86937 - DNA, 582 bp, Glycine max
  Peptide Sequence Number=SeqID_178622
atgacgcacatgatccaacgatgcttgatatttgtggagacaccacctttttcgacagttatgcctaatatgaatgattcacactacgttgacgatgtacacgcaaatcgtaatgatcatgatgaaggactatgggagaacattcttacgttcatggcaaccccaccagcgtcccctctgcagtcaaatattcagtcaccaatgaagtctaggaatactagaaaatcaacacggctacggaggttgactgtacgagcattggataagccaaaaccaactgtttacgtggatgccgcaactagccaaggatcgggttcattcaaagagaaattccacagttatcttggggtcgtggccagagagaaaattcccattgtacataatagctggaaagatgttccagacacgctaaaggacctagtatggaatgacattttggcaaaatttgatatcccagaagcattaaatgcaaagaaaaaggtcatgtccaccgtggccagtagatggaggcaatttaaatgtaacctgacgactagatttgttagacaagtggcctcagatatcttaagaagggggggttga

SEQ ID NO: 86938 - DNA, 450 bp, Glycine max
  Peptide Sequence Number=SeqID_178623
atgcagctgtgcgctaagcgcgccatacagatttcagtttctaaaaaatcaaaggcagtggcactttgggtactacctttgcacccaaacctctgcaccttcttacccttgagcacttgtgtattttctacttcttttgtattgtttctctgcatcttcattgcttcatttcaagaacactccaatacggctaagcacaccctgtgcactaagccggagtgttattttgttgagtctgagctaagcgtgccatgcagcggtaagctccaactctcttcgaatttgaaaattatggcatctaagaagaggaaaacaccttctacacctacccaggctagatttgatagatccaagttcacatcccaagaggcttgggagagatatacagacattgtggtgcctcgtaagctactactagagaggaatgtggtagttattactcagagttga

SEQ ID NO: 86939 - DNA, 354 bp, Glycine max
  Peptide Sequence Number=SeqID_178624
atgcgtatggcacagatgcattttatgaatacgggagcccaggagattgtccccttcttagatacaacattcgggcagcatggcgcccgatgtatgcatttaagaaggcgacacggaccctccgtcggtatcatccccttcaacaaacatattgcggcagtagggactactagcaacaatatgttatcaaagagaaaaactctatatgagggttcactgttatcaagcaagtcggagacccagcatgaccacaaattcacctccactccttatgttcccatggacccgggtataaggccccttttcaactcactgtgcatgcaaaaaggtgttggtgttgtgtgcatcaaatga

SEQ ID NO: 86940 - DNA, 405 bp, Glycine max
  Peptide Sequence Number=SeqID_178625
atgtccagtattttcgggccagatgtcctggacatcgtatccgacattgtggatcctgcagcttccattcttcatttgacttttatcttgccttccagtattttcgggcaggatgtcctggacattgtatccgacatcgtggatcctgcagcttcaatgcttttagcaattccagtattttcgagcaggatgtcctggacattgtatccgacattcgtgaatcctgcagcttcaattcttcatttgacatttcatcttgccttgtgcattgtgcagcccgatcttatcgttgacataacgttggacatcatgtgcagcaactccagctttccttcattgtctaagtgcttatgttttaacaaaatcttagccaatcttttaaaactcagtagagctaagcactaa

SEQ ID NO: 86941 - DNA, 235 bp, Glycine max
  Peptide Sequence Number=SeqID_178626
atggctccaaagaaactctccacaaagaggtctagaagagatgccacaggagagggatccagtgccgccccagaatttgatagtcatcgtttcaggaactttcaggaggagatagctcgcagacgttggacaccgctagtgacttccgtggccaagttcaaccctgagatagtcctagagttctatgctaatgcttggcccacggaggagggagatcgggaacatgcgctcgtgg

SEQ ID NO: 86942 - DNA, 291 bp, Glycine max
  Peptide Sequence Number=SeqID_178627
atgactgcaagagcatttgcctgtgaagcacttctcagattagtagacagcaaagctccttcatctcaagcatgggtaaagactgtagggtgtggctttggggatcctgtaaatcaggacataaggggtggatggtggatcgccttgactagttctatttggcaccataggaacaatctgattttccaaggaagtcctttcgatccctataaagtcatggatcatgctatatatctagtttggtcctggttcaaggctaaagacaaagattttaatactagcttcatataa

SEQ ID NO: 86943 - DNA, 258 bp, Glycine max
  Peptide Sequence Number=SeqID_178628
atgttactagggtatttgagtagggaaagctgttgtattggaatgtgttttgggcagagttttctacctctgccctgttttcttggtttaggcttggaggggttgtggggacccggtgctgagaggaacgaggataagggctacttgaggagtggtacctggagatatgtcgcgggggtcaggagaccttggggacgtcaggtggggtgctattgcccaaaaccaagcttgaccaatcccgacccaacccgggcatag

SEQ ID NO: 86944 - DNA, 165 bp, Glycine max
  Peptide Sequence Number=SeqID_178629
atggcttctaggaaatgcaagagtattggttcaagaccctctacacaatatgatacaaggagattttactcctttgatgctttgaaccgatacatggataatatcttgggaagaaacattgtgccagaaaggaagctggagattgttggatcaagtggcctctga

SEQ ID NO: 86945 - DNA, 87 bp, Glycine max
  Peptide Sequence Number=SeqID_178630
atggctaggaaactccaggaagattgggctagggatgttggagaaggccctagggttctcatgggccttaggggctccatagtgtag

SEQ ID NO: 86946 - DNA, 435 bp, Glycine max
  Peptide Sequence Number=SeqID_178631
atgaaaagtttttgctcaagcttaaggacagaattgatagacttgctagcgaaattgtccaaaagagaaaaggaggaaaatatcaagcctgatccagatattgatgcctgcatgaagtgttcaactgcacactcacttaactgtgttagttattgggccacctgcatgtccagtcctatgtgtgagaaggtcttaggagcaatgttgaggtgtgatgatctaggacctctatctgctaagaattttaacaattactctgagtctaaagataaagatctttatgttactggggacttgtatgagaatgatgttgtcacacccgctatgatcgttgttcctcgtagaaggggaagcaggcttacgcgatccgtgaaattccataatgtggcggaaatcgaaaagaggtgtttttgcgcaatccgtgagtttccgtaa

SEQ ID NO: 86947 - DNA, 231 bp, Glycine max
  Peptide Sequence Number=SeqID_178632
atggcagcagaatggagaagtaagagagagaggagacgccacttcaaggagaagatgagtctagaagaagctcaccaccataggaggccatggataagagcttggaggaagaaggagatgaatgaagggagagggagagaagagcacgaaattttgtgctctaaaagagctttgaaatctgaacccactaatccaagatcaattccaagattctccattaagtgtgcatag

SEQ ID NO: 86948 - DNA, 189 bp, Glycine max
  Peptide Sequence Number=SeqID_178633
atggaagcattagaaccttttgcaagagaaaccccaaaacagggcctatggacattggaaggggcagaccctaagttctacagtgctgtagctgtggaagaattcccctacttcattaataagataccgggtttctatcaaattatagcatatgggaccgataacaaaaacttacaacaaaattactga

SEQ ID NO: 86949 - DNA, 141 bp, Glycine max
  Peptide Sequence Number=SeqID_178634
atggctagcaagcctactttttgtagacaaaggatcaagctgaatgttttgatgatgccaaaggttcacatgcgtctcaaagctttattcaagacaaagaaattaaagatattcaagatggatgatcaagacagtctctag

SEQ ID NO: 86950 - DNA, 723 bp, Glycine max
  Peptide Sequence Number=SeqID_178635
atggctgggaatcaattgacattcgctaagggtgcatccattagtaaaccaccattgttttgtggcatgaactaccctttttggaaggttcagatgaaaatcttcatggagtctattaatagaggcattttgagtgtactggaaatgaacattatacattcctcattaaaccctaatgaggttttcagggtgtctgttggcacaattgccaaagagatatgggatttaatccaagtcatagatgaaggaacacaagaaggtcttggacatatttttatagaagaagagatcaatgtcaagcgagcgtccgctaagtacaacactcctaggctaagcgcgaggaagactctggaagaagatgagctgtacaggttcgctaagcgcaccgcttcatctcactcagctcaccgctttagtttatctgctaagcgagaaaggcgcgctaagccaaaaatcactaatctgaggggatatgaaatgggcttgacaagaatggctgaagaagaagctatagataagaaaaatagaggtttagcatcgaagactagcattccatcaagtgacaaaagtgagtatgacaatgcaaaagggttgaaggctaaaaatttgaacttgctcatgggaaagttcaacaaattccttaagaaagggaagaactacggaaacaaaacctttctgcctaagaagaatctcaagaaaggagaaccatttttctctaattga

SEQ ID NO: 86951 - DNA, 537 bp, Glycine max
  Peptide Sequence Number=SeqID_178636
atggtagacaagtgctattttgaagcattggacaagactttgagagacatcatgagaattatagatgaagttgatattgcttttagagggaaagtcatagtttttggaggagactttaggcaaattttgccagttattcctcgaggaatgtgttcaaacattgttcatgctaccatcaacgcatcctcattatgggaccattactttgctaaatggatccttgaaattggtgatggcaatcatggtcagccaaatgatggatatgctactatagaaattcctccagcccttctcatcctaaaatacattgatccaatcgatgctattgttcaatccacatatgctaatttaactaatcattttatggatccacaatttcttcaatctagagctatacttgcatctataaatgaacttgttgaacaacaaaatgattatgatttatccatcattctagcagaatggagaaggaataaagatgattggagatgccacttcaagaagaagatgagtcaagaagaaggtcacctagactag

SEQ ID NO: 86952 - DNA, 348 bp, Glycine max
  Peptide Sequence Number=SeqID_178637
atgaagacattgccgccttttgaaagcatgcatcgccttttgaaagcatgcaatgactggagacaatgtcgtcttcgaaatgcaaaggagactgcaatagtcttgaaaacaatgaaagcgaatgaccatgatggtctccgtatgccatcagacttgattgtctctggatggcaaaggagagtgaatgaccataatttgtctccgcgtgccaacaaacttgattgtctctggaaggcaagaaaagcagatgaccataatttgtcctcgcatgccaacagacttgattgtctctggaaggcaaaaagggtgtggatgaccatgattgtctctgcatgccaacagacttga

SEQ ID NO: 86953 - DNA, 414 bp, Glycine max
  Peptide Sequence Number=SeqID_178638
atgtcgggactcttctttctcactcccactcgcagccaggtcattgctattatcgttgttggtgtcaagcctcttgagaaagcttctcaaagaagccacgaggaagcttctggaggaagcctcttaatgaagcttctagagaaagctacatggagctacctcaataaaaacgatgcccagcgtttgttaactgttggctcttctcaaaatttgcctcttaatgaagcttctgaaggaagcctcttaatgaagcttctagagaaaactacatgtagctgcctcggtagaaatgcttcccagccttcgttaaccgttggatcttctcgaaatttggcttgtgcggaatcgacaagcaaggacaaaaaggaatcttcaagtgacgcgacgaggaatccgtggggtagctcactatag

SEQ ID NO: 86954 - DNA, 630 bp, Glycine max
  Peptide Sequence Number=SeqID_178639
atgccatggggaggaattcagaaggctgaccatgatcaactggaggctcgtgtgagtcgcccccaaggcgacgagcactttactcacacaatgcatgaacgtactcaagggaaatcataccccaaacacaccatcagcacccaagatgatcccagtctctcacacgtacaccgccatgaagaacggatgatttgtcgacatccctttgtcgactgcatcatggaagttgacatacccttaggttggaaaccgctcaacctagagaggtatgatggaaccatcgattcggatgaacatctagattcattcctcacccaggcgaatctttacaccaacaacgatgcagtcctatgttgcgttttcccaatgtccctcaaaggggcaatccaaaatcacaaccgtgaagtagcactccactctatactactgctcgccctacgtcctagtaagttcatagatagtctattcaaaaaacctcctagtagcatggatgagctgtgcgaacaagccaaatgctacatccaaatggaggagatgtcaaggttaagaaatgatgtctggcaagtcggacaaaagcgcaacaagagagaaggaggaaccaagacagactcacacaagtcggacaaatga

SEQ ID NO: 86955 - DNA, 705 bp, Glycine max
  Peptide Sequence Number=SeqID_178640
atggcctccaggaaacgtaagagcattggggcaaggccaactgctcaatatgatactagacggttccattcgcttgatgcttggaatcgttatacagataatgtcttggggaggaatattttgccagaaaggaaggttgagatataccacacagagttcaacgacttcaagacagactctgagggtccttcaccaaagcaagccagagttagaggccacctggtgaagatagacgtagaaaacctcaacacatttctagagactcctgtagtcatagaggagggggagacattacccacctactctagctactgcaagttgcccacagactacagagagattgaggctgctctttgcataccagggagggtgttcattttgaatgccgagggccatccagggaggattctcaagaaggatctgactaccttggccttggtttggagtgttctttcttactccaacctggcccctacatctcacacctcagacctcacagtagacagagccaagttgatcttcattgcccagtctaactctttcagacttgggtttcctggtttgatcaccgccttatgccgagctcaaggggttgtctctgacagcctcacatttgagagcctgagccccgtcattgatttggcctacatcaggaagaactgttggaaccttgatgatctgacagttgctttctgggggggctag

SEQ ID NO: 86956 - DNA, 879 bp, Glycine max
  Peptide Sequence Number=SeqID_178641
accctgtttgtggagtacaaggacagcggtaagaaagatgcgaacggtcgtgcgattctggtgaagcaggaagaagtgattaacgtggcgaacattcagtcgcgcctcggcaacagcttccgaattaccggtatcagcaacccgaacgaagcgcgtcagctgtcgctgctgctgcgtgccggtgcgctgattgcgccaatccagattgtggaagagaggaccatcggtccaaccatgggccagcagaacatcacgcagggtctcgaagcctgtctgtggggtctgattgcctccatcatctttatggtggtgttctacaagaagtttggtctgattgcgaccagcgcactgctgtgcaacctggtgttgattgtcggcatcatgtcactgttaccgggcgccacgctcaccatgccgggcattgccggtatcgtactgacgctggcggtggcggtggatgctaacgtattgattaacgaacgtattaaagaagaactgcgtaacggacgctcggtacagcaggcgattcatgaaggctataaaggcgccttctccagtatcgtcgacgccaacgtcaccacgctgattaaagttatcattctttatgcggtcggtaccggctcgatcaaagggtttgcgattaccacggctatcggtatcgcgacttccatgttcaccgctatcgtcggcacccgtgccatcgttaacctggaatatagtattgaacagctgaaccatgggcgtaaagtcgtcgactttatgcgctgggacacgctggcctttatcatctccggcctgctgattgtggcgtccatcgccattatcggtgtgcgcggcttttacttgggggctcgatttcaccggcgggacggtgattga

SEQ ID NO: 86957 - DNA, 306 bp, Glycine max
  Peptide Sequence Number=SeqID_178642
atggtaagagctgaaataaataggcctaactctcaaaaacatgtccctagtggagtcgccaactgtcacaaccaacccttcggcgggagggcgacgcagggctcacgggtgcgtcttccaagggaggagaatgcgcggagttgccaccaacatttattcgaggaaaacatcggaaaaaccggaatgagtggtctacgaactttcatcgtgaaaggttcagaagttatttttatgcacggggaaggaattaatgaaacattgggcttaatccggattttggttcgtagacttgaagagggcaaataa

SEQ ID NO: 86958 - DNA, 393 bp, Glycine max
  Peptide Sequence Number=SeqID_178643
atggtgggttacacaccttcaagctttgccgatttagttttcgccggtgaaaagatcgaagtgggtttgagaagaggaaaatttgattatcctgctttgatgaataggaagcctggggaaaatggagagaatgagaaggaaggaggaacccatgttgtgactgtcgttcctacatggccaaatttcccaccagctcaacaatatcaatactcagccaatattagcccttctcattacccaccaccctatcaaccaagaacactcaatcatccacaaaggccacccctaaatcatccaaaaccaaacaccacccttaacacaaaccaaaacactaaccagggaaggaattttccaacaaagaagcctatagaattttccagtgtcatatgctaa

SEQ ID NO: 86959 - DNA, 237 bp, Glycine max
  Peptide Sequence Number=SeqID_178644
atgcaaaaccggatttatactggtttggccacaacccgtgcctatgtccagtcctcaacattgaaccacaaaggactttcctcctttgtgttcagtgtttacaccaagaagcaaattccacttcttgccatgaaccccaaaggaccttttgtagaagcaagcttcatgatgatgaatcaagttgattcaagaagttttgataatgacaaagatgatgacaaaaagcccaaagaatga

SEQ ID NO: 86960 - DNA, 348 bp, Glycine max
  Peptide Sequence Number=SeqID_178645
atgtgtaagagggagcatgaaacttttaaagaatatgcccaaaggttgagggatctggtagctgaagtaggacccccaatgatggaaaaggaaatgataacaatggtagtagacatgttactggtgttctactatgagaagatggggcttctatggaggttgaatctttgtgcttcaatgaggtccttcaatggtgattatccaccatggaggcgccagccactagggaataagccttggaagaaggagcttcaccaccaagaatgtgccttggataagaagcttggagaggatgcttcaatgaaggaaaagaaagagagaggggggagcacgagattgaaggagtaa

SEQ ID NO: 86961 - DNA, 225 bp, Glycine max
  Peptide Sequence Number=SeqID_178646
atggcttacactcacattccggattcacaagcgattctcctcaaatttatgccagcccgcatcaattggaccttgcaccttatgcttcagggccctacaatgctcaatagaatgcctcggggctcctccatgataagcacacattgcgttcgagtcgtatcctcggaaaaatggaggttgaggaaacctagcaggggttatggctaccattgcagtatcaagtag

SEQ ID NO: 86962 - DNA, 240 bp, Glycine max
  Peptide Sequence Number=SeqID_178647
atggggagtgcaactgagacactctgtggacaagatttcgaagctgggcaggaagatatagctgatcctgcagggagtttctccattttagtaattccacaatttctttcacttcccttcaattttccaacgcaaaagttccttcaagctcagagcaagatggtgcaactttggcatttgatatcacgagttggggatcacagtggctcaacttgtttatgttgtgatctgtttttttaa

SEQ ID NO: 86963 - DNA, 153 bp, Glycine max
  Peptide Sequence Number=SeqID_178648
atgggagaaaatgaaaaggaaggaaagaaagctcctgatcaaggatcgaaagaaaacagaagaagtgtgcagaaaggaaataattcgcaaagtcaagtcgtgacatatctatggttcggaattaggataaaacacttacctgtgcgagattga

SEQ ID NO: 86964 - DNA, 429 bp, Glycine max
  Peptide Sequence Number=SeqID_178649
atggctctgagaaagctttccacaaagaggtctaagaaagacgctgtggctgaagggactagtgccgttcccgagttcgacagtcatcgtttcaggagcgctgagcaccaacagcctcaccggcattggacgtcgctggtcactcccatggccaagtttgatccggatatagttctggagttttatgtcaatgcttggcccacggaggagggcatgcgggacctgcggtcatgggtaaggggccagtggattccttttgatgcagacgccctcagccagttcctgggatacctgctagtgttggaggagggccagaagtgcgagtatagtcagagaaggaaccgagtcgatggatttgacgaggaggccattgcccagttgctatgcataccaggtcaggattttgcccggaccgctgccgggagacgg

SEQ ID NO: 86965 - DNA, 429 bp, Glycine max
  Peptide Sequence Number=SeqID_178650
atggctgcagcaggaaaagcaggcgctacggcggcacggcgagcggctgttggggtatgccgatccgcaagggttgccggagctgcgcgcggagatcgcgcgctatctgcagcgggagcggggcgtgaaggcgacggcggaacaggtgatcgtggtgaccagctctcagcaggcgttggcgctgtgtacccaggtgctgttcgatcccggcgatgcggtgttcgtcgaagagccgggttaccagggggcgaagaagctggtgcagtcggcggggctgcaggcgcggccgatcggtatcgacgagcaggggctggacgtcgggcagttgatgcaggcctcgggcggcggacggggcgtttacatcacgccgtcccatcactacccgctggggtattcgctgagcctcgagcggcggttggcgctgctgca

SEQ ID NO: 86966 - DNA, 198 bp, Glycine max
  Peptide Sequence Number=SeqID_178651
actgatcctgttgctcaggagaaagcagtagctcaagagccaacttctccagttcaaatctctccagcacccattcctaaggattcccaaccatctgcaccagcatcggagccagcgcaacctattgttcaggatccacctgctgctccagtgttggatcttaatgagcatgcagaggatcacccgcaggaggattga

SEQ ID NO: 86967 - DNA, 261 bp, Glycine max
  Peptide Sequence Number=SeqID_178652
atgagttgtaaaggttcgctaagtgctccacttcatctcactaagcgcaccacttcagttcatccgctaagcaagaaaggcgcgctaagccaaaaatcactaacatgcgctaagcggtccataaagctttgcatgtctagggtttctagagagagaaaggtccaagttccagagagtttagagagattttgctgtgtgaagatctgcagagaccagagcttgaaacaggagccggttttagagcttgagatgagtttgtga

SEQ ID NO: 86968 - DNA, 208 bp, Glycine max
  Peptide Sequence Number=SeqID_178653
atggcaagggaaaagtgtgattcagagggagaagaagagacaaaaattggaacagaaatatcatttgattcgccgatcctcaaaaaagaaataagcaaagttccgtcgttaaaccgcgagctaattatcgagactttggattatccggacacatacttcgtgaaatggttcatgcatgtttattgcccggtgcaacaagatccagttg

SEQ ID NO: 86969 - DNA, 501 bp, Glycine max
  Peptide Sequence Number=SeqID_178654
tcgggaaacctgtcgtgccagctgcattaatgaatcggccaacgcgcggggagaggcggtttgcgtattgggcgctagcggagtgtatactggcttactatgttggcactgatgagggatatattccgcttcctcgctcactgactcgctacgcttcggtcgttcgactgcggcgagcggaaatggcttacgaacggggcggagatttcctggaagatgccaggaagatacttaacagggaagcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccgtcatgcgccggttaaggctaaactgaaaggacaagttttggtgactgcgctcctccaagccagttacctcg

SEQ ID NO: 86970 - DNA, 351 bp, Glycine max
  Peptide Sequence Number=SeqID_178655
atgtttgaatgcaatcaactaggacatctgagggttgatagtccaattttcaagaaaagaatggagaaatttgaaaagaaagcttttaatgataagaaagctaagaaggcctacattacatgggatgacaatgatatggactcatctgaagattcagaaaacgaagttgtaaacctgagtctaatggccaagaattataaaagcgatgaagaggtaacatcttctgacaacaacatatctatttcatttgatgaattacaagatgcattcactgatttacataaagaattagttaaccttgcaaaactggtttcatcttctaagaaaactatttcaaacttagaaaaataa

SEQ ID NO: 86971 - DNA, 600 bp, Glycine max
  Peptide Sequence Number=SeqID_178656
atgcgagtttttcatgcatggggttctgtcgctctcatcgatgagataccccatgcccaccatccatccatcagcgcaacatcatccatcatccatagcaatttctgtcagtcaaagtggtggaattgctgttggtcatccacgtggatctctcagttaatctggcgggattggcttgaccttcgtgcaaaaagaaaagtccttgcttcatgcagggtagtattaatggcttcttcttcatcatgtttgtcaaatatttcaattatttctggtcctgttgagggtgactgtggatgcaagataagcatatttcacagcatatttagaatgggggaagaagatataaaactacatattagaagagttgtccccacatatcaaggtcaagaagaaataccagaagagattattcctctacttcgtcaatctggttatttaaataaccatggtgggttagaacaggtagaaaggtttactcatgcatggatctttcgattcattggaggtgtcttatttgttgacagcgccaccaattataaaactaaatcaattggaggtggttgcgacgggaaaatcaaaatattggtaatgatgatttga

SEQ ID NO: 86972 - DNA, 234 bp, Glycine max
  Peptide Sequence Number=SeqID_178657
atggattggggtatgaacccgggatgccggggaggaggaatgtgccgtcaagacttcgggcggatagagtatggcccgaccgtattagccagtgtttcaccagtgccggaatggtgtccgaggaagagatatgagggtcgattctttgaggatcctaacgacgagggtttgacgatcgatttcgaccgagatgaagaacgcgaaatgaagcctcaccaagaagaaaccgaactg

SEQ ID NO: 86973 - DNA, 1338 bp, Glycine max
  Peptide Sequence Number=SeqID_178658
atgtacccggacagcctgcagggctacgcacctaccgtgcgcgggattgcccggacgcccgccaaagtggtggtgcgtcagaacggctacgtgatctatcaaagctacgtgcagccgggcgcatttgccattagcgatctcaacccgacctcctcaagcggtgaccttgaggtgacggtcgaagagaaagacggcacccagcagcgttataccgtgccgtactccaccgtgccgcttctgcagcgtgaagggcgctggaagtatgacctggtggccggggattaccgcagtggcaacagcgatcaggatacgccgttcttcacccagggcaccctgattaccggccttgccaacggctacacgctctacggcggcacgcagctcgcgtcacgctataccgcggtggccatcggggccggtaaaaacctcggtgactggggtgcggtctcgctcgatattacccatgcccgcagccagcttgcggacgacagcaaacatgaggggcagtctctgcgcttcctctacgcgaaatcccttaacggcttcggcaccaacttccagctgctgggctaccgctactccacaaaagggttttataccctggacgatgtcgcctggcgctcaatggaaggctatcagtatgccgacagccagaacgataacgatgtgccggacgtgcagagttaccacaacctgacgtggaataaaaaaggccgcttccagctcaatgtttctcagtcgctgggagattacggctcggtgtatatctccggcagcgagcagacctactgggggacggacgagtcgaacctctggtatcagctggggtacgcggggggcgtgaaggggatcaactactccgtttcgtggtcgtggaacaaatccgtcgggatcgacggtaccgaccggatcgcctcgtttaacgtctctgtgccgttcagcctctttacccgtcagggttatcgccgggacagcgccatcgacagggcctacgccacggcatccgcaagccggaacagcgatggcgacacgagctggcaaaccggggtcagcggaacgttgttggaggatcgcaacctgaactacagcgtgacccagggacacaccagcaccaatggctcaagcggaagcgccagcgccaactggcaggcgacatacggcacgctgggggtgggctacaactacagccgcgatcagcacgatctcaactggcagctctccggcggggtggtcggccatgctgacggcgtgaccttcagccagccgctgggtgacaccaacgtgctgatcaaagccccgggggcatccggcgtcagcgtcgaaaccagaccggcgtga

SEQ ID NO: 86974 - DNA, 723 bp, Glycine max
  Peptide Sequence Number=SeqID_178659
atgcgagttagtcagaggaggaacagggccgatgggtttgacgaagaggccattgcccaactattatgcataccgggtcaggatgtcgctcggaccgctgcagggaggcaggtgcggatcatgcgcaccagcatgaccaccttgacccagatgtggatgacattgctgctcatcaatgtcttgcctagtgatcataactccgaccttcctctgccgaagtgtcagctggtgtatgccatccttacacggatgagcgtccatgtggctgagttgattgctgacgccatctatttatttgcaggtatgccacccaccaggcaccctctagactcggataagtctaacagggccctggggtttccaacattggtcacgggcctctgccagtcattcggggttcccgtcacacctagtaaggtgatccgaccaccgatcacccgggccttcattgagaaatattgcacgcctaggcaggcacaggtcgatgcaccacaggccacagacgcactgccaccacctcatcaggcagatcatgctgggtcattaggcatggagcagtatctacagcacttgtttagggctgaggtcgcatggcccggagattggcccgaggcccaggcaggggaggcgcctgcaggatccccaggcgatgcagaggaggcccgcatggatgaggagatgatggatttgctcggtttcttgggagggagcggagccatgtga

SEQ ID NO: 86975 - DNA, 657 bp, Glycine max
  Peptide Sequence Number=SeqID_178660
atgccttatttgcaagatggaagacccgttgatatggtcttcaatccactaggggtaccttcacgaatgaatgtaggacaaatatttgaatgctcgctcgggttagcaggaggtatgctagaaagacattatcgaataacaccttttgatgagagatatgaacaagaagcttcgagaaaactagtgttttctgaattatatgaagccagtaaacaaacatctaatccatggatatttgaacccgagtatccaggaaaaagcaaaatctttgatggaagaacagggaattcttttaaacagcctgctataatgggaaaaccttatattttgaaattaattcatcaagttgatgataaaatacatggacgttccagtggacattatgcacttgttacacaacaaccacttagaggaagggccaagcagggaggacaacgggtaggcgaaatggagagatgctttacttataaatctgatcatattaaaactcgccaagaagtactcgggactacgatcattggaggaacaatacctaaacctacagatgctccagaatcttttagattgctagttcgagaattacgatctttagctatggaactgaatcatttccttgtatccgagaagaacttccggattcataggaaggaagcttaa

SEQ ID NO: 86976 - DNA, 565 bp, Glycine max
  Peptide Sequence Number=SeqID_178661
aacttgtaaaaggaatttacaagatagtggaactctcaagcgggttgcttggggactggacgtaggcacaaggatatctgaggccacttgtctaacagcatattcctctcttggaacacgcacccgcgagtcacgcgtcaccctcctgccgaagggtaggttgcgacacatatcaatcttgattcatcatgaagctttgcttctacatcaagtgcaagataagttccacaactatctgggggtagaagctcgagaaaagatcccaattgtacataacaattggatagatgtatcggaatctctaaaggagttagtgtgggacgatatcttggcaaaatttgatatcccagaagcagcaaatgccaagaagaaggtgatgtcaacagtggccactagatggaggcaatttaagtctcagttgaccaccaaatttctgtatgctaacaatgatggacaacataaaagcgatccttttgaaaaatattgtatagatccccaaatttgggaggaatttgctgctacccggaagacacctaattggcagggaattaggaagagagcatag

SEQ ID NO: 86977 - DNA, 516 bp, Glycine max
  Peptide Sequence Number=SeqID_178662
atgtctgaacatagctacactgtagttgtggatgatctgattgctttgtgtcctgcgaaggatgttgtcgtttggttctgttcgttgcataagaagccggatattcatatcaaagttgccgttaacaatgcaatgaagacattaaagagtagtttggatggccatattgataaagttgcatcgcagtgggtggaaataaagagtcatgttcaaatcggtaggtgtgagtttggttattatgtcatgcattggatgtggaacacatggtttgttgatggcacctcattagacatggagagcatcacaacaattcgcaagaaatgggcagcctattttttaaaagtcattctgtaccttcgaatgtccatagtgttgatgatagaccaattgacatcaacaaatatgaggttcgacaactacattcatgcgtgtagtatgagggaacatggttatgaagcttcatcacagtctgatcataaaccaaataagttaccctttcatctcactatagaataa

SEQ ID NO: 86978 - DNA, 426 bp, Glycine max
  Peptide Sequence Number=SeqID_178663
atgggttcaatgttattatttgaagatattgacgataggtggatgcatttctctgactatcttgcagcagtggggcagatttatggtgtgccaggaaaatgtgcatcagattacatgcagtggttcttcatgatttctcatccattcatgacaccggcacagcctgttgatccggttagacatccacttgtgacgcaggatgacatatatgtgaagccacatatccctaaggtcccagtggcactagcaacagcattggcacatgccccttctgatgtggagcagcctagacatgcagtggagacttgtcaagaaatcacagaaaggttggagcatttgctcaacctaaggatagtcattgcaggcatagaaatacacaaagtcatggaagactgcttaaggatcgctaggggtgtcacaacatag

SEQ ID NO: 86979 - DNA, 390 bp, Glycine max
  Peptide Sequence Number=SeqID_178664
atggtgcgtagcctctcctccatatgctcaatcctttccttctcaagtactgtggaaggcccctctccccttacaaaatgcaaggttgtgataacgaacaacattgagatattccgggagcattccgcacagggatgccagaaaatgcctacccttcagtggtatatcctggataaaccccaaactcaaccagagtgtggtcttggggaacttcatgtgtttcccccatgggttgagagacatgtgcttgatcagattaggggtgtgctcaagaaacttaaccaggaagcctttggagggggtgtgaacttatcaattgggggtgcgcttagaaatcttcatcaggaagcaactgggcggcaaccacctcccattttctcttataaatag

SEQ ID NO: 86980 - DNA, 93 bp, Glycine max
  Peptide Sequence Number=SeqID_178665
atggttgatggaaaactgatagagatgaagggtagagttaacctagggttaaaagactggggaaagcttgggttgtgcaaaggaggtaaatga

SEQ ID NO: 86981 - DNA, 777 bp, Glycine max
  Peptide Sequence Number=SeqID_178666
atggcagaatcatcaaagaagcgcaagggctcatcttcctccaccaccacttcaggccaccaccaccacggtgcttccggtgactctccggcaccaccaaacccatatctttcgtcaccatgctctctcactctattttccaccgatgaccaatgtcaaaggtattactcctcattttccaatcgtgtcattcttgaccctaaattccttgattttgaattctttgagggagaaaactttgattgttatcaagtttttcaaaaatctgaattagcggattttatgactctgaaattgccttattattcgaaaatagttcgggtcttttataacaacttggaaattcgtgatggagtgatattttctgaagtacacaaaatacccattgttgttgatcaatctttgtttaattctttaaccaaactgagtagtcaagcactacaaattggtcgtcaaattcactggggccatcttgttcgccaccgtatccataaggcattacgggtaaatgcacctctcccatatccccatctggttactctaattctgcagcacttcaacatccctcttgctaatgaaccttttgtcaaggatctcccgactaatgctcctgatgaacgcactccatctccaccaccaagggattcttcctctacactactaaatgatgtcctcaccgagcttcgggatcttcgtgcttttgttggagaaagatttgattccatggattcttgcatcattcatcttgaggatgacatgggatttatccgtcgttga

SEQ ID NO: 86982 - DNA, 653 bp, Glycine max
  Peptide Sequence Number=SeqID_178667
atgggtgaccaagaggagatacaggaacagatgaaagccgacatgtcgactttgaaagagcaaatgacttccatgatggatcccatgttagggatgagacaacttatggagaataacgtggccaccactgtcgctgttagttcggctgccgaagcagacccaactctcccagctactgcgcaccatcctctctcaaatgcggtaggacgagaaaggagcacactggggcacatcagcaacccccatttgggatacaaccgggtggcttacctttatggattaccacctaattacacgccactagtcatgcgtgatgacgcgggtcatgtcccttcccccttccttgaaggggagcctcctcgacagtcagacgaggttcacgaggatcatagagagtatgcccaagtagacatcgatttctaccccccggtccccgtcgagggtccggcacccaacatattgcctcagcccaacctcccaacacaaccaatattcttgtccacagaaggaccacccccgacggcggaagaaagaaggaaactcgatctcatcaaagagaggttgagagctattgaaggctttggcgactatccgttcgcggacatggtggatctttgcttggtaccggacgtcgtcatcccccaaaattcaag

SEQ ID NO: 86983 - DNA, 333 bp, Glycine max
  Peptide Sequence Number=SeqID_178668
ggttcctctcggtgtggggtttcaatggagaacaacgatggtttgtggttgctaatggtggatgtgggtgatggagaaagttcttgggactttagaaatggctttggaagaaagaaagaagaagaaatgacgtttttcctaagctacacgaaagcaaaggctgaaaccaaatgtcgagaagatccaacggttaatgaaggctggacagcgtttttcccaaggcagcttcatgcttatcgcgagtttggtgctaagcgcaacgtcgaggatagtgagccctttttaagcttgacttgcagagaatgtaaggaggatggagagagtgcggaatag

SEQ ID NO: 86984 - DNA, 786 bp, Glycine max
  Peptide Sequence Number=SeqID_178669
atggttatccgcaccttttgtcagccagaggcaagcgagcccattgacatgcagagactaacattgtcatctgcacctttgtcatccagagacggtgagtctgatgacatgcagagataccttatggttatttgcaccttttgtcagctagaggcaagcgagccctttgacacgcagagactaacgtcgtcatcggcacctttgtcatccagagacggtgagttcgatgacatgcaaagattacttatggttatccacaccttttgtcagctagaggcaaacgacgctgttgacacgcagagactaacgttgtcgtctgcatctttgtcatccagagacggcgagtctgatgacatgcagagatactttatggttatccgcaccttttgtcagctagaggcaagcgagcccattgacacacagagactaacgtcgtcatctgcacctttatcatccagagacggcgagtccgatgacatgcaaagataccttatggttatctgcaccttttgtcagccagaggcaagcgagcccattgacatgcagagactaacgtcgtcatctgcacctttgtcatccagagatggcgagtctgatgacatgcgaagataccttatggttatccgcaccttttgtcagctagaggtaagcgagccagttgacacgcagagactaacatcgacatctgcacctttgtcatccagagacggcgagtccgatgacatgcggagataccttatggttatccacacctttttgtcagttagaggcaagcaagcctgttga

SEQ ID NO: 86985 - DNA, 576 bp, Glycine max
  Peptide Sequence Number=SeqID_178670
atggacaaggcgagacggggacctgacacttctgctccttcttcttccgctcttccagctccagctcctccaccaacaccaccagctcccactcctaccactccaataccctccagaacctccgctcagagcatagagattctagtgtcgatgctgcagagcctccaccatggcttatgcctggtgatgcagagtatcaatcatctggctcaacatcggcccattatgagcatggaggcatttatggcccaagtggtctggccaggagtccagcattctcctttggggggaggtaaggctcctacagcccaggagtcacagtcagaagctgagccggaggcatcaccagaggccgagggcactctggaggacacaccagaggtcacacctgctgccacaccacttgtggagattgaaaaggatgaggatggcaccgaggacacagattacacagtagatatggcagcgacaaagagcactagggatccctggcccactccagcaccagagacatctcagccagccccggatgctccttcctcacatcatgatgagcatacaccggcacaggattga

SEQ ID NO: 86986 - DNA, 338 bp, Glycine max
  Peptide Sequence Number=SeqID_178671
atggttgctggaaatacaacaatagaaaagcctagggaagattggagtgaggaagaaagaagactagtacaatacaacttaaaagccaaaaacataattacatctgccctaggaatggatgactactttagggtatcaaactgtaaaagtgcaaaggatatgtgggatactctacaagaatacgaaatggaattgttgagactaaatcaacatgaagaaaatgataagaaaaagaaaggaattgctcttaaagcttcatcttcaatccaagaagaaagtgataatgaagacttaattgatttgaatgaagatgataatcttagcctttttgtaaaaag

SEQ ID NO: 86987 - DNA, 267 bp, Glycine max
  Peptide Sequence Number=SeqID_178672
atgccaactgagccacgaactccagtggtgaatccaccttcttctcctgagcttgaagtagtttctccatctccacctttgattgtcatctccgatgcatcatcagatgaagttgctacccctcctaattcaccagctggagaaacagctgacccccctgcttcccagttggaggaattgccgatctttctgattcgtcatctggagaagctgttgctcttattgattccccagtttaaaccactgttgacatttattgattcttga

SEQ ID NO: 86988 - DNA, 237 bp, Glycine max
  Peptide Sequence Number=SeqID_178673
atgggatcgtctaggttgatagggttgatgcccttgaagtccttgtccgtaaaggtgataggaggaagacttcactatagggttgcatcgacaaaattaatgttgatgtcctggatggcgtatttgcctggatttacatgcagtgtttataacggtaatcatgctttggtatcaccagaaagtcatgtatatggcccattgcctgattggtactgtaacaccctacaatattactaa

SEQ ID NO: 86989 - DNA, 204 bp, Glycine max
  Peptide Sequence Number=SeqID_178674
atggaaaatgcgcggagtcaccaccaacgtttattcgaggaaaacgtcggaaaaaccggaaaaggatgtggtctacaaactttaagtgtgaaaggttcgggagttgtatttacgcacgatgaaggtcatttaaggcgttggaccattaaacgatctttcgattcttttgaaaggagagaaaacattaaggcattagaccattaa

SEQ ID NO: 86990 - DNA, 456 bp, Glycine max
  Peptide Sequence Number=SeqID_178675
atgtccaaccataagagtactgagttagccctgaaaaacattgagattcaggtgggtcaactggccaagcagttagctgagaagtcatccgacagattttgggcaaatactgagaagaatcccaaagaagagtgtaaagctgttgtaacaagaagctggaagcttgtggcggctgaggatgaggatgttgttgctttgaaggagcaagttgccttgaaggacaccactgttaaaaagaagaataaggaaattggaaataactatgccctttggagaagctttgcagcagatgccactctactcaaagtttttgaaagatatgttgacaaggaagcacaaatacattcactaggagaatatcgttgtggaaggcaactgcagtgctgtgatacagaagatccttccaccaaaacacaagaaccttggaagtgtgactattccttgttcaataagtga

SEQ ID NO: 86991 - DNA, 487 bp, Glycine max
  Peptide Sequence Number=SeqID_178676
gtcgactctagaggatcccccactcaaaggcggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggattagcagagcgaggtatgtaggcggtgctacagagttcttgaagtggtggcctaactacggctacactagaagaacagtatttggtatctgcgctctgctgaagccagttaccttcggaaaaagagttggtagctcttga

SEQ ID NO: 86992 - DNA, 756 bp, Glycine max
  Peptide Sequence Number=SeqID_178677
atggctaagtttgaccctgagatagtcctagagttctatgctaaagcttggcccacagaggagggagtgcgagacatgtgttcaagtgtgaggggtcagtggattccctttgatgcaaatgccctcatccagttcctgggtgacccgctagttttggaggaaggccagcaatgtgagttcagccagaggaagaagagggccgacgggttcgatgaggagaccattgcccagctgttatgcacaccggggcaagatttcgcccggaccgctgcagggaggcgggtgcagttgtcttacctagctttgatccagacgtggatgacactgctgctcagcaatgtcttacctagcgatcataagtccgatctccctctgcctaagtgccagttggtgtatgccatcttgacacggatgagcgtccacgtggcccaggtgatggctgacgccatctatttgtttgtaggtatgccacccaccaggcaccctctggacccggataagtctaatagggccctgggtaaagtgatcttaccgccgatcactcgggccttcatcaagaagtactgcatgcctaggcaagcgcagggtgatgcacatcaggccgcagacgcaccgccaccacctcggcaggccgatcccgctggatcactaggcatggagcattatctacaacacttggtttgccagcaggcggccaatcaccgtgggcaggtgcagatacatgagtgtctctaccggttcagcctcagtcagtag

SEQ ID NO: 86993 - DNA, 510 bp, Glycine max
  Peptide Sequence Number=SeqID_178678
gctgacaaagccattgcagaaattgaggcaaagtgtggccaaaaaattgaagaatgcaaagaagaacaaaggcagcagttgatgcgcattgaagatgaacacacgttgctcatcaaagcattgaggtgtgaacttgaagatgagtgtcagaagctggaagaggagttgcatcttcaaaaatccaaagaagacaggcaaagggctttgttgcagttgcagttgaaagtgatgagtgacaagcccaaagaggaccaagaagtgaattcaaaacagactctcagtcatagcctctgccagggaataaataccttgaattcaaatgtcaaatcagacactgcattccaaggcggttattacataataaccgtctttgaatgtcgaccagacgtaacattcaaagacggttattatgtaataaccgtctttgaatgtcgaccagacgtaacattcaaaggcggttattacgtaataaccgtctttgaatctcgagcagatgtaacattcaaggcg

SEQ ID NO: 86994 - DNA, 384 bp, Glycine max
  Peptide Sequence Number=SeqID_178679
atggagaaatttgagaacaaaaacattggagaaaagaaggcaaagaaggcctacatcacatgggatgataacgacttagaatcgtttgatgattctgaaaaagaagtgattaatctatgtctaataggcaaaaactatgaaagtgacgaagaggtaacatcttctaacaaatctatttcttttgatgagttacaagatgcatttgctgaattacatagcgaatctattaaacttgcaaaacttgtttcttcatctaagaaaactatgtcagatttagagaaaaagatttcaaagttaaataaagagttagatcatcttaagtctgaagtgtcaatctctaaatcaagggataaagttcatgcttctactatgactattgaaaaa

SEQ ID NO: 86995 - DNA, 183 bp, Glycine max
  Peptide Sequence Number=SeqID_178680
atgggtgtttcctctgatcagaaagccattctcttatcctgggggaaactgtcaggaagccacattataaacgaaacctcaaagagagttggacttcgtcctcaaaaggaaacaacaccagaaaatctagccttccatagattcaaacagaaaatgcaaatgaaactaaaagcagaaacgtaa

SEQ ID NO: 86996 - DNA, 47 bp, Glycine max
  Peptide Sequence Number=SeqID_178681
atggaatatttacagaatccccatgataggaccaaaccttatctgtg

SEQ ID NO: 86997 - DNA, 192 bp, Glycine max
  Peptide Sequence Number=SeqID_178682
atggccggaacagttgattcattgtggattggaaagaagaagggtttgacattcacaggggctgtgtttggtagtagagttatagaatggtccgtgggtcgtgacggtggtagggttgctagaggttggaataatgaggagtacttggtgaccaaggatgcaatttccgggagcatgtgtgtcgtaggttga

SEQ ID NO: 86998 - DNA, 723 bp, Glycine max
  Peptide Sequence Number=SeqID_178683
gcgcaaggaagctgattggtgggatccccctgtggttgcaccgccgaccgaccctgatcttctgaaactctggtggaggcccgcagcgatactgacgatagctggagcccgcgggcgagttctatcgggacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggaggcgcgagccgggcggagcggtcgtcggtgcagatcttggtgggacgggggaagcccgtctgatagcgctctgtgcgcgtactccgaaagggaatcggcctgcccaccctggaaacggctcagccggaggtagggtccagcggctggaagagcaccgcacgtcgcgtgcctctggtcgatggaacaatgtaggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaaca

SEQ ID NO: 86999 - DNA, 528 bp, Glycine max
  Peptide Sequence Number=SeqID_178684
atgtctcttctcttcttgatcattgttgctattgtgattgttgcattgttttttaccatctttagacccaaggatcctaacatcattgtccaccccgttggcttcgaaaactttaacccttccctcttaaccaatgtgaccgcgaatgtgagcctcggcatgcttatcactatcgagaattcaaactatgaaaactttgagtacccaaatgccactggttatatcaaattccatgacaccgttgtgggccaagttccaattgtgggagagttggtcccaccgcgaagccagattaatgtgaacacttcggcaaatttcatggtagcaaagttaatcaatgaccccaattttttgtcagattttctaagtggaattgtgaatttcacatcaacagcttcactgcctgggaaagcgcatatgctaaagattatcaaattcaaggccacagtttatagctcgtgtgacatctctcttaatataacctctaggaatgttgattccaaatgcatatccaagatcaagctttga

SEQ ID NO: 87000 - DNA, 711 bp, Glycine max
  Peptide Sequence Number=SeqID_178685
atggagaaagatattgatgaagttggaaagattgcacatggggtcaaaacaaaaatagaggctataagcagagataacctatccaatagacaaaagcctggatgtgagaagggaacaggtgttgacagagcaagaatgaatatgacaaatgccttgactaaaaaattcaaggatctcatgacagagttccagactcttagacaaagaatacaagatgaatatcgtgaggttgtggagagaagagttattacagttacgggaactaggccagatgatgagacaattgatcgcctgatagaaactggaaacagtgagcaaatcttccagagagcaattctagaagcaggccgaggacagattgtaaacacagtagaagaaattcaggagagacatgatgctgtaaaagaaattgagaaaaaacttcttgatttacaccagatttaccttgacatggcagtcttagttgatgctcaaggagaaattttagacaacattgaaagtcagagcacatttagtttgatttgcgttaatgagaggcttgttcaggtcaacaatgcagtcgatcatgtccagagagggacatctgcacttcaaaatgctaagaaactccagaagaactctcgaaaatggatgtgcattgccatcattatactgttgataatagtagctatcatagttgtgggtgttctcaaaccttggaagagtagctag

SEQ ID NO: 87001 - DNA, 519 bp, Glycine max
  Peptide Sequence Number=SeqID_178686
atggaggtggattgggaatcctcccattctttactctgtactgttgagagttctgattcagctcgtagagaggcactccttaaattcatcaaacatgctaataaacaaatgatatattcctccttgctgcaaaggtggtgggactgtattgctttgccagacgatgttgattcttctgatgaagcttcattcaggctgcaaataaaaatgttggcatttgagtctctccaacttcttaaaaaagccatatttgacaaggaatcttctcctgtggaggattacttcttatacattgatgatctgacatatcctaataaggaagaagctgagaaaattacgcaaccaattctggatgctcttggtgaagagtattctatttattgcaaaggaactgcattttttcctttgcaaagctgcttgaaccattcctgttgtcgtaatgccagggctttcaaaagagatagggaatgtggggtgccatgtgcgtcaacaagatcccctaagcctttgatgggttga

SEQ ID NO: 87002 - DNA, 1482 bp, Glycine max
  Peptide Sequence Number=SeqID_178687
atggatctcgaaatgatcttcacaaatagtgtgacccctcattggaacaagcgcttcagtttcttctgggcatgcacagaccaacctcgtgaaatacacattgaggaagaaggaatacacgcaagaattgcttcatttgaacaaatggtactattaggaacaccatcaaagctagaaaacttgcattcttcatcacataatgtgtatgaatctaaaaccaccacaacccttgaccatcttgtgtttggaattgcttcaagtcggtcttcatggcctaagaggaaggaatacgtgaagctctggtggaacaccatacgcaacacaacaatgagaggatgcgtattcgtggatacacttccacaagacaaagataacaacaacaatgccagtacccttcctcctctctgtgtctcccaagacacttcacggtttcgctacacttacagtggttggggagggggaatgagatcagcaattcgtgtggcgcgtgtggtgaaggagacagtggcacggatgaaccattctcatattaggtggtacgtgtttggggacgatgacacgctcttcttccctcagaatgtggtcaaaacgctctgcaaatatgatcacaggctttggtactacgttggtgctaactccgagagttataagcagacatggttttttggatttggaatgggatttggtggggccggttttgctatcagttcgtctctggcaacagtcttggtcaaggtctttgattcttgcatagaaaggtacccagaactgtatggaagtgatgccagggtctacgcttgcataacagaactaggtgtaggattaacacatgaacccggttttcaccaggttgatttaaggggaaatgcctttggcctattggctgcacatccattaacacccttgttgtccctgcatcacttggacaacattgatccaatttttcccaacatgacaatcataaaagctctacaacatttatatgaagcggctaaagttgattcccagaggcttctacaacaaacagtttgttatgacaaacggttgtcatggacaatctcggtgtcttggggctatgctgcccaagtgttccataaccatttgtctttgccagatgttgtcagagttcaaaaaacattcaagcactggaccagaggaactgctttggcagaccaatttacttttgacaccaaagaacttcacactgacccatgtagaaggcccaccatattctatttggaaaatttgtcccgtggtgaagatggcataataataagcaattaccggaaatctatccaaaattgctcatccaatgtggcacctgaagttatcagagtggcctcaagtaagctagagcttggcatcaaacagttgctggctcaaagaaggcactgttgtgatgtgttgccctctagcgtttctgaccaaatggagattgcaataagggaatgcaaagaggatgaattgattagcatgcaatga

SEQ ID NO: 87003 - DNA, 1245 bp, Glycine max
  Peptide Sequence Number=SeqID_178688
atggtcaacagtgaggtttctacacgtcttgagggaaaatatgctgcaattgtggtgtgctggcttcttggcaatggatgtcttttctcgtggaacagtatgctgacaatagaagattactacggttacttgtttccgaaataccacccctctagggtgcttactcttgtatatcagccattcgcagttggaacacttgcgatactggcatataatgaggccaaactcaatactcgactaaggaatctgtttggatatatactttttttcataagcactttgttggtgttaattttgaattcagcaacatctggtaaaggaggacttggaactttcatcggtatatgtgcacttagtggtgcttttggagttgcagatgctcatgttcaaggtggaatggtgggagacctctcctacatgaaaccagaattcattcaatctttccttgctggtttggcagcatccggtgtattaacctctgctttgaggttggttacaaaagcagcatttgagaattctaaggacggtctccgcaaaggagccattctgttctttgccatatcaacattctttgagcttctttgtgttgttctctatgcatttattttccctaaaataccaattgtgaagtactaccgttcaaaggcagcatcagaaggatccaaaactgtttcagctgaccttgcagctggtggcatccggacattacctggaacagagaaggaatatacgaaagatccagagaggaagggaaacaagcaattgttattagaaaatattgactatgcacttgacacgttcctaatttatatgctaacactgtctattttccctggattcctcttagaagatactggatcacatagtttaggcacctggtatgctcttgttttaattgctatgtataatgtgtgggatctgattggaagatacattccactcttgaaatgcttgaagttggagtcccgaaagttgatcactataacaattcttagccgtttcttacttgttccagcattttatttcactgctaagtatggtgaccaagggtggatgatagtgttaacgtccttcttggggctatccaatggttaccttactgtctgtgttctaacatctgcacccaaaggttacaagggtccagaacaaaatgccttgggaaacctattggtgttgtttcttcttggaggtatttttgcaggggtgacacttgactggctgtggttaataggtaaaggatggtga

SEQ ID NO: 87004 - DNA, 1407 bp, Glycine max
  Peptide Sequence Number=SeqID_178689
atggctcaagagatgaatgagcctgcaatgaacatcatagagcagtctcaagttgctcctccacagggctcccttccttcaacaattatccccctcactttcctcgacattccatggctcctcagccgccacgccagacgcatcttcttctacgactttccctttcctaccacccacttcttgcaaacagcacttcctattctgaaacattctctttcccacacactccaacacttcttcccctttgcctccaatctcatcctccctccacacccccacgtcccttacatccgttaccttgagggtgactctctctcattcactgtcgcagagtccagtcctgcagacttcactcttctcacatcagattcccctcgagactcctatgactggcaaccccttgctccggtgctaccctcgcaacgtacttctcacgacggcacgtgcgagttccccctcatggccattcaggtaacgatgataccaaactctggattcagcatctgtgttatcttcgaccacgttgcaggagatgggagaacccttcatcatttcatgaagttttgggcctccgtttgcaaggccaaaggagatttggatttcccttgctctatgcctctacccttatatgataggaacatagtcaaagaccccaaagggctcatgcacgtttacatgcaagacctgagaaattcagcgttgctaactaaacagttccgaggggttttacgtggtgtttacactgacaaggtacgtgcgactttcatattcagtagcgaacaagctcagaaattaaaaaaatgggtctctcttaaatgtaacggttcgcggactttacatatatcaacctttgtggtgacatgttctttgatatgggtgtgtatgctcagatcagaacaaaaggaaaaggaaggtaataatgagccatgcaacatcggattttccgcagactgtcataaccatcctcagttttcattaccttcaaactactttgggaattgtttgatccctctcattacaaggctaaagaggggtgagttggtggaacaaaatgggattgttgcagctgcaaatgccattgaaaagaagattagagatttcaagagtgatgctttgagatgggccgaaacaacgatgtcagatattagaggcttaaggaaatctggtcaatctcttgtagtgattgttggctcgccaaagctgaccgcgtacaacactgactttggttgggggaagcccgtgaagtctgaagtggtgaatcttgattctgtgggaacagtttctctctctgattgtagggaccaagaaggtggaattcaggttggaatggtactcgagaggattcgaatgaacaatttcaccagcatcttggaagaacaccttagtcatgttgccgttcttgactaa

SEQ ID NO: 87005 - DNA, 345 bp, Glycine max
  Peptide Sequence Number=SeqID_178690
atgggtctcgatctcttgaatgtgccagctacgatgattctgaggcgttacacatatcaaccttcgtggtggcatgttccttgtgatgacgatgaactgtgctacttggtgtttctagcagattgtcgtgatagtactcctgaactttcatttccttcaaggattagagattttaagagtgatgctttgacaaaaactgagacgttgatgtcagaatatagagttatggaaaccagagacaaagaaggtggaattgatgttggattggcacttgacaagagtcgaatgaatagtttcaccaagatcttagaagaacaacttaatattatggcttgtgaagaatga

SEQ ID NO: 87006 - DNA, 426 bp, Glycine max
  Peptide Sequence Number=SeqID_178691
atgagtagtgcaacaagcaaggcttggattgtggcagcgagtgttggagccgtggaggctttgaaggaccagctggcaaaaaatgtttcttcttcatctgctcttgttgcaagcaaattaaagggtgatgagaaggctaaaaaggctgaagagtccttgaggactgtcatgagagcatggactgtggcgattagtgttggagttgtggagaccttgaaggaccaaggcctctgcagatggaattcggctttcaagtcagctcaacaaagtgtgaaaagccatcttagatctttgtcacaggcaaagaagctctcttcttcatcttctgctatgctttctagcacactgcagcatggagagaaggccaagcattcagaagaatccttgaggaccgtcatgtacttaagttgctggggtcccaactga

SEQ ID NO: 87007 - DNA, 252 bp, Glycine max
  Peptide Sequence Number=SeqID_178692
atgggttcgaatccggaaacagcctctttgcatatgcaagggacgaaccctggtacagcggtaaagttgtgccttggtgacttgttggtcatgggttcgaatccggaaacagcctctttgcatatgcaaggaactactgaactatggtcacaacctatgaagcacggacacttcagccctatgccgtgtccggtatccacgtgtccgtgtcgtgtcgtgtccggtgtccgtgtcggtgtcggtgcttcatag

SEQ ID NO: 87008 - DNA, 1176 bp, Glycine max
  Peptide Sequence Number=SeqID_178693
atgatgatgcattcacggatcagaagcgtcgccggaaacatcaaatgcgcggcgagactcttctgttcatcttcgacgatcacgccggcggcggcgccgtcgcagctcccgcagactctggcgggtctccgagcccggctggcggaggaatcgccgtcgctgtcggatttcgtcgcgcttaaatcggacagcgcgtactcagtggaggtcgggacgaagaagaagccgcttccgaagccgaagtggatgaaggaggccgttcccggcggcgagaagtacgtgcagatcaagaagaagctccgcgaattgaagctccacacggtttgcgaggaggcgaagtgccctaatttgggggagtgctggtccggcggcgagacaggcactgccaccgccactatcatgattctcggcgacacgtgtactcgaggttgcagactgaacatcttgagtgtgaagtttgtaggacgggatatcttgagcatgaaattttgtaatgttaagacatccaggactcctccaccacctgaccctgatgagcccaccaatgtggctgaagcaattgcatcatggggcctggattatgtggttataacgagtgttgaccgtgatgatttacctgatcaagggagtggtcatttttctgaaacagtgcagaagctgaaggcactgaagccaaatatgctgatagaagccttagttccagattttcgaggagatgctgactgtgtagagaaggttgccaaatcaggattagatgtctttgcacataacattgagacagtcgaagagcttcagaattttgtacgggaccatcgcgctaattttaagcagtcattagatgttctaatgatggccaaggaatatgcgcctgctggaacacttactaagacttcaataatgttaggttgtggggaaacacctgatcaggttgtgaagacaatggagaaggtgagagcggctggtgttgatgtgatgacatttggtcagtatatgagaccttcaaagcgccatatgccggtatctgaatatgttaccccagaggcctttgataagtatcagaaacttggcatggaaatgggctttcgatatgtggcatctgggcccatggtgaggtcatcatacaaggcaggctggctagtgtctgtctcacaacatcctgtggggactaatggttaa

SEQ ID NO: 87009 - DNA, 108 bp, Glycine max
  Peptide Sequence Number=SeqID_178694
atggagaacataattgaatacagtgatgagaatgaagaaaaattaatggattgtaactttaatttagaccaggtccctatggcggggctaatcttgagtagagactag

SEQ ID NO: 87010 - DNA, 1110 bp, Glycine max
  Peptide Sequence Number=SeqID_178695
atggctactgtttcttctccttgtactgttttccccatacttacatcaaccttgtcgaagccccacttggctcccctctcttgccgaacccaaaaacgaagtcgtgtcagtatcatcacctctgtcgccgaggatcgagaaatagttccggtgtccgaagatagaggaattcgtttgaacgaagttgatggatttcaaccttcggagcctcacacagagtcagatgttgttgttcctcgcctcacaagcagtagtaccgtcaatgccatcatcgttttggggtttgggactttcgctgtcaccaagttgctcaccattgaccatgactactggcatggttggacactttttgagattgtaaggtatatacctgaacacaattggattgcctatgagcaagctctgaaagcaaacccggttttggctaaaatggcaataagtggaattgtctactcaattggagactggattgctcagtgctatgaaggaaagcctctttttgagtttgatcggacacgcgtactcagatcaggtcttgttgggtttactctccatggatcactttctcactattactaccaactttgtgaggctctttttcctttccaagaatggtgggttgttcctgctaaagttgcttttgaccaaactgtatggtctgcaatttggaatagcatctacttcgtggttttgggcttgttgcgttttgaatctttgactaacatatatggtgaactgaagtcaacattcttgcccttgcttactgtatatagtagggaagtaattagagtgagccttggattcaaattttcatgcagggtggaaactttggccttttgcgcatctgattacttatggtgtgattcctgtggaacaaaggcttctttgggtggactgtgtggagctcatctgggtcacaatactttcaacgtagctattcaaatgagaaatcagaagcacgaatatctgaggcagcatcagaaacagggtcatccacttcaagcgaaaattccaaggaataaacgaaacgaggagaggagaaaaaactatctaggttcatggcagttgcaaaatcaacctcagcaaagatttgaagaatctatcagttga

SEQ ID NO: 87011 - DNA, 156 bp, Glycine max
  Peptide Sequence Number=SeqID_178696
atgtatgataagatacttaaacgaagtactaaatggatgaggaagaatgtcttagaagtaccagtattggaggatatccatgctttgaaagatgaagctgttatgtaccaaaagaaagaacgagagatatacggtgtaatgtgttccgtaagttaa

SEQ ID NO: 87012 - DNA, 978 bp, Glycine max
  Peptide Sequence Number=SeqID_178697
atggaaaacatccagcacagtcacgtggaagttaagggactaaagctccatgttgctgagattggaagtggtcaaaaggcactggttttcttacatggattcccagaaatatggtatacatggaggcaccagatgattgctgcagcaaatgctggctaccgggctattgcctttgatttcagaggctatggactttctgagcatcctgcggagccagaaaaagcaaacttacttgaccttgttgatgatgtcgtgggtctgttggattcattaagcattaccaaggctgtgcttgttggtaaggactttggtgcctttccagcgtatattgttgccgctctccatccagacaaagtagattcagtcataatgttaggtgttccattcatgcttccaggtccctctgctattcagaacctcccaaaaggctcctacgttattaagtggcaggagcctgggagggcagaagcagattttggccgctttgatgttaagtcagttataaggaacatctacacactcttctctggaagtgagataccaatagcaggtgataatcaggaaatcatggatttgtatgacccaactactcccctgccaccatggttctctgaggaagacctggcaacctatgcatcactatacgaaaaatctggcttcagatttgcattgcagttttcaagtctagggtacttcagtaatattatctcagttaatgatccacacaggactcttggagtggatagtggcataagtgatcctaaaatcacagttccggcactgctgatcatgggtgagaaagactatgtcttcaagtgttttggaatggaggactacatccgaagtggcgcagtgaaacattttgtgccagacttggaaatcatatatattccagaaggaagccattttgtgcatgaacaatttcctgagaaggtgaaccagctcatcattgaattccttaacaaacaaagcatttga

SEQ ID NO: 87013 - DNA, 339 bp, Glycine max
  Peptide Sequence Number=SeqID_178698
atgaggtggaacaaccacccaagaagaataggctttcatgataaagcaaagtcagtttggggagatgaggacctttcctgtatatccctaaatcctggtgcttctgctatgcataaacttaggccacagccatcttgggatcgtacatgtacagcggcagcagctgctggtctgctctcagagctccagcttcttccacagtttagctctgttgaattggaaaaacaggcagaagcagtagaacatgctttaacagtcctattagatgccctcacaaatagacgtcttcgcatgggaagatccataacacgaaaaatgaggcataccaacatccaataa

SEQ ID NO: 87014 - DNA, 640 bp, Glycine max
  Peptide Sequence Number=SeqID_178699
gatccccgttgaggtcgatggccatgtgatggaagatgtaagcgatgcattcggggaggaagcgaaggttggcggcctcgccccaaatgaggaggtagagggcgacgtagagaagttcgcggcggcggtcgtcatcggaggagttggttttgttattggagagccagacagagggtttggtggggaggtggttgcaccaggcggtgtagttgcggaggagttttgtgcggaaggagcggaggacggtggcgtcgagggtttcggggggaggggagaggcgcatctgggagttggcgaggtggaggacgaggtgctcgcgctggttgcgaacgttgtcggtttggaacccgaagaagagggcaagccagtccaggaggtccatacctggctgccatttcggggggcggaggaggtccccgacggagtggagggcggcggcggcggcgcggacctccgggaagcggagggatggatggtcggagagcggggagtggagggggatgatgttgtagggctgaacgtggtggtggtggcgattagtgatcggcatgtgatggggaatgtggatccagaagagcagggaacactgcgctggttccgggaggtgtttgtttactactacaaggttgatttcaaatga

SEQ ID NO: 87015 - DNA, 258 bp, Glycine max
  Peptide Sequence Number=SeqID_178700
atggagcagtctctgctgagaggcgaaagcagtgaccagagtaaccggtcgcggggaatattccggcgctccgatgctatcacctacggctccaactacgagaaagccgctgcgttcatcgatctggtagtgtcattgttaatattgctggttcgtaattcaagagctacaaatttacgaaggatatttgttttgagggagatgaatagaagtaggagatgtcaaaatgaagaggaagatgaaaaatatcaaaagtag

SEQ ID NO: 87016 - DNA, 147 bp, Glycine max
  Peptide Sequence Number=SeqID_178701
atggaggaaatggaaatgagtttgaactgggaccagaacttgatggaagaacacatctcattgacgattctgggcatgtttccaaactcgttcatcggttctactttgtcaagcattggccaacagacccctattcaatatctttaa

SEQ ID NO: 87017 - DNA, 1008 bp, Glycine max
  Peptide Sequence Number=SeqID_178702
tcagaaaggaaccatatatgctttaggttggaacacttaagacattggcaaagggaatggagaaactgtatggacagaaaagggaagatactaaaccagttgcatgtcgctcttgatgatttgtgttttatgttgaattccttgatgctacacgggaacaaaaattttgcggaggaaaaacaaattctgaggaatgtaaacattcaagagagagatggtgcttcatttaagtcactagaaatgcttaaggaaactgttagatgcaatgattacttgaataactggcagaagctcctgagagaaattgaacaattcgaaatccaatgccaaagagcttctggttctggtaatgcttatgtgaagggaaagatttcaaactctgaatccttgagaaaaactataaaggatgaaattaaggttagatgcaatgattacttgaataactggcagaagctcctgagagaaattgaacaattcgaaatccaatgccaaagagcttctggttctggtaatgcttatgtgaagggaaagatttcaaactctgaatccttgagaaaaactataaaggatgaaattaagcatttatgtgatgactcttcggaaaacaaaagaaaaatgatagcacctggaatcgaagttatgcattcagaaaaagaattagaggccatagacaggctaataaattctctggaaacaaagttgacagagaggcgccagaaaaagggtcaagcatatcaatcaatttcaaaattgaaagagtttcatgatggggaggttatccactattaccagtatagttcgctcattaataaagtccatcagctggctaaagagaaagatgtagcagcccttgatgaattctcacgttcagaggttagaaaatttatgttggaatggaacagtaataaagctttccgagaagattatgagaagaaagttgtgcaatcactcgagagacgacaactaagcagagatgggcgaaggagacaggataaaaacagtacataa

SEQ ID NO: 87018 - DNA, 201 bp, Glycine max
  Peptide Sequence Number=SeqID_178703
atgatccatgttacacttaggaacgaaagcaaacaaattactacaaaagtaaagcaattcttccgtcacgcagcgcaacctccagacaaactcagacatgtgaatgtcatcaaaaagtgtttggagtatagaagtggagaaaacaaaatcaacgaaggagacttggctctcttcaataataatgtctcctctaggctgtag

SEQ ID NO: 87019 - DNA, 1500 bp, Glycine max
  Peptide Sequence Number=SeqID_178704
atggagaaagaacggtacataaaagtgaccgaaataataatactatgtccttatagtaagagttctggtgctggattccatccagcgtatgctaaaaacaaggtcacgtcctcacaaagccacatgaaagccgagctaaagggcacgacgtccatttcctttcaaaaccctaacaccgctctcttcaacacaccccacaacaaccctctctcgggagcactcaaagggtgcctcggaagcctcgatggggcttgtattgagaagctattgctccactgcgccagtgctttggagagcaacgacatcaccttggctcaacaagtcatgtgggtgctcaacaacgttgcttcccctgttggagacactaaccaaaggctcacctcgtggtttctaagggccttaatctctagggcttcaagaatttgccccactgccatgagtttcaaaggaagcaacacaatccaaaggaggttgatgagcgtgaccgagcttgccgggtatgtggatctaattccttggcataggtttgggtattgtgcgtccaacaatgaaatttacaaagcaataacggggttccaaagggtacatattgtagattttagcataactcattgcatgcaatggcctacttttatagatgggttagcaaaaaggccagaaggacccccttcacttagaatcacggttccatcttgtagaccacatgtaccccccttggtcaatatttcaatacacgaagttggattgcgtttagggaattttgctaagttcagagatgtcccttttgaattcaatgttataggaaacacagaaggaccattaacacctgcggaattgagcgatgaatcgactagctttcactttgaagcaatgttaagtctcttaaatcctaccatgctaaaccttagggaagatgaagctttggtcataaattgccaaaactggctacgttatttgtctgatgatagaaagggaattagctgccaaagtttttcccttagggatgcttttttgaatctaatcaaaggccttaaccccaggattgtgctcttggttgatgaggattgtgatcttagtgcttcaagtctcacatcaagaataaccacatgtttcaaccatctatggataccctttgatgcattggagacttttttgccaaaagatagttgtcagaggtcagagtttgaatccgacataggccagaagattgagaacatcataggctacgaagggcaccaaagaattgagaggttggaatctggggtgcaaatgtcccaaagaatgaaaaatgtgggctacctcagtgttcctttttgtgatgaaactgttagggaagtaaaaggtttgctagatgagcatgctagtgggtgggggatgaaaagagaagaaggtatgttagttctcacgtggaaaggaaacagctgtgtgtttgcgacagcttgggtcccctgtgaaatattgagggatcatcatatcggtatggatgcaagcctgtcttaa

SEQ ID NO: 87020 - DNA, 918 bp, Glycine max
  Peptide Sequence Number=SeqID_178705
atggcaattatgtcaaaggtggtgatgggtcttgttctctgcgttcttttggtgtccgcggttttggtccaagatgctgaggcatcaatggtaggccatggagcaatgcagcgtgacacttttcctggatgcagcaaaagacaccccagtaatgtggcctgtcatctgccaatagctaatgattatagaagagattgtgagccaggacaaagatgtcgtcatcaagaagctccaaagattacatgcaatacaactaccaacatcactatgttacaatttacttgcaaaagcaagttggcgggattagctgtgattgaagatgaacttggtagttttgcaaatttactacattgtcaaactatgcatctcccatttgtgtatctaggcatcccaattgctgcaagcccccagagtcgaaacttggcatccggtcatccgaaagttcaagcgaaaactctctttgtggaggcacaagagcttatccattggatgaaggatctgtcttgtcaatatgaaagtggtgcatgtcttgagatctttgcaaagaaattttttgtgggggaaaaagaggaatctaggaaaattgcttgggttttgagatcaaaatatggggagtataatgggaaggtgagagagggacatttcatgaaggggtctaaagggtggagtggagggacctgggggggtgtaacaaaagtgagaggacaaagtcattggtttgcgagtaagattaagtggttggtgggggaaggtgaagagttagcactaccatcggatccggcttcacatgaggcaacacttgggtctgatagtagggaacaaaagaaggaaaggaagtccatatggtcattgtggttatatagaaatgatatagctttcaacaacttcaatgaaggaacagatcatggtattggttaa

SEQ ID NO: 87021 - DNA, 1761 bp, Glycine max
  Peptide Sequence Number=SeqID_178706
atggagaactcaagcgaaaaatgcaattttgaagggaacaaagagttgaatgcttcaaccattactgttggaggaatctatgacatgttgttggacagcatcaaccatgaagacaccagatccgttgttcgtcttggtcgtgtagatcccactgataacccattgtttcggactaccactgtggctgttgatgctattacaagagccgttcattcctttaacttcaactgttaccctcccactgttggcttacctgaggctaagagggctgttgcagaccatctcacctctaatcttccacacaagatcatatcaccagagaacgtttttctcaccattggtggcacacaagccatagatataattttaccttccctagcacgtcctggtgccaacattctccttccaaaaccagggtacccacattatgaacttcgtgccactcgttgtcttcttgaaattcgacactttgatcttttgcctgagagaggatgggaagttgaccttgactctttggaagctttggcagatgagaacactgtggccattgttttcatcagtcctagtagtccatgtggaaatgtgttcacgtacgaacatttgaaaagggttgctgagattgcgagcaaacttggaatctttgtgatttctgatgaagtttatgcccatgttacttttggaagcaaaccgtttgtacccatgagggagttttcgtcaatagtgccagttattaccattggttctttctcaaaacgatggtttattcctggttggagaatcggttggatagccttatgtgatcctcaaggaatttttcaaaaaactgggattgtgacgaaaataatcgacaatctagagatcacttcagatcctacaaccatcgtacagggggtctgttattttactacaaagcgcctacctgagaagcgcgttccaccagaacgcgacacgtggcttgactggacaggacgatgtgacaggggtggtcgtgcctgcctgtcaggcgctaccagtcgtgcctacctgccaggcgctaccagtagtggtagggccccaggcgcgaccactagtggtagcctgacaggcacttccactagtgctgagttgaaacgtgttaaagcgctttataccggtaaatatattgcactgcaaatttgtgacgatgaagatgttgaaacaatgattcaaagttttgaacaacaacaagaaatgcctgtcatagaattatgtgttgaagttgatgttgcggggaacaaggacgtgtcaggggccccaccactagtagaagtgcctgccaggctaccactagtggtcgcgcctggggccctaccactactggtagcgcctggcagtcaagccacgtgtcgcgttctggtggaacgcgctcctcaggcatcgatacctggaatccttgagaaaactacagatgatttccattcaaataatcttaatatactgagggaggctgcaaacatattctacgacggatgtaaggagattccttgcttgacatgccctcacaaaccggagggagccatggttgtaatggtggagattaacttttcacaacttgagggcattgttgatgatgtgcaattttgcactaagctggccaaagaggaatctgtaattctttttcctggtgttgctgttggactaaagaattgggttcgggttagtcttgctgttgacctttctgaccttaaagatggccttagcaggataagagaattcagccttcgacatgcaaagatgtcctaa

SEQ ID NO: 87022 - DNA, 403 bp, Glycine max
  Peptide Sequence Number=SeqID_178707
ggaggtgtggtgcgtggcgaagaacaacgcggaggacgcggcgctgcagtcggcggtggagtgggcctgcggcgccggcggagccgattgcggagcaatccacggaggaggaccctgcttcgacccttccaatatgcagaatacggcgtcgtacgctttcaacgattatttccgcaaacacgctatctccgaagagaattgcaacttcggcaacaacgccgccattacctccttcaaccccagttttggtaattgcaagttcccttctagtttgttagtgaacaatggaagtttctcggggtcggcgtcatctatgggaacgatgtccggtgaagacacaagtgggtacagtggagttgtttggaattggagtggttatgctcagctgcttccaaatttgtag

SEQ ID NO: 87023 - DNA, 417 bp, Glycine max
  Peptide Sequence Number=SeqID_178708
atggtgggtaccttcacactcagacacggtgagagcaacaaagagaacattcctccaggttgcaccaagttggaaacgaagaagaacccaattcctctcatggcgcagcaatctttcaagaggaagatgaagagactccctcttgctgatatcaccaatctcgtcaataactctgcccaggaactaaatcaactacacgggtttggagtttctgctctatcttctgcttccgttttacttcactctatttctcgaaggaggacgacaccagtgttacatagattacaagccaaaaagagacaagaaaatagcaaaaatatgaaaaagcctcaacgtaagatgcgctcagcgcgaatgcagacattctcgctaagcgggaagaagcgtgctaagcgcaaaaacacgcattggcgctaa

SEQ ID NO: 87024 - DNA, 939 bp, Glycine max
  Peptide Sequence Number=SeqID_178709
atgactgcctccaaggatcgcgagaacttcgtctacatcgccaaactcgccgagcaggccgagcgttacgaagagatggtggaatcaatgaagaacgttgcgaatctcgacgttgaactgacggtggaggagcggaatttgctttctgttgggtacaagaatgtgattggtgctcgcagagcgtcctggaggatcctgtcttccattgagcagaaggaagaaacaaaagggaacgagttgaatgcgaagcggattaaggagtacagacagaaggttgaattggagctatcgaacatctgtaatgatgttatgagagtgattgatgagcaccttatcccttcggctgcagctggtgaatccactgtgttttactataagatgaaaggagattattatcgttatcttgctgaatttaagtcaggcaatgagaagaaggaagctgctgatcagtctatgaaagcatatgagcttttactcaaaaggagtttcctcttcagaatactttatcctttcatcccctacctaacccaaatcttgaactcccctgaaagagcctgtcatcttgcgaagcaagcttttgatgaagctatttctgagcttgacaccttgaatgaggagtcatacaaagatagcaccttaatcatgcaacttctcagggacaacctaactttgtggacttctgacatcccagaagatggagaagatgcccagaaagtgaatggcactgccaagcttggtggaggtgaggatgcagaggtgagtaatcctttctatacctgtaccttgagtccgatggatgatggaatcttccataggattcgatgcatgcgtttgggaatgaaacatgagggccgattacttatctgtgtattagctagagatagggattctattgtttcctctttgtttcctgttggattgcccaatacttcccgatag

SEQ ID NO: 87025 - DNA, 207 bp, Glycine max
  Peptide Sequence Number=SeqID_178710
atggatttagaaaatagcctcaggatatgccggtttgagtatgagttcagatgccactccttggaatatcaggaatcaaatctatttgtggtggcagctagcgtaacatcaaaattcaaaactagtggtcttgatttgattatgatacctctggtggcggtgcacgaatcacattctcctctctgtcttccttttctttttgattga

SEQ ID NO: 87026 - DNA, 2469 bp, Glycine max
  Peptide Sequence Number=SeqID_178711
atgaatgaaactctgaagcaaaaccgtctcttgagagaacgaggggatgataactcattccccaattctccaaacaatagtagtagtgatgcaaatcttcagaaaaatgtgtcaaatttccatcttgatggccatgatgaaagatctgccctatattcttttcagcgtgaccaaggaacttcacaaaaggcaatgtcattaccatcttcaccacatgattatagaggccaggcttctgagagaagtgggccatcaagatacggagtgaatgatgaaatggagtcaacatggaataaagtactggaatctccaatgttcaataataaacctctgttaccatatgaaaaatggaacattgacttctcagaattgactgttggaactcgcgtagggataggtttctttggagaagttttccgtggcatatggaatggcacagatgttgcaatcaaggtttttctagagcaagatttaactgctgaaaatatggaagacttttgcaacgagatatctattctgagaataatgacagaatctccaatgagagattcttcctcagctggaactccagaatggatggctcctgagcttattcgaaatgaaccattcacagaaaaatgtgatatctttagccttggggtgataatgtgggaactctgcaccttgaacagaccatgggaaggagtaccacctgagagggtggtttattccgttgcgcatgagggttccagattggagataccagaaggccctctaggcaggctgatttcagagtgttgggcagaatgtcatcaacggccaagctgtgaggagattctttctcgtttggtggacatcgagtactccttcattctgtcttctcttccgcgaaaaagcttttctcctctcttctctcttccacgaaagcaagcttccttggcggtcttcttctccgcgaggcttctccgccttcatcttctccgcgaggcttctctcttccatttgcattcgaggatagaggacgctggaaaaaatggcggaagcttggtgacgatgagccttccggaagacccgttaggggttcttccggaacttccggaagaagatcttccggaagattttcggaagaagggttcttctggaactctcggaacacctcttccggaagatgtacttcttccggaaacattccggaagagggttcttccggatgacctttcaatggttccggaagcacttttcggaagaccctccttccggaatgttttcggaagaagtacttcttccagaataaatggatatcttccggaagaagtttcttccggaaacattccgaatgacgttcttccggagaaaaaggttttccggaatgattccggaagaaccttcttccagaagaagaattcccgaaagacaatttcgccactgtttgctggatgccccaacaataaacctggacccaccgaactcaccgtatcaccaaaccaccaccaccaccgtcaatccaaaaccaaaccaccaacaccagcctccaccatggactccatcgccggagctccgccacacgccgacgtcacccctccgccgcctcggcagtcgccgttccccggccgggaagactgctggtcggaggaagccacgtttacgctcatcgaggcgtggggccagcgccacctcgaactcaaccgcggcaacctccgccagcgccactggcaggaggtcgccgacgccgtcaacgcccgccacggccacgtcagcaccaaggcccgccgcaccgacgtccagtgcaagaaccgcatcgacacgcttaagaagaagtacaagatcgagaaggctagggtttccgattccggcgactccgccaccacctggcccttcttccgccgcctcgattttctcatcggcgacaatttccccgccaagaagccctccccgcccgccaccgccggaataactcgccggagcaccccgccggccaagtccccgccttgggcggtcattccggtcggccctcgatccggaacaaagaagcggccggcggcggcgaagccggcgtcggcctcgccggatagcgtcgccaactcgtacttccgccggaatttctccgtgttcgcagccgcggcagcggcggcggcggcggcggcggccgacagcgagaattcgaatggttcgaaatggagcagtgggagtgagaaagggacgatgaagaagaaaagaacaagaggagattgggaatttgggtacagagagatggcagaggcgttggagaagtttggggagatttatgagagagtggagggagcgaaacagaggcaaatggtggaattggagaaacagaggatgcagtttgctaaggatttggaaacccagagaatgaaactcttcatggaaactcaggttcacttgcagaaaatcaaccgctccaaacgttcttctgcttctggtttgttattagcctctctttttctttcatgtcaatttcttaaatga

SEQ ID NO: 87027 - DNA, 623 bp, Glycine max
  Peptide Sequence Number=SeqID_178712
atggatgagacaatttgcgtatctgaagaagatcatcataagagtggaagtagtagcaaaccctcttctccaactcttagaagaaaacgttcatttttcgatttgaatgaagaagctgtggatggtggtggagatgatagcaccagtgatgatgatggcctcatgactagcaatggcatttcatcacaagaaggtaatttgagtagcaacaatagctctagtgaagaagggaaagagcgtgcatctactgttagacaatatgtgcggtccaaaatgccaaggcttcgttggactcctgacctccatttagcttttgtgcatgctgttgagaggcttggtggacaagaaagagcaacgcctaagttggttctccagttgatgaatgtgaaaggactcagcattgcacatgtaaagagccatttgcagatgtatcgaagtaaaaagcttgatgagtccggccaagttttaccccacaatagggcaatgcaaggaaggcatagtatttttgatatgtacggaagacttaatgccccacgacactttgggaatgataatagaaactatttgccatcatctctactgttggaacaaagaccttatgaaagtggtcatggttcttcaag

SEQ ID NO: 87028 - DNA, 303 bp, Glycine max
  Peptide Sequence Number=SeqID_178713
atgaccccaaagctccttgcctttaacaaagatctggaactggaatgtccaggtggagtagttctttccattaagacgaacaaagaggacatcatatcttttagtagacatgatgctgagaaaaaatcacaggaggagaaaaaacaagaaactggaaaaatcaagaacagaaccaggatcaacatgaatagtgccacgcgtgaacagtaccacgacgtgaacaatccgcacgcgaacaatactgcacaagagactagaactgggaactcggagaccaggagtgcggcgaaggaaaaaaactag

SEQ ID NO: 87029 - DNA, 1386 bp, Glycine max
  Peptide Sequence Number=SeqID_178714
atggagaacgcacctcctaatcctatgcacatagcaatgtatccatggtttgccatgggacactttatcccatttcttcacctctccaacaagttagcaaagagaggtcacaaaatctccttcatagtccccaaaagaacacaaaccaagatacaacatctcaaccaacacccacacctcatcacccttgtccccatcacagttcctcacgttgatggccttcctcatgatgcagaaaccacttcagacgtgctcttctctttcttccctcttcttgccaccgctatggatcgcatagagaaggacatcgagcttctactgagggaactgaagccgcaaattgttttctttgatttctctttctggcttccaaacctggctcggagcctaggaatcaaaagcgtccaatacttcatagttaatgcagtttcagtggcttacttcggttccccggaaagatatcacaatggaagagacctgagtgaaactgatttcacgaaaccctctccggggttccctgattcttcgatcacgcttcacgaacacgaagctcaattcgtcgttcgcatggggaaggtggagttcggcagtggtgttttgatgtacgaccgtttcgacatcggtactaggttgtcggatgcaattgggttcaaaggttgcagagaaatagaagggccttatgtagattatcttgaaacacaacatgggaagcctgttttactttcagggcctcttttacctgagccaccaaacactactttagagggaaaatgggtcaaatggcttgaggaattcaaccctggttctgttattttctgtgcatatgggagtgaaaccactttacagcaaaatcaatttctagagttgttgcttggtcttgaactaacaggctttccctttcttgcagcacttaagcctcctaatggttttgagtctattgaagaagcacttccagaagggttcagagaaagggttcaaggaagaggggttgtgtatgaaggttgggtgcagcaacaattgattttagggcatccttctgttgggtgtttcataacacactgcggggctggttctataactgaggcacttgtgagtgagtgtcagttggtgtttttacctcgcctaggttctgattatgtcatcactgcacgaatgatgagtagggagctgaaggttggggtggaagtggagaaaagtgaagaagatgatgggtcgttcacaaaagaaagtgtatgtaaagctgtgaaaattgtgatggatgatgagaatgagcttgggagacaggtgagagaaaatcacagaaaagtgagaaacatattgctaagcaacaatttagagtccttccatgttgatattttgtgtgacaagcttcgtgctttactctaa

SEQ ID NO: 87030 - DNA, 1710 bp, Glycine max
  Peptide Sequence Number=SeqID_178715
atggattcaacaagcaacgagcgagctagggacctttttatggggttctcaatatttaccgagccaatgaaaaccgaaatcatcgagcatgcacgttcagccatggaagagttgttaaagataggcactgcagggcatcttttatggaagccgcaaccaaaggatagatatgacattttaaatcaaattgaatatatgagacaatttggtcaggttgattcaacgctaaattcaccaacctttgccacatatcaaaccgagcagccagcatcaatggaaactcctacagtagccctacaaactgaagcttcacgagatatggcatttattaacatgtccccaatcagcattgttgaattactaatggatgtgaatgaatggtcgagtgcattttacaacattgtctcaaaagcaacaattgtaggaactttgttaggagcccaaggaagctataatgacaaattgcacgtgatgagcgcagaacttcatttaccttctactactgtaccgattagggagtattattttggaaggtacagcaagaagttctctcataacatatggggaattgtggatatatcattggagaagtttattccttccccaacgagtaatttattgaaaagaccatctggctgtttaattagtggaatggctaacggacattctaaggttgcatgggttgagcatgtagaagcagatcatagtcatttggacaattatttcaagcctctagtcgcctctactctagcttttggtgcaagccgttggcttaattccttaaacagatatggtgaatggttacaaactctaagagcaacaacatttgttgcagatgaaggagttcttataccccaaactgggaggacaagtttcttgaagctgggagatagaatgatgaaaaccttttgtgcaaatgtgagtgctaccgcagacaatccatggatgaaaataactagttttcatggtgattcagatgtgaaagtcatgatcaagaataatgtagaagatactgcaatgcctcctggtacatctgcggttttcactacttctgtttggctggaagtctccccaaatcgattattcaacttcctacgtcatgagaattccagaaccaagactaatttaattatgatggcatcaataaagctcaatgtaatgccatttatagtgccacatgttctaacgtgtttgtttgttgatttcgttgaaaaattacagtgggatatgctttcacatagacttgttattcgaaaagtcgcgtccatacctaagggagaaaatccagggaattgtgtttccttactgcgtgcaaatacctcacagggcaagcttcagatcttttatctgcaagagagttacacagactcaacaggttcctacgtggtatatgctccactagacgagtcagctatcacagctattgtaaagggaacaaaccctgatagagtgatgattctaccatcagggtttagtatacttcccggaaggttgcaaggagatgaagatagaggcaccactggaagccttctaactgttgcattccatgtatttgaaagtgtcacaaataagtcacatatccttcctgagtatatccacaccatgcgcaaagtcattacagataccgttacctctataaaggacatagtgcagtatcataatcgacccaacaattggatggaggattcagattttctagtcagattctaa

SEQ ID NO: 87031 - DNA, 627 bp, Glycine max
  Peptide Sequence Number=SeqID_178716
atggtgtattgttttgtgttttggtttgcattggtgcttcttgtttttgtgttttgtgtattgttcttcctccctgccatgcttctctactccatggttatttctgtaaaaaactcgtacggattggcaatccaatgtcacgctctcatccgtcgtcatcacgttggaccaacctcaatgaggaactggagtagcttcttgcgactgtgtctaattttcggtgaagttagtaaggtacatactatcaggtggaaggacgtacttgaaaccgtatggcatttggttgacaaagacggaaattatcatagcgttgtctacaacaaagatttggaccaaccagtcattgtagtagggtggacagcactacgagatttttaccagctgactggagaccatctagtattcttaactcattatgattctgtcaccttcaaggtttatctcactcaacagaaagttatagcagtttggacgttccaagcagcatgtattattttgttaaagacaaagactgaactcatttgtacttggagaacgttgcagaatgtcggcttgtgttcaatcattggaggaagacacttaaaattagagtcagatggaaacatttatgtgagaccttatccttga

SEQ ID NO: 87032 - DNA, 108 bp, Glycine max
  Peptide Sequence Number=SeqID_178717
atggggatggaagaagaagggagatggataaggagggaagaaatggcgttagagagggccttagttagcttaaaattcatgcgacatcgcgctaagcgtgacatctga

SEQ ID NO: 87033 - DNA, 285 bp, Glycine max
  Peptide Sequence Number=SeqID_178718
atgggaggagtgattcttcggtgttggttggtagtcggagaaagaaacgcacccccagacaggcgccttcactgtgcacgtgacacagcaggtagcgctcctgacgcgggcgcctttggtagcgcccaggggtcaggtactactggtggcgtccctgctgcaggcgctacgactagcgcagggcagccaggcgcctaccccccagcctcttcttctcacacccccagtctcttcccacacccccccaaaattttatattttttatattgtttatcaaaaatttaa

SEQ ID NO: 87034 - DNA, 780 bp, Glycine max
  Peptide Sequence Number=SeqID_178719
atgaagaactgcgagttgtgcaagcttccggctcggactttctgcgagtcggaccaggctagcttatgctgggactgcgacgccaaggttcatggagccaacttcctcgtggaaagacacacgcgcacgctcctctgccacgcgtgccagtcgcccacgccgtggaaggcctccggcgccgccctcggaaacaccgtctcgctgtgcgagagatgcgccggcggaaccaccgaacaaggtcaagagagccaaggaggcaatgacgacgacatagacaccgacatagacaccgacgatgaggatgactacgatgagagcgaggacgaggttgccgccgacgaggaggacggagacaaccaggttgtcccttggtcctccgagccgccgccaccagccccgagctcttccagcagcgaagaatcggttagccggtgcaacaacgtggacgaggtttcgaccacattgaaacgccgtcgccaggaggacaatgattttcagggttggaattcgaataattggggatgtgaacggagcgaagtggagagaggaggttggttggttcggttgcggcggagaaccgccgatgatgtggcggttgagcaacggagtgctagagcggcgtctccagacggttgctgtggtgatagagcatctgaagacagtgcaaccaagaaagagaaaagcgtgtgtgaaaatgcgatgagcagggttagacacgcagctaagcctgtggctctggaaagcaaaaattctgcgtgtgaggaagttgcttcgatgtag

SEQ ID NO: 87035 - DNA, 114 bp, Glycine max
  Peptide Sequence Number=SeqID_178720
atggctcacacatttggaaaaggatttcggtatccatttcaaccaatgattccattaggagcgattttagccattgttgatcctgtggtgataggcattgttgagaagccagag

SEQ ID NO: 87036 - DNA, 297 bp, Glycine max
  Peptide Sequence Number=SeqID_178721
atggggaagcataataactctggatgggagcggtattttaattggaaaagaccgttgttcgacagcgaaattggaatggctatcacttttctttctgaagttgaagctaagcctattcacaattatgggtctgatagctgggactgggcagcagacccatggggtatctactctacaaatagtgcttattcaatgttttgggaggaagcagcagtggacagtcttgaggaatgctttgaggagctatggaaaatcaagattcctagtaaaatagcggtttttactttgatagattaa

SEQ ID NO: 87037 - DNA, 213 bp, Glycine max
  Peptide Sequence Number=SeqID_178722
atggaggagggaaaaggggtggtggagaaggaggcgaacggcagtgccggcaccgaagccgaggagggagaggggaacgatggaagagaacactcgacaaatatcagcaaagaggtttggggcacagaaattgaggacatgatgacgatgggcactggaacaacgacaatggtcacaatggaaacgatgacaacaatgagaggcgagatctag

SEQ ID NO: 87038 - DNA, 117 bp, Glycine max
  Peptide Sequence Number=SeqID_178723
atggttgcaaacgaccgtcttagaatgttgaacattctacatcggtccttcagacatgaccatcatagaatagtcatcattctaagatcatcatgtctcaacgaccgtcttagaatg

SEQ ID NO: 87039 - DNA, 204 bp, Glycine max
  Peptide Sequence Number=SeqID_178724
atgagcttgccacccagctcgcctgttgcttcctccagaaggcaccgccttctagaggaacatcctggaaggcccaaaatgttacggaacctcacagattgggtaacaatgcttccttttgacttctggcacgttatggaactttacgtattgtgcaacaatgggtgccaagtacctcgaagcggtcgagcaaaggttgcatga

SEQ ID NO: 87040 - DNA, 352 bp, Glycine max
  Peptide Sequence Number=SeqID_178725
gtatgccagccaccaggcaccctctggacccggataagtctaacagggccctggggtttccggcattgatcactggccttttccagtcattcgggattcccgtcacccccagtaaggtgatccgaccaccgatcacccgagccttcatcgagaagtactgcacgcctaggcaggcgcaggatgatgcgcatcaagccgcagatgcaccgccaccacctcggcaggccgatcccgctggatcactaggcatggagcgggaggagcccgcaggatcccctggtgaggcagaggaggcccgtatggatgaagaaatgactgacttgctcggtttcttgggaggaagcggagccac

SEQ ID NO: 87041 - DNA, 603 bp, Glycine max
  Peptide Sequence Number=SeqID_178726
atggccgatgcacttgccactctagcatccatgtttcagttgatcccgcatggggacttgccgtacatcgaattcagatgttgcaacaagtccatacattgctgcttgataaaagaggagcaagttggtaaaccttggtactttgatatcaagcgatacatcaaagacaaggagtacccacgagaggcttccgacaacgacaagagaataaacaaagctaacaacaatgctctgggtcaaacacccacgtcactacgtgaaagtgctgagagcatctcggttgaaaggttcccctcagtgtgggatttcaatggagaaaatggtggtttgtggtggctaatggtggttgtgggtgatggagaaagtgcttgggacgttagaaatggctttggaagaaagaaagaagaaatggtgtttttcctaagctacacgaaagcaaaagctgaaaacgcttatgtgagaaatggtctcggacacggaaacgtcacgttgggtagcatttttactgaggcagctcatgtggcttcctcaagaagcttcattaagaggcttcctcgtggcttctttgagaagctttctgaagaggcttctttgagaagctag

SEQ ID NO: 87042 - DNA, 432 bp, Glycine max
  Peptide Sequence Number=SeqID_178727
atgcctctcaaaagaaatggctccgaagaaactcccaaccaagaggtcgagaaaagatgccgctggatttggatgacgttgctacttagcaacattttccccaacgaccatagttcagacctccccttgctgaagtgttatctagtctacgccatcctgactcagggccctggggttcccggtgttgatcacgtgcctttgccaattctatggagtatcggttactcccaccaagctcatctggcctcccatcagcagagccttcgtagagaaatattgcatgcccaggcaggtgcagggtcaggcaccgcaacagctcaaggaggatcagcagcaaccagctacaggtgcactgctgccatctctataggaggtaccatctctggggtccatcttcgatcacctgtggaggttagagctccagatgcatag

SEQ ID NO: 87043 - DNA, 324 bp, Glycine max
  Peptide Sequence Number=SeqID_178728
atgtcagaattcacaagcgattatccttctcaaattttagccaacctgtattgtcttgacctacccttcggcgggagggcgacgcgagggctcacaggggaaaagagggaggtggttaccacccagctcgcccaggcaagctcagcttgcccaagcgagttgggttgcttccaccagaaggcaccgccttttgctggaacccctggatggcccaagtgggcctggttgctatttgcacacccctttttacttaatacacccccttttgccttttttttgctgatttcttttccgaagcgttacggaacttcacggattacgtaa

SEQ ID NO: 87044 - DNA, 445 bp, Glycine max
  Peptide Sequence Number=SeqID_178729
attgcaccctggtaatcacttcaacaaagaccagggtggaccttccaataggccgcctcaacaagggcctgacatttttcagaggacaaccaagttggaggagactctgactcaattcatgcaggtaaccatgtcaaatgacaaaagcactgagttagcattgaagaaccttgagatccaagtgggccaactagccaaacaattagctgaaaagtcatccaatagctttggggcgaacacagaaaagaatcccaaagaggaatgcaatgttgtgatgacaagaaacaaaaagtgtttggcagatgaggatgaggatagtgtggctttggagaaacaaatttttgtaaaggatggcactaagaaaaaggaagaggaggtaacagatgtgaccaatcaggagagtgaaaaaccaataatggttgaggagaaagaaataaacgactag

SEQ ID NO: 87045 - DNA, 897 bp, Glycine max
  Peptide Sequence Number=SeqID_178730
ggcatttagtccatgtcgctattccgggatccaggggggaatacgttcgatggaataatttattaagtatattgcctcaccccgaaggattaggtccatttttcacaggtcagtggaatctttatgctcaaaaccccgattccaatagtcatatatttggtacccctcaaggagcaggaactgctattctaacacttctcgggggatttcatccgcaaactcaaagtttatggctgaccgatattgcacaccatcatttagctattgcatttctttttctagttgctggccatatgtatagaaccaacttcgggattggtcacagtataaaagatcttttagaagcacatactcctccggggggtagattggggcgtggacataaggagattataatccagaacagaatgaagataaatgtcttagcaagaatgttagcccataaagaagctatcatatcccacttaagttgggctagcctctttctggggttccatactctgggactttatgtccataatgatgtcatgcttgcttttggtactccggagaaacaaatcttgattgaacctatatttgcccaatggatacaatctgctcatggtaaaacttcctatgggttcgatatacttttatcttcaacgaacagtccggcgttcaatgcaggacgaagcatatggttgcctggttggttaaacgctgttaatgagaatagtaattctctattcttaacaatagggcctggagacttcttggttcatcatgctattgctcttggtttacatacaactacattgatcttagtaaagggtgctttggatgcgcgtggttctaagttaatgccagataaaaaagattttggttatagttttccttgcgatggcccgggacgaggcg

SEQ ID NO: 87046 - DNA, 726 bp, Glycine max
  Peptide Sequence Number=SeqID_178731
atgaacttacacgaataccaggcgaagcagctgtttgcacggtatggtatgccagcaccgactggctacgcctgcaccacgccacgtgaagccgaagaagccgcctcgaaaattggcgcgggtccgtgggtggtgaaatgtcaggttcatgccggtggccgcggtaaagcgggcggtgtgaaggtggttaacagtaaagaagacattcgtgctttcgctgaaaactggctgggcaaacgtctggtgacctaccagactgacgccaatggccagccggtaaaccagatcctggttgaagcggcgaccgacatcgaccaggaactgtatctgggtgcggtggttgaccgtgccacccgtcgcgtgatcttcatggcgtcaactgaaggcggcgtggaaatcgagaaagtggcggaagaaaccccgcacctgatccacaaaatggcgctggatccgctgaccggcccgcagccataccagggccgcgagctggcattcaaactgggcctgaccggcaagcaggtcagccagttcaccaaaatcttcatgggtctggcgaccatgttcctggagcgcgacctggcgatggttgagatcaacccgctggtgatcaccaaacagggcgacctggatctgtctggatggcaactgggtgccgatggcaatgccctgttccgtcagccagagctgcgtgaaatgcgcgacccagccagggaagacccacgttaa

SEQ ID NO: 87047 - DNA, 259 bp, Glycine max
  Peptide Sequence Number=SeqID_178732
ggaaagctgctgcttcagtgctgtgtccaaggatgctctgattgctgaactcaaggacacatgcaaggtgctggaagcaaccatcaaagccaacacagagaagaagatggagctggaacggctgatcaaaaggctctcagagagtggcattgatgatgaagaagcagctgaggaagaaggagaagcagctgaggaagaagaagaagctgctgaggaagaggaagatgcagatcccttcagaagagacagaatcagatga

SEQ ID NO: 87048 - DNA, 381 bp, Glycine max
  Peptide Sequence Number=SeqID_178733
atggatatctctaaagatactgacatccctataatcttggggaggtcgttcatgttgaccgcaagctgcatagttgacatggggaagaggaagctggagttaagctttgaagaccagaaaattgattttgacttttttgttgaagacaagcctgctccagaacacaatgtttgcttgcagcgactgcttctcgctaagtgcataatcgtttatgcggtaagccacgagtttcaagcgcttagcgcacaaccctggcatctaaggctgacaaattccgttaagctaactgagctaagcgacagactgatcgctgagcgatggcttcccttcgctaagcgagacctagtgtcaccaagcgcaattcattacagccagaattaa

SEQ ID NO: 87049 - DNA, 270 bp, Glycine max
  Peptide Sequence Number=SeqID_178734
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtgggcgcgtcccattcgccattcagctgcgcaactgttgggaagggcgatcggtgcgggcctcttcgctattacgccagctggcgaaagggggatgtgctgcaaggcgattaa

SEQ ID NO: 87050 - DNA, 396 bp, Glycine max
  Peptide Sequence Number=SeqID_178735
atgtttcactgcataattatccaagtcaacatcatcagtgtagaagcaaagcttcatgatgaatcaagattgattcaaagatgttttgatgataacaaagatgatgacaaaggtgatgacaaaaagctcaaaggtcaatcaaagaatgagttcaaggtgttcaagatagaatcaagaacacttcaagattcaagagaaaagttgaattcaagaatcaagaatcaagattcaaggatcaagcttcaagaatcaagatcaagattcaagactcaagaatcaagagaagaattaatcaagataagtatgaaaaggttttttcaaaaactgagtagcacatggatttttctcaaaacatgtttaccaaagagtttttactctctggtaatcgattactag

SEQ ID NO: 87051 - DNA, 56 bp, Glycine max
  Peptide Sequence Number=SeqID_178736
atgccgatctccccctgcgaagtatcagtgggtctatgtcgtcccgacataggtag

SEQ ID NO: 87052 - DNA, 311 bp, Glycine max
  Peptide Sequence Number=SeqID_178737
atgacgttgttacttagcaacattctgcccagtgatcgtaatgccaatctccccctgcagatgtatcgggatcgcgcccacaagacgcccagtgggcccgaagaagtccaacagggccctggggtttccagctctgggatcgcgcctgcaagacacccagtggacctgaagaagtccaacagggtcttggagttgtcaagctctaattacggcaagggcatcaggccccctactgatcgagctttcatcaagaagtactgcgtccccaggcaggcgcagggcgaaacaccacagcagcattgggatggccg

SEQ ID NO: 87053 - DNA, 1486 bp, Glycine max
  Peptide Sequence Number=SeqID_178738
tgttgctcgcgctaagcgccgcccccatgggctaaacgctattcgttgcggcatgcataaggctaagctagcactgctcactaagccattatggcatccaggaaaaggaagagcattgcttctaagccacaggctcagtatgataccaggagattccaatccttggaatatagataacattatggaccggaggatccttccagaaaggaatgttaagatttatcatactgaattcgatgagtttaaggaagagttggagaggcgtaacctacacaaatgcctcaccaaccttcaggagggaagcatagatgtggcaatggttaaagaattctatgacaagctgtacaactcagaagaccaagttcccaagtgtgccagagtaagaggtcgtatgatcaagatagatgcagacagcctgaatgaatttcttcagaccccagtgttattagaggacggggaatcgttacccacttactctgattttggccaaccatggaagctcctcaaacaggatcttactaccttggcccaaacatggagtctcttctcttactccaacctagctcctacctcccccacctcagacttgaatatggacagagctaggttggtttatggcttagtcatagggatggacatgaacatttgcggcttgatctctggacatataaccattatggctcaatccaactcttctcgcctaggcttcccagctttaatcacagccttgtgcaggtcgatgggagttggatctgatgctcttacttcttacaagagcctgaggccggtcattaactctgcctatattaaaaggaaatgttggaatgtgaatgaccaaacagttaatcttccagaggcaaggaaaaccaagtccaaagcagatgatgttcccttttctccagcatcaacagccccatctgcccaaatctcccagacttcagatgctaagttgcagagtttgtttgagggacaaattttcattatgcagagcttgcaagaattggcccaccagaggccaatcatgagtgtcgagcaattcattgagcaggtggcctggcccagagctcgaccttcttttgttagtgataatggaagctctacagcccagacacctcagcagcaaaagctagagccagagccagaaaacgaccaatcctctgaagccactgttcctagagcttttgatgtttcagaaggtagatcacagataagatccgatgaggctgcttatcctgacccagtaccagtacctgctgatccaccatctctagtggtggatccatcttctctcacgccagaagcagctctcccatctatacctattattatatctgatgaccctacagtgcaagcacctggattggctcctactcctccagccacacctgagcttcagttttcatatgaggaggggagacgggttactactcctccagggacgtcagtgctacatttcgatgatgaggagcaggatcgagatgaatga

SEQ ID NO: 87054 - DNA, 312 bp, Glycine max
  Peptide Sequence Number=SeqID_178739
atgtggctagtagtccaaacctcgttagtagctagtgggcagtcgaccatatgctgcaagctcttctcttcttcggtgctttctattggctgccgggaaacacccccaatcgaggacctccacttgttagatagtatagtaggagctcatcacagctgtgttggttatagtataagtagtcgaacggtgggtggggcctggggagtattagaccttgtatatatgagagctggccatgtgaaagaggtgctcatacatcatatagtagtagcgaggagtcgaactgctgccatatcgttgtgttatggatga

SEQ ID NO: 87055 - DNA, 991 bp, Glycine max
  Peptide Sequence Number=SeqID_178740
gtctggacgaatcaaaactattgcacagaagaagagcacaccaatcactcctaccacatccagatggagcaaagttgcaatcccttccaagaagaggaaagaaatttcctcatctgattctgatgatgatgtcgaactagatgttcccgacatcaagagagccaagaaatcagggaaaaaggtgcctggaaatgtccctgatgccccattggacaacatttcattccactccattgacaatgttgaaaggtggaaatttgtatatcaacgcagacttgctgtagaaagagaactgggaagagatgccttgaattgcaaggagatcatggacctcatcaaggctgctggactgctgaaaacagtcaccaagttgggagattgttatgaaagcctagtcagggaattcattgtcaacattccctctgacataacaaacagaaagagtgatgagtatcagaaagtgtttgtcagaggaaaatgtattagattctcccctgctgtaatcaacaaatacctgggcagaccaactgaaggagtggtggatattgctgtttctgagcatcaaattgccaaggaaatcactgccaagcaagtccagcattggccaaagaaagggaaagctttctgcagggaagctaatcaacatcccaatatcttaaacaacattgactctgtgaagaagagagaatctcctctatccctgcattacaaactgtttgaggggacacatgtcccagacattgtctcgacatcagggaaagctgctgcttcaggtgctgtgtccaaggatgatttgattgctgaactcaaggacacatgcaaggtgctggaggcaaccatcaaagccaacacagagaagaaaatggagctggaacgcctgatcaaaagactctcagacaatggcattgatgatggagaagcagctgaggaagaagaagatgcagcagaggatacagaatcagatgatgatgattctgatgccaccccatga

SEQ ID NO: 87056 - DNA, 423 bp, Glycine max
  Peptide Sequence Number=SeqID_178741
atgtcaaatcataaaagcactgagtcagcactgaagaaccttgaggtccaagtgggacaactggccaaacagataactgacaagtcatccaacattgtgatgacaaggagtaaaaggtttgtggaggctgaggatgaggatagtgttgtgcataagaaaaaaactgctgacaagaaaggtactgatggcaagaaaaatgaggtgagaggtgaaagtaatcaagaaaaagaggaacaaataatggtcaagaataaagaattgaaggaccaagaaaaagaaaaagaagtagaaaaagaaatagaaaatgaaaaaatgaaaaagaagaaaaaaataataagaatgcaaagaagagtagaagtgaaaaagctgtggatgaaggtgtggaagtaccatatcctgtggtaccttccaagaaagaaatag

SEQ ID NO: 87057 - DNA, 333 bp, Glycine max
  Peptide Sequence Number=SeqID_178742
atgttctgcatagtcatttgcctcacaagttcttcgaagaaaggttgtggaggggcctcaactgttggctgtttctggggctgttgctgttgttggattggtggaggaatcataagcttcgggctgctcaattgctccaggttgctgcatggaagggcaaaggtctgtatggtggtcagtagaggagcacaaaccacaaacccttgcaagaggtacaaatttctggttcaaggccagctgggttaccaagttagccaatgcatccagtttgccttcaacttcttagtttcagatgatgcagatgggtttgtagctacctcatgcactctctaa

SEQ ID NO: 87058 - DNA, 342 bp, Glycine max
  Peptide Sequence Number=SeqID_178743
atggcttctagaagaacagctcagtatgataccaggcgtttccaatctctagaagcttggaacagatttacggacaacattctcggccggaacatcattctggagagaaatgttaaaatttattatactgagttcgatgagtttaaagtggagttggagaggcgtaatctccacaaacacctcaccaacctccaagatggaagcatagacgtggctctagtggtggaattttatgctaatctatatagcccagaggaaccaacccctaaacaagctcgagtaagagaacatctgattaagatcgatgcagatagcttgaatgaatttcttcagactccagtg

SEQ ID NO: 87059 - DNA, 273 bp, Glycine max
  Peptide Sequence Number=SeqID_178744
atggcttcctatggtggtgagcttcttcttgactcatcttctcctcgaagtggcatctctaatcatctttcttccttctccattccgctgccattcatgtttaagaagcaaaggactccatttgatgcaatcctccctaggaagggaccagtcactagagccatgagcaagaggctccaagaggattgggctagagctgctgaagaaggccctagggttctcttgaatcttagggtagggtaccctagaaatataggatttttcagcccttga

SEQ ID NO: 87060 - DNA, 294 bp, Glycine max
  Peptide Sequence Number=SeqID_178745
atggctctgagaaagctttccgcaaagagatctaggaaggacgccgtgactgaagggaccagtgccgcccccgagtttgacagccatcgtttcaggagtgctgagcaccagcagcgtttcgaggccatcaaaggatggtcattccaccgagagagacgcgtccagctcagggacgatgagtacacggatttccaggaagagataactcgccggcgttggacgtcgctgcttcaatggggtcctttaatggtgattttccaccatggagatgcagcggaagacaaaggaaaggag

SEQ ID NO: 87061 - DNA, 300 bp, Glycine max
  Peptide Sequence Number=SeqID_178746
atggcggcgcagctaatccgtgatcgagtagagatggagtgtctagagggagcttgggagactctcgaaggcaacacgaggtatgaacctgcacggacgcttcagcgcactgtggaatggatactacccacgcctacaccatatcgtctagtggagcccgttcaagtgatcgagagggtgatgaggatccacttcttgaggtggattcttcccgaggaagtcatgtcggcatctgaggcagactctacggaggatagtggcccgagggagatggcgatcagcggaggctcttcatcctag

SEQ ID NO: 87062 - DNA, 114 bp, Glycine max
  Peptide Sequence Number=SeqID_178747
atggaggataagatgcaacgaaggataaaggataagaggtgggaggaggcgccatccactaaggaatatgccatggaaggaggagcttcaccaccaaaagagtgtcttggataa

SEQ ID NO: 87063 - DNA, 243 bp, Glycine max
  Peptide Sequence Number=SeqID_178748
atgtcaaatttactgtctgtgttttcaaatgattcattggaggaccaggcctcacagggttcctttgcagcccatggatgtcagaatgtactgattgctgcaattgggcaaccagaacaccctggttatatgcgtgctgctggagccggtgtcacgatcaagaaatactttggaccagctccaaggacctccagcacgtcttcctccatggctcccgaagacctggggcagctgccacaataa

SEQ ID NO: 87064 - DNA, 315 bp, Glycine max
  Peptide Sequence Number=SeqID_178749
atggaaacatgtttagtagtggaggacctgttgcaacagatgatagatcgaggccgactggaagtcggcgatgaggggagtgaagagcagcatatatgtatgcagtccgcagatgagagaagttttggaaggcctaagcctatggtgctatgcagttccgtggaggtatgcacctccaagcgaaaggaaggaagaggccaccgatatcagctcgttgctagccaaggtaaccaatatcacggggttgagcggcgtgacccacagcggtcgcgtgtttgcacccccttacctgccgacacaacccacaaacgttaa

SEQ ID NO: 87065 - DNA, 825 bp, Glycine max
  Peptide Sequence Number=SeqID_178750
atgggacgcccgctagaaggaaggaagccataccttttttctagattctacccttccatggcaagagtagctaaggtggtcaagatctcggcacaagagttagaccgagtaaagacaaataggaatggggtggtagggttaccaaggaagagcttggaggagaaggcaaaagctttggcggatcaaggagagtggacctcattcattgacatattagctttgttggtgtttgagaccatactctttccaaatgtagataggctaatgggtttagtagcgatcaacgcttttcttgcttatcatcacagtaaggaaagcccgatcgttgctattttggccgatgcatatgacacattcgacctgagatgcgaaaagagtagcacaaggatcatctgctgcacgcccgctctttatgtagacctgtctgtcctctacaaggtcatcgcatgtgcgccaaaaagggaaaaacaaattgggaggaactcttggcaaggttttgtgacgtttcgaaagggaatgtgcaaaatacttaaacggagggcaaaaagaggtccagaaagaagaagaaagaagagaaagaaagaagaaagaagagaaaacaaggccaaaatgcttctgaattgcatctgtgatcgattcctacaccgttctgtggaagcaaagctttccaagtttattttgatgatgccaaagactcaagtcaagaatcaagagtcagacaagtttcaagaatcaaagagtcgttcaatcaagaatcaagattcaagtgaagatttaagagaagactcaagattggcaagaacttcaagaaaaacatcaagataa

SEQ ID NO: 87066 - DNA, 426 bp, Glycine max
  Peptide Sequence Number=SeqID_178751
gtcctccaagtccttcaagtggatccttgcccttgctcttggtcatgtcctcatcacgaaggaacatcacaggtaacaacaccaagagccttaaagaatattgattctatgtcccttgaggaactagttggtacccttaaggttcatgaacaagaacttcagcaggacaaaggaaccaaaagagaaaagtctttagctctcagtagccaaaagaacaagaaggcgctatcgtctagagaacaagtatcgagaagtttgtccaaagatcttaaagctgatgattcatctgatgaatttgaggaagatgagttcacctttatttcacgaaaagccgcaaaatatggtgaaacaaaggtagctccaagtgaaaaaactgctcaagaagaatgcctaaagaaaaaaaagataaagaaaagagctccataa

SEQ ID NO: 87067 - DNA, 324 bp, Glycine max
  Peptide Sequence Number=SeqID_178752
atgtggcttagagttctaaataacttaaggttttgggatagttggttcatgattccaaatgcatttcttcacatacaggctcagagctcccagcgatttccgacaacggtttccgtcatcgtcggcaacactggagcaaaaaagggtaaggttcacggtgcttacctcgacggtggacgcactaacctcctcaacgatcgttgctcttcgcagaagcttccttgcagcaccaccgcaacaatggcggcaacctcctcaacgaagaagaagaagaggcacaaagaagacgcacaaggaataaagaagaagacgcccaaagaatga

SEQ ID NO: 87068 - DNA, 2136 bp, Glycine max
  Peptide Sequence Number=SeqID_178753
atgccgacaagtgacaacgctggaaacggaaatgggctggcaaagattcaacaacttggtgacaatgaagaaggtcgtccaacggtgaaggctcaaaccattgatgagcttcactctttgcagaagaagaaatctgcaccttccactcccaagggctctctgcctacgtctgccagcgtttttaccgaggaagaacgcaacaaacagcagcttgagtccatcaggtttccgaaatctcgttctcgaacttgcgactcttacttcacacctgatgaccctcttcttcaagaaatatcatttaagttcgcgaagcgtcgatcaaggtgtagacatagggggacatgtagaactgtacccaccaatcaggggagcaactctcgttgcccatcacgcggcagaggtgctcgttggcacgaagggtctgagtcatgtcttgcgtcattgacgaaatgttgtggggtcggcgtggtgattgcatctttggcgtcactaacaagagaaagtggaccaaaggtagtgaaaggggatccagcagctaggaaatacgaagcctcaagggttgaacacgtgccgcaccaaattctcacacctaccattgctgtcagtgacagtgccttgaagtttacacatgttctctataacctctccccagcagaactttatgaacaagcgatcaagtatgagaaaggatcgttcattacttccactggggcattggctacgctttctggggccaagacgggtcggtgtcccagagacaagcgcgtggtgaaagatgaagttactgagaatgaactttggtggggaaagggttctcctaacatcgagatggacgagcacagtttcatggtgaatagagaaagagccgttgattatttgaactctttggacaaggtctttgtgaatgaccaattcttgaactgggacccagagaacaaaatcaaagttaggattgtctctgccagagcttaccattccttgtttatgcacaacatgtgcattcgaccaactaccgaagagcttgagaattttggcacaccagacttcactatttataatgctggacagtttccttgcaatcgttacactcactacatgacatcttctactagcattgatcttagtcttgcaaggaaggaaatggtgatccttgggacacagtatgcaggggaaatgaagaaaggtctctttagtgtcatgcactatctcatgcccaagaggaaaatcctctccctacactctggctgcaacatgggcaaaggtggagatgttgctctcttttttggactctcaggtactggaaagaccactctgtccacggatcataataggtatttaattggagatgatgaacactgttggagtgagagtggtgtctcaaacattgaaggtggttgctatgccaaatgcattgatctctcaagggagaatgaacctgacatctggaacgccatcaaatttgggacagtcttggagaatgttgtttttgatgagcattttcgagaagttgattacacagacaaatcagttacagaaaatactcgtgcagcttatccaattgactacattccaaatgtgaagttaccatgtgttggtcctcaccctaagaatgtgatccttttggcatgtgatgcatttggtgtgcttccacctgtggctggcacagaagagggcataaaggagccacaggcaacattttcagcttgttttggtgcagcctttataatgctacaccctacaaagtatgcagccatgcttgctgaaaagatgcagaatcatggtgctactggatggcttgttaacacaggatggtctggtggaagctatggttgtggaagtcgtattaaactatcttatacaagaaaaattattgatgctattcactctggaagcctcttggatgttgagtacaagaagactgagatttttggacttgagatccccactgaagtggagggagtcccctcggaaattctagaacctgagaacacgtggtcagacaaacaagcctacaaggagacactattgaagctggctggattgttcaagaacaattttgaaacattcacctatggagagaacaaccaagtgacaaaggagattcttgctgctggaccaatcattcatgatgcttaa

SEQ ID NO: 87069 - DNA, 681 bp, Glycine max
  Peptide Sequence Number=SeqID_178754
atggtaaggaaatttggaaaatttcataagtccaaagacagaaaattctctaaatgctccaagaagattgagaacaacaacaaaaacaacttcacatgcttcgaatatggtaagcaaggtcatatcaaatatgagtgtcctatctaccttagaaaacatgttggtgaaaagaaaggaaagaaggacaaaaaacaaaagaaagcctacatagcttgggaagataatgtgtcaacaacctccgactcttctagtcatgaagaagttgaaaatgtatgcttaatggcaaagtcaatggataactcatcaacctttgaagaaactgaggtaaatcctaaacttgaagaagttttggaagcatttaatgaaatgcatcaagaagctcaaaggcttgatgttttaaacaaaaaattgaaaagtgatttgaaattgcatatcactaaattggcttcaacacaaagtgagctagataaattgaagcaagaaaatgaaaaacttgtttcaaactataaagccactgactgtgattgtacctctacttcttttaacatgaatgattacaagtctttgcaaactgaatttgaaaatttcaaaaaggatcactgtgctgaacatatgaagttgcaaactgagctttcctatcttaaagatctatttggaaaattaaaacaaaggaaagagtga

SEQ ID NO: 87070 - DNA, 1093 bp, Glycine max
  Peptide Sequence Number=SeqID_178755
tccgcaccggcggcgatgacgttgtcgacttcctcgccgaggcgggcgaagttggcggagagaatggacggggcgatgaggcagttggacatggccggggccttcggaacggggaaaggattctcccgcccgcaggcgggactgtcgggtcagcgcttgcgcagggtcttgatgcggtcgtaggcggcgttgatccgccgcgacttctgctcggcctgctgctgcagctcgggggcggcaccgcccagcttgtcggggtggtactgcgagatcagcttgcgataggcgcgctctacctcggcatcggtggcctcggaggtcagccccagctcccggtacgggttctccttgttcaggcggaaccagtccgagtcgaaggcatggccgatcaacaggccgaccaccgcgccaaacagcggattgggccggaacagcagggcgccggcgatgaatccgagcagttttccgtaccagcgcatggcgctccggggtcgaccgacgaaatggacgctcattttacgagtgcccgtgccaaccacgctgttgcaatccgatctccccggcctgcccttgcgccatcgcggcaagggaccccaccgggcgactacctgctgatggtggccaccgatcgcctgtcggcgttcgacgtggtcctgcccgacccgattccgggcaagggcgagatgctctgccaggtgtccaacttctggttaaccaagtccgcgcacctgatgcccaaccacctgaccggcatcgacgtggccagcgtgctgcccgagggcgtggacccggccctgtatgcaaagcgcgcggtggtcacccgcaagctgaagccggtgccggtggaagcgatcgcccgcggctacctgatcggcagcggctggaaggactaccagcgcaccggcaaggtcagcggcatcgacctgcccgacggcctgcgccagaccgagcagctgcccgagccgatctttaccccctcgaccaaggccgccgtcggcatccatgacgagaacatcgattttgatgcgatggtgaagcaggtcggtgcggacctgaccgagaacatgcgcgatgccaccctgcgtatctacaa

SEQ ID NO: 87071 - DNA, 294 bp, Glycine max
  Peptide Sequence Number=SeqID_178756
atggtttgggtgaagcctttggcaactagcctagccttgtacctctcaatagacccatctgcattatacttgatagtaaacacccatttgcatcccacggttgtttttcctcttggtgatgacaaaaagctcaaagatcaatcaaagaacaactcaagtgaatcaagaacaattcaagagttcaagaatcaagaagaaagcctagaatcaagaatcaagattcaaggttcaagaatcaagatcaagattcaagactcaagattcaagaatgcagaaaagactcaatcaagataa

SEQ ID NO: 87072 - DNA, 780 bp, Glycine max
  Peptide Sequence Number=SeqID_178757
cgaactccagtcgaatatgaagcgcctggatacaagttatgccttggaatggaagagaattccgaatcagctttgtctacgaacaaggaagctataagtaatgcaactaggaatctcatggagagttcgatcctggctcaggatgaacgctggcggcatgccttacacatgcaagtcggacgggaagtggtgtttccagtggcggacggccacactgggactgagacacggcccagactcctacgggaggcagcagtggggattttccgcaatgggcgaaagcctgacggagcaatgccgcgtgaaggtagaaggcctacggttcgccgtcaaatcccagggctcaaccctggacaggcggtggaaactaccaagctggagtacgagacgaaagctaggggagcgaatgggattagataccccagtagtcctagccgtaaacgatggatactaggcgctgtgcgtatcgacccgtgcaatgctgtagctaacgcgttaagtatcccgcctggggagtaccgaagaaccttaccagggcttgacatgccgcgaatcctcttgaaagagaggggtgccttcgggaacgcggacacaggtggtgcatggctgtcgtcagctcgtgccactgccggtgataagccggaggaaggtgaggatgacgtcaagtcatcatgccccttatgccctgggcgacacacgtgctacaatggacgggacaaaggatcgcgatcccgcgagggtgagctaactccaaaaacccgtcctcagttcggattgtag

SEQ ID NO: 87073 - DNA, 1246 bp, Glycine max
  Peptide Sequence Number=SeqID_178758
atgaacggtttccgtcggggcgtgttgcatactaatgcgtctcttacttcaatgcttcagcgcttctctgatattttcgttatctttagcgggctgtacttgtcttgcctaatctccggtgccgcatttagcgtgcaacactggattatggtattaatatcgatcgttatcttccaaatgattggtgggattactgacttttatcgttcgtggcgtggtgtgcgtgcggggctggagatccagctcattttgcaaaactggtcgctgagcttgctgttgacctcaggaacggtggcgttgataaatgtcttcaataacgagtattccgtctatatccaatggtatctgctggtctgctgcggtttggtcattacgcgcagcgtgatccggctgctcttgggatacatgcgcaatattggcttcaatacccgtaatgtggccatcatgggtgcgatgcccgtcggtattcgtctggcagaatctttacgtgacgcgcactggatgggatttaaagtgttgggcatttacgacaacgataattctccgttgaacagcaaaatcgaacgctgcggcgacttgtctcagctcgtgagcgacgcgaaaagtggccgtatcgatagggtctatatcgcaatgtcgatggagcaggaaaaattgatcaaagatacgatcgcggatctttctgatacgacctgctcagtgatgctgatcccggatatctttacgttcaacatattacagtcacgatcggaagagattaatggcgttcccgtcgtttcgttattcgatacgccaatgagcgggattaatcaggtaattaagcgtattgaagacatcattctgtcaatatttattttgctgttcatttctccggttctgttgctgatcgcctgcatggtcaaatttacctcttccgggcccatcattttcaaacaaaggcgttatggcatggatggcaaggccatcgaggtatggaaattccgctcgatgaccgtgatggaagatggcgataaagtcgttcaagcgaaaaaaggggacgcgcgcctgacgccggtcggctccttcttgcgtcgtacctctctggatgaattgccgcaatttgtcaatgtactgaaaggcgacatgtcgattgtaggcccaaggccgcatgccgtggcacataatgaacagtatagaaagttgatcaacggctatatgctgcgccataaaatgaagccgggtatcacggggtgggcgcagatcaacg

SEQ ID NO: 87074 - DNA, 489 bp, Glycine max
  Peptide Sequence Number=SeqID_178759
gttacaagttgtaccatctgtggtgaggctcatgaaacacgtcaatgtattcccatcaaagaaaacactcaagaagttcactatatgggaaatcaacagagacaaggatatactcgaggaggattctcaggcttccagcagggcccttataaccaacaaggacagtggagatcacaccctggcaatcaattcaacaaggaccagggtggaccttccaacaggccaattcaacaagggcctaacatctttcataggactactaagctggaggagactttgactcagtttatgcaggtgggggaactggccaagcagatagctgacaagtcatccaacagttttatggcgaatacaaaaaataatcccaaggaggaatgcaaagttgtgatgacaaggagtatgaggtttgtggaggcggaggatgaggatagtgttgtatctaagaagaatgttgttgaaaagaaaggtactgatgaaaagaaagatgat

SEQ ID NO: 87075 - DNA, 258 bp, Glycine max
  Peptide Sequence Number=SeqID_178760
atgggccccgacagaaaattccagcagctcccttttctccctccacgttgctttttctttctcttcttctccaccattgttgtctctcttgaagctccaaattccctttcatttccacaccaaattgcaaggaaaagccattttcggagtctaggagcctacctctacttcgtgggaccttcaattccagatagaaaaatggtagagaggatggggagagttagcttagagttaaatttgagaatggtagtgttgtag

SEQ ID NO: 87076 - DNA, 77 bp, Glycine max
  Peptide Sequence Number=SeqID_178761
atgaactacttggcaaagctagttggagttggagctagaaggatcgttgggttgatgcactgcccacattctattat

SEQ ID NO: 87077 - DNA, 861 bp, Glycine max
  Peptide Sequence Number=SeqID_178762
atggaagcatccgtccccatcaccgctgtggtagccttcgtccacgaggccgagcacgccagctttacccgcaccgccgaagccctgggcgtgtcgacctcggcgctgtcacagagcgtgcgcgcgctggaagcgcggatgggcgtgcgcctgctgcagcggaccacacggcgggtcagcctgaccgaacacggcgcgcgcttcctgcagcgcgtgcgcggcggcctggaccagatcgaccaggcctttgccgaactggacagcgcgcgctcggtgcctgccgggcggctgcgtgtgaccctgccgcgcatcgtcgccgatcgcatggtcctgccgcggctgcccgatttccttgcgcgctacccgcaggtgcaggtggaactgtgcgtcgacccggcgctgaccgatctggtggccgagggcttcgacgccggcatccgcctcggcgaatcactcgcacagggcatgatcgcggtgccggtcgggccacctgagcgccaggtggtggtggccacgccggcctatttcgaacgccatggcgtgccgcagaccccgcatgacctgcagggccacgcctgcatcgtgcaccgcctggccaatggccggctgatgccctgggagttcagccgcgaaggccacgacctggacgtggaagtgagcgggcggctggtgttcaacgatgccggcgtcgcccatcacgctgtgctggcggggctgggcatggcccaaggcttcgcttcgctgatggccgacgacatcgccgctgggcgactgcagagcgtgctgcaggactggcagccgccgttccccggcttccacctgtactaccccgcgcgtgagcagatggcgcccaagctgcgg

SEQ ID NO: 87078 - DNA, 264 bp, Glycine max
  Peptide Sequence Number=SeqID_178763
atggtcaagagggagatgattaccatgatggtagacaccttaccggtgttttactatgagaagttgctaggctatatgccctccagcttcgcggacttggtatttgccggggagaaaatcgaagtaggtttaaagagagggaaattcgattacgtctcctccacaagtaccaatgctaggaggatcggagcaactggggcaaaaaggaaggaaggagatactcatgccgtcacttcagcacccgcatgggtcaagccaccatag

SEQ ID NO: 87079 - DNA, 473 bp, Glycine max
  Peptide Sequence Number=SeqID_178764
tccaaactcaggagcacaggtcgcttgagcaaatggaccaatggcttgcactcaattctggatttacatgcgattctcctcaaattttagccagcccgcatcaattagaccttgcaccttatgcttcaggcccctacaatgctcaatggaatgccccgggacttttccatgacaagcacacgttgcgttcgagtcgtattctcggagaaatggaggttgatgaaacttggttaaggctttctcgctgcaaaattcatttcttggttggtgttttggtttacactaaagggatggcctttgtggataactgggcggtgggtaaggagaaggtttgttattggctgagtaatgacattgttgggttggtgggaaacttggctgtattggaatggcagtcacagcatgggcttctacttcatcctcaccctcttcatttgccccagttttctcattcgtccaagcaggatgactaa

SEQ ID NO: 87080 - DNA, 483 bp, Glycine max
  Peptide Sequence Number=SeqID_178765
atgcttcggggagttgaaaataagcgtagatccgggattcccgatataggtcaacctttcgaactgctgctgaatccacgggcaggcaagagacaacctgagctatacaagtgtcgtgctgctaggcgaagcagcagagaatgctgcaccctagatggcgagagtccagtagccgaaagcatcactagcttacgctctgacccgagtagcatggggcacgtggaatcccgtgtgaatcagcaaggaccaccttgcaaggctaaatactcctgggtgaccgatagtgaagtagtaccggaaaccaccggagccgtagcgaaagcgagtcttcacagggcaattgtcactgcttatggacccgaacctgggggtgaaatgccactcgaacccagagctagctggttctccccgaaatgcgttgaggcgcagcagttgactagacatctaggggtaaagcactgtttcggtgcgggcgcgagagcg

SEQ ID NO: 87081 - DNA, 279 bp, Glycine max
  Peptide Sequence Number=SeqID_178766
atgacgaagaacgatggaaaatctttgcgaaatcgctcatggaaacatctcggaaggaaaagaaggagaagcttgccacccagctcgcccaggcgagctaggtttcttcctctagaaggcaccgccttctggtggaacttcctggaaggccgaagtgggcctggttgctatttacaccccctatttactaaatacaccccctacctttttcctgattctttttctgtaacgttacggaactttacgagtttcgcaatgatactcgttttctttccgtaa

SEQ ID NO: 87082 - DNA, 294 bp, Glycine max
  Peptide Sequence Number=SeqID_178767
atgaagagcggtggaaaatcttcacgaaatcgctcacggaaacgtctcggaagcgttacggaagcgcctcggctgggattttcttcacggaaacaatttttctcactaatttcaaggggaaagagggaggtggttgccgcccagctcgcccaggagagttgggttgcttccaccagaaggcaccaccttctattggaacaccctagaaggtccaagtgggcctggttactctttgcacacccttttttactaaacataccccctttgcctgttttgctgattctttttccgtaa

SEQ ID NO: 87083 - DNA, 309 bp, Glycine max
  Peptide Sequence Number=SeqID_178768
atgtcaatttttaatgggcttaacttccctaactggaatgagcaagtccaatttaacctcggtgtattggatcttgatcttgctatattggaagaaaagcttgctactattactaatgctagtagcaatgaatctaaagcccattataaagcttgggaaagatctaatagactcatcttaatattcatgagaatgaatgttgaagacaatatcaaaacaactctccctaagatcgatagtgctaaagattttatggggttagtgagagagcgctctcaaatagctgataaatcttttgttgggacataa

SEQ ID NO: 87084 - DNA, 204 bp, Glycine max
  Peptide Sequence Number=SeqID_178769
atggaacacagctccaaactcgaaaacggaggacacatgaatgacaacgcaattcattcatgtggctccggaaaaaggatgagaatggaggattgccttgagggtcctctcttaggcaatgatggaacacagctccaaactcgaaatggaggacacatgaacaaccctaagcaatatcattcgtgtggctccggaaaaagatga

SEQ ID NO: 87085 - DNA, 219 bp, Glycine max
  Peptide Sequence Number=SeqID_178770
atgtggtggaagtttaatggtgttaagtatccaacaattcaagcaattgctaaggatatattagctatttcggtatctaccatagcttcaaaatccacatttagcactggtggttctatgagctataaagttgttgctgaatgtgctaatgtaatgaatgaaatggtttcagatgaaggtgaaatgatgggtgctggtgtcactaatttggaggaatga

SEQ ID NO: 87086 - DNA, 818 bp, Glycine max
  misc_feature (15)..(15): n is a, c, g, or t
  Peptide Sequence Number=SeqID_178771
gtcgttatgctctcngagcgaaatagccctaagcaccgcgaatcgcttggattctggctaagagataatctggcggattcgatcgttctttgcgatgcctatttctctagcgcggattgcgaatttatgcaattggtgttggcggagtgccctgatgccaagctcacagtgctgacgagcatgaaaggagtgagtcacgaggaattcagtcaggacttattcctgagccgctggaagctcctatcagatgatgatccgccagacactgaaattattgccattgcaggatacgataacaagggtcagatcctcatccatgatcgttggctgattagcggggacgccgctcttaggctgggaacttcctttaacagtttgggaatgggaaagctcagcgagctttctcctgtggtggctgaggggtgccctgctgtgcttgaagagattgcaaagtacaaggcgaagaaccgtttagtgaacggtgtccgtgcgcaaacgaggagagggaagatgctagtgatggttaggcacgcgcagagcatggctaatgcgggatttgtaactgccgacccggagtccattgcccttacggccctgggcgaggagcaggctcgcgcattggcaatgacctggtcggctgcgcctgaccgcatatttacctcaccattcttccgggctaggcagacatcacaaccactcgccgaacgcttcaagctggtcgttgcgcccctgggggtgcaagagttcacttatctgtcgcctgagcggtgcgtgggcacctcggcagcagaccgcaagcagtgggtagaggactactg

SEQ ID NO: 87087 - DNA, 435 bp, Glycine max
  Peptide Sequence Number=SeqID_178772
atgaccaaccctctctatgagtcaatctcttgctttctcataagggtggacccttgggtactagtaccctcgccttctgagggctgcatgacctcgccttcagaggactacacgtcctcacctttagaggactacacgtcctcgccttcagagggcagcatgccctcgccttcagaggattgcaggtccttgtcttcagagggctacacaccctcgccttcagacgccttcagaggactacacgtcctccccttcaaaaggctacacgtcctcgccttcagaggactacacgtcctcgccttcagaaggctacacgtcctcgccttcagaggactacacgacctcgccttcagaggactacacatcctcaccttcagaggactacatgtcctcgccttcagagggcagcatgccctcgccttcagaggattgcac

SEQ ID NO: 87088 - DNA, 330 bp, Glycine max
  Peptide Sequence Number=SeqID_178773
atgacatttagagggccaaggaaggccaggggtaagagatcagaggtccccactacttcagcaccacctgagacaccatctacttcttcttccacagctctactaggagctcagccttctccttctggagggggtggggactttgcatcccaggagcctacttctgaggagccagcagcagcagcaacagagggggaggatgagctaacccctcttgagcccttttattttgatgcagatgcacacatggctcagaaggagggcacttccatagatcagatacctgagccatctcctgcacctgttcctgaggagacccgtaccatctaa

SEQ ID NO: 87089 - DNA, 911 bp, Glycine max
  Peptide Sequence Number=SeqID_178774
atggctaagtttgactttgaggtagtcctggagttttatgctaatgcttggcccacaaaggagggagtgcgagatatgcattcatgggtgaggggtcagtggattccttttgacacaaatgccctcagccagttcctgggtgacccgctagtgttggaggaaggccaggaatgcgagttcagtcagaggaggaatagggccgacgggttcgacgagaaggccattgcccagctattatgcacactggggcaggatttcgcccggactgctgcagggaggcgagtgaggatcatgcgcaccaccatgaccaccttaacccatatgtggatgacattgctgcttagcaatgtcttgcctagtgatcataactccgatcttcctctgccgaagtgtcagctggtgtatgccatcctgacatggatgagcatccacatggctcagttgattgctgacgccatctatttgtttgcaggtatgccacccaccaagcaccctctagacccggataagtctaacaaggccctggggtctctagcattgattacgggcctctgccagtcattcggggttcccgtcacccctaataaggtgatccgactatcgataacctgggccttcattgagaagtattgcacgcctaggcaggcgcagagtgatgcacctcaggccgcagacgcaccgccaccacctcatcaggccgatcccgctgggtcactaggcatagagcgttatctacagcacttggttcgccagcaggcggccaaccaccgggggcaggtcgcatggcccagagattggcccgaggcccaggcaggggaggcacctgcaggatcccccggcgatgcagaggaggcccgtatggatgaggagatgacggatttgctcagtttcttgggaggaagcggagccac

SEQ ID NO: 87090 - DNA, 304 bp, Glycine max
  Peptide Sequence Number=SeqID_178775
atggttagaacacgaggtttaggtcgtgcgttaggagctggtagaggtagaggcattagtgaggatgcgcatgaggctaatgttcctcggcgtcacaggcctattgcttcagcacgtaggcaacgggttcatctgcatgaggacgtcactgagagacatgaggatgtgcctcagttgcatgaggatgttcctcatgtgtttgatgccacccctgagatgacaggcgccgccgatgctgttcagacaaagggagtggctactgatgggagcttggggtcacttgctacagatgagggattccccg

SEQ ID NO: 87091 - DNA, 354 bp, Glycine max
  Peptide Sequence Number=SeqID_178776
atggaagcttgcttgtggggcttctatggaggctggatctttgagcttcaatgcaacggaagacaaaggagaagaggtgagaggaggcaccatctactaggaaataagccatggaagaaggagtttcaccaccaagatgagccttggataagaagcttggaaggatgcttcaatggaggaaaagaaagagggagagaaagagagaggggggagcacgaaattgaaggaataaaagagggagagaagtggaactttgaagtatgtctcacaagactctcattcatcaaagttacaacaagttttacacatgcttctatttatagactaggtagcttccttgagaagctttcttga

SEQ ID NO: 87092 - DNA, 177 bp, Glycine max
  Peptide Sequence Number=SeqID_178777
atggacgcacctcgtaaacaacaggtatcgttgagaggagcaagtgcgaaggagataacgagagacgcgcttcttcagaaggtctcctgggaaagagaatttcgcaattacgcaaaaaaagctgcttctcctgcgctctttattcaggttctttgtctttgcttccgatttctctga

SEQ ID NO: 87093 - DNA, 600 bp, Glycine max
  Peptide Sequence Number=SeqID_178778
atggtcacgttctcagtttacacggttgtgaagtattgtagtggaagtgtttggtggtcaaaatttgccacagaaaatatcaaagaaaaatatctcgatcctgcaatgtactgggattcccaattgatggccaggtatgccactctggttcaagtttctagagaagtttgcgaagctacgtactatgatgaagacgagtatggcaaaatgttgcatttcctatcaaatgaggttagaaggctaaagtcgaagacaaacagccaaccatgttttgatgacaatgatgaccagcagggtgataattatgatggtattttagaccctgttgttgttcgaactaaaggatgcggacaagttggaatagatgaatccggcaaacgaaggagaatccaaaagtgtggccaatgtgctggaagtcgccacaataagcgttcttgcaccaaccgtcctcgaaatacaaatgtttctattggtggttcatttatttcatccactgaacaaactaacactatgtgtcaacctacggatgaatataactatcaattgttcatgcagcagccacacacatttgttgttggtagtagtcgtgctggtccataa

SEQ ID NO: 87094 - DNA, 378 bp, Glycine max
  Peptide Sequence Number=SeqID_178779
atgctgacatctccagaaagggtgcaaatgaccacattggtctctgtttgtcaatcagacttggggtctccgaatgacgaggtgcggataactgtaaggtgtctctgcatgctaccagactcttgggtcatgatagcaaaaggtggggtggtcgacaaaagcgaggcttttactcctacgtatcctcaatttgtgatgaggaactcagacctacgtagttctttcaaaaaggaaacactagtgttgcaacctacccttcagcgggagggcggtgcgagactcacgagtgcgtctttcaagaaaggaaaacgcgcagagtcgccaccaacgtttattcgaggaaaacatcggaaaaatcggaaaagacgtggtctatga

SEQ ID NO: 87095 - DNA, 438 bp, Glycine max
  Peptide Sequence Number=SeqID_178780
atgggatcgagtcaagcgccttcgcttaaaaagagggtctatcaagtcatggtcaagaggctaggaatcaccaatctaaaagagttagggcagttgatgggtcagctccagcgacgagcttttcacaaagcttacggtaaaatttgggacctagccatggcagaagtctccatagaggccattgcctccctcgcccaaaatcctaggatgccctctagggggaaggaaaccatacctcttctcaggattctatccctcttcagaaaatgtttggaggcaaaagcaagaatcttggcaggtagaggcgaatgggccccgttcatagacatcctcgcacttttgatcttcggaggagtcctctttccaaatgtggatcgattggtggacctagcggcgatcgacacttttctcgcctttcatgaccgcaaggaaagcccg

SEQ ID NO: 87096 - DNA, 661 bp, Glycine max
  Peptide Sequence Number=SeqID_178781
atgggctaagaccacaaaccaagcaattgttagatactctacagggggaaagataaaactgaagacctcggaagaagcaactgagctaattgagaacatgtcagctagtgatcatgccattctacgagacagaacccatcaacccacgaagaaaagcttgatagagctatcatcacatgacgctttattgggacaaaacaagttgctttctaagcaacttgagattttaaaagaaacactcagtaagctgccaactaagttgtctatgggtcaacctacgcattcttctgttgtgcaggttacaggtagtaccatctgtggtgaggctcatgaaataggccaatgtattcccactgaagaaaacactcaagaaattcattatatgggaaatcaacagcgacaagggtatactcaaggaggattttcaggcttccaaaccgcgacaattcctcttggattgggatttatgttgagcatgacaattcatgctaagcgtaattcctcttgcactaagcgcggcaattcacactcagcgcaattccctctcgggaacctacaatccaaatttgaagatgatccaactgttaatgaattcaggatcacggttttaccagaacagggtgttatagtgggtcatggaagaggaggtttggggtgttag

SEQ ID NO: 87097 - DNA, 512 bp, Glycine max
  Peptide Sequence Number=SeqID_178782
ggcgttacactgaccttgaaggtaacctcttctctactgttaatggagtagatatggtcattgatgttgctttgtggaaggaagtagccagtctggacatgggtggagtccgcaagttcgatgaaatgcctgatgggtataggaagatacagacctataaggaaatgcttcttgaccctgttaggaacttgaggaatcacttagaagttggtatcaagatgaattgggtactactgattgaagacattatgctgaagtgtcatcgcctggtggattatgaatttccttatgttgtgtttgcctcaagatacactgactacttcgttgttgatgtctctaataagattgtggattttaccaaagcttctagtgagattactgaaaaccatctcaagaagcttggaatgaggtttgttgatcatgaatggataatagtgggaaggcatgcaactggaaacgttggcgagatggaagaagatgttgacgctgaagctcaacataagcttgtgtaa

SEQ ID NO: 87098 - DNA, 441 bp, Glycine max
  Peptide Sequence Number=SeqID_178783
atgacatctaagaaaaggaaggctttttctacacctacccaggccagatatgacagatccaggaaactactaccggagaggaatgtagtagtttattacactaagtttgacgagttcaaggaggaactagagagaagacactgggatgagaagttgactgattttgctgacagtagcatagacattgctattgtgaagaaattttatgccaacctctatgaccccgaggataaatcacctaagcaagtgagggagagaggtcacctagtgaaatttgatgaggataccttgaacacatttctgaagaccccggtgattttggaggagggggagaatttatgtacttattccaagtttgcactcctgaggcctaatcctcaggagttggctactaagttctgtatcccagggaggggattcgagctaaatgcagatgggtag

SEQ ID NO: 87099 - DNA, 198 bp, Glycine max
  Peptide Sequence Number=SeqID_178784
atgactcgggcatacttcaagcggtgcatggaaaataggaaaatgcaaggatcacgcatgagcgaacatgaaaacaaaagagatgcttatgcgatgcatgatatgaatgcatttacagacacgagagcccagaaaattatctcttcttacttgcgcattcagggacgcagtgccccatgtgtgcagttaagaaggtga

SEQ ID NO: 87100 - DNA, 678 bp, Glycine max
  Peptide Sequence Number=SeqID_178785
atgacggtggagctgagcgaccaggagatgatgcgctacaaccgccagattgtgctgcgcggctttgatttcgagggtcaggaagcgctcaaggcggccagcgtgctggtcgtcggacttggcggtctgggctgcgccgccgcccagtacctcgccgcggcgggtgtgggcaggatgacactgctggactttgataccgtgtcggtgtctaacctgcagcgccagacgctgcacagcgacgcaacggttggccagccgaaagtagattctgcccgcgcggcgctggcccgcattaaccccaacgttcagttcactctgcttgacgcgatgctggatgatgacgcgctctccgcgcaaattgcccggcacgatctggtgctcgactgcaccgataacgtcgccgggcaaatcagcgtcttcacatacgcggacggtgaaccctgctaccgctgcctgagccgcctgtttggcgagaatgcgcttacctgtgtcgaagccggcgtgatggcgccgctggtcggcgtgattgggtcattgcaggcgatggaagcgatcaaagtgctggcgcattacggtacgccggcggcggggaaaatcgtgatgtacgacgcaatgacctgccagttccgcgagatgaagctgatgcgtaatccgggatgtgaggtgtgcggaggttaa

SEQ ID NO: 87101 - DNA, 231 bp, Glycine max
  Peptide Sequence Number=SeqID_178786
atgtatattgttgtggtaaaacaggggcaggatcaccttgggctaccttctgaggtagagacaaacgtgagcggcagaaaccaatcaaggtacttaaggacggatgcaagtggggatagggtcacgaccgaccgatcgttgccccttctctgtgcgaaacaagcagagaatgttagctcgcctgggcgagctgggctcgcctgggcgagccacccctgcaccaaattataa

SEQ ID NO: 87102 - DNA, 721 bp, Glycine max
  Peptide Sequence Number=SeqID_178787
agggttgcacgccctcaccttcagagggttgcacaccttcaccttcagaggactacatgtcctcaccttcagaggactacacgtcctcggcttcagaggacttcatgtcctcaccttcagaggactagacgtcctcgccttcagagaactagacgtcctcgccttcaaaggactaaacgtcctcaccttcagaggactagacgtccttgccttcagagggttgcacgccctcgccttcatagggctacatgccctcaccttcagaggactacacgtcctcgcctttagaggactagacgtcctcgctttcagagggctacacatcctcgcctttagaggactagacgtcctcgccttcagagggttgcacaccctccccttcagaggactagatgtccttgcctttggaggactagacgtcctcgccttaagagggctgcacgcccgtgccttcagagggctacacgccctcaccttcatggggctacacgccctcaccttcagaggactacacgtcgtcgcctttagagggctgcacgccctcgccttcagaggactacatgtccttgcctttagagggctacacgccctcgccttcaaagggcgacacgtcctcaatttcagagggctgcacgccctcgcctttagagggctatgtgtcctcactttcagagggcttcacatctgcgccttcagagaacttaaggccctctgcccttaa

SEQ ID NO: 87103 - DNA, 492 bp, Glycine max
  Peptide Sequence Number=SeqID_178788
atggaagacgcacccgcaagccccgcgtcgtcctcccgccgaagagtaggttgcgacagatgtcaacatgaccatgaccgaagcgttagcgtggaaacaaagagagctcgaaaagaaaaatggggcagaaacaacgagcttaagcttagaagggccaaaagggacaagtcaagggtggaaagtatgtgtaaagagaagctaaacctagctgttagccatgggcaaagactagaggatgagcatgcgaaggtgtcggctttgcaagtggaaagggaagcaagagagaaagtgatagaatcattgcacggggaagctgtgaaatggatggatagattcgctctcactatgaatgggagtcaagagcttccaaggttgttggccagagccaaggcaatggcaaatatatacctggctcccgatgaagttcatgggctttttgattattgccaacacatgattgggttgatgtcccacataattaggaaccgctga

SEQ ID NO: 87104 - DNA, 213 bp, Glycine max
  Peptide Sequence Number=SeqID_178789
atgacggtgtcggccgaatcacaatttcggttgagctgtgatgagaatcctgaaattggccatatacaggctaaaggcccaagtggagaagggcgaagacttatcaaggtaatccttgtggcgtctaccctgacttatcttccttcaccggaagtggcgtctaccctgacttatcttccttcaccggaagtggcgtcatccaaaccttcgtag

SEQ ID NO: 87105 - DNA, 219 bp, Glycine max
  Peptide Sequence Number=SeqID_178790
atggtgggttacacaccttcaagctttgctgatttagttttcgccgatgaaaggatcgaagtgagtctgaaaagaggcaaatttaatcatcctacttggatgaatgagaaaactggggtgaatgaagagggtgagaatgaaggagaaacccatgctgcgattgccgttcctacatggaaacttcccaccagcccaacaatgtcattactcagccaataa

SEQ ID NO: 87106 - DNA, 198 bp, Glycine max
  Peptide Sequence Number=SeqID_178791
atgaatttagtttcaagagtagataataaggcataccttcttgaaatatttgatggcatattggaattgttcaagaaactccacccacctggcatgtctcttgctcagtttgctttgacccttaagatgcttcaaggattcatggtcactatgtatgacaaattgttagggaaagaggtagtgttgccaagtttgtaa

SEQ ID NO: 87107 - DNA, 303 bp, Glycine max
  Peptide Sequence Number=SeqID_178792
atggctcaggagcggacatggatgtcttgtgtcttgttggaacaagtgcgaaaccaaccaaacacagagggcgggtacttctgtggtaggcccgctatgtcgttccgagtctgttttatgcggtccaaacctcttgctgaatccttgaccacagttgcaattctgctcaaagaggggagacacccggaggaaagatatggttttcttcccccgagaggacatcctagaatttcctcaaattcttcaatggttggtactaattggaagtctccgaatgtgaagcacctcaaaggctggtcgtag

SEQ ID NO: 87108 - DNA, 874 bp, Glycine max
  Peptide Sequence Number=SeqID_178793
atggagagaagtatgattgatgctgccagtggtggagcccttggagacatcacccctgctgaagccaggaatttaattgagaagatggcttccaactcccagcaatttagtgccagaaatgatgctattgtcattataggagtgcatgaattggccttgaatcaaaaatctgtacatgtcgcaagactttgtggtttatgctcctctgctgaccaccatacagacctttgcccttttgtgcagcaatctggagcaattgaacagcctaaagcttatgctgcaaacatctacaatagacctcctcaacctcagcagcaaaatcaaccacaacagaacaattatgacctctccaacgacaagtacaatcccggaccagatgttcctccaccaatccagctacaacaacaacaacagaagcagcaacagccccagaaacaacaaatagttgaggctcctccggaaccttcccttgaagaacttgtgaggcaaatgactatgcaaaacatgcagtttcaacaagagaccagagcctccattcaaagcttaactaatcagatgggacaattggctacacagtcgggaaagcagtatcaaggacctcaactagtagcatcttcctcatctgcaaatgaacctgcccaacttcactctactccagaaaaagaggatgacaaaaatttaaaaacatatccctcttccattccctccaagagcaatttccaacaaaaaaatgaagaggtagagaaggagatcttggaaacatttagaagagtagagaagcttaaaggaagtgagagaattagcaagggcagaaatgtctccgcattgattggtaaatttgttgcccaaatccctgaaaaatggaaggatccag

SEQ ID NO: 87109 - DNA, 261 bp, Glycine max
  Peptide Sequence Number=SeqID_178794
atggaaccccgcaggcttgtagagcggaacgccggcaaacaggtcatagctgaatcgcccccacagcgcgccgcgcacggtggtccgagcgtcatgctgccccaagcgttgatggtgccgcagcccagacaagtgcggcgaggttggccacaatcactgcgccttgccgccggccacttccataaaaccggcagctggctggccagattgttgctgttgacattcgttgaggatgacgcgagtccggcgattgggcattga

SEQ ID NO: 87110 - DNA, 477 bp, Glycine max
  Peptide Sequence Number=SeqID_178795
atgggggcatacgcaaagatgaggattgctgatacattcttccaagaaaatcttactggggtagctgttacctgggcaaatgaagagggtgagaatgagggaaaagcccatgttgtgactgccattcctatacagccaagtttcccaccaacccaacaatgtcattactcagccaataacaaaccttctccttacccaccgcccagttatccacaaaggcaatccctaaagcaaccacaaatttcgcccacaaccatacccttgcattttgcggtgggaagagcccctcctgctatggctgaaaagggaaaggtggatcatctaaaggaaaggctcagggccattgaaggaggtgaagattatgcctttgctaacctagaagagttgttcctagtacccaatatcatcacccctcccacgttcaaggtgctagactttgacaagtacaagggactacttgctccaagaaccatctaa

SEQ ID NO: 87111 - DNA, 240 bp, Glycine max
  Peptide Sequence Number=SeqID_178796
atgagggttcattgttatcaagcatgtcggagacctagcatgaccacagattcacctccactccttatgttcccatggacccagtccctgagtggagtcgccaactgtctaacctacccttcggcgggagggcgacgcgagggctcacgggtgcgtcttccaaggaaggaagatgcacggagtcgccaccaacgtttattcgaggaaaacgtcagaaaaccggaaaggtgtggtctataa

SEQ ID NO: 87112 - DNA, 694 bp, Glycine max
  Peptide Sequence Number=SeqID_178797
ttctatttctcgatggaggcaagggatataactcagcggtagagtgtcaccttgacgtggtggaagttatcagttcgagcctgattatccctaaacccaatcgaactccagtcgaatatgaagcgcctggatacaagttatgccttggaatggaagagaattccgaatcagctttgtctacgaacaaggaagctataagtaatgcaactaggaatctcatggagagttcgatcctggctcaggatgaacgctggcggcatgccttacacatgcaagtcggacgggaagtggtgtttccagtggcggacggactcctacgggaggcagcagtggggaattttccgcaatgggcgaaagctgacggagcaatgccgcgtgaaggtagaaggcctacggttcgccgtcaaatcccagggctcaaccctggacaggcggtggaaactaccaagctggagtacgagacgaaagctaggggagcgaatgggattagataccccagtagtcctagccgtaaacgatggatactaggcgctgtgcgtatcgacccgtgcaatgctgtagctaacgcgttaagtatcccgcctggggaaaccttaccagggcttgacatgccgcgaatcctcttgaaagagaggggtgccttcgggaacgcggacacaggtggtgcatggctgtcgtcagctcgtgccgtaag

SEQ ID NO: 87113 - DNA, 799 bp, Glycine max
  Peptide Sequence Number=SeqID_178798
aggactacatgtcctcgccttgagagggctacacgccctcaccttgggtactacttaccctcaccgtcagaggactacacgtcctcgccttgagaggactacacgtcctcaccaccagagggctgcatgccctcacctccagaggactataagtcctcgccttgagagggctacacgccctcaccttggaggactacacgtcctcgccgtcaaagggtcatgtgccttcacctttgtagggctacacgccctcaccttcagaggactacacgtcctcaccatcagagggctgcacgccctcacctccagaggactacacgtcctcgccttcaaagggtcatgtaccttcaacttcagaggactacacgtcctcgccgtcaaagggtcatgtgccttcacctttgtagggctacacgccctcaccttcagaggactacacgactacatgttccccattttcaaaggggggcatgccctcacctttagaggattgcacgtccttgccatcataggactacactccctcgccttcgaaaggcgacacgtcttgaacttcagagggctacacgccctcgcctttagaggactatgcgtcctcactttcagggccagtagtttccttttaacggttcctgggccaccccctgatattggaggagggccaactgtgcgagcacaaccagagagggaggctattacacagctactatgcataccggggcaagatttcattcgtgccgctgtaaagagacgagtgcggatcatgcgcaccaacatgaccactcttacacagatatag

SEQ ID NO: 87114 - DNA, 378 bp, Glycine max
  Peptide Sequence Number=SeqID_178799
atgggtgaagtagaggaggtgcaagagcagatgaaggccgacatggaggccatgaaaaagaaaagggccacaatggtagaggccatgatgagcatgaagaagataatggaagccaatacggttgcagttgccgctaccagtgctgttgctaagtacggacgaccccatgatgtgaaaattcaaaataagcacgccttcccgccatatggctcgcctcccaaggaggatgtcaataactccgctcccatactcattgaaagccaacaacctcaatatgatcatgcacatgtctctcgacccataggggagacacatggaatgcctcaccacaatctagccgacttcgagccttgcctcggatatgccactgaagggtaa

SEQ ID NO: 87115 - DNA, 90 bp, Glycine max
  Peptide Sequence Number=SeqID_178800
gggcaggatcatcttgagctaccttctggggtagagacaaagctagaacagcagaaaccaatcaaggtacatagggacggatgcaagtag

SEQ ID NO: 87116 - DNA, 162 bp, Glycine max
  Peptide Sequence Number=SeqID_178801
atgcagtttctaggaagtgatcctaggtcgtctcccaatgagcaatgcaacaaatacagagcaattggtgaagaggaaaaactgataaaattcaatagtaataacaaaacctcaaagagagctgtgcttgatcctcaagagaaaacaacgctggagacttag

SEQ ID NO: 87117 - DNA, 222 bp, Glycine max
  Peptide Sequence Number=SeqID_178802
atgacgaacaaggccaaaggaaaaggcaaggaggtcgccggaaaaggttcttccggaaagcgcaagggtgccttcgacgatgacaagattggtggcggccgaaagagaaacaagcgaggccctgttcgaatgaactggtgtctcctgttattttttttggattcgttggcgtgcaaacatgagacgggcgacctttggagatcttacggggggatcctctag

SEQ ID NO: 87118 - DNA, 225 bp, Glycine max
  Peptide Sequence Number=SeqID_178803
atgacgaaagataactcaaagccttacactggggcaatgaagggcatcgtgcatgagcctcaagtgaacatagggacagataaaaagttctcacccgtcgattacctatcaccttcagaggactgtacgtccttcaccttaagagggctacacgtcctcgccttcagagggctacacaccctcaccgtcaggaggactacacggcctcaccgtcaggaggactaa

SEQ ID NO: 87119 - DNA, 324 bp, Glycine max
  Peptide Sequence Number=SeqID_178804
atggcagatccattgaagaagagaaagggatcatcctccaccgctgctgctgctgcccatcgtcgccacggcccatccggagcacccacagcacctattcctccttctttgtcatctccaagatcatcaacattgttttcatccgatgatcaacgtctacggtacctttctcagttttcttcaagaataatcttagatcctaagtacctagacgtagagttctttaatgatgaaacgtttgattgctatcaagtgtttcaaaattctggtcttgttgatttcatgttgtcgcaacctacccttcggcgggagggcgacgcgtga

SEQ ID NO: 87120 - DNA, 642 bp, Glycine max
  Peptide Sequence Number=SeqID_178805
atgaccaccctgactcagatctggaagactttgctgctcagcacatccagcccagcgaccataatttcgacctccccctgcccgaagtgtcagctggtgtacgccatcctgacgcagatgagcattcacgtggctcagctaatcgctgatgccatctatatatttgcaggtatggcgcctagtaggcaccctctggacccggataagtccaacagggccctgggatttcccgccttgatcacaggactctgccagtcgttcggagtccctgtcgcacctagcaaggccgcagaagcgccgcaacctcatcaggccggtccagccggattgtttgatacggagcagtatttgcagcatttggttcgccagcaggcggccaaccaccgggcacatgtacagacccatgattgtcattatcagatgagcctcagcctacagagccagggctttacttcttttccgtgccctactccagaccagttcagggcagaggtcgcatggcctggagattggcctgaggcccgggcaggagaggcaccagcagaggcaccagcggaggctcccgatgaggcagatgaggcccgcgaggacgaggagatgaccgatttacttgatttcttaggaggaagtggggccacatga

SEQ ID NO: 87121 - DNA, 441 bp, Glycine max
  Peptide Sequence Number=SeqID_178806
atgaactcgctaagcgagttcatcaatactcattgtatgaaagtagagctttatcacactgagctagatgactttaaggatgaattggagaggcgtaatttccataaacgcctcaccaatttagtcgatggaagcatagacctgactttggggaaagagttctatgcaaatttatacagttatgaggaccgtccaccaaagcagtccaaagtcagaggtcatttggtgaagattgatgctgacagtctcaacgcattcctagagacacatgtggtattagctgagggagagactctacccgcatactccagatactgcatgttgcctatggacttcagagagatagaggttgccttatgcatacctagccgagggttcatcttgaactctgagggccatcctgggaagattctcatgaaggatttgactacattggcttag

SEQ ID NO: 87122 - DNA, 633 bp, Glycine max
  Peptide Sequence Number=SeqID_178807
atggtgagcaatccttcaagagcacagaagaaagcaaaaacttccaagaggaagcaagatgaatgctcacaggctgctctcaatcgtctagacacatggatccccaagtatttggacttgaaatggttctctcaacaagggttcaactttcctaatttgttggaagcacaaggattgtcaaagcaggttttctacacttgtgcacatgttgacattgaaggtaacttcttctctactttaaacagagtagaaatggtcatttttgctgctgtgtgtaaggaagtagccagtctggacatgggtggagtccgcaagtttgaggaaacgcctaatgggtataggggaatgcatcttgaccctgctaggaacttgaggaaatgctttaatcacgcccaagtaatggataatgatctgcagattgtttatggcctgaaatctggtatcaagatgaactgggtattgatgattaaagacattatgctgaaaagtcattgcctagtggattatgaatttccttatgttgtactttcttcaagattcattaactacttcaatgttgatgtctctaatgagattgtggactttaccaaagcatctagtgagattactgaaaggcacctcaagaagctttga

SEQ ID NO: 87123 - DNA, 378 bp, Glycine max
  Peptide Sequence Number=SeqID_178808
atggaagtgagggacatggttgaactccttccatatagggacctagatgagctagtccaactttgtataagagtggagcgacaacttaaaagaaaaccttcttcaaaatcttatggctttcactcttatccaaggaaggaccaagcccaagaaattttgggggctgcaccttcaaaacccaaggaagataagggtaagatcatagagaaactcaaccctaagacttttctcaagcaaggactagcaacattaaatgcttcaaatgtcttgggagaggagactacttcttccccttcctctagtggaagtgaagatgaagtaaggggtgaagagtctagtcaagatgtctactctcatgaagaatttgacctcctaatg

SEQ ID NO: 87124 - DNA, 240 bp, Glycine max
  Peptide Sequence Number=SeqID_178809
atgggtgttaaacattttgaggtggtcaaacgaaggtcgcatgccgacaaaaatgatccccggatgaaattaggtggcgtctcctctctctcttccttctccatttcgttgccattcatcttccaagaagcaaaggaatccattgatgaagaagatcataggcctacaagctccaatggagcttacatcagggcacatcagaaagtgaacgctaatggcattagaagatgcataagttga

SEQ ID NO: 87125 - DNA, 570 bp, Glycine max
  Peptide Sequence Number=SeqID_178810
atggtcgaaagaaaaaatccctatttgacaaggcttcttactatacctatgaattccattggacccaaaaatgatacattggaagaatcatctgagtcttccaatatcaataggttgattgttccgctcctgtatcttccaaaaggaaaaaagatctctgagagctatttcctggatccgaaagagagtactcgggttctcccaataactaaaaagtatatcatgcctgaatctaactggggttcgcggtggtggaggaactggataggaaaaaagagcgattctagttgtaagatatctaatgaaaccattgctggaattgagatctcttcaaagagaaagatccccatcacaattcgagttacctttttgtatattatatggatgatgagattccgtaaggccatgattgattttacagagctactcgttcttttttctctgacaagatggtcagaacttcatctgagttcgaatcctactgagaggtctactagagatcagaaattgttgaagaaagaacaaaagaaacatcttgttctttccggcgatcggaaaataaagaaatag

SEQ ID NO: 87126 - DNA, 372 bp, Glycine max
  Peptide Sequence Number=SeqID_178811
atggcttacgaacggggcggagatttcctggaagatgccaggaagatacttaacagggaagcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccgtcatgcgccggttaaggctaaactgaaaggacaagttttgggtgactgcgctcctccaagccagttacctcgggttcaaagagttggtagctcaaagaccttcgaaaaaccgccctgcaaggcg

SEQ ID NO: 87127 - DNA, 441 bp, Glycine max
  Peptide Sequence Number=SeqID_178812
atgatgctccgcaggcatcgatggcctatcgcatctgcacggaggcagcgagtctctgtcactgcggcgcatgatgagccagtggtccctgcaccagatattgaggctgatgtatttctggatgacccgatggcaccaattgatgtagaggacattgtggcagacattcctgcagacataggcgcagaggcttctgaggatgagcatgagggatttttgggtggtctgagcgacccattcgtgctgacccagtatgcggatcacgttgcttgcagcgtatggatgggagagttatcctctcatgggaggaaggtccatagtttaggcaggtctgtccctaccatagagggactcgttgctgggataggactaagtcctctgatcgtgtgttcagtagacaccagcaatcggggacttttgtcgtcgtttgtcgatcggtga

SEQ ID NO: 87128 - DNA, 586 bp, Glycine max
  Peptide Sequence Number=SeqID_178813
ggtggacccttgggtactagtacctatcgcctttagaggactacacgtcctcaccttcagagggctacacgtcctcgccttcagaggactacacatcctcgccttcagaagactacacgtcctcgccttcagagaactacacgtcctcgccttcagaggactacacgtcctcgccatcagaggactacacgtcctcgccttcagaggacaacacgtcctcaccttcgccttcgtagggctagacgccctcacttttagaggactacacgtcctcactttcagagggcggcacaccccccgccttcaaagggctacacgccctcaccttcagaggactgcacgtccttcagagggctgcacgctctcgcctttagagggctacactttccttttatcagtttatgggccaccccctgatattggagggcgaccaactgtgcaagcacaaccagagaggggaggctatcacgcagctactatgcataccagggcaagatttcacccgtaccactgcaaagagacgagtgcgaatcatgcgcaccaacatgatcactattacacagatatggataacgttgctacttag

SEQ ID NO: 87129 - DNA, 282 bp, Glycine max
  Peptide Sequence Number=SeqID_178814
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttcccccctggcggctccctcgtgcgctctcctgttcctgcctttcggtttaccggtgtcattccgctgttatggccgcggtttgtctcattccacgcctga

SEQ ID NO: 87130 - DNA, 333 bp, Glycine max
  Peptide Sequence Number=SeqID_178815
atgaccatgattacgccaagctcgaaattaaccctcactaaagggaacaaaagctggccgggggatccactagttctagagcggccgccaccgcggtggagctccaattcgccctatagtgagtcgtattacaattcactggccgtcgttttacaacgtcgtgactgggaaaaccctggcgttacccaacttaatcggcttgcagcacatccccctttcgccagctggcgtaatagcgaagaggcccgcaccgatcgccccttcccaacagttgcgcagcctgaatggcgaatgggacgcgccctgggggaccgctacacttgccagcggtga

SEQ ID NO: 87131 - DNA, 663 bp, Glycine max
  Peptide Sequence Number=SeqID_178816
atgagccataggcgcctatatcaacaaaggataaagaacgcgttcgaccagaaggtacgcccgcgcaagttcaatcaggggggccaggagtgcgagtttagttggagaaggaaccgggtcgatgaatttgatgaggaggccatcgcccagctgttatgcataccaggtatgccacctactaggcaccctctagacctggataagtctaacaaggccttggggtttccagcattgatcacgggtctcagccagtcattcggggttcccatcacacctagtaaggtgattcgaccaccgatcacccgggccttcattgacaagtattgcacgcctagacaagcgcagggtgatgcaccgcatgccgcagacgcatcgtcaccacctcatcaggctgatccagctgggtcatttggcatggagcggtatttacaacacttgattcgccagcaggtggccaaccacagggggcagctgcagatccatgaatgtctctaccagctcagcctcaatcagttcagggcggaggtcgcatggcccagagattggcctgaggctcaggcaggggaggcacccacagaggctcccggcgacgcgaatgaggcctgcatggatgaggagatgacagatttactcggtttcttgggagggagtggagccacatga

SEQ ID NO: 87132 - DNA, 467 bp, Glycine max
  Peptide Sequence Number=SeqID_178817
gactctgccatttgttcggagtccccgttgcacctaccaaggtgattcggccgcccatcacccgggcttttattgagaagtattgcacccagagacaggctcagggtgatgctccacaggccgcagacgcgccaccactacctcatcagcctggcccggctgggtcgtttgacatagagcagtatttacggcatttggttcgccagcaggcggccaaccaccgggcacatgtacagacccatgattgtctttaccagctgagcctcagcatgcaaagccagggcttcgcttctttttcatgccttactccagaccagttcagggcagaggtcgcatggccaggggattggcccgaggcccaagcaggagaggcacccccaagggctcccgacgatggagaggaggcccatgaggacgaggagatggctgatttgcttgacttcttgggagggagtggagctacatga

SEQ ID NO: 87133 - DNA, 601 bp, Glycine max
  Peptide Sequence Number=SeqID_178818
atggcaccgaggaagcttgcctcaaagaggtccaggaaggacaaggcggccgaaggaactagttccgccccggagtacgacagtcaccgctttaggagcattgtacaccagcagcgtttcgaagccatcaagggatggtcgtttctccgggagcgacgcgtccagctcagggacgacgagtatactgatttccaggaggaaaatagggcgccggcggtggacatcactggttaccccccatggccaaatgctatcggccagctcctgggatatccgttagtgctggaagagggccaggagtgcgagtatggccagaggaggaaccggtctgatgggttcgatgaggaggccatcgcccggctgctatgtataccggggcaagattttgcccggactgctgcagggaggcgagtgcaaattatgcgcaccaacatgaccaccctgactcagatatggatgactttgttgctcagcaacatcctgaccaccgatcataattccgacctccccctgccgaagtgtcagctggtgtacgccctcctgacgcggatgagcatccatgtggctcagttaatcactaatgccatctatatttttgctg

SEQ ID NO: 87134 - DNA, 562 bp, Glycine max
  Peptide Sequence Number=SeqID_178819
caacagatacaaccctggatggaggaatcaccctaatctcagatggtctagccctcagcaacaacaacagcagcctgctccttccttccaaaatgctgctggcccaagcagaccatacattcctccaccaatccaacaacaacaacaaccccagaaacaaccaacggttgaggccgctccacaaccttccctcgaagaactcatgggacaattagctacacaattgaatcaacaacagtcccagaattctgacaagctaccttctcaagctgtccaaaatcccaaaaatgtcagtgccatttcattgaggtcgggaaagcagtgtcaaggacctcaacccgtagcaccttcctcatctgcaaatgaacctgccaaacttcactctactccagaaaaaggtgatgacaaaaatttacctaacaatttatgtgcaggtgaatcttcttccataggtaattctgatttgcagaagcaacacattccccctcatccattccctccaagagcagtttccaacaaaaaaatggaagaggcagagaaaagagatcttggaaacgtttag

SEQ ID NO: 87135 - DNA, 342 bp, Glycine max
  Peptide Sequence Number=SeqID_178820
atgtttatacggataaccactcggtccttcttcttcactgtgcttcttcttcgtcatccttcactcaaccactgtgcttcttcttcgtcatccttcatcttcttcttctccctctccctctccctctctccccttcctaatgtcatctcttcatcttcttcccggtgccaccaccaccctcaactccgcattcctcctccacccccattctcccctcttcccctccaaaaccctaacccccaaaaaacccaaacccccctctgccctcctccagtggaattgcaaaccaaaaccccaacccaaaccccttttgcagaccctattggtgtaccttgggcataa

SEQ ID NO: 87136 - DNA, 288 bp, Glycine max
  Peptide Sequence Number=SeqID_178821
tgtgtctctggggtgcgagacttgatagaggatgttgctgcacctccacctctcttggaggaccttccactccaatgccactccttgcccataattggtaaatttatgccctttgctgaaaggtttcgaaagaaggaagaatattacacactctctctctatgttcttatcttaatcgcactcactcccaagcctgctggtagagaactaaaaccaaagagaaccaactctgctgcttattgggaactgagatgggtaaaggaattaagaattgaggaagatgacgat

SEQ ID NO: 87137 - DNA, 384 bp, Glycine max
  Peptide Sequence Number=SeqID_178822
atgtacctcactgtgttggctgatctcaaccaagttaggtggtatagttggggtcctgcttgtctggcaatgctgtatagggaaatgtgttgggccactgacgctgatgccaaaaccatggtcggttatgcgtcattgttgcaatcttgggtatggtatcgcatgcccttcattgcaacaagagttaatcggacaccatcgtatccattggttacaagatggagtggtggtggattaagctttactggtacaccacatggagatgtcatcggttatcgaatgagattaaaccacatgacaactgaacagaatggaaccaagcggatagagttaaacttcaattccacctccgacaagacatatcagatcccccatgaaacatag

SEQ ID NO: 87138 - DNA, 373 bp, Glycine max
  Peptide Sequence Number=SeqID_178823
cttatcgataccgtcgaccatcgaagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggggaaatggctttacgaacggggcggagatttcctgggaagatgccaggaagatacttaacaggggaagggagagggccgcgggcaaagccgtttttccttag

SEQ ID NO: 87139 - DNA, 1424 bp, Glycine max
  Peptide Sequence Number=SeqID_178824
ctgtaggagacagtaacgcgacctgtggatttaattacattccaccactcaactgtttcctgcccaggaagatagatgaaattggaaatattaaccaaatgcctaatataaacagtccaataacactgaaattgaatattctcactgagacaggtgcagccgtccttgtcaatggagtcgccccaactccttcacaaggaccttaccctttgacgggcaatacccaatggcaaacctatgccattgaagggattacaggaaatgtgtccatcacatctacaaaagcggtaactgcaggaattaatggaggatatagcactgcaggttatggaggatacttcgcaggattttcatctgtcccggtaattacgaaaaaaagcggtgagtgtgtccctggtattgttttggaagttgacgatggatatgaaacttatcaatggtatttaaatggagtcgccattcccggagctgtaaatagcacctatactccagtacaatcaggaaactacactgtaaaagtaacaatgggaagctgtccggtaacaactccaatttataaggtttttacctgtatgaaaaatacaacaaccagtataaatatatgtgccactaaaattataaccccaaccttttcaagctctacgcaaacacctgttccgagtactgtatcaattttaacagcacctattcacggaacagcaatcctaaatccttctacaggaataattacttacaatcctgcgccgggatattttggaccagatgtaatcgtttatactttctgtggaaatgctccggaattcatcgactgcgaaacagtaactataaatctgacagttgtcccttttatcgtaaaagatgccacccttgaagcttgtcaatatgaagacaaagcttattttgatttaacaacagcaaacgttattgacttcaatttagtaacaaaaaaatactaccccactttagctgacctgaacgctaataccaatcagatcacaaatccacaaaattacgaatccacaggaggagttgtgtatgttaaaattacaagtaatgaaggatgtacaggaattgcaaaaattacactaattgcaaaacctattaagaaatctcctactctgcttgataaatatatttgtattgattctagaaccaatcttgatgcaggccctggttacgattcatatcaatggagcacgggtgccactacacaatccatagagggagtaggagttggtgaatataccgttattcttggaaaagacggatgctttgttacacagattgtaaaggttatcaaaactcaggatcctgtaattactcagattgaaatctctaacaatacggcaactgttattgtaactggtggtacaccaccttacaaatattccgtagatggaacatcaaactggcaggattcaaat

SEQ ID NO: 87140 - DNA, 414 bp, Glycine max
  Peptide Sequence Number=SeqID_178825
atgaaatataagagggataaggaagaaaaactagaaaaacaaatgaaaaaaaaggataataaagccttgtctacaaaggccaaggggaaggaaaaagaggaaaaggattcctccaagaatattgttaagaaggaaaattattttgcaacaaaaggtgatatcaaaagagcactccttcttaaacaatctttctaccttctcctaacaagggaaacatcccttagcactgtcatacctcttgagcttaaggttattcctcaagtaaaggagttgttggatgagggtttggttcgtattgtgatccaccaaatccctatgataggtggtatgatgaatgtgttgagtggtgaaaccctcttttgtaaaatcactcatgcatccaacatcttcatgattcacatacataagaactaa

SEQ ID NO: 87141 - DNA, 183 bp, Glycine max
  Peptide Sequence Number=SeqID_178826
atgtgggtgcaagccattggtctgtttgctcaagcgacctgtgctcctgagtttggacttccaagaccgttcaatcagagattactcgtcttgcacgttggtggggaaagtctgaaccacacagggacaacccttcccttgtattcaggaatcctctataacaagagacccacgatctcttaa

SEQ ID NO: 87142 - DNA, 246 bp, Glycine max
  Peptide Sequence Number=SeqID_178827
atgacccttccactatccaatctgctgcaaaaggaggtggagtttgattttgatgaccggtgcaaagaggcttttgattgcctcaagcgtgcggtgactaccacccctatcattcaggctgaccacctaagtaggattgaactgaccaggttattaggagatgcattccaggccatgagatcgactcggttctgcaattctgtcattcttctgcaccaggtggccatcatggcatacagaggatag

SEQ ID NO: 87143 - DNA, 357 bp, Glycine max
  Peptide Sequence Number=SeqID_178828
atggcttcgagcgcacttgcgttcaaagactcgatggttccacgggatctgcaattcacaccaagtatcgcattcgctacgttcttcatcgatgcagagccgagatatccgttgccgagagtcatcgccggggtttgtgtttgtcgcgaggacgaggaggccgggcgcacggggcgccgtggtcatcccctccctcccgacggttcagtggacttctcacaacgtcgcgggcagcgaaccgctcacgtcgccgcaatccgaacacttcaccggaccattcaatcggtaggagcgacgggcggtgtgtacaaagggcagggacgtagtcaacgcgagctgatgactcgcgcttactag

SEQ ID NO: 87144 - DNA, 467 bp, Glycine max
  Peptide Sequence Number=SeqID_178829
atggcttctagaaagagaaagagcattggtacaaggctcatatctcagtatgacacaaggagattctcttcattagatgcttggaccagatacactgataatgttctgggaagaatcattttacctgagaggaaagtagagctatatcacactgagctagatgactttaaggtcgagctggagaggcgtaatttccataaatgcctcaccaatttagccggtgggagcatagacctggctttggtgaaagagttctatgcaaatttatacagttctgaggaccgtccaccaaagcagttcagagtcaggggtcatttggtgaaaattgatgttgccagtctcaacacattcctggagacacctgtggtattagctgagggagagactctacccgcctactccagatactgcaggttgcctacagacttcagagaaatagaggctgccttaagcatacctggtcgagg

SEQ ID NO: 87145 - DNA, 222 bp, Glycine max
  Peptide Sequence Number=SeqID_178830
atggcagcggaatggagaaagggagagagagagagaagatgccacttcaaggagaagatgagtctagaagaagctcaccaccataggaggccatggataagagcttggaggaagaaggagatgaatgaaggcagagggagagaagagcacgaaattttcccactaatccaagatcaattccaagattctccactaagtgtgcttaggtgtcatgaggcatga

SEQ ID NO: 87146 - DNA, 468 bp, Glycine max
  Peptide Sequence Number=SeqID_178831
atggcgttaagcgcgacgtcgaggggctttagcattgaaagatgtattgtcaccctagaacttgatagagcacgattaggttatcatatgtctggacatgaagtgcgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 87147 - DNA, 315 bp, Glycine max
  Peptide Sequence Number=SeqID_178832
atgacctctatagcccagtctaacacttctagacttgggttccctgctctgatcaccacattatgtagggctagaagggttgtctctgacagccttacctttgagcgcctgagcccggtcattaacttggcctacattaggaagaactgttggaatcccgagaatctaactgtttctatccgaggggctaggagggcgagggcaaggcctgctgagcttccttctacttctacagctcctactccagcatccacttcagcagccccttctgtcctagctcagacagactctcagcgctttgaagccatgctttag

SEQ ID NO: 87148 - DNA, 177 bp, Glycine max
  Peptide Sequence Number=SeqID_178833
atggctcgcctgggccctcaaaagacttcaggactaagtctcagctcaccagggcgagctgtcatgaaagaagaagaaaaaagaagaggaaacaaagtcgaggcgttaccggatcacgactgggatcaatctctacatcgttctttgttcggtgttcttcgtgcgactgccagttag

SEQ ID NO: 87149 - DNA, 684 bp, Glycine max
  Peptide Sequence Number=SeqID_178834
atgaccatgtctgatctgttcctcaccatgcctaacatgaggattggtagaaaagaccatactgaatgcacattttgcatgacaactgggcatacttggaaaacatgcttcaatttatttggtttccctaacaagacaacagatgcatccaaattcaagagaggtgagcctatattctctgatgaagattatcaagagtatctaaggttaaaagccagcagacaagctcaacctcctttaacctctaatatttcaacagcttgcatttctcaatccaaggacattcaaggtccatgggtgattgactcgggtgcttctgatcatatttctgctgctccatctcctaaacttctttgtgatcgcttaggtcatctgaatttgtcaaagttaaagcaaatggttcctaatcttagtagattacaagtgttagagtgtgaatcatgccaattaggacacacaagagtatgcccttctttgttggcttcccctatgatgaatccttctacatcatcatcacctcctcatgatgatgactccgattggcccattgttcttcggaaaggcattcgatctactcggaatcctcatactatttatctgagttatcatcgtttatcttcttcttcgcatttctcttttgtttcctctttatctcctcttactattcccaaaaatgttcattaa

SEQ ID NO: 87150 - DNA, 702 bp, Glycine max
  Peptide Sequence Number=SeqID_178835
gctgcagaggagtcattagaaacatccttccaggcattggaagttgtgagcaatgcttatgaggagtctcccctagtgcagccaccctcatctgatgccgctttgatggtggctcaagtgatgttggggcacagatatgagcccgaaatgggtttgggccaaaacgggaatggcatagcaagtctggtggagttcacaaagaatcacggaaggttcgggttggtttatgagcctacgcgcaccgacaagaggagaatcaccttagaaaggagggagagaagctcggctcagccacgagggccacaagtggaaagaattcccttttgtcacatcgatgaaagcttcatcagtgcggggtggatgtgcgagggacgagttgccgtgataaatgaagaaacccctcaagaccaatcaatttgggtgtggccatgtcctctagagtttgaattggggaattggcaagacctagatgttgattttgagcaactaataaatcaagccgaaaaaggggaagatgaggattgggggcttcctccagagttgaaaagaatggtcgagcaagaagaaagggaattgaggaggatgaagcctgagatgtccctgaaaataaaagaagtagtaaagaagcaattcgatgctggcttcttggccgttgctcagtacccagaatgggttaccaacattgtgctagtccctaaatag

SEQ ID NO: 87151 - DNA, 306 bp, Glycine max
  Peptide Sequence Number=SeqID_178836
atggctccaaagaagcttctttctaagagggcagggaaggacgccacgggagaaggatccacgatcaagagttggtctttcctcaaggagagacgggtccaactgagggaaggagaatacactgagtttcaagaggaagttgctaggcggcaatggactcaactcacagggcccatggctaaatatgacctggaaatagtcatggaattctacactaatgcattgcccacagaggagggagttagggataagcgctcctgggtccgaggccaatgggtcccttttgatgaagatgtcattaattag

SEQ ID NO: 87152 - DNA, 219 bp, Glycine max
  Peptide Sequence Number=SeqID_178837
atgtctcttccacctctagaacctcacaatcactcccagactcatttcatgctctcaagatggcttcctcttctcgctcagttctctgcaagtggccatgttggtgctttcgtgcttagcgcaactctggctcgcttagcgcgcattagtgaattttggcttagcgcgcgtcttttcgatagcagatggactcaagcgggattagcccttgctcagtga

SEQ ID NO: 87153 - DNA, 135 bp, Glycine max
  Peptide Sequence Number=SeqID_178838
atgccgcagaacttcacagattacctaacaatgggtgttaactacctcgaagcggtcaagcaaagttgcaggctatcaaacaatggtccccggacgaaattagggccactggtaatcgattacatcctttggtaa

SEQ ID NO: 87154 - DNA, 135 bp, Glycine max
  Peptide Sequence Number=SeqID_178839
atggttcagctaagcgtacattgctatgctaagcctaacatcttcactaaagtgctaagcgctgctgttgcgcttagcccaaatgcttactggattttacaacttcaagttgggcttagcgcgaggctaggctaa

SEQ ID NO: 87155 - DNA, 825 bp, Glycine max
  Peptide Sequence Number=SeqID_178840
atgaaggaattttatcaaaatctatatgtcctagatgacaaatttcctaagaaagttagggttcgagggcacctgataaaatttgatgttgattccctcaacacctttttggagattccagtggttatggagcaaggggagagcttgccctcttactccaagtttgttagattgaggcctgatcctcaggggcttgtagcccgactgtgtatccctgggaggggatttgttcttaatgtcaagggtctgccgtggaagctcttgaggaaagatcttaccactctggcccaaacctggagtgttctatctcattctaacttggccccgacatcccatacttttgatcttaatctggatagggccaagttagtgtacgggcttgtaatgaagatgaacatgaacttagggacccaaaaatctagggctagaagatctgaggcctccatctacttttgcttttccgtcaccaccagcagctccagttcttccaggtccctccgcttagaggtcaaagccttctgtgtctatgttgcagagcctgcatcagggccaactcctgatcatgcagagtttgcaggatgtggtccagcaacgaccagttatgagcatggaggagtttctgtagaagcccaggagcctcagccagaccaggaggacgacattctggaggcctcagagcccactccacccgagtctttcatttttaagactgatccagtagcagctaccccacaggtgacaccagagccttccactgtagtgctggacatgtcttcttctcagcctgagtcatctgcaccagtgccagacctgacccttccttag

SEQ ID NO: 87156 - DNA, 108 bp, Glycine max
  Peptide Sequence Number=SeqID_178841
atggtgagcatgaatgaaggtgagaagaggataggtgaagaacaacaacagctgatgaatgcaaagaatagcaaaggtgcaggaatgcagggagatgaagcaaggtga

SEQ ID NO: 87157 - DNA, 174 bp, Glycine max
  Peptide Sequence Number=SeqID_178842
atggaaccagctatggaggagttgattaacaaaacacaactctctcccaaaataatcccaacgtcatcatgtcggctcgacggctctacaaaagaatctcacttctcatactctactgctgtcattttgctcccacaaacaaaggttcgcgatcatcacaagtaccaatcacag

SEQ ID NO: 87158 - DNA, 279 bp, Glycine max
  Peptide Sequence Number=SeqID_178843
gaaactggtaatcgattaccagagagtaaaactttgcataaggatgcacaggttaaagttgagtatgtgaaacgattgcatgagcaggtgaaggctcaaattgcaaaggagaatgaaagttatgccaagcaagccaacaagaacaggaaggaagtggtacttgaaccaggtgataattctgaagatttgagggcaaatgctttccaagaaggagggaatgatgagaatcctaaaactgtccaaatacagggacctatgactaggagtaggaccaaatag

SEQ ID NO: 87159 - DNA, 501 bp, Glycine max
  Peptide Sequence Number=SeqID_178844
atgaaactggccaaatacaggctaaaggcccaagtggagaaggacgaaggcccaagtggagaaggacaaagcccccgagtggagaaggatgaaggcccagaggcagagacactatcaagactattaattgttgctgaaggcccaagaacttttgggcatttgataaaatttggtgagagtttctctctgggttccttgttgaaccaatatcagacttatcaaggtaatccttgtggcgtctaccctgacttatcttccttcactggaagtagcgtctaccctgacttatcttccttcactggaagtggcgtctaccctgacttatcttccttcactggaagtggcgtctgcccggacttatcttccttcaccggaagtggcgtctaccctgacttatcttccttcaccggaagtggcgtcatccaaaccttcgtagcctgtatcaaacgatccgctcctactcaggttcacatcatctggtatcagagcttcggctcttga

SEQ ID NO: 87160 - DNA, 375 bp, Glycine max
  Peptide Sequence Number=SeqID_178845
atggcgatattaaggataattacaattgatgcaaatggtttaagtattgtgagagtcagtcattaccttcagggaaggaatgacgaatctaagatccacattggttctgggaaccaaagagttgagtctagtgattccgggaatcacttagttgtgtttgagcactccatggaagacttctctcttctaaaatccttctctatctctattcatcctcctaaaccttatgctattaaaaaggttctttggtatccccctcaacctgatactatcaaatgtaacattgatggtggtgcaaaaaaggctcctgagcatgctagatgtgggcacattttcaatgatcattgcggtgctgatttgggttgttttgcgtga

SEQ ID NO: 87161 - DNA, 351 bp, Glycine max
  Peptide Sequence Number=SeqID_178846
atgagtggtgttgttagggctgcattgagatccaccactagtgtttgtgcacttgtgcagagaagccatggcctcctcccattgaggtgcttctccactgaggcagaacagccacctttgaattcaacaccccctcctcctccgttctttgagactgaccattcagagattcataggtatcctctacaagaggcaatcctgcctgagtcgggtttgacatatggtaatctgcttggtgttcgtaaatatgcgctgaaaactgatatcatcaactttcttgaagggtgtaatttgactctggaggatgttaaaatggattatgaccgtagcttttccccagtttcaacgtaa

SEQ ID NO: 87162 - DNA, 54 bp, Glycine max
  Peptide Sequence Number=SeqID_178847
atggccgaccagcaggctaccaagtccaaagccaaaggtagagggataccttag

SEQ ID NO: 87163 - DNA, 547 bp, Glycine max
  Peptide Sequence Number=SeqID_178848
atggcatcaagaaagaggtctagaacccgatgacatctcttcatcatctatcccagctcctcagtcagcagccataggaccagatgtccaacactcgcaaaccttagtccctatgctacaaagcttattcagaggacaacttattatcatgcccagcctgcgagagttggctcacaacaggccaatcatatctatggagcattttcttgagcaagtagcctggcctgaagctcaacttccattggtgagacccaatgaggctactcctcctgagcccgcaccggcacgggttgaaccaatgccagctgagccacgatctccagtggtgaatccacctccttctcctgagcttgaagtagttcccccatctccatctctgattatcatctctgatgcatcatcggatgaaactactgccctcctgattcaccaactggagaaacagctaatccccctgattccccagttggaggaattgccgatctttctaattcttcatctagagaagtttttactctcactgattccccagtttagacactgttga

SEQ ID NO: 87164 - DNA, 742 bp, Glycine max
  Peptide Sequence Number=SeqID_178849
tgccggaaggtcaaggaagttggtgacctgatgacaggggagccgacgaccgaagccccggtgaacggcggccgtaactataacggtcctaaggtagcgaaattccttgtcggactcggtgaaatagacatgtctgtgaagatgcggactacctgcacctggacagaaagaccctatgaagcttcactgtttcctgggattggctttgggcttttcctgcgcagcttaggtggagggcaaagaaggcctccttctgggggggccagagccatcagtttcctcgggccagacggagattggccctcgagtgcaaaggcagaagggagcttgactgcaagacccacccgtcgagcagggacgaaagtcggccttagtgatccgacggctgatcttccccaagagctcacatcgacggaaggtttggcacctcgatgtcggctcttcgccacctggggctgtagtatgttccaagggttgggctgttcgcccattaaagcggtacgtgagctgggttcagaacgtcgtgagacagttcggtccatatccggtgtgggcgttagagcattgagaggacctttccctagtacgagaggaccgggaaggacgcacctctggtgtgccagttatcgtgcccacggtaaacgctgggtagccaaagcctccggtagcacagccgagacagcgatgggttctctgccccagcggggatggagcgaaagaagttttgagaattcaagagaag

SEQ ID NO: 87165 - DNA, 186 bp, Glycine max
  Peptide Sequence Number=SeqID_178850
atgaagacaaagctggtgtttgttacctgtgatgatgttttgaattgggctcgagctattgcttatgaaattggttttgtgaccgtcattatgaggtcagacacaaacactagtatgagaggaacttcatttgtcttaattggttgtgaaaggagtggtcaatataggtccaagaagaaagatttt

SEQ ID NO: 87166 - DNA, 731 bp, Glycine max
  Peptide Sequence Number=SeqID_178851
ggctacacgcccttaccttcagaggactgcacgtcctccacttcagaggactacacgccatcgccttcgtagggctacacaccctcaccttccgaggactacatgtcctcaccttcagaggactacacatcctcacctttagagggctacacgccatcacattcagaggactgcacgtcctccactttagaggactacacgtcctcgccttcagaggactacacgtcctcgccattagagggctacacgtcctcgccatcagaggactacacgtcctcgccatcagaggactacacgtcctcgccatcagagggctgcacgccctcgccttcgtagggctacacgccctcaccttccgaggactacatgtcctcaccttcagaggactacatgtccttgccttcagaggacaacacgtcctcgccttcgccttggtagggctagacgccctcatctttagaggactacaagtcctcgccttcagaggactacacgtcctcaccttcagaggacaacacgtcctcgcctttgccttcgtagggctagatgccctcacctttagaggactacacgtcctcgccttcagaggactacacgtcctcaccttcagaggactacacgtcctcaccttcagaggactacacgtccttgccttcagaggactacgtgtcctcatcttcagaggactacacgtcctcacctttagagggctacacgccctcaccttctga

SEQ ID NO: 87167 - DNA, 500 bp, Glycine max
  Peptide Sequence Number=SeqID_178852
atgccgaagtgtcagctggtatggcgccccactaggcaccctttggacccagataagtccaacagggccctgggattccccgcactgatcacaggactctgccagtcgttcggggtccccgttgcacctaccaaggctcagggtgatgctccacaggccgcaggcgcgcccccaccacctcatcaggctggccaggctggggcatttgacatggagcagtatttacggcatttggttcgccagcaggcggccaaccaccgagcacatgtacggacccatgattgtctgtaccagatgagccttagcatgcagagccagggcttcgcttctttttcatgccctactccagaccagttcagggcagaggttgcatggcccggagattggcccgaggcccaagcaggagaggcacccccagaagctcccggcgacggagaagaggcccacgaggatgaggagatgaccgatttgcttgacttcttgggagggagtggagatac

SEQ ID NO: 87168 - DNA, 372 bp, Glycine max
  Peptide Sequence Number=SeqID_178853
atgacttgtgaagatcgcaaggtcactgctcaagatcttcgtctgaagcttcaaaggaaaggtcttcatcctggaggtcaaactggaaaaagttctgttcatggtgagcgggatctccgtgaaaggctatcagggacaatgactcaacaacctaaaaactatgacccaccaaagcctaaagtggccgctaaacctagcagtaaaagtattcatgttgagactcctgcagtacatatcaacagatcagctaacccaactcctaaaaagttgtcccggaagaattgtttagcagggatgtcgattgtagtgtttgtcatgttctgttgccatgttttcctccacattcagcattgcattgacttgaatctttga

SEQ ID NO: 87169 - DNA, 409 bp, Glycine max
  Peptide Sequence Number=SeqID_178854
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccaggcgtttccccctggcggctccctcgtgcgctctctgttcctgccttcggttaccggtgtcattccgctgttatggccgc

SEQ ID NO: 87170 - DNA, 159 bp, Glycine max
  Peptide Sequence Number=SeqID_178855
atgtgtcgcaacgtgcccttcgcgggcgagcgagggcgaggctcacgggtcgacaaaagtggggcttttgctcctacgtaccctcctttggagaggaaatcagacctacgtagttctttcttaagcgtgaatcaagcgattcttttacttgaagagtga

SEQ ID NO: 87171 - DNA, 492 bp, Glycine max
  Peptide Sequence Number=SeqID_178856
atgtcggctctggtggcgcattgccgtgaaaaccgtaaaaccctggtgacggtcacccataatccgcggctgttgccgttattcgatcgggtcttgcgcatgtcgcaggggcggctggtggctgagcccaccgacgacgccaggatgaatgattgtgcagaggtgaacgtgggcgcgcaggtcaacgggcagttgaaaaaactgtatgtcaaacagggtgacagggtgatccaggggcagctgttggccgagatcgatccgacgctgcagcttaacgaactgcgcaagtcacaggctgaattacgcagcgcacaggcgcagaaactggcgagccaggcacagctgaagcagtaccagctggagctgaagcggcaaagagcgctggcgcgagaccgcgccggcgtggccggcgatttggaaaaagcgcaggcgcagcacgacgcgcaactggcgcagttgaaagtgaacgagtcgcagatcgtccaggcgaaa

SEQ ID NO: 87172 - DNA, 339 bp, Glycine max
  Peptide Sequence Number=SeqID_178857
atgggtaaagcaaaagaggtgcaagagaaggtgaaggcctacatggaggccatgaaagaaaaaatggccacaatgatggaggccatgatgagcatgaagaggataatggaagccaatgcggttacaattgccgctaccagcactgttgctaaggtgaacccgatgcccccatctggcctcaaccaaatgaatcatccaaccttagacatggttggcaaagatttgggaagtagggatggcccccatgatgtgcaaaatcaaaacaagcacgccttcccgccatatggcctgcctcccaactatacaccacccaatgtggcatacactcccaatgaggat

SEQ ID NO: 87173 - DNA, 335 bp, Glycine max
  Peptide Sequence Number=SeqID_178858
cgggtgctatccgagaacaattggccgatctggatttgagaattcttatggattcttcgttgatagaatggaaagaattaggggaagagggatccccggacaatgaaaacgaatgggaagatcgaaaagttggaagaagaaagaattttttggttcgacgcatagaattagctaagcattttctccgaacaaatatagaaccagaatggatggttttatgtcttttaccagttcttcctcccgaattgagaccgattattcaaatcgatgggggagaaattggtacaagaagccgtgatacacttcttgataatggaatccgcggacaccgatga

SEQ ID NO: 87174 - DNA, 525 bp, Glycine max
  Peptide Sequence Number=SeqID_178859
atgtgtagaaactgcccgaaatcgtcgtggtatcactccagagcgatgaaaacgtttcagttgctcatggaaaacggtgtaacaaagggtgaacactatcccatatcaccagctcaccgtctttcattgccatacgaaattccggatgagcattcatcaggcgggcaagaatctgaacggtctggttataggtacattgagcaactgactgaaatgcctcaaaatgttctttacgatgccattgggatatatcaacggtgttggaacctcttacgtgccgatcaacgtctcattttcgccaaaagttggcccagggcttcccggtatcaacagggacaccaggatttatttattctgcgaagtgatcttccgtcacaggtgctccagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 87175 - DNA, 731 bp, Glycine max
  Peptide Sequence Number=SeqID_178860
gggcaccactagaggaagagattgcgcctgtcatttcaagaggtttcaataagacaagcgtggagacacttcagaaggtctacaaggcatgggaggtggtgcgaaagaaggacaaagaactcaggggcggtaacaatgggcccatcggtggctaccgtaaaaccgctaaaagggaggaagttgaggcaccggaggaagacgaagaggtgcaggcccttaggacagaactcaagcaagcccgaacagtcaaagaaaggttcaaatcagtagctcttaatatccgaaaggagaatgccgaactaagagatataaatatagctaccaccaaggccttggaacaagagaccaagagggctcgtagggaagagcacggccggaacaagttccgaggggctatgtggggcaagaccaacatgttagctatcgttagcaagtaccaagaagaactaaatctagccacggcccacgagcatatagtggaggacgagtatgcccaagtgtacgctgaaaaggaggctagaggatgggtgatcgactggttacatccagaggcaaggatgtggatggaccgatttgctcttaccttgaacgggagtcaagaacttcctcgattgctagccaaggccaaagagatggcggacacctactccgcccccgaggagatcctcagacttcttgactattgtcagcatatgatagatctaatggcccatataattagaaaccgctag

SEQ ID NO: 87176 - DNA, 411 bp, Glycine max
  Peptide Sequence Number=SeqID_178861
atggcacgcagagaccaagtttggtcattctgcacccatgatacgcggagataccttacggttatctgcacccctttgctaggcagacacagttgtgtccgatggcacgcagagaccaagtttggtcattctgcacccatgatacgcggagataccttatggtgcttggcaccccttaggcacatttgtgaatcgatgggaaccaagtttggtcattctgcactgtggagatctttatgcacccctgctcgtcaaatcgagagggacgaaattgtgtcttatctttactttttcgatggcaagcagagaccaagtttggtcattctgcacccaagatacgcggagataccttacggttatccgcacccttttgctaggcagacacagtttgtgtccgatggtacgcagtag

SEQ ID NO: 87177 - DNA, 424 bp, Glycine max
  Peptide Sequence Number=SeqID_178862
atgaaatgtaaacgtctgaatgaagttattgaactcctccagccagcctggcaaaaagagccagagcttaatctgatgcaattcttgcagaaactggcaaaagagtcaggttttgacggcgaactggcagacctttctgacgacatcctgatctaccacctcaaaatgcgcgattctgccaaagatgctgttattcctggtattcagaaggattatgaggaagattttaaaacggcgctgctgcgcgcccgtggcgcttttactttccagacattacacccggataccattatggatgccctgtttgaacagggcattcgtgtggattcggggttaacgcctttaaatagctacgaaaaccgtgtctatcaatttcaggatgaggatcgtcagcgctttgtcgtgaagatctatcggcctgaac

SEQ ID NO: 87178 - DNA, 376 bp, Glycine max
  Peptide Sequence Number=SeqID_178863
gtatatgatgaattcggttataataatattgtatttcaatggaagggtatatgaagagactgatggtgtaatatttgaagacagtaaaaaagtgattcagattaaacgtgaaattagtttcaatgctttgaaaaaaaaattggaaataagatttttagtttctggaaaatatgttgctttacaaatttgtgacgacgaagatgttgaaaccatgctcgaaagttttcaacaacaaaatcaaatgtcagttttggaattgtacatagaaaaggatgtggttggtggttctatgtttcattctgcaaattctcttatatcatgcggaaataatttatctaataatgaggcgcaaccgccaacaaatgtgagcaactaa

SEQ ID NO: 87179 - DNA, 252 bp, Glycine max
  Peptide Sequence Number=SeqID_178864
atggataagagcttggaggtaggagaagatgagtggagggagagggagagaggggggaacaaaatttatgcctcaagtgagcaagcaaatgttcacctcccccttaggctggtgtcgcaacgtgcccttcacgggcgagcgagggcgaggctcatgggtgcgcttcccaaaggaggaaagatgcgcggagtcgccaccaacgtttatttgtggaaaacgtcaggaaaaccgaaggaaaccggtcaaaaatga

SEQ ID NO: 87180 - DNA, 231 bp, Glycine max
  Peptide Sequence Number=SeqID_178865
atgagacaaacgcggccatacagcggaatgacaccggtaaacgaaaggcaggaacagagagcgcacgagggagccgccagggggaaacgcctggggggcggagcctatggaaaaacggctttgccgcggccctctcacttccctgttaagtatcttcctggcatcttccaggaaatctccgccccgttcgtaagccatttccgctcgccgcagtcgaacgaccgagcgtag

SEQ ID NO: 87181 - DNA, 1198 bp, Glycine max
  Peptide Sequence Number=SeqID_178866
atgacggaagggtgtggtgaagggttttgccttgcaaaccttcccggtgatgcttttagtctatgggggaacttctttgaggcaaagaaacaaatgatggctgatgccaagtttgcggggctgcttggtcttggcaagccgttggttgaaattttgccccccggtcaacttcgtggtttttgcccgttgttggcttggctagggtcggcggtgctgggttatggccccgtgctaagtttcggattggttggccccctcctcccccccgtgatcagttttgttgccaggattttgccaactttggcttgcgccccgttggctaagtctgtgcctcggggcttggcgtccgtccgcccgggcacacacctagttagcaccaggcaggcaaacgagagagagccgacgaacggggagggacgatcaaagcgacaagggcctgaatctcagtggatcgtggcagcaaggccactctgccacttacaattacccgtcgcgtatttaaagtcgtctgcaaaaggattcttcccgccgctcgatgggaattgcgccttcaaggcgtctcgtagggctaatccgcctcacgagggtcaccaacggcacgtgccttttggggggccgaggccccctactgctggtcggcaaacggaccggcggggcgcacgcgtcgcttctagcccggattctgacttagaggcgttcagtcataatccaacgcacggtagcttcgcgccactggcttttcaaccaagcgcgatgaccaattctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggatcgaccggccgaagccgaccttgggtccaaaaagaggggcagtgccccgcttccgattcacggaataa

SEQ ID NO: 87182 - DNA, 444 bp, Glycine max
  Peptide Sequence Number=SeqID_178867
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggtaaggctaaactgaaaggacaagttttggtgactgcgctctccagccagttacctcggttcaagagttggtag

SEQ ID NO: 87183 - DNA, 400 bp, Glycine max
  Peptide Sequence Number=SeqID_178868
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaatggtggcgaaacccgacaggactataaagataccaggcgtttccccctggcggctcctcgtgcgctctctgtctgcttcggttaccg

SEQ ID NO: 87184 - DNA, 1050 bp, Glycine max
  Peptide Sequence Number=SeqID_178869
atgagtaatcaggttgaagaacaaaacaaaagaagccttgagaaaatggaatgggagttgaaagaggccataaaaatcgagctttcacaaagtgtggcatatgcagatgacgtggtaaaggtaaatgttgaaaaagtttttgacggtgatgctcaagtcccgttcccgtcatcagaaatgcagtatgtcaagcaatcccttgacacattcattacatggccgacacagcttgtgaaacttgtatcacatgaggattcagttattactccaaacaaactggttacacttgttcgaaggtcaaataatgttgctacaaatgatcccttgtgtaggctgattaggagcctttatgatatttatgacaagcctattgaattgttgttcgatgggactaaatttgggattccagatgtagatggtttatggatgagtggagttcaagcttgggtcatggttccgtgcatggattccttgagcctcagtccatacacaatgcaaaagatagacgtggtgaatgtcaacaatacattgaaacatgggttaaggaatcctaaccagagtgcaatgaacacattaaagactactttgcatggtcgtattgatcaagctgcacctaagtggattgaagtaaagttattacgtcatgcattagatgcggaaatagtaagcagggagttgaacactgattggaccatggtttggggatggcacaccgttagacaaggagaccatgacaacaattcgcaagaaatgggcatcatattttttaaaacctatggatttcttccaccaatatttgctacttttgaagctatacaggaaggaaaagaattgggaattccaactaaagcatattatgtcgttgaagaggttaaagagaatgccactcaaaaaagtcaaaaggtgtttgtgtatgtgccatttgagattgctgctcgtgaagttaaggaaatagccttgaaaggtttggatgcaagacttaaagagatcaggggttaccttgaccttgttattgatggaaagcttccattaaaccatgagatcctgtag

SEQ ID NO: 87185 - DNA, 594 bp, Glycine max
  Peptide Sequence Number=SeqID_178870
atggtctacaaaggacaagattcaacaagccaattacattggggacctcacctaagcctcagccatccgacttggatccttccagggagaggaaatgtatgccccattcaacaccttgcttccaatgattttttagtgttgactgaattttttcatgcatgcccacttgtagttaacctaataaacttagcttatagtgttgaaataagaatggtggcaggtttgtggctttctgggagctgccccaatgcaattgtcaacttcattagtaatccagtgaattccacagttgctattgctgcagaggttttcaagaaagctggtacatatgatccaaagggactactgggtgttatgactgttgatgttgtgagggcaaatacttttgtggttaagcctcacaatagcttcacttcagaagggaagagaaggccttgtgcttttacggattcgtacgagaagttcaagaaagcaggagcagtggttgttgggataagtggtcatgatgttgcctctcacaatgcattggccagcaagtacacacttccatttactttgttgagtgatgagggtaacaaggtgagggaacaatag

SEQ ID NO: 87186 - DNA, 1356 bp, Glycine max
  Peptide Sequence Number=SeqID_178871
atgggttctcgaaaccatgaggtatcaatgttgatggagaatggtggtggtgggaacatcgtgaaggggttgagcaaggaaatgagacatggcagaacggcacataacatgtcatcatcttctttgcacaagaaatctgacctaactcttgtgtctaaggttcactctatccccctcaggaatgtgttggtgaatttgcaagaggttgttcttggaaccaagctctctattcttttccctgccattccccttgccgttgttgctcaatgctatggctttggaagaccttggatttttgcattgagcttacttgggcttaccccacttgctgaacgagtcagtttcttgacagaacaactcgcttattacactggtcccacagtgggaggacttttgaatgcaacatgtgggaatgctacagagctcatcatagcaatttttgcccttagcaataacaaaattcacgtggtcaagtattctctactgggttccatcatttctaatcttcttctggttctcggaacctctctattctgtggtggcattgcaaacattagaaaggagcaaaaatatgatagaagacaggcagatataaacttgctcatgttgtttgtggcactgctttgccacttgctgccagtgttgttccattatgttggtgcctcagctgctgacactgcagagtcatctctgcagttgtcaagagctgctagcattgttatggtgattgcttattgcgcttacctcgtcttccaattatggactcaccggcagctatttgaagcccaggatgaagttgatgaagaaggtggcaatgaatcagaagaagcagtgataggattctggagtgcatttgcttggctggttgggatgactgtgatcattgctctactgtctgaatatgtcgtgcaaacaattgaggatgcatccgattcatggggtttgtctgttagcttcctcagcataatcttgctaccaatagttggcaatgcagctgaacatgcaggagcgataatatttgccttcaagaacaaactggacatctcgttgggtgtttccttgggttcggcaactcaaattagcatgtttgtggttcccctatgtgtgattgttgcttggataatgggaatcaaaatggacctcaacttcaacatcctagagacaggttcttttgctgtggcaataacaatcacagccttcacgttacaggatggaacttctcactacatgaaaggccttgttctcctactctgctacattgttattggggcatgcttttttgtacaaagaacaccctccaatgttgctaacataacgcttaaatcagctaccgaagcagtgtttagagctcaatag

SEQ ID NO: 87187 - DNA, 528 bp, Glycine max
  Peptide Sequence Number=SeqID_178872
atgtccttccgcgaagaccatttctggaagaaccttcttacggaatcattccggaagacacttcttccggaaaatttccggaagacccttctttcgaaagaagatttcgtgattccggaaaaaatcaggaacactttccggaagaacttcatccggaatgtttctggaagaaggttcttccggaagataaccttcttcttccggaaggaggctttgaagatttggtggtcccgtgaagtaggtgttccgtatttgaagatttggtggtcccccgtgaagcaggaacgcatttatgggtatttttgcgtattctggctagtttttagagaagaaaaacagcaaaaagttgtttccggaagaaattttaagtacaggaggaagaagttccggaatgagaatgttgtatttccgaaagaacttcttccggaagttactaaggcggttccggaagaagtagttccggaagtgttttccggaactacttctcccggaatgggccatagtaacttccagaagaagtgcttctga

SEQ ID NO: 87188 - DNA, 1500 bp, Glycine max
  Peptide Sequence Number=SeqID_178873
atggcttctcgaaaccatgaggtatcaatggtaaaggagaatggtggtggtgggaacaacctgaaggggttgagcaaggaaatgagacatggcagaacggcacataacatgtcatcatcttctttgcgcaagaaatctgacctaactcttgtgtctaaggtttgctctggccatgtaaggaatgtgttggtgaatttgcaagaggttattcttggaaccaagctctctattcttttccctgccattcccctagccattgttgctgaaggctatggctttggaagattagatcgtacattagtcatcattaatcattgtacgtacaatttttactttcgtttacccctttatgtttgcatgctgattctcgttttatttgctctcttggtgtttggtactttcaaatttggcagacaagttgctttttacactggtcctgcagtgggagcacttttgaatgcaacatgtgggaatgctacagagctcatcatagcaatttttgcccttagccataacaaaattgctttggtcaaatattctctcttgggttccataatttctaaccttcttctggttcttggaacctctctattcattggtggcctagcaaatcttagtcaggaacaaaaatacgacagaaaacaagcagatatgaacttgcttatgttgtttgtggcattgctttgccacttgctgccattgttgtttcattatgttggtgcctcagcagctgacactggagactcatctctgcagttgtcaagagctgctagcattgttatggtgattgcatattgtgcttaccttgtcttccaactgtggactcacaggcagctatttgaagcccagaatgaagatgatgaagagggtggcagtgattcagaagcagtgataggattctggagtgggtttacttggctggttgggatgactatgaccattgctttgttgtctgaatatgtggtgcaaacaattgaggatgcatctgattcatggggtttgtctgttagcttccttagcataatcttgcttccaatttttggcaatgcaactgaacatgcagcagcaatcatatttggtttcaagaacaaactggacatctctttgggtgtttctttgggttcttcaactcaaattagcatgtttgtggttcccctatgtgtgattgttgcttggattatgggtatcaaaatggacctcaacttcaacctcctagaaacagcttctctttctttggcaataacaatcacagccttcgcattacaggatggaacttctcactacatgaaaggccttgttctcatactctgctatattgttattggggcatgctttttcgtacaaagaacaccccctaagcgttgtgttcccgtgtcctctagcatgaggttattcatattcatccacctattcatctgctcccccgaacacaagttcaagatcatcacaggatccaaacacaacaacacacagggagtgagttatcacattcctagctaa

SEQ ID NO: 87189 - DNA, 1542 bp, Glycine max
  Peptide Sequence Number=SeqID_178874
atgggggacttcaacctggcgctggtgatcgtggcgatcgtggtgtgcgtcatcgtgttcctcttcaacgtctacctcctcgtcaacttccagcaccccgacgacgtcaaccaggcctacttccctaaattcgtcgtcgtcctcggcctctctgtcgccgctatctccattctcatgctccccgccgacgtcgccaaccgccaggcctgccgccatgccatctacaatggcgcctgcagcctcacgctccccatgaaggacctctggctcgcaatttacatcctcgacgccgtcctcgtcttcttcgtcatccccttcgccatgttctactacgaaggcgaccaggacaagagtgttgggaagcggattaagagcgccttgttgtggatggtgaccactgccattgtgtgcgctcttgttttggggattttatatgttgtactttctttgttgttttgctttgtgtttgtgtgtgaggtgggggattttgatagtttcatgctgttgatcacttgttggttagtacttggtaggcatagaaatccattggttgtggtgctgcctgctttggatgtgaagctaaataccatgcatccatctcgtaataacttccacattaaggaaaaaaaattcagagccattcctggccttcatcttagaggttgtgtgagagatataaacttttgtagcctccatctaacaggacttattgggaaggtggactttactgttaggcatctctcttcttccacaagccaatttcctagcacatgggacttcaatagtggtcaacaatgtattggaagcacacatcagtgttctgcattcactgccagtccttcatcagagaaaacatggaccatgcgtactacctttccagaatatgttgttgctcttgccactattgttggatctgtgctttttgctatatttggtggtgttggtattgcttgtcttccattgggacttatattttcattcattcgacgtccaaaggctgttatcactcgttcacagtatatcaaggaagcaactgaactgggtaaaaaagcaaaagaactgaagaaagcagctgaatcacttcatcaggaagaaagaagtggttcgaagggtaggaaatttcgtaaaaatgtgaaatcagtagaaaaggagttgtttcaattagaagaagatgtcaagcttcttgaggagatgtatccacaaggggaaaaggctgagacaacatgggcactaacagttctagggtatctggcaaaattcgttttgggaatattagggcttattgtttctgtggcatgggttgctcatatcattatctatctattaattgaccctcctctttctcctttcttgaatgaagttttcatcaagttggatgatatctgggttattcttcatgatgtctgcattctactttcatcaggtcttctgggtacagctgcatttgcatttttctgcttctaccttctccttgctgtgattgctggagccatgatgcttgggctgagactagttttcattactatacatcccatgaagtaa

SEQ ID NO: 87190 - DNA, 318 bp, Glycine max
  Peptide Sequence Number=SeqID_178875
atgttgactctctcggcaaaacccacaacacaacaattagccgcccattgtagagcacacattgtagcgttgattggtggagtgttgataccagacaagctagcagctggtgtctcactaagtgaggcttgtgcacttagcgagaatcatgcgctaagcgagggactcagcccgcttagcgagttgggagaatctggaggagaatctaagaagcatttgcaagctcagcacatcatcagctcgctcagcgagacgcttgtctcttcctgcgctaagcgcgcccaactcgctcaacggatgttcacttactcgcgctaa

SEQ ID NO: 87191 - DNA, 213 bp, Glycine max
  Peptide Sequence Number=SeqID_178876
atggccaccaagaggttaaaaaagttgttagaagctcgtaaatcttccagtcgagacacttcagcccactccccactttcttggatcataaaggtccagattgcacttaatgttgccaggggtcttgaatacatacatgagcacacaaaaactcattatgttcaccgtgatatcaagacaagtaacattttacttgatgcttccttaagatga

SEQ ID NO: 87192 - DNA, 351 bp, Glycine max
  Peptide Sequence Number=SeqID_178877
atgactcgtcgtttggaagttggaggttggaactatctaactagtcacggcatggaagaggtgagggtgttgcggggtgaagagatcgaagagggtgttgtgggggtggacggcgtaggagcagcggcgggggaagggagcggggttggaggtggcggggttgacaaaattcgaatgtctatgagtatgagtgtgagagtgagtggaggccaacagactagggttcaatgtgaaaggagaaggcacattattcgaatgtcgtcaaccagtggccatgatcatgtggaagttttccttagatttgaaccaatagacaacccaaagataccccatcggagttgtatttattaa

SEQ ID NO: 87193 - DNA, 436 bp, Glycine max
  Peptide Sequence Number=SeqID_178878
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaaataccaggcgtttccccctggcggctccctcgtgcgctctcctgttcctgcctttcggtttaccggtgtcattccgctgtatggccgcgtttgtctcattccacgcctgacactcagttccgg

SEQ ID NO: 87194 - DNA, 465 bp, Glycine max
  Peptide Sequence Number=SeqID_178879
atgacccacacgaagaaaactggtcagatgacgtctgaggcagcaaaggaaattgctgagaagattaattcgttgcaggagcaggcgtcacagggtttctttgtcgcccatggacgtcaagatgtactgactgctgccattgggcgaccagaataccctggtcgtgtgcgtgctgctggagctgggaataatccagacacgagggactcagacaaatgcggggtgtacatcgaagaaaatcctccctgcctggttgccttaggaaatgtttatgagggatccaccaccgttcgcaacattactttgttgcatgatcaagtcaaggttggtgttgaggaggttagagatgtagatgctcccattcctgtacccactgaagaggttaagttagtggggcagacacttaacatcttccttgcttggttgacacatctggtcaaacgtttatcagaacaagtattttag

SEQ ID NO: 87195 - DNA, 926 bp, Glycine max
  Peptide Sequence Number=SeqID_178880
gcggcagacaccatcaaagtcggcattatgcattcgctgtccggcaccatggcgatttccgaaacgccgctgaaagatgtggcgctgatgaccattgatgagatcaacgccaaaggcggtgtgctgggcaagaagctggaaccggtggtggtcgatccggcctctaactggccgctgttcgccgaaaaagcgcgccagctgctgactcaggacaaagtagcggtggtgtttggctgctggacgtcggtctcgcgcaaatcggtgctgccggtgtttgaagagctgaacggcctgctgttctatccggtgcagtacgaaggcgaagagatgtcgccgaacgtgttctacaccggcgccgcgccgaaccagcaggcgatcccggcggtgcagtatctgatgagcgaagatggcggcagcgccaaacgcttcttcctgctcggcaccgactacgataaggatatcgaagagatgtacacgccgtttggttacagcgattaccagaccatcgtgtccaatatcaaaaaattctccgccggtggcaaaaccgcggtgatctccaccatcaacggtgattccaacgtaccgttctacaaagagctggcgaaccagggcattaaagcaaccgacattccggtgatcgccttctcggtgggggaagaagagctgcgcggcatcgacaccaaaccgctggtcggtcagctggcggcgtggaactactttgagtcagtggataacccgactaatgcgaagttcgtggccgactaccgcgcttacgccaaagcgcacaacctgccgaacgccagcaccgtagtgaccaacgatccgatggaagccacctacgttggcctgcacatgtgggcgcaggcggtagagaaagccggcaccaccgatgtggataaagtgcgcgccgcgatggccggacagac

SEQ ID NO: 87196 - DNA, 363 bp, Glycine max
  Peptide Sequence Number=SeqID_178881
atggctagaacacgaggtttaggtcgtgccataggtagacttgtaggcagaggtagacatgatgatcatgatgcagctgatgttcccgagaggcgtaggcctactgccttagcccgtaggcaacgggttcatcagatgactgcggatgcacgtgatatggctgaggacgttgctgacatgactgacgatgtccctgatttggctgcagaggcacctgagatgcgtgtggacgtacagggtgctgatggtgctaaggggtcagatgctgatgatgctgctaagggtttccctggtgggccacgtgacccgtcagtgctggcatcatttgcggatcatgttgcacatgttttttggagtgaacag

SEQ ID NO: 87197 - DNA, 318 bp, Glycine max
  Peptide Sequence Number=SeqID_178882
atgaccaaacttggtctctgcttgtcatcgggccggccgcctctggatgacaaaagagtgccgaataaccataaggtatctcgcgtatcatgggtgcagaatgaccaaacttggtctctgctgtcatcgggcccgccgctctggatgacaaaaggaatgaccaaacttggtctctgcttgtcatcgggcccgccgcctctggatgacaaaaggaatgaccaaacttggtctctgcttgtcatcagggcccgccgccttggagacagaagacgaggtgcggataaccgtaaggtgtctccgcgggctaccagctcttga

SEQ ID NO: 87198 - DNA, 426 bp, Glycine max
  Peptide Sequence Number=SeqID_178883
atgaagtcactgaggggaaaggagatcacgttggtgaaagtgcagtggggacccgacgagggtgattcaacctgggaattaaaggatagggtgagagaattgtacccaaccaaaagaattcagaagcttttctccctcattctcacgttgctttttctccctttctcctccaccattgaagcctccatcaaagctccaaactttactcaccatttctgctccaaatcgcaaaaggaagccattttcggagtcgtgaagcgcacctccatgttgtgggacttcaaatttcagttatttgtgaaatttgttgaaagcatgctaaacttgtcatgtttgataaaactgataaagatgaagggtagagttaacctagggttaaaaagtgagaatggtagtgatatgaatggaaaaagtgtgaggctttga

SEQ ID NO: 87199 - DNA, 558 bp, Glycine max
  Peptide Sequence Number=SeqID_178884
atgacccaagagctggtagcccgcggagacaccttacggttatccgcacctcgtcattcagtgaccccaagtgtgattgatgagcagaggccaatgtggtcatctgcgccctttccggagatgtcagcatcttccagtggagactttttcaagtctcacaagttatctagaactacacacagtcgtgttccgatggcacgcagagacaaatctaggtcattctgcaccctttgtcatccagaggcggcgggcccgatacgcggagataccaaattacggtcatatccgcccccctttgccattcagacacagtcgtgttcgatggcacgcagagaccaagtttggtcattctgcacccatgatacgcggagataccttatggggctgacacagtcttctgcaccttttgttcctccggggacaacaaagtcatttacatgtggaaatttcatggtcacccgcgactctcgtcagcctagaggagcgaaattagtgtcatacgctgattttcggggacctttgcttgatgacatgcgaccattcttttggtccttgtga

SEQ ID NO: 87200 - DNA, 429 bp, Glycine max
  Peptide Sequence Number=SeqID_178885
atggcccatcttgtccggtaccgtgtgcataaggcattacgggcaaatgcacctctttcatacccccaacttgtcactctttttctccaacattttaatgtccctttagatgaggaaccctttgttaaggttaaatgttcttttgccattggagctgcggctgttgcatcctttgggtatcggaaagatatggatggtcagtgggtatggaaacaagacctttcacctactgttcctgatgaaagtacaccctcaccaccaccacaaagggattcctcgtcttcattgctgcatgatgttctcacaaaacttcaggatcttcgggcctttgtaggtgatcattttgatgttatggattcatgtataacgcgtcttgaggatgacttgagcttcattcatcaatgctttgatcctccggtagatccttag

SEQ ID NO: 87201 - DNA, 249 bp, Glycine max
  Peptide Sequence Number=SeqID_178886
atggaaagctatctaggcggtttgacaatggaagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcgtgcttttgccgttacgcaccaccccgtcagtagctga

SEQ ID NO: 87202 - DNA, 186 bp, Glycine max
  Peptide Sequence Number=SeqID_178887
atggatgttatggactggtgtgagcttgggaggattgatggggacccggtgttgagagaaacgaggatatgggctacgtgggagtacgtgagctcagatggaggtgggcaacaggggatggtgggtttatgcgcgcattgtggacgtggaaaacttgttgtgcaccatcgcccgaccgccacctag

SEQ ID NO: 87203 - DNA, 666 bp, Glycine max
  Peptide Sequence Number=SeqID_178888
atggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaaggccaatccctgggtggagtttcaccagttttgattaaacgtggccatatggacaacttcttcgccccgttttcaccatgggcaatattatacgcaaggcgacaaggtgctgatgccgctggcgattcagtggtgcttttgcatgtctttccgggttggactcaagacgatagttaccggataaggcgcagcggtcggactgaacggggggttcgtgcatacagtccagcttggagcgaactgcctacccggaactga

SEQ ID NO: 87204 - DNA, 276 bp, Glycine max
  Peptide Sequence Number=SeqID_178889
atgaccaaacttggtctctgcttgtcatcgggcccgccgcctctggatgacaaaaggggtcagtatgacaaagattatggggcggccgacaaaagcaaggctcttgctcctacgtatcctccaatgaggaactcagacctacaagatgcctacatctccggaaagggcgcagatgaccatattggcctctgcttaattaatcacactcgaggggcggataaccgtaaggtgtctcccgcgggctaccagctcttggtcatgggcaaccaaaaggcg

SEQ ID NO: 87205 - DNA, 231 bp, Glycine max
  Peptide Sequence Number=SeqID_178890
atggcagtggaatggagaaggaagggagagaggagacgccagttcaaggagaagatgagtctagaagaagctcaccaccataggaggccatggataagagcttggaggaaaaatgagatgaatgaagggagaggaagagaagagcacaaaattttgtgctctaaaagagctctgaaatctaaacccactaattcaatatcaagtccaagattctccactaagtatgcttag

SEQ ID NO: 87206 - DNA, 336 bp, Glycine max
  Peptide Sequence Number=SeqID_178891
atgagggtttttacttgtcgtggaatgcaagaggggtataccaccaactgcttggcccttccgtggcatatccaggcaaggtcgaagtcggtagattgtggtggggaattcatgtgtcccccccacggtttaagagacatgtgcatgatcagtttggggttgttggctctcaatgggtataggagtggagttattgacattcttattgggagtgtacgccactttgggtggcgtatagttgagaggcaagccatatggcgggaaggcgtgctcgttttgaatttgtacattatgggggctgcccgtacttcccaaatctttgcctaccatatctga

SEQ ID NO: 87207 - DNA, 499 bp, Glycine max
  Peptide Sequence Number=SeqID_178892
tgatagatatgctgtttctgagcatcaaattgccaaggaaatcactgccaaacaagtccagtattggccaaagaaagggaagctttcagcagggaagctaagtgtgaagtatgcaattctacacaggattggtgctgcaaactgggtacccaccaaccatacttccactattgccacagagatccaacaagtgaagaggatcaagcccagacttggactcgacatcctgacaccacgggcaccgaacctgcttcaggtgctgtgtccaggtgacctcattgacttagaagaagtcgaatccatgaaggaacccattgcaaacaggtgtggcaccggcattgcggaaagcacttcaaaacagagaagggaagaaacctgcttaagaggtactggacgaatcaaaactatggcccagaagaagagcactccaatcactcctactcgatccagactgaagcaaagtcagctgattccggaagaaggaaagaaattcatctga

SEQ ID NO: 87208 - DNA, 261 bp, Glycine max
  Peptide Sequence Number=SeqID_178893
atgttgtttcttctctcttttcccaaaaccctctctttttcccgcaggccacctaacctgtctcagaaaaatgacgatctcggactctttcaccgttggatcgttgtgaaatttaaaaatcagtattcgtggtgggagaaaaaagaatcgcatgaagacagtacaagtagaagtttcaatctcttctccgtctctctgacgtttgggaattcaatcggagcagtcggaggaataactgaaggaatctcaaggaactgctag

SEQ ID NO: 87209 - DNA, 267 bp, Glycine max
  Peptide Sequence Number=SeqID_178894
atgggtttagctgtttccgggatccacaaaattcagaagaagctcaatgaagtggaggatttagcatctaatagaaacctatctgatgatgagataaaggctaagagagaattacaacaagaattgtgggaggcctcaatagcttatgaatctttattaaggcagaaatctagagggagacaagtggagacatcaactcagatcaagaacaggagacaagtgcaggctctattcagacctaggaagctcttaaaatgtggaaaatga

SEQ ID NO: 87210 - DNA, 138 bp, Glycine max
  Peptide Sequence Number=SeqID_178895
atgccggaaatcaaaagaagagtgttttttgaagctgggttgcttctggaggaagcaaagaagcaacccatctcgcctgggcgagctaaggtcgcctgggcgagctgggcggcaacctcctccccctttttcctataa

SEQ ID NO: 87211 - DNA, 78 bp, Glycine max
  Peptide Sequence Number=SeqID_178896
atggaagcaaaagcgcaaaaatggtggcctaggggtgaaaaacccttaattcccgggttgctcgcccaggccagctaa

SEQ ID NO: 87212 - DNA, 198 bp, Glycine max
  Peptide Sequence Number=SeqID_178897
atgtctatgtttctcttaaccagtgctttaaagggattcaatgataaacacagcaataaatccaaggcaaatggtaaacgaatttccgttaaaaattttattgatccaagaacattggaaccacagagaataaaggtaattcacattgagtgggcaaaatgtttagtaagagttaaaaatgaagtattgagtgtttaa

SEQ ID NO: 87213 - DNA, 114 bp, Glycine max
  Peptide Sequence Number=SeqID_178898
atggatgaagcgatgaagagacaatgcaaagtcaacctgtacagaactgctttttgttcgcttctggcaagtgcaccggatcatgcaagtagtataaaacggtgtgtaaagtaa

SEQ ID NO: 87214 - DNA, 192 bp, Glycine max
  Peptide Sequence Number=SeqID_178899
atgaatcctttcaaaaagggagggaatgatagaggtgtaactagtttgtctattgatcctttacatgaaattagaggttctatgacaaggtccaagactaagaggatgaagcaaacattgcaagacctgattctaaagatcaaagagaaagaagaccatgtagtggcatgcaattatcaatgcatcgagtaa

SEQ ID NO: 87215 - DNA, 402 bp, Glycine max
  Peptide Sequence Number=SeqID_178900
atgagaaattgcgctcaaacacaacaacaaagtctctcttccattgacagacgcggttggatggttgcacaccaaagcaatgagctcccagtttgtgatacctttctagagcttgctaatccctacttgtgttgttcgacaccagtttctgcacaaggcgtgagatcattcgacgttttggtcaaggatgcgaaagatacccaaggggaggggcaaaagggtcatttcaagcaattttatggactctggctcgcctgggcccccaaattgcttagggctgaaggaaccagcttgcctcggcgagctgcagctcacttaggcgagccaatttcttctggactaagcatcagctcgcctaggcgagctgccatagtcccaaatgccctcatttcctataaatag

SEQ ID NO: 87216 - DNA, 507 bp, Glycine max
  Peptide Sequence Number=SeqID_178901
atggataagagcttgaaggtaaaagaagatgagtggagggagaaggagagaagaagcatgaaattttgtgcctcaaaagagctatggttcagcccactaatccaagatcaagtccaagattctccactaagtgtgcttaggtgtcatgaggcatcccatgggcccaaaatctatccaaaggctcatgagaaccctaaggccttctcttgcatccctggctcaatctacttggagtcttctatccaatgcccttgcacggtaggattgcatcaggggatgtctcctccacctctaggaatctcacaatcactcaaaaactcactaatctccctaaaagatgaaaacttggccccttgctctgctctacactctctgaaattcacactcttcaggcctctgagtagtaaacagttctcttggctccctcacaattttgtgcaaatcaggcttaaaaagggattcctgatctcgacatcacgcttagcgccattattgcgcttagcgtga

SEQ ID NO: 87217 - DNA, 243 bp, Glycine max
  Peptide Sequence Number=SeqID_178902
atgtctatattcctagacctaaagccacatgagggggcagcaattgcctttggaggcatagctaagggaaagatctttggcataggtaaaattggtattccctctctatcctccatagacaatgttgtatatgttgaagggaaatccggtttgccggaaaacgcaccggatcgtcaagtatttaaaattaaaacggatgaatctgagtatcgaactcagggaactagtcttagacagagttaa

SEQ ID NO: 87218 - DNA, 327 bp, Glycine max
  Peptide Sequence Number=SeqID_178903
atgaaaaaatctccttctgcttctttttcctctttgtcataccctaacttcgttcggggacaattatttgtcgacatgcggattttcgccagtcacattgagttgcttaaagccaattgttgcgtgatccgtaagggggtgttcttcagccctgggcccatctgggcccatcaggaggaagcaaccaactcgcctgggcgagcatgttgcttcaagcttaagcctccagcttgcctgggcgagctgggcggcaagctcctcctccattttccctataaaatggcgttggaggctgaggggaaagggttcagcccctttggcaattag

SEQ ID NO: 87219 - DNA, 660 bp, Glycine max
  Peptide Sequence Number=SeqID_178904
atgtaccctctcttgttctcagttacaaaaacccaagtagatgtaccctctacttgtaccgcaaaggatgtaccctccaatgtgttaagacaaagttctcaggcggagaagggagacacaacagaattcaggcggttagtcctttgttcttttggaaaagggagaagagagacacaaaaagaattcaggcagttagtccttgtcgaattctttttggcaaagggagaagagagacacaaaagaattcaggcggttagtccttcgttcttttggcaaagggagaagagaatgaaaagatatagcacacttttgttttctgtgaaagaacaaggtttagaaaccaaaaaacttagaaagcttttggcaaaggaagaagaagaagaagaagttcaaaaagacgttcaaaaagttatgaagaagttattaaaatgcaaatcaaggtcttgcttttatagactcttcatgtctggtcaagaaaatcactggaagagttataaccttgagaaaatcctgagaaaagcattggaagagttacatctcttgatttttattcaaaacttgtcactggcaatcgattaccaaaaccatgtaatcgattacacaaagcattttatgaaaagatgtgactcttcacaattgaatttgaatttcaacgtttag

SEQ ID NO: 87220 - DNA, 240 bp, Glycine max
  Peptide Sequence Number=SeqID_178905
atggcagtgatgaatgaggttagggtttggagtagagggggtatgaaaccgaggttgttttgggaagcggctctgatggagtgtaacctaaaggagaggaggaagacagaaagtgaggtggtggatgagggagacaaaaagttaattaagcaagctttgagaagtgttgcttttcaccttctcgctaagccaatctgctggcttagcgagagtccgctaagcgcaacactcatgggctaa

SEQ ID NO: 87221 - DNA, 381 bp, Glycine max
  Peptide Sequence Number=SeqID_178906
atgggtcactgggtaatcgattaccagatcgtgatggcggcgcagctaatccatgatcgagtagagatggagtgcctagagggagtctgggagaccctcgaaggcaacacaaggtgtcgatttcggggcattattcgatttacgatgacttctttggtgcatccagatgaacccgtgcgcacgcttctgcgcactgtggagtggatactacccacgcctacaccataccgtctagtggagccagtccaagtgatcgagggcgatgaggacccacttcctgaggtggattctcccgaggaagtcatgtcggcatctaaggcagactctacggaggatagtggcccgagagagatggcgaccagtggaggctcttcatcatag

SEQ ID NO: 87222 - DNA, 375 bp, Glycine max
  Peptide Sequence Number=SeqID_178907
atgggcttgatactgagggtggataaagaaaactacatcaaagccggaatcgaatttgtagacggaaagtataatctaagtacggtcgttactcatacgacgagcgactggagtgtcattaccctggataaaatcccttcagcgatatggataaaggcagtaaggagactggatgcagtagaagtattttattctttcgacgataaaaattacatcatgatgcgcaatgcccatctacaggacaatactccggtaatggtcgggttaatggctgcatgtcctgacggagcaggatttaatgctgttttcgaaaattttaaagttaagcatttacccgatgaacgtcgtttacaatggcttgacaatcatcaataa

SEQ ID NO: 87223 - DNA, 551 bp, Glycine max
  Peptide Sequence Number=SeqID_178908
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaatggtggcgaaacccgacaggactataaaagataccaggcgtttccccctggcggctccctcgtgcgctctcctgttcctgcctttcggtttaccggtccgggtaggcagttcgctccaagctggactgtatgcacgaaccccccgttcagtccgaccgctgcgccttatccggtaactatcgtcttgagtcccaacccgggaaaagacatgcaaaagcaccactggcagcagccactg

SEQ ID NO: 87224 - DNA, 489 bp, Glycine max
  Peptide Sequence Number=SeqID_178909
ggcttcccggtatcaacagggacaccaggatttattttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttggtcgtaacaagtcaacaaccccctctttatccttattatgcctgcgggtggagagagaaagggacagagcagcagatgatgacgtatgacaaggactctcttactggtgggctgtcgtatgagagtggagctaccaaggatgctctaacccactaccccaaccacaagcactcacacaacgcaggcactctgtcat

SEQ ID NO: 87225 - DNA, 515 bp, Glycine max
  Peptide Sequence Number=SeqID_178910
atggatgggcacatagatgtggccctggtcaaggaattttatgcaaacctgtatgatcctgaagacaaatctcccaggcaagtccgagtgcgggggaagctgattaaatttgatgtcgcctctcttaatgcttttctagagacaccaccagttctggagccaggggagcagtatattgcatataccaagttctgcagcactcgcatagaacctcaggagatggctgccaaactctacatcccaaggaagggatttgtatttaatgcagagggcgtaccttggaagctcctggggaaggatttgactacactggcgcagacctggagcatcctgtcatattctaacctcgcccccacctctcatatgtccaatttgaatatggacagggcaaggttagtttatggacttgttatgaggatggacatggacgtgggctcactcatatcaggccagatctcacagatggctcagtccaactcctccaagctcggattccctgcacttatcacagcctt

SEQ ID NO: 87226 - DNA, 114 bp, Glycine max
  Peptide Sequence Number=SeqID_178911
atgttgcggaacttcacagattgcttaacgatgggtgtcaagttcctcgaagcggtcaagcgaaggttgcatgccattaaacaatggtccccagacgaaattaggcctaaataa

SEQ ID NO: 87227 - DNA, 294 bp, Glycine max
  Peptide Sequence Number=SeqID_178912
atggtaatcgattaccagaggctaatttccagataccacccaagatacatagctggccagccaccacacaagcctccttgcttcgtggactttgttcttttattggttgactgccaggagctcgcctgcttaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 87228 - DNA, 671 bp, Glycine max
  Peptide Sequence Number=SeqID_178913
ggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatcaacacctcaacaagacgatgttgaacttcgtcttgttgagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 87229 - DNA, 365 bp, Glycine max
  Peptide Sequence Number=SeqID_178914
tgatcttcgtcacaggtatttattcggcgcaaagtgcgtcggctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagtgttttccccagtcacgacgttgtaaaacgacggccagaattcgatcttgcattgccagaaaacatcaaacatatgtgtgatcagcaatacattaaaaagctagcagtcttgtga

SEQ ID NO: 87230 - DNA, 636 bp, Glycine max
  Peptide Sequence Number=SeqID_178915
atgggtgaagtaaaggaggtgcaaaagcagatgaaggccaacatggaggccatgaaagagaaaatggccacaatgatggaggccatgataagcatgaagaagataatggaagccaatgtggttgtagttgccgctaccaacgcttttgctaaggtgaacccgatgcccccatctggcctcaaccaaatgaatcatccaacctcatctatggtaggcaaagatttaggaagtacgggcgacccttattatgtgcaaattcaaaacaagcatgccttcccaccatatggcttgcctcccaattatacaccacccaatgtggcttacactctcgatgaggatgtcaataactccactcccatactcattgagagccgacaaccttatcatgcacatgtctctcaacccatgggggacacacatgaaatgccccaccacaatctagccgacttcgagccttgcctcggatatgccactgaagcgaaagcagttggtggtatacccctacaaaacactttggagggccctcagtatcacccacaaccacaccccttgcattccacagcgggtaaaaaccctcaggctatggcagaaatgggagaagttggatcatctaaaggaatggctcagggccattga

SEQ ID NO: 87231 - DNA, 321 bp, Glycine max
  Peptide Sequence Number=SeqID_178916
atggatacaacaatcgttttccatggtgagccagtaataccctaccctcaggatctttcgggccatagcactcccgttggtgtgcgttctaaaggaacccttgtgaacatccacctatatctactcagcttccctggcatccacacatcagagcaaaaccatgtcatgcaaatccccatgcggggtcaactgaagcatggatgccagagtggcaagcgcatcggccatttgattctcctccctaggaatgtggtggaaggatatgtcctcgaagaactctatgagcttcttgatgtaagcctggtagggtatcacttatga

SEQ ID NO: 87232 - DNA, 509 bp, Glycine max
  Peptide Sequence Number=SeqID_178917
acctcacgaggaaatgggcccttgcagtcgatcaggacagtgtggaggacactgtctgtgagaaatacggcattagcaaggaaaaatgggcccaattttgccagactcgcagacacccttcttgggaggatgtgcgcaaaaaggcacaggccagccagaagcagaagctcctggctgagaagacgaagaaaaagctggaggaagctgcacagtcaggaagcgttgatggcttcatcgaccctccatccccggtcagacgccacgtgaagtggaagatggcccgcatgaagaaaacaggggagatgacgactgaggccgcaaaggaaatcgctgagaagatcgattcctttaacgagcaggccacacagggatccttcgtcccccatggacgtcaggatgttctcaccgctgctattggatgttctcaccttcgtcagtccttaaatcttgccagtcagtcttacatccgacagatcacctcgatggaaaaattacatagcctaagttag

SEQ ID NO: 87233 - DNA, 390 bp, Glycine max
  Peptide Sequence Number=SeqID_178918
atgggtggggcaagctcttctattctggttcatggtttctcttggctatatggttcatccgggggagagatcgagcttcaagaaatagtgaacggtcttatcaatacacaaatgtataactccccaggaattttaattgcacttttattcatcactgtaggaattgggttcaagctttccccagccccttctcatcaatggactcctgacgtatacgaaggagtgcgatgctacatagttggttctcatccttcagagactacgagtataatagggagcatccgtcaacaaaaggatcaccctaagatgatcatctcgtggctattgagaacgaatcaaatcagatggttctatttcttattcttaatgttttcgatctcggttccgtag

SEQ ID NO: 87234 - DNA, 306 bp, Glycine max
  Peptide Sequence Number=SeqID_178919
atgaagatcttaaaagggtatacaaagaatctacaccatcctgaagcatccattgttgaaaggaaaaacctattgggcttcccaagtgttgataagaagagagagtgggagtgtaagtgggttgatagcaatatcggtgtgcaaactgatgattttggatttactttggtagatctaaataagttagcttatcaggatgtgtctttcatcatggtagacaagctaagcaagtgttttatgttcaagatccttgtgatgaaaggtggtcagtggttctacacagaaaatcattggtgttcatcttaa

SEQ ID NO: 87235 - DNA, 396 bp, Glycine max
  Peptide Sequence Number=SeqID_178920
atgattatgaggggccaagacatttatagtagccaagatgaggctactacttcaccttcctctagtgaaagtgaagaagcaaaaggggaagaatctagtgaagaaatctacccccaagaagatggacaaccattagtggttaaagagaagtgtaaggagacacttgctagcattgccacacctcttgggcttaagtttattcctcaagtagagaagttgttggatgaggcaccactcactgagttggtgagaaaccttgttccttcatgggaagatgcccaggaaatgggtgttgagggaaggagcccagagtatgaagaacctcgggatttgaggtcaaatcctttacaaggtggagggaatgatgcaatcctatcccgcaggggcattgggtag

SEQ ID NO: 87236 - DNA, 404 bp, Glycine max
  Peptide Sequence Number=SeqID_178921
atggccttcaaactcagcaacagtagtggattttgcacattgccacacaatatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 87237 - DNA, 375 bp, Glycine max
  Peptide Sequence Number=SeqID_178922
atgacgtgcgacctttctttggtccttgtgaggtgcttgacacccatcattaggcaatttgtgaaattccaggacatgccgaaaaaaccaaaaatattgatgcacaatccttccgtacattacggaaagaaaacaagtatcgttacgaaattcgtaagtttccgtaactttacgaaaaaaagaatcaccaaaaaacagcagaggggggtgtacttagtaaaaatgggggtgcaaatagcacccaggcccacttgggccctccagaatattcctccagaaggcggttgcttctggaggaagcaacctggctcgcctgggcgagctgagctcgcctgggcgagctgggcggcaaccacctcccctattttgctataa

SEQ ID NO: 87238 - DNA, 362 bp, Glycine max
  Peptide Sequence Number=SeqID_178923
tactgcgccctcaggcaggcgtagggcgagacaccacagcagcctggggatggccgacatcgggcaatagacacactgccgccacctccggagcccctcagctcatctacaaaggctggagcgttgcctacgacccatggccgaccagcaggcgaccaagtccaaagccaaagcacttagacaatgaaggaaagctggagttgctgcacatgatgtccaacgttatgtcaaagaataagatcggggctgcacaatgcacaaggcaagatgaaatgtcaaatgaagaattgaagctacaggatccacgatgtcggatacaatgtcctgacatctggcccgaaaatactggacgcataaagctg

SEQ ID NO: 87239 - DNA, 354 bp, Glycine max
  Peptide Sequence Number=SeqID_178924
atgccccgtaggcctctctcgggtgacctaagcatttggtacttcgatcttttattaggttggcgccaggttcgtattcaaaccttctttccaaatcagtccttgttcatttcattcgtggtgctcttggcacaatggtctaatctggaggagggaagttggatgtttttctctatttatcatcactacgggccatatggccagatcgacgttgtcagaataatagtgtgcccctttgaaaaggatgaatgccccacccatgtgatatctgctaaaggcttcgtcagtgaggtgagaatttcagccctatctctccttcggggttcaacctccttaagcggtcagcgggcataa

SEQ ID NO: 87240 - DNA, 857 bp, Glycine max
  Peptide Sequence Number=SeqID_178925
atggcccgcacgaagaaaacaggggagatgatgacgactgaggccgcaaaggaaatcgctgcgaagatcgattcccttaaggaggaggtgacacatggatccttcgtcccccatggacgtcaggatgttctcaccactgctattggacgtccagagcaccctggatgtgtccatgatgttggagccgcagtggacctagcaaatcagggaccagctagaggagtccatcacggaaagagtgatgcggcaactcatggcatccttctgccagatgcagtcccagagcctctggttggtccctccggtcttcgagtaagcacaaaggggagttgtgttgatccctcaggaaacgatcctgagacaggtgacttagataggtgtggcttgtacatcgaagtagatcttgcccgcctggttgtcttggggagagtttatgagggatccactgttgttcataatactcctttgttgcttggccaagtaaaggtgggtgtggaggaggttacagatgcagatgctccagttcctatacccactgatgaggtagctgtgtctccggcaaaaccacctccaaagcccgatccagaggtcgatgatccgctttatctgacgacattgaccatctcagagcttttcttgaggccttatcaggttacatgggatgccactgtgtttggggtctttaatccagatttcccgctctacataaagctcgaagacctctccgaaatcgcacacggtggtcaatgtctcaacatatcagtgttacagttatggattctgcatctcactgaaacatgtatgcgagcggggaattctgatatctatggattcctcgagccacagtccattcagag

SEQ ID NO: 87241 - DNA, 129 bp, Glycine max
  Peptide Sequence Number=SeqID_178926
atgtcagtgaaaaacctcgtcgggcacctaagagtacatgacaagatagaccacacactggtaagtcaggtcattctcactaggcttaaaggagcacttaaaccgggtgtatttacccccaaggcctag

SEQ ID NO: 87242 - DNA, 555 bp, Glycine max
  Peptide Sequence Number=SeqID_178927
atggatgtgggtttgattcctcctgatgctaataaaatcccgcttggcgagcaacctcctcaggaaggaaatgtgcagccatacaagtttatcctccccccgacttggaaacaggctcgtgtagcaaatatattatctggaaattactgccagcctaaatgtgcagagccctgggtggaggttaagtttgaagatgaaaaacaaggaaaagttcaggttgttgcttcgcctttgatacgccttaccaacaaaccgaatgcatcaattgaggacatcgggagcccagaaaaactgattgcttctcttgggccatttgtcactggaaacactttggatccagatgagctccttgagacttctgttgaaaagattggcgatcagacatactacaaatacgtgctcgaaacaccatatgctctcacaggaacacacaatcttgcaaaagcaacagcaaagggaaacactgttgttttgtttgtggttagtgccaatgacaagcagtggcaaacttctgaggagactctaaaggccgtgcttaattcctttgaagtttag

SEQ ID NO: 87243 - DNA, 513 bp, Glycine max
  Peptide Sequence Number=SeqID_178928
atgtgtcacttaactgcatatgtttgtgttcactacgacgaccaaatttgcaatactaatgagggcaccaccttctttagtaacaacacaaaaactttcatggtcaacaaggtcataacctttacacaattgcttgaacttgttcaccaaaaactagacattgacccacaacaacatatccaacatctccactttcggtgccctatatttgagtcaggacaacgttatatgtacacatcttttattttgcgagatgatgctgatgttcgaaaaatgttcaacattttttacaacaacccatcacttccatttgtggagttatttgccataatttgtctcaataataacccaccagacaaccaacatagctcaacctctaatcttgaggacttatcagatgaatacgagacttgttgggttaaaaaccatgatagtgatattgactcatcttctaggcccgaaggaagtaacctgtctccatcccacgaaccaatattcaaacgagattggtaa

SEQ ID NO: 87244 - DNA, 429 bp, Glycine max
  Peptide Sequence Number=SeqID_178929
atggctggacataataacaaggagttcataggcaaaggttatattggaacttggaatgggggggatgaacaggagttgttacagaaaattgtgctactggagagacaagataaagaaaaaagatatgaatctactcaacaagcatttaaaagtctagaaattcaagttggtaagctagcaaaagaaatggctaaatttgtggccacaagggaagaaaactttatagaggttgaagctcatgaggaaagtcttgtaaaagagcatgattcaagagaaaaagatgaagaaaaaagtgaggagagaacacaacaacaattagagaagtgctcacaagtagaaattcaacaagaaagtattctccaagtcaatacccctgctcatcaactgattgtcaaggaagaaaggcatggagaacatgataatctttaa

SEQ ID NO: 87245 - DNA, 764 bp, Glycine max
  Peptide Sequence Number=SeqID_178930
atggtgccagtgcagaaaacagaggtgcagatagaaggaaaagctaagagggtcatcacaaagccctcttaccttaaagattatgtgcagagcactggtgtgattccagtggatgacctcgaattgtcagtttacgtcttggcctatcttcctccaagccctgcaagcgggttctgttgctcattacctgtcggagttcgaggacctcgcaaatcgcatcatcagtcttcctttgtcgttcctactgagctgttttatctttggcttaactccggagatccgtcgcgaggtgcatgcgcaccaaccactaaccctggtgcaggctacaggtctggctcgtctccaggaagagaagttgttggacactcgccaaccttcacgatctcgggttcctccactgcagcccaccctgtagaagcaaagcttcatgatgatgacaaaggtgatgacaaaaagctcaaaggtcaatcaaaggatgagttcaagatggaatcaagaacaattcaagactcaagaagaaaaagttcaagaacacttcaagattcaagaggaaagttgaattcaaggatcaagcttcaagaatcaagatcaagattcaagattcaagaatcaagagaagacttaatcaagataaggtacatcctttgtggtacaagtagagggtacatctacttgggtttgactgagaaccagaaagagtacatctcttgtggatcagttctagtggagggtacatccactaagttcacagagaaccacggacg

SEQ ID NO: 87246 - DNA, 598 bp, Glycine max
  Peptide Sequence Number=SeqID_178931
ggtttgtacttttgacgatttactgccatgtatcgagaagatcactcttttgtctgaggaagaggataagatacttgaggcacatgaagatgctcccccttctcagccacaatttgaacatcaacagtttaatatactacagcaaagtgtggagactcaaggcttagcgcgacgttgggaaactgttgatgcagcaacatatagtttgtctccgatgccagaacgacaacatgaaatgtattacacactgtcgacattcacccaagaaccgtctcagatgccgccgatgtattcatacccacatgattttcaaccagggtatagttttgcaggcatatttgggtcctctcctccatttacccaaagtggtcaagtatcgaccccaaatgcctcacttgctggtccgtggaatgtacctggagatatatccgacatggacgactttttagggtttgatttacgtcatgatttctctgccgaggttgaccaagtggatgaaagggcgaatcctagaagaagaaatcctgatagggcagctagaaattgggaccggccatgtgggacttcgtcgcggcatcacatacatagtgatgattga

SEQ ID NO: 87247 - DNA, 1954 bp, Glycine max
  Peptide Sequence Number=SeqID_178932
tcctgaagttgaaatcaggatgccaatggaggcatttccgccagtttcagctgatgtgagctttatttctaatagttttccgaagtacaaactggatgctgataatcaagttctggaagagccagttgaggataaccagggtccttctttgaaggacgttattgaacaagaagcttccaatttgtcagaccaacacaagcgtatctcagttcgtgaccttgccagtaaatttgacaagaacctggctgcagctgctaagttgtctaatgaggcaaagctaagagacgtggcatctttggagggacatgttcttttgaaaaagctaagagatgccttagaatctttaagaggccgttttgcaggaagaaacaaagaggatgtggagaaagctatctctatggtggaagctttagcagttaagttaacccaaaatgaaggagaattgattcaagagaagtttgaagtgaagaagcttgtaaactttctcaaacaggcttctgaagatgctaaaaatttggttaatcaagagaagtcttttgcttgtgccgaaattgaaagtgctagagctgtggtgctgagaattggggaggctcttgaagaacaagaaaaagcttcccaagcttctaaaccacaggatgtggatggactagtcgaagaggttcaagagtctagaagaatcaaattgttgcatcacccaagcaaggtgatggccatggaatatgaactacgtgctcttagggatcaaattcgagagaaatctatattttcaattaagcttcagaaagagatggttctgaagctttgggttcatatctgcgagtccagccttgctcagatgaagtgccacaggtttcgaaatgttcatttcagtggtaccgcttgtcttctgaaggcagctggagggaaggcgagccctggtgcagcggtaaagttgtgccttggtgacttgttggtcatgggttcgaatccggaaacagcctctttgcatatgcaaggggggtcaaatggccagcaattagaagaacgatcatctaagagcaggtttttgcatttaggatgggatagtaggagttttggtgccaaactacttgccactgtgcaagcaccagcagctgctgaaaacaacatgaaacaagcatgtgctaatgtggctggagctcctcctgttgctaaaggagttgcgctggccaaaagagcggtggcccccaaaccgggtcagaagaaagtgactgtaaaacctaagtctgaggaagatcagattcttgacatcgatgcttctgatgttgacaatgaacttgctgctgtggagtatattgatgacatttacaagttctataagcttgttgagaacgagagccacccccgtgacaacatagactcacaacctgagataactgagaggatgagagctatactagttgattggctgatacaagtccaaaccaagtttgaactttcacttgagaccctttacttgacaatcaatatagttgattggttcctggcggttaagaatgttccaaagagggaactgcaattggttggcatcagtgctgtgcagatggcaaccaagtatgaagaaatctatccccctcaggttcataactttgtcttcctctcaggtagggcttacactcatgaacagatactgattatggagaaaatcatactggccaagctggactggactttgactgtgccaatacctttggttttcctacttcgttttatcaaggcatcagtcccagatcaggagttggaaaacatggctcattttctgtctgagttgggattgatgaattatgcgactgaaatgtattggccatcaatggttgctgcctcagcagtctttgcagctagatgcactctgaataaggctcccctttggaatgagacacttaagctgcagacaggttactcacaagaacaacttatgtatgtgaatctaaattga

SEQ ID NO: 87248 - DNA, 774 bp, Glycine max
  Peptide Sequence Number=SeqID_178933
atgttctcacctttcagaggactacacaacctcgccttccgagggctagacgccctcgccttcagaggagtacacatcctccccttgagagggctacacgcactcgccttcgtagggttacacacccttaccttcaaaggagtacacgtactcaacatcagaggactatacatcgtcgccatcagaaggctacacgtcctcgccttcagaggtgggctacacgtccttgcctttagaggactacacgtccaagccttcagagggctacacgtcattgacttaagaggactacatgtccaacacttcagaggactacatgtcctccacatcagaggactacacgttctcccctttggaggactacataggactacacgtcctcaccttcagaggatacacaacctcgccttccgagggctagacgccctcgccttcaaaggagtacacatcctccccttgagagggctacacgccctcgccttcgtagggttacacacccttaccttcaaaggactacacatactcaacttcagaggactatacatcgtcaccatcagagggctacacgtcctcgcctttagagggctgcacgtcctccccttcagaggacaacatgacctcccctttagaggactgcacgccctcgccttaacaggactgcatgttctcaccttcagaggactacacaacctcgccttccgagggctagacgccctcgccttcagaggagtacacatcctccccttgagaggctacacgcactcgccttcgtag

SEQ ID NO: 87249 - DNA, 420 bp, Glycine max
  Peptide Sequence Number=SeqID_178934
atgaagcacttcactgacaccctcatcagtgccaacataataacatcgaattcctgcagcccgggggatccactagttctagagcggccgccaccgcggtggagctccaattcgccctatagtgagtcgtattacaattcactggccgtcgttttacaacgtcgtgactgggaaaacactggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 87250 - DNA, 248 bp, Glycine max
  Peptide Sequence Number=SeqID_178935
agggtacatcctttgtggtacaagtagagggtacatctacttgggttgttgtgactgagaacaagagagggtacatctcttgtggatcagttcaagtggagagtgtagaagcaaagcttcatggtgaatcaaaaggtgatgacaaaaagctcaaagatcaatcaaagaaaaactcaagtgaatcaagaacaattcaagagttcaagataagaatcaagaagaattcaagactcaagaagaaagtttag

SEQ ID NO: 87251 - DNA, 453 bp, Glycine max
  Peptide Sequence Number=SeqID_178936
atggcttaccccctcaattatacactgcacaccatgcacatgcccaacgagaacgctagccacgccgttcccccataccctatgtttgccattgagggaccgacatgtagtggtatgcctccgcccaacgccacagcagctcctcaacaccgtttgctgcaaccgctgcatttctcagtaagggggcctcctccagcgttggaagggagggagaaacttgatctcatcgaggaaagattaagggcttttgaaaggtttggtgattaccctttcatggacatggcaaaattgtgtttggtgcctgatgttgtcatccccccaaagttcaagggacgagaagctgttaatgcatttcttctaagaaagtttggctggggcggcggtcatttggtataccaatttggaggcttctcatattcactcatggaacgacttgattactgtcttcattag

SEQ ID NO: 87252 - DNA, 288 bp, Glycine max
  Peptide Sequence Number=SeqID_178937
atgttggtgcgcctgatccacactcgtctttttgcagcggcacggggggtggcccaggaactaataaaaggaaactactggccccttaactgggagcgcaagtctcggttaagcatccaagggcaaaagaccttatattctcttaaggcgaggacatatagtcctctaaaggtgataggtactagttcccaagggtccacctttatgagaaagcaagagatcgactcatcgagagggcagacgcatgcaacatttgttgtgaaacttggtaacgctgacctcatatga

SEQ ID NO: 87253 - DNA, 488 bp, Glycine max
  Peptide Sequence Number=SeqID_178938
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacaggggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgcttctcctgttctgcctttcggtttaccg

SEQ ID NO: 87254 - DNA, 442 bp, Glycine max
  Peptide Sequence Number=SeqID_178939
agggctacacatcctcgccatcagagggctacgggcccttaccttcagaggactacacatcctcacctatagagggctgcacgccctcgcctttagaggactacacgtcctcaccttcagaaggcttcatgccttcgcctttagaggactacacgtcctcaccttcagagggctgcacgccctcgccttcagagggcttcacgccctcgcctttagaggactacacgccctcaccttcagagggctgcatgccctcaccttcggagggctccagatctgcgccttaagacaactcaagggaggctatcgtgtagctactatgcatatcggggcaagatttcacccagaccgccacagggagacgagtgcggatcatgcgcaccaccacaactctgatctccccctgccgaagtgtcagttggtctgtgccatcatgacatag

SEQ ID NO: 87255 - DNA, 321 bp, Glycine max
  Peptide Sequence Number=SeqID_178940
atgggtgacctagaggaagtgcagcaaccgatgaaagccgacatgtcggctttgaaagaacaaatggcttctatgatggaggccatgctgggaatgaaacgactaaagcagagtaacgcggccaccgccgtcgccactagcacggttgtcgaggcagacccggctctcctgactgctacgcaccatcccattccaaacattgtgggacgagagagaagtacactgggggcatccatgcatgaagacatgggtcacattactcccctcatccttgaaggggagcctccttggcatcctgacggggtccacgagaatccttga

SEQ ID NO: 87256 - DNA, 333 bp, Glycine max
  Peptide Sequence Number=SeqID_178941
atggtttccggggcttccgtggcttccgtagtgcttccgttaaatttccaaaaaccttgggtacgcgtatttcacttaacattggcgaaagggaagagaaaaaaaaatgaaaatcaaatccaaaacacttccgtaaggcttccgttacttttccgtaaagtacgaaaagggggtgaacttagtaattcgcttagaaagcttcctcaagaagcctctgggcggcaagcacctccctttttccctataaataggggaggggggctgtttcaaaaatattcatcaccccttggctatgcatttcggctattttgggcaaaaaacacgttttcgtga

SEQ ID NO: 87257 - DNA, 384 bp, Glycine max
  Peptide Sequence Number=SeqID_178942
atgggaacaaatcaaaccggcaagaggttttaccaagtcaaggttaaaagcctagataccaccagcatcaaggaattagggcggttgatggaacctctccaaatgcaagccttccgcaagacttacggaaagatcttagagttgaccatagcagaggtatccatagaggccattgcatcactcacccaatactacgaccagcctttgagatgcttcacgttcggagacttccaattggggaagaaaaccatacctttcctccgggtgactcccctctttgagcagaattgcaactgtggtcaaggattcagcaagaggtttggatcgcataaaacagactcgaaacggcatagcgggcctaccacgaaagtacctagaagataa

SEQ ID NO: 87258 - DNA, 453 bp, Glycine max
  Peptide Sequence Number=SeqID_178943
atgttatttcattatggtgaaagttggaacctgatacgtgccgatcaacgtatcatcttcgctaaaagttggcccaggacttcctggtatcaacagggacaccaggatttatttattatgcgaagtgatcttccgtcacaggtgatccagtggattctgtttttatcagctgtccctcctgttcagatactgacggggtggtgcgtaacggcaaaagcaccgccggacatcagcgctggcaagtgtagcggtcacgctgcgcgtaaccaccacacccgccgcgcttactgcgccgctacagggcgcgtcccattcgccattctggctgcgcaactgttgggaagggcgatcggtgcgggcctcttcgctattacgccagctggcgaaagggggatgtgctgcaaggcgattaagatgggtaacgccagggttttcccagtcacgacgttgtaa

SEQ ID NO: 87259 - DNA, 558 bp, Glycine max
  Peptide Sequence Number=SeqID_178944
atgagcctctgccagtcattcagagttcccgtcacccctagtaaggtgatccgaccgccgatcacctgggccttcatcgagaagtattgcacgcctaggcatacgcagggtgatgcacctcaggcagcagacgcaccgccaccacctcatcaagctgatcccgctggatcactaggcatggagcattatctacagcacttggttcgccagcaggcggccaaccaccgagggcaggtgcagatacatgagtgtctctatcggttcagcctcagtcagcttgggcagggtttcgctccttttgcgtgccctactcccgagcagtttggggctgaggtcgcatggcccggagactggcctgaggcccaggcaggggaggcgcctgcaggatccctcgacgatgcagaggaggcccgtatggatgaggagatgatggacttgctcggtttcttgggaggaagcggagccactgaccgagctctcagttatttcgtcaccgcttttttgcgacttaccatttcgtgcgttcttttcgtttaccttgtggttagacgtaagtaa

SEQ ID NO: 87260 - DNA, 381 bp, Glycine max
  Peptide Sequence Number=SeqID_178945
atgcagtgtaaaaatgtggaaaagacagcagttattatattttacacagttcaacaaatgcacacacaaagtttcacaattccacaattccttaaaataggcctaactcacaaaaaatgtccccagtggagtcgccaactgtcgcaacatgcccttttgcgggcgagcgaggcgaggctcacgggtgcgctttccaaaggaggaaagatgcgtggagtcgccaccaatgtttatttgtgggaaacgtcggaaaaaccgaagaaaaccggtcaaaaggaaaattctaagttcgggagttgtatttacgttgaggaaggtcgacaaaagcggggcttttgctcctacgtaccctccatcgaagaggaaatcagacctacgtag

SEQ ID NO: 87261 - DNA, 1302 bp, Glycine max
  Peptide Sequence Number=SeqID_178946
atgggtcccgcacagatcagccgcgaacaggcaaaacgtagaattgttgtaggctttaatgttaaaggacgtgatgtacagagtgtggttcaggatattcagaagaagcttgacaaagacgttaagctacctgcaggatattattatacttacggtggacaatttgaaaaccttcaggaggctagccagcgtcttatgattgcggcagcattgatttttacagccattccaatgagtgctattggtgggatctttgcccttcttgtaagagggatgccttttagtatcagtgccggaattggatttattgccttattcggagtagcggttcttaatggaattgtattgataggaaccttcaatgaattagaaaaagaaggcgaaaaagatatctttaaaagagtgatggaggggactaaaacaaggcttcgaccagtattaatgactgcaacggtagcatcgttaggatttttacccatggcaatttccacgggcgcaggagctgaggttcagaaaccattggcaaccgttgtaatcggtggattaatcagtgctacttttcttactttatttgtgttaccaatgctgtatattattttcaatacaaaacttcgaattaagaaggtgaaaatgaaaccatttacaccggtgattattcttggatttataatgttgggtcaattcgccagcgctcaatccagaacattgactgtagaacaggcagtagaacaggccgtggcgaacaaccccggactgaaatccaaagacctgggcattgaggctgcaagggctttaaaacctacggctaaagaattgccaaaaatgaattttaatgcacagctcgggcagtataatagtcctacttttgaccaatcttttgcaatttcacaaagtattccttttcctaccatattcaaggccagaaaagaattaattgcggaaactataaaaggtaaacagatagagaaggaaatttctatgaatgagcttgttaaacaggttcgctcctattattatcagattgaatatctgcaatataataaagcgcaattaaagaatctggacagcctgtatcgcgatttcattcgtatagccaccgtaaggttcaaggctggggacataaaaaagattgagatcagtactgctgaaacccaacaaggagaaatcaaccttttgctcaatcaaaatcagacacttttaaatatttctgatgacattgaggttccgtttaacggaaattatgagccacttaaatccggaaatattctggacagcaagaggttgataataaccctacattaa

SEQ ID NO: 87262 - DNA, 303 bp, Glycine max
  Peptide Sequence Number=SeqID_178947
atggctgagatgttcagtcgactccttaacctttgtgggggtccggaccccttacgacttcgctgcccgacagtatggagtactgaccacaccgagggacaggccctgaagcgaaggacaggaacgagcggaatcaatgtgttccaatttctggccttgcaccgaccatctaatggaccatggactaaacggccactgcctgaaaggactatgtcccgtggaccgccgcccccccacaaggtacatctcgcgcctatgggccgctataactatccaagaagacactcgaaactggaaggataa

SEQ ID NO: 87263 - DNA, 492 bp, Glycine max
  Peptide Sequence Number=SeqID_178948
atgcatggatctcccacagacaatttagttcctctagacttagaaattaaagctacattgagaaggaacagggccgagagaagaaggaaacttctgcaagacataatagttgcatccattcttgaggaagaaactattttttctgattcattatcacctgattcaccatcatcaagggaattcgctactcaattgcctgaaacaactagcatggaagacgagcaacaccagaagatcacccttgaggattattcaagcagctcggtaccgcaattctttactagcattgcacgtcatgaagggaatttattccaaggattacctaatgaagacccttatgaacatttggcaacattcattgaaatatgcaacactgttaagattgccggtgtgccagatgaagctgttagactcagcctattctcattctcattggcaggagagaccaaaaagtggcttcactcatttaagggtaatagtctgaaaacctga

SEQ ID NO: 87264 - DNA, 234 bp, Glycine max
  Peptide Sequence Number=SeqID_178949
atggctccattgccgtcactccaaaatggtcaaaggactacacgtcctcgccaacagagggctgcacgccctcaccttcagaggactacatttaccctcaccattgagaggactacacgtcctcgccttgagaggactacacgtcctcaccatcagagggctgcacgccctcacctcccgaggactacatgtcctcgccttgagagggctacacgccctcaccttgggtactag

SEQ ID NO: 87265 - DNA, 354 bp, Glycine max
  Peptide Sequence Number=SeqID_178950
atgagtcgtgggcgtttatatcagaaacaagtgaagaacgcttttgacaagaagggattcctgtcctctgtaatttctcatcgcagttttttaaaagaaaatgggattgaggttccggtcctcactttgtgtctcaaactatgtcaagaatttgataacctgagcctttttgctcagtccatgggatgtccaaatagcagaatcgtcttaggcaatggtcaaatgtcgggccggatccaaaggcagagaccaatcaagggatggacgcaagtagaagctaggatcacgatcgatggatcgtcgtcccatgcccagctctggacaagcggaaagcgcgactgggaggcagcctag

SEQ ID NO: 87266 - DNA, 711 bp, Glycine max
  Peptide Sequence Number=SeqID_178951
atggtgaaggagcgtcgcactgaactggtcgagggattccgccattctgttccctatataaacgcgcaccggggaaaaacgtttgtcatcatgctgggcggagaagccatcgagcacgataacttttccagcatagtcaatgacattggcttattgcacagcctcggtattcgcctggtggtggtctatggcgcgcgtccgcaaattgacgctaatctcgcggaacaccaccacgagccggtttaccacaagcagacccgcgtcaccgacgccaaaacccttgagctggttaagcaggccgccggtatgctgcagttagaaattaccgcccgcctgtcgatgagcctcggcaatacgcccctgcagggggcgcatatcaacgtggtgagcggcaattttattattgctcaacctcttggcgtcgatgatggcgtcgattactgccacagcggccgtattcgccgcatcgatgaagaagccattcatcgccaactggacagcggcgcaatcgtgctcatgggcccggtcgcggtatccgtcaccggcgagagcttcaacctcacttctgaagagatagccacccaactggcggtaaagctgaaagctgaaaagatgatcggcttctgctcgtcgcagggggtctacgaccagcacggcgagatcgtttccgaatcaagcttatcgataccgtcgacctcgagggggggcccg

SEQ ID NO: 87267 - DNA, 657 bp, Glycine max
  Peptide Sequence Number=SeqID_178952
ggaagacacatattagctgagaggaaagtggaaatctatcacacagagctggatgaattcaagggcgagctggagaggcgtaactttcacaagcacctcaccaacttagctgatagtagcattgacctcgcgttggtgaaggagttatacgccaacctttacagtcctaaggggccttcacctaaacaagtcagaattcggggccacttaataaggattgatgcaggaaacctcaatgcctttctagaaacacttgtggtgcttgctgagggtgaatctttccccgtctactcaagatactgcaagatgcctactgacactagagaaattgaggttgcattgtgcatacccaaccgagggtttattctaaatgccgaaggtcacccggggaagatcctcagaaaagacctaaccacccttgctcaggtctggagtgttctatcctactccaacctggcttcgacctctcacatatcggatctgactatggatcaggctaggttaatctttggtctagttactcaactggacatgaatgtcggagccctcatttcagggcatattacttctatggcccagtctaactcctcaaaacttggatttcctgctcttagcacagctttatgcaggacgagaggagttgcctctgacagtctt

SEQ ID NO: 87268 - DNA, 474 bp, Glycine max
  Peptide Sequence Number=SeqID_178953
atgggacatcaactagctcctgcatgtacggattggtggagcctgactgcaatgcaacaactccagcgtgccgctactcccatctcgtttcaactacttgatgtactagtagttggactcatgagctatatggagttcagagctgcggttgctgtcaagcgagctattggtggggttggggtgccgactgtcaactccaatcgctactcgttccttccgctacttgatgtactacttggcgctactaggagagcaactagccccagcctctcgttcatgtctctcttgctagtggactatgctcatggactacgtactggagctactgggttgctatactccaatgtgcctagctgcctctactacctgctgtacatggagatcatgatgtactgcccgagcgcactgttgcttcaaccccgactctcgagttctactgtcccgtcgtccctcaactccactctcaactactag

SEQ ID NO: 87269 - DNA, 465 bp, Glycine max
  Peptide Sequence Number=SeqID_178954
atggagtatttagccaacaatgtttctcttctcaacaaagaggataatgcaccaatctacagtgttgaagatgtcaaaaacattaaagagatagctgcaagagatgatgcatttgatctgctaagtgattcacttgcaccttctatatatgggcattcttggataaagaaaggagtgttactcaatcccacaaaatttttagggaacattgtggttgaacatgattatgctgagtgcactggatctgctattcaagctttagttttgtttaagaagctatatccaaggcatagggagacagagataaagaattccattgccaatgcagttcatggtatggaagttggggagtttgctacatttatggcacttggtttgcacttcgtggtcttgcagcagcgagtaaaacttacactaattgtgctgccattcgcaaaaccattaaatttctactttcaacactga

SEQ ID NO: 87270 - DNA, 288 bp, Glycine max
  Peptide Sequence Number=SeqID_178955
atggtcgaagttacgcatggagacggcgtcgtcggagaggcaggaggggatgaagccgccgcggcgatgtgtgagggggaggaggacggagggtggcagaggaggaggaaaagggggaggcttggggtatttttggaaattccaatggttcgaagtagcggcgtgaaaaaccgctccagaacccatgccgctccgccctgcgtcaccgcaatagcggccgctccagccgcgacacaaaaccactcccagaggtgcccgtcgcggatgggggctactccgccgctatag

SEQ ID NO: 87271 - DNA, 2435 bp, Glycine max
  Peptide Sequence Number=SeqID_178956
tgagcaacaaggccaacaaccacaaggctgcttcttcactctgcccagagacacacacatactgctcagtactgcgttctgcaccaatcagcaataactctctcaaatctctgtttcttctagaatcttcgaacgatactttctcaacaacactgtcactctcagtcaacttccttcttcagcgggtggaaagactgagagcatttagtggaggagggttggatttagggttatttatgataggaaggatgggtgatgaacctcgtgctggttctttctggacggaggaaattaatgaggcggttccgacccccatgagaaggaaaaggaaatacaggacaaagaaaaaggaatatcaaggatggggatcaacttcccttatttggtttctcgaatccatcggtagagatacgagcaccaagatagctcaaagtgaggttgcaaatattgtaatggagtatgttaagcagcacaacctctttcacaagacgaaaaagaagcgaattgagtgtgatgagaggcttcattcgctgtttgggaggaagaccattagccggttgaaaatcaatgacctgctagagtcacactttaaggagaactgtgaggagtcctctgatggcgttttctttgactcagaagatgatgagaatgccttgacagcttgtgaaaccccgagaacagcaccttccgagaggaagagccaaccaaagaaaccagtttttgaaaaaccaaggagctgttttgctgccattgttcctgccaacatcaagcttgtttatatgaagaggagtctagttatggaccttttaaaggaccctgaaacttttgagactaaagttgttggaagcttcataagaatcagatgtgaccctaatgattaccttcagaaaaactcacaccagcttttgcaagtcacaggtacgaagaagagttctgaagtaaatggggaaattcaccttcaagtttctggtttcattaaagatatcaggattcaaatgctttcagatgataatttctctgagagtcctgatgagcaggaacggttattacgtgaatttcctcaagttattgcagatgagcaagaatcagaatctacaacaccagatgttctagataaaaacgtagaaaacaatttacaggagttctggcaggctacatatacaaaatcatcttcagtgaccgaggtcccaaatgaagttgcaaattcaaaattggatattgctgatcttgtaaaacaacaaagcaattcaccaaagtcaattcccattctccacagagcaccagaagttcctcttttggatatgacaaataatagcactatgttgaattgcatttctcgagacaccatagagcaccagtcccgtggcttatctgtccaactgccaccagagcaacatacagtctttgcatataagaattacatgtctaagcccggtgattcacaagcacttcccgacaagcagatgtggtcgcctcagattcaggttataaggctaagcaatggcttatcagtccgacagtcgccagagcaacaaacagacattgcatataagaatgacatgtctaagccagccaattcacatgaagcgaaaatctctcaagcactgcctgacaaacagatgtggtcatctcagattcgagctataaggctaagtgatggcttacctgtccaacagtcaccagagcaacaaacagattttgcatataagaatggaacatctaagccagccgaatcacaggaagaaaagatctctcaagcactgcccaacaaacagatacggccagctcagcttgagtttatagagctaagtgatgacttatctgtccaacagcctccagagcaacaaacaaacttcacatataagaatgacatgtctaagccagccaattcacatgaagcgaaaatctctcaagcactgcctgacaaacagatgtggtcatctcagattcgagctataaggctaagtgatggtttacctgtccaacagtcaccagagcaacaaacagattttgcatataagaatggaccatctaagccagccaaatcacaggaagagaagatctctcaagcactgcccaacaaacagatacggccatctcagcttgagtttatagagctaagtgatgacttatctgtcaacagcctccagagcaaaaacaaaacttacaaatactgtcctgctgtgcagttggataccttgatgtggcattacagagatccaacgggaaatgtacaaggaccattttccttgatttctctaaaacgttggagtgatgctggctactttcctcgaggtttcaaggtctggcagtcaggtaataggcaggatgaagatgtattactggctatggttttccaaagcagtgattgtttaagttatagtgaaaaatatcaacttggaaaggaggttgatgcaatagacatgactccatga

SEQ ID NO: 87272 - DNA, 243 bp, Glycine max
  Peptide Sequence Number=SeqID_178957
atgagttcagaactccagagacaacatcaagacatggacccatatgagatcgttgaacatcttaagaaaatgaagaagacaggaactgtcatggtagttggcaagagctccaagatgaaaggcaaagtaccaaaaaggaagaatcttggacctaaggttggtatgaccaaacccaagaacaaaaggaacaagattgaccaaactgatgctgaatgtttcttttgtaaggagaaagttcactga

SEQ ID NO: 87273 - DNA, 2106 bp, Glycine max
  Peptide Sequence Number=SeqID_178958
atgacaacagaatgcttattctttaatttcaggatttttgacaatgaaatattgaagaatgactggagatccaagaagaaggttcagataatccattatgtgatgcttaagtggggatttgctcttcttattggattaggtactggattggttggcttctttaacagttttgcagttgagaacatagctggtttcaagcttcttatgaccaccggtctcatgtctaaacacagatatcttgatgcttttttagcatatgccggtgcgaatatgtgtttagcagctgctgctgctgcactttgtgctttcattgctccagcagctgcaggctctggcattccagaggtaaaagcatatctcaatggcgtggatgctcaaaatatcttggctccaagcaccctttttgtaaagatatttggttccatcctaggagtttctgctggatttgtggtgggcaaagaggggcctatgggtggatctcacaagtatcacttgacttgcacttggcttagatatttcaaaaatgaccgagaccggcgagacatgattacttgtggtgctgctgctggtgttgctgccgcctttcgtgcaccagtaggtggtgtcctttttgcccttgaagaggcagcttcatggacttttttcacaacagcagtggtagctattgttttaagagttgcaattcagttttgtgccacagggaaatgtgggctatttggggaaggtggtctgataatgtatgacgttagttcagccaatataacatatagtgctagtgggatatttgcagtgctacttttgggagccattgctggaattcttggaagcatatataattaccttgtggataaggttgttcggacatatagcatcatcaatggaaaaggtgcattttccaaaatctctcttgttgtcacaattgctcttttgacatcatgttgttattatttcttgccatggattgcaaagtgcattcgctgtccttctaattcaacagtgatttgtccctctgttgatgagtctggagactacaaaagctttcaatgcccaccaggctactacaatgatcttgcttccctgtttctaaacaccaatgatgatgctattcgcaatctatttagccccaggataatcaaagagtttcatattaccagtttgtttatctactttgctactatttactgtcttgggataatcacttatggcattgctattccatccgggctcttcattcctgtcatacttgctggtgctgcctatggccgtctcttcggccggctcttcgaaacgattaccgaactcgacagaggactctttgccttacttggagctgcttccttccttggtggcaccatgagaatgacagtgtctctttgtgtcatattgcttgagctcactaatgatctcttgttacttccacttgtgatgttagtcttattggtctcaaaatccgtggctgacagcttcaacaagggtgtctatgatcaaatacttaagatcaaaggacttccttatttggaggctcatgcagaaccttacatgaggaatttagtaacacgcgatgttgtttccggtccattgataacgttttctggcatcgaaaaggttgcaaatatattgcaagctttgaatactactggacataatgggtttcctgtcattgatgaaccacctttctcagattcaccagagttatgtggacttgtactgaggtctcatttactagtgttactgaaggagaagattttttcaagggataggggttttgcaaatcaaaggatcttccaaagaatttctactttggattttggaaaggcgggatcaggaaaggggatcaaactagaggatcttgatatccaagaggaagagatggatatgtatgttgatctccatcccataactaatgcatctccttacactgtggttgagacaatgtcactagccaaagctgctattcttttccgacaacatggactcaggcacatgtgtgttgttccaaagagccaagggagacctccagttgttgggattctaacacgccatgattttatgccagagcatgttttgggacttcaccctgatatcatgcctcacaaatggaaatga

SEQ ID NO: 87274 - DNA, 234 bp, Glycine max
  Peptide Sequence Number=SeqID_178959
atgcccttttgcgggcgagcgaggcgaggctcatgggtgtgctttccaagggaggaaagatgcgcggagtcgccaccaacgtttatttgtgaaaaacgtcaaaaaaatcgaaggaaaccggtcataaagaatattccaagttcgggagttgtatttacgtttgaggaaggtcgacaaaagcagggctcttgctcctacgtaccctccaacgaagaggaaatcagacctacgtag

SEQ ID NO: 87275 - DNA, 615 bp, Glycine max
  Peptide Sequence Number=SeqID_178960
atgcagttcgatgcattcgaccggacagaccaccttgcattgcggctcgtcgtggtggccgacgcattcggtgcagcggtcagggtcgatgacgtagtagtcctcgcccatggaaatcgcgtcgttcgggcactggggctcgcaaacgtcgcaattgatgcattcttcggtgatggtcagggccatgatggaggggcaacggaatccggcagggatactgcaattgtactgccgggcccgcgccggcccggacaagcccctggcgccgacctgcccatggcccgccggtgcggacagccaaaatgcagggagggcgcgcaaggcgccctccgggagggttcggtgaggcggagagcgggacgctcagcccggccaggattgctcgcggcgttccttggccttttcctgcagccagcgttccaccgacgggaacacgaatttgctgacgtcgccgcccagctgggcgatttcgcgcacgatggtgccggagatgaactggtattgatccgacggcgtcatgaacagggtctcgacgtccggaatcaggtggcggttcatgccggccatctggaattcgtattcgaagtcggacacggcgcgcaggccgcgcagtag

SEQ ID NO: 87276 - DNA, 930 bp, Glycine max
  Peptide Sequence Number=SeqID_178961
atggacgcacagcgcgcaccgggcccgcgcccgaagctggtgatcctggtcgtcggcgagaccgcgcgatcacagaacttccagctcaacggctacccacgcgcgaccaatccccggctctcgcgcaaggaaggggtcatcagcttcaatgatgtctcctcatgcgggaccgccacggccatctcggtgccgtgcatgttctcgcagatgacccgaggccagtacgacgacgtgcgcgccgcaaccgaggagaacgtgctcgacatgctgcagcgcaccggcatccgcgtgctctggcgcaacaacaacaacggcggctgcaagggcgtgtgcgaacgcgtaccgaccgaggacatgcctgcgctgaaggtggccggccagtgcgtcaacgccgacggcacctgctacgacgacgtgctgctgcaccagttgggcgcacgcatcgatgccatcaacggcgacgccctgatcgtgctgcatcagctcggcagtcatgggccgacctactttgaacggtatcccgcagcgtcgcgggctttcagcccgacctgcgacagcaaccagatccagcattgcagcaacgaggcgctggtcaacacctacgacaacactctggtccacaccgaccacctgctgggcaaggccatcgacctgctgcagggctatgcggaccagcgtgatgtcgcactgatctatgtgtccgaccatggcgagtcgctgggcgaacgcgggatgtacctgcacggcacgccctacttcatcgccccgcgcgagcagacccaggtgccgatggtgatgtggttctcaccggaattcagccgcaacgcaggcctggacctggcctgcctgcaccagaatgccctgcaccgggcgcacagccacgacaacctcttccactcgctgctgggcctgttcgcggtcaacagcggg

SEQ ID NO: 87277 - DNA, 321 bp, Glycine max
  Peptide Sequence Number=SeqID_178962
catcccaatatgttaaactacactgactctgtgataaagagagaatctcctctatccctgcattacaaactgtttgaggggacacatgtcccagacattgtctcgacatcagggaaagctgcttcaggtgctgtgtccaaggatgccttgattgcagaactcaaggacacatgcaaggctctcagagagtgggcattgatgatgaagaagcagctgaggaagaaagaagcagctgaagaagaagaagaagctgctgaggaagaggaagatgcagcagaagatacagaatccgatgatgatgattctgaagccaccccatga

SEQ ID NO: 87278 - DNA, 746 bp, Glycine max
  Peptide Sequence Number=SeqID_178963
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatggggaaactcaacatcgtcatcaaacgcacgacccatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 87279 - DNA, 336 bp, Glycine max
  Peptide Sequence Number=SeqID_178964
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgcagttcgctccaagctggactgtatgcacgaaccccccgttcagtccgaccgctgcgccttatccggtaactatcgtcttgagtccattacccggaaagacatgcaaaagcaccactggcagcagccactggtaa

SEQ ID NO: 87280 - DNA, 315 bp, Glycine max
  Peptide Sequence Number=SeqID_178965
atggatatctcagagccctacactaaggcaatgagaggcaccttgcatgagcctcaagcgaacctaggggcagatcaaaagttctcgcccggattcgtttcgaatccaagggtagcttcgttatataaattctttcatgatcaatacatgtcatcaagtttcaacgggatcgacaaacccttggcatcactctatgaccttaaatcaggaaagtttcacttggtcatataccaaagtgtgacaattcattgccatccttcaatggggcgcacgatcgatccccaaagccttatgttttctggctgtgcagaataa

SEQ ID NO: 87281 - DNA, 869 bp, Glycine max
  Peptide Sequence Number=SeqID_178966
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccaggcgaattggagctccaccgcggtggcggccgctctagaactagtggatccatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaatggtggcgaaacccgacaggactataaggataccaggcgtttccccctggcggctccctcggtgcgctctcctgtcctgcctttcggtttaccggg

SEQ ID NO: 87282 - DNA, 546 bp, Glycine max
  Peptide Sequence Number=SeqID_178967
atggctccgaaaaagctttcggcgaagagatctagaagggacaccgcggctgaaggaaccagcgccgcccccgagtttgatagccaccgtttcaggagcgccgagcaccagcagcactttgaggccatcaaaggatggtcgttccataaggagagacgcatccagctcagggacgatgagtacacggattttcaagaagagatagctcgccgacgttggacgtcgctcgtcactcccatggctaagtatgacccagatatagtcctggagttttatgctaatgcttggcccacagaagagggagtgcgggacatgcgatcatgggtgaggggtcagtggattccctttgacgcagatgccctcagccagttcctgggtgacccgctagtgctagaggaaggccaggagtgcgagtttagtcagaggaggaacagggccgatgggttcgacgaagaggccattgcccagctattatgcatgtcgggtcaggatttctctcggaccgctacagggaggcgggtatgccacccaccaggcaccctctag

SEQ ID NO: 87283 - DNA, 123 bp, Glycine max
  Peptide Sequence Number=SeqID_178968
atggaggaaagaagacctgagaagaagattgcttatccgctaagcgcaaaccttgtgctaagcgccatctcttcacgcgctaagccaagcttgctcgcgctaagcgcaaagacccctgattga

SEQ ID NO: 87284 - DNA, 678 bp, Glycine max
  Peptide Sequence Number=SeqID_178969
atgattcaagggactaaccgcctaagaattctttgtcttaacacattggagggtacatcctttgtggtactagtagagggtacatctacttgggttgttatacagagaacaagagagggtacatctcttgtggatcagttgaattggagggtacatccacttgattgttcaaagagaacaagggaggcactatccaaagtaatatatgaagtgtgggaagtaggggccaagttagaaaaagacagtacactccaggtttgggccagcatattcaaattcttcctcagaatcttcaaaggtagcccgtctacattcaactcaaatccccttccagggatacgtaagcgagctgccagcacttgcagttctggccttaacctggtaaatctagagtgtcgcgacctaaccttcggcgggagggcgacgcgagactcacggatgcatattctaagggaggaaggcgcacagagtcgccaccaacgtttattcgaggaaaacgtcgaaaaagtcggtacgtgtagtctacgaacttcaagtatgaagggttcgggagttgtttttatgcatgaggaaggggtggtcgacaaaagcggggtttttgctcctacgtatcctcgatttggggtgacgaactcagacctacgtagttcttgcaaaagcggtaaagttatgtgttga

SEQ ID NO: 87285 - DNA, 720 bp, Glycine max
  Peptide Sequence Number=SeqID_178970
atgggtgatcaagaggagacgcaggaacagatgaaagccgacatgtcggctctgaaagcacacatggcctccatgatggaggccatgttaggtatgaagcagctcatggagaagaacgcggccactgccgctgctgtcagttcggctgccgaagcagacccgattctcttggcaactacgcaccagcctcccccaaacatagtaggacggggaagggacacactggggcacgatggcagtcctcacctgggatacaaccgagcggcttacccttatggattgccgcccaactattcaccacccatcatgcaagaagatgcgggccacattgcttctcccgtccatgaaaaagagcctcctcagcagcccgacgaagtccataaagaccctcaagattatgctcggagggatgtcgagttttatcccccgatccccgaagggccggcaccaggcacgttgcctcaacccaacatcgcagcatcgccaatagttttgtccatggaagggccgcccccggcaactgaagaaaagaggaagctcgatctccttgaggaaagattgagggctgtggaaggatttggggactatccatttgcagacatgacggatctttgcttagtacccgatgttgttattcccccgaagttcaaagtgccggacttcgacaagtataaagggacgactttgtcccaaaaaccatctcaagatgtactgccgtaa

SEQ ID NO: 87286 - DNA, 1317 bp, Glycine max
  Peptide Sequence Number=SeqID_178971
tttggatgcaaaggggcggctcagtgtgccggccaagcatcgtgacgccctgaccgcaggcgggcaaggtgaagtggtgctgacagcgcatccacatcgctgcctgatcctgtatccgcaagccgcttgggagccgattgaaaccaagctgaccagtttgtccagttttaatcctcaaaccagtggtattcaacgcatggtcgtgggccaggcggatgtgatgcatctggattctgccggtcgtttgctggtgaacgccgtgctgcgcaagtttgccaagctcgataaagacgtgatgatggtcgggcaagctggaaagcctgatggcgaccgaccagctgcagataccgcaagagctagaaggattctcgctatgacgcggggcgcgaagtcagcgcccgcgtccttgacggaaacgtcagtgtcaccagtcgccgccagtcatatcaccgtgttattgcatgaagcggtagatgctttgaatgtgcaggctgacggtgtgtatgtggatggtaccttcgggcgtggtggacacagccgtcttattctttccaaattaggtagcaaaggacgtctgatcggcttggatcgcgatctggcggccgtggcgcatgggcaaacaatcgccgatgcgcgttttacgatggtgcatgcgcatttttcaacgatggcaacagtgttggtggggctgggtgtgcaagcggtagatggaatattgctcgatctggttttccgttttgacgggccactggatatgcgtatggatcaaagtcggggtaaaacagccgcagagtggctggtgacgatgtctgaaaaacaattgggtgaggtgataagggattatggtgaagaacggtttgctaagcaggttgcaagggcgattgttaaagagcgcgaagatgggcgtgccatcaccactacagggcaacttgccaaggtcgtggcaggcgccatccccaagaatgagccgggccagaaccctgcaacgcgcacatttcaggctctacggattttcgtcaatcaagagcttgaggaactctcgctagtgttgcctgattgcttgaaattgctgcgtccgcaagggcgcctgccagtgatcagctttcattcgctggaggaccgtatcgtcaagcgatttatccagtctgaagaggacagggataacctgcccgcggggttgccggtccgcgccaaggacctgccccagccgcgcctggtttctgttggccgggcgatcaagcccggtaaggcggaagtgacggccaatgtgcggtcgcgcagctcggtgctgcgcgtcgctgagcgtacccatgtgca

SEQ ID NO: 87287 - DNA, 285 bp, Glycine max
  Peptide Sequence Number=SeqID_178972
atggcttcttacactattcaagtttactatatgccatataagctaatgccaaggataacatgtccaggatttgtttgtcaaagcatcatgaagtgtcttctagagtggacctttgtcttcatcttcgcaatgaaccttgatgtttctcttccaccttcattactagagaaacaacattctacattggttatttgggaccaactacatcgattgacgaccatcgccataggggacgtcgtcaaaaggggtcgcctattctacatcggttgccaaggatcatcttag

SEQ ID NO: 87288 - DNA, 2076 bp, Glycine max
  Peptide Sequence Number=SeqID_178973
agtgcagcgtctgccgatcgagccgatctcgcaggcgtcggctaaccagcgcaaagggcgctgcggccgcgtgtcggaagggatctgtatccgtctctattcggaggatgatttcctcagccgcccggcgtttactgacccggaaattctgcgtaccaacctggcgtcggtgattttgcagatgacggcgcttggactgggcgacatcgccgcattcccgtttgtcgaagcgccggataagcgcaacattcaggacggcgtgcgcctgctggaggagctcggcgcgattaccctgagcgacgaaggtgcgtacaaactgacgccgtccgggcgcagcctggcgcagttgccggtcgatccgcggctggcgcgcatggtgctggaagcgcagaaatttggctgtgtgcgcgaagtgatgattattgccgctgcgctgtcgattcaggatccgcgcgagcgcccagtggagaaacagcaggcatctgacgagaaacaccggcgttttgccgacaaagagtcggattttctcgcttttgttaatctctggaactacctgcaggaacagcagaaagcgctgtccggcaatcagttccgccgccagtgtaaaagcgattatctcaattacctgcgcgtgcgcgaatggcaggacatctacacccagctgcgtcaggtggtgcgggaactgggcatgccgctcaacagcgagccggcaccgtaccgtgaagtacactgcgcgctgctcaccggtttactgtcacacatcggtcagaaagatgcggaaaagcaggagtttaccggcgcacgcaacgcgcgtttcgctattttccccggttccgggctgtttaagaagccgcctaaatggaccgtggtggcggaactggtggaaaccagccgcctgtggggccgcgttgcggcgcgaatcgatccggagtggatcgaaccgctggcccagcatctgctgaagcgcagctacagtgaaccgcactgggagaaagcgcagggcgcagtcatggccaccgagaaagttacgctgtacgggctgccgattgtgcaggcgcgtaaggtcaattacagccgcatcgatccgcagctcagccgggagttgtttattcgccatgcgctggtggagggcgactggcagacgcgtcacgctttcttccgcaacaacctgaaactgcgcagtgaaatcgaggatcttgagcacaaatcgcggcggcgcgacattttagtcgatgacgagacgctgtttgcgttttacgatcgccgcattggcagcgaggtggtctcagcacgtcactttgacagctggtggaaacaggccagtaaggacaatccggatctgctgagctttgataagcagatgctgatcaaagacggtgcggagaaggtcagccagctggattacccgaacttctggtatcagggcaacctgaaactgaagctcagctaccagttcgaaccgggggccgatgcggatggtgtgacggtgcacatcccgctgccgctgcttaaccaggtcgacgaagccggcttcgagtggcagatccccggcgtgcgccgcgagctgatcatcgcactaattaagtcgctgcccaagccggtgcgacgcaactttgtgccggcgcccaactatgccgaagccttccttggccgcgtgacggcgctggagcagccgctgctggatgcgctggagcgtgagttccgccgtatgtctggcgtcaccattgagcgcgacgcctggcagtgggatcaggtgcccgatcacctgaaaatgaccttccgcgtggtggatgagcacaaccgtaagctgcaggaagggaaagacctgcatcagctgaagcaggtgctgaagggcaaggtgcaggaaacgctgtccaacgtggcggatgacgggctggaacagcgcgggctgcatctgtggagcttcggcgatctgccgcaaagctacgagcagaagcgcggtaattatcaggtcaaagcctggccggcgctggtggatgaaaaagacagcgtcgcgattcgcctgtttgacagtgaacgcgagcagcagaagatgatgtggcgcggccagcggcg

SEQ ID NO: 87289 - DNA, 414 bp, Glycine max
  Peptide Sequence Number=SeqID_178974
atgtggcatacactctcaatgaaaatctcaataactccactccgatactcattgagaaccaataaacctcatcaggcacatatctctcaaaccatgggggagacacatgaaattccccaccacaatctagctgacttcgagccttggctcggatatgccactgaagggcaagcagttggtggtataccctttgaaaacactttggagggccctcagtttcgcccacaaccacaaccattgcattttgcggtgggaagagcccctcctgctatggccgaaaagggaaaggcggatcatctaaaggaaaggctcagggccattgagggaggtgaagattatgcctttgctaacctagaagagttgttcctaatacccaaacatggtcattcccaagttcaaggtgctggactttga

SEQ ID NO: 87290 - DNA, 585 bp, Glycine max
  Peptide Sequence Number=SeqID_178975
atgcagcaatctggagcaatcgagcaacctgaagcttatgcggcaaacatcaacagatacaatcccagatggaggaatcacccaaatctcagatggtctagccctgaacaacaacaacaacagcctgctccttccttccaaaatgctgctggaccaagcaagccatacgttcctcctccaatgcaacaacaacaacaacaacagccacaacaacaacaacaacagagacaacaatcaactgagaccccttctcaaccttccttagaggagttagtaaggcaaatgacaatacataatatgcagtttcagcaagagacaagagcctccattcagagtttgaccaatcagatggggcagatggccactgagttgaaccaagctcagtcccaaaactctgacaagctaccttctcaagctgtgcagaatccgagaaacgtgagtgccatcactttgaggtctggtaagcaaactaaagtgccaatcccagtagcagaacctacacctgaaagagagaatgagatagatgcacaaaagagacagcctcctgaccatgtaggacctacttctagcaattctgatgtatga

SEQ ID NO: 87291 - DNA, 435 bp, Glycine max
  Peptide Sequence Number=SeqID_178976
atggtggttgcggtagaggtggcggtggtgcatttacggcaggctgctgctgtgctcttgccccaaatgtgcctgccttggcatgcaccatttctaaatgaaagacctattaatgggaggctggattggctttgtgggcataatcggcaccctatagaactagcagagacctgtgatcaaagttggaaatcccagtgctcaattggacttttctgggtccactgggtggtctatatgaacactgatctaggtcaggatagtgtagaccagctggcatttaggcagtggaagatcagaattatggttgctgggaaggatgttgttgaggagaagcgtcatccagatctgtgtcaaagtggtcatgctagtgctcatgatccgcacccaccttcctgttacacttcatgcaaagtcttgtctcggggagcacagtag

SEQ ID NO: 87292 - DNA, 456 bp, Glycine max
  Peptide Sequence Number=SeqID_178977
atgtaccctccactagaactgatctacaagagatgtaccctctcttgttctcagtcaacaacccaagtagaagtaccctctacttgtaccacaaaggatctaccctccaatgtgttaagacaaagatctcaggcgattaaacctttaatactttgtgaatggggatacaaaagaattctcaggcgggagaagggagacacaaaagaattcaggcagttagtcttttgttcttttggaaaagggagaagagagacacaaaaagaattcaggcggttagtccttggcgaattctttttggcaaagggagaagagatgaaaataatgaatagcacaagttttcaaggtttagaaaaaccagaaaactttggaaagcttttggcacaaagaagaagttcaaagagattcaaaggttgtaaaggattgtattctaaaggttattcaagatacttgaaatga

SEQ ID NO: 87293 - DNA, 507 bp, Glycine max
  Peptide Sequence Number=SeqID_178978
atgctgcttgccttacgacctgacaagttcatggatagtctgtgcaaaaaacctctcaacagcatgaacaagttgcgcgaacgagccaagggctacatccaaatggaggagatgtctaggttaaaaaataaggtccgacaagacgaatcaaagcgtgacaggagagaaggaggtaccgataaagctacctccgccacttcctcccaggtcgagggagacaaagacaccattagcaaagatgtgatcaataaccttagtaaaaatgaacccgtccaacaaattagcggtgtaatcaataccattacaagcagattctcctatggaagtgatgtagctctatgtggaacttgtaagccttggatcttcttcatcaatgaagtcctttgcttcttaaagttggatggcagcggaatggagaaggagaaggatgattggagacgccccttcaaggagaagatgagtctagaagaagctcaccaccataggaagccatggataagaacttga

SEQ ID NO: 87294 - DNA, 243 bp, Glycine max
  Peptide Sequence Number=SeqID_178979
atgacttctttccaaatcctcctccttcaactcaagacaagcaagctagtagccaaaggtggttgcggtggaggtatcatcaccggagtcgtcatagtagccatagaagatgaaacagggaggatgctgacattggtggcaattggtaggcagcgacaaaaacttagtatgatttggaatgagaaaataataggtcagggaaatgttggtaaatacaaagaaaaagaaaaaaatgaaaaatga

SEQ ID NO: 87295 - DNA, 477 bp, Glycine max
  Peptide Sequence Number=SeqID_178980
atgacaattttacaaggtagccttgctcaagcgaggtataggccgctcaagccagctcaaacaaaggagaagacaaaattttgtagagggatatctcacttaagtgatgagcgcaccagatatgtcgcaacgtgcccttcgcgggcgaggctcacgggtgcgctttccaaaggaggaaaggggagaagcttgccgcccagctcgcccaggcgagcaaggttgcttcctccagaagcaacagcctcctggaggaatcttctggagggcccaagtgggcctgctttcgaagaagttacggaaactcacggattgcgcaaaaacacctcttttcgacttccgccacattacggaatttcacggatcgcacaagcctgcttccttttgatttctgagacgtctcaggacttcatttattgtgcaacaaaggacgccaagtatctcaaagcggctaaccaaaggttgcatgtcatcaagtaa

SEQ ID NO: 87296 - DNA, 501 bp, Glycine max
  Peptide Sequence Number=SeqID_178981
atgtcagagttggaaactactgataattttcgtagctttgttaatggtgatggtgccaatgatgatggagattatgaaaatgatgacgactaccaagatgatgtcggagtacaagatgaggaggaggtggattcggagttacagaatgaggatgatggagattatgatgaattttggattccaggacataggaagatgtcggcatctgatattatgcaagttgaaaattataggaaagttggcattagacctccgcacatgtacgcagcatttgccaatcaatgtggtggatatgagaaggtcgggtttatcaggaaagatatttacaatgaagaagggtgcatgaggaggcaacatagttcagatgcaaggggtgcattgaagtatttatatgatttatgcaagaaagagccaatgatgtatgtttcatgcaccgcggatgaagagtcaagactacaacggttgttttggtctgatactgagagccaattgctttatcag

SEQ ID NO: 87297 - DNA, 774 bp, Glycine max
  Peptide Sequence Number=SeqID_178982
atggccacgttttcagttttcacaattgtcaagtattgtagtggaagtgtttggcgtgtgtcgtattgcccatcaacgattgagtttacatgtacttgtatgagaatgcaatccattggtcttccatgtgatcacatattggccgtgttggtttctttaaattttatggagttgccaagtagttcggttttgaataggtggtccaaacttgccaccaaacagattaaagacaaatatccggattccgcaatgtattgggattcacaattgatgggcaggtatgccactttggttgaagtttctagagaagtttgtgcagccgcataccgtgatgaagaggagtatgacaaaatgttgcatttcctatccaatgaggctacaaggatgaagtcgaagcaaaacagcgaacattgtgttgatgataatcaaacgcaccaacaagatgatgattttgcaggtattttagaccctgttgtggttcgaagtaaaggatgcggacaggtcggaatggatgaaagtggcagacagaggagaatccaaaagtgtcggcaatgtggtggaattggccacaacaagcgttcttgcaccaaccatcctcgaaatgtaaatggctgtatgtcatccaccgaacaaactagcagtatgttgcaagctacacatgagaattactctgaagtggtaatgattacaatttgtattttgttaatgttggacaaaatgcaggagccgcagacacagtcatttgttgctggtagtagccgtgttggtccgtaa

SEQ ID NO: 87298 - DNA, 837 bp, Glycine max
  Peptide Sequence Number=SeqID_178983
atgcaacaaactaggggcagttcgtctggaaacatgaccaacaacaacccaagctggatgtttcataggagtcgcacgacttccagtaggggatacacacacactattcctaaggacatgccctgctgcttcaagccaactgtggacatgaatcttacatttgaggagacacaggtttgtgcttatgtgctcaaccctaatctggacccgagcgggaaggaaattctatatagggtaggaaacaacttgggcacacgacaaacctttcagtcgttgtgtcccaataagccagtaagggaggagataatactattcatgtgtttgaaggttgcttacagccaactgtaccgcaccaggagtgtttggtgtatgccaccagcctttgcggtggacgtcattaatggaagtccagtggaaactctgattgaacattatggaaaggattggatgcctccattttcggacttgaagctcatttacattccgattattcaaaattcagcccattggtatctcatggtcatagacatgaatgacagaaacatttatcatctagattgtgacctcacaagtcaaactgcatatcaacgcaaagatgccattaaaatcatggcgaatgtgatgcttagtgttctggaaattgtgtttccaacacaagaattcgttattggctttgatggaatggattgttgggatattattgaagctagaggaatcccaaattgtggatccagaagaaaaggccgtcagaatgaaggtggcaatgatcctgctgttagggacacacaaccagtgcaggggagagttgattacaaatgcagagcgcaactggcatga

SEQ ID NO: 87299 - DNA, 74 bp, Glycine max
  Peptide Sequence Number=SeqID_178984
atgattttgaaaggaaatgaacttgccattcagaacacaaggtttttgaagaaaaatgtgtatgcacctgaagg

SEQ ID NO: 87300 - DNA, 189 bp, Glycine max
  Peptide Sequence Number=SeqID_178985
atgaagaacggtggaaaatcttcacaaaatcgcccacggaaacgtctcggaagcgttacgaaagcgcctcgtcttggattttcttcacggaaacaatttttctcactaattttaaggaaaaagagggaggtggttgccgcccagctcgcccaggcgagctgggttgcttccaccagaaggcccaagtag

SEQ ID NO: 87301 - DNA, 993 bp, Glycine max
  Peptide Sequence Number=SeqID_178986
atggtggttgttgcggtggttggtttagttgttaacggagatatgttgaaggtgtttgctacccaagatgatattttgcattgggctcgatctgttgcttatgatattggatttgtggcgttgattatgaggagtggtcagtataggtctaggaagaaagattttgtaagaagagatactagcagtaggaaatgtgtgtatccctttaagcttgatgggaaactagtggttggaggccaaggatggatggtgaagttaatgtgtgagagtcacaatcatgaaatggaaaagccattagttggacatccatatgctggtcgattgactaaggatgaaaagataattattgctaatatgacaaagtcaatggatgaagatgtcatacatgatatcttttggtgtcctcctgatgcagtgaaacatgatgtcctccatagagttattgttaccgatagagacctagcattaatgaatgcagtgaaaactgtattccctgagtgtatgaacttgttgtgtatgtttcacatcgacaagaatgtcaaggcaaaatgtacatctctggttgagcttgatgtttgtgacaaagttactctaaagagtaaactatgggaaattgcctaccctgatctaaactctatgtgttctcctctagaaaatgtcacaccaaagtatgttgatgctttacattctgtgcaaaataataattcttcagtcaaacgtagtgcatcatcatctgacctagcaattccaagaaggactatgccgatgttagatcaatttcatctgtacattcacaattccattgaaaacattgtcaatgtcaaagcagacggtaactgtggatatcgtgcaattgctgccttattaggtatgggtgaagattcatggtctttgatgtgcaaccatttgcttaaagaatttactaaatggtctgatgagtatatcaacctccttggtggcatagatatatttgaggaattaaagtggtcctga

SEQ ID NO: 87302 - DNA, 180 bp, Glycine max
  Peptide Sequence Number=SeqID_178987
atggtgtcaggagctatgcaaaacttgttagacctcaaagttgtgccagagggagtggatcgcttgatacaagctacaaagttttggacgacgccacttcctgatagggaagataagtcaggtagatgccacaagaattaccttgataagtccgagattggttcagcgaggaacccatag

SEQ ID NO: 87303 - DNA, 564 bp, Glycine max
  Peptide Sequence Number=SeqID_178988
atgggcccgaaatctaccctaaggctcataagaaccctagggccttctcttgcatctctggcccaatctacttggagtttttctatccaatgcccttgcggagtaggattgcatcaggaagggcaatgtagaggcttacttagattgggaaataaggccaagataaggctactacttcaccttcctctggtgaaagtgaagaagcaaaaggggaagaatctagtgaagaagtctacccctaagaagaaggacaaccttttaatggttaaggagaagtgtaaggaggtaagtgtctcctccaagaggttagctaagaaggaaagtcattttgcaataaagacaaacattaaagaaacttcccctcttagacaacctccacatcttctcctttgtaaaaagacacttgttaacactgccacaactcttgggcttgaggttattcctcaaataaaggagttgttggatgagggtttggttggtaagagcttaaatccttgtgctttgttggtgcccaaaataggtattattaggcaccaaatccctaaaataggtgtcataccctaa

SEQ ID NO: 87304 - DNA, 363 bp, Glycine max
  Peptide Sequence Number=SeqID_178989
atgggtgatcaagaggagacacaggaacagatgaaagccgacgtgtcggctctgaaagaacaaatggcttccatgatggaggccatgttaggaatgaggcaactcatggagaaaaacgtggctaccgctgccgctgttagttcggctgccgaagcagacccaactctcttagtcaccgcgcaccatcctcccccaaatgcggtaggacgaggaaggagcacactggggcacaacaacaacccccatttgggatacaaccgggcggcttacccttgtcgattaccgcctaattacacgccgccaatcatgcatgatgatgcgggtcatgcctcttcccccatccttgagagggagcctccttga

SEQ ID NO: 87305 - DNA, 423 bp, Glycine max
  Peptide Sequence Number=SeqID_178990
atggaagaaggaaacttacacacaagagtttttatactggttcggcaacaacccggtgcctacctccagtccccaagcgacctgcggtccttgagatttctttcaaccttggaatgggaagaatcaaaagaattctcagactgtgtcgttttgaattctttgacaagggagaagggagacacaaaagaattcaagcggttagtcctttgttcttttggaaaagggagaagagagacacaaaaagaattcaggcggttagtccttggcaaatggcaaagggagaagagaatgaaaaggatgaatagcacaagttttcaaggtttagaaaaccagaaaacttcagaaagcttttggtacaaagaagaagaagaagttcaaagagattcaaagagattcaaggcttgtaaaggattgtatgaataa

SEQ ID NO: 87306 - DNA, 723 bp, Glycine max
  Peptide Sequence Number=SeqID_178991
atggacctcatcaaggctgctggactgctgaaaactgtcaccaagttgggagattgttatgaaagtctagtcagggaattcattgtcaacattccctctgacataacaaacagaaacagtgatgagtatcagaaagtgtttgtcagaggaaaatgtattagattctcccctgctgtaatcaacaagtacctgggcagaccaactgaaggagtggtggatattgctgtttctgagcatcaaattgccaaggaaatcactgccaagcaagtccagcattggccaaagaaagggaagctttctgcagggaagctaagtgtgaagtatgcaatcctgcataggattggcactgccaactgggtacccaccaatcatacttccactgttgccacagaatcttttgctgtcaaaatacccattgccttcccaactgtattatgtggcattatgttgagtcaacatcccaatattttaaacaacattgactttgtgaagaagagagaatctcctctatccctgcattacaaactgtttgaggggacacatgtcccagacattgtctcgacatcagggaaagctgctgcttcaggtgctgtgtccaaggatgatttgattgctgaactcaagggacacatgcaaggtgctggaggcaaccatcaaagccaacacaaagaagaaaatggagctggaacgcctgatcaaaagactctcagacaatggcgttga

SEQ ID NO: 87307 - DNA, 192 bp, Glycine max
  Peptide Sequence Number=SeqID_178992
atggggatacaaaagaattctcagtcgggagaagggagacacaaaagaattcaggcggttagtccttcgttcttttgtaaaagggagaagagagacacaaaaagaattcagacggttattccttggcgaatttctttttggcaaaggaagaagggaatgaaaaagatgaatagcacagttttcaaggtttga

SEQ ID NO: 87308 - DNA, 744 bp, Glycine max
  misc_feature (48)..(48): n is a, c, g, or t
  Peptide Sequence Number=SeqID_178993
tttgacgagttcaaggaggaactcgagagaagacattgggatgagaanttgattgattttgatgacagtagcatagacattgctattgtgaaggaattctacgcgaacctctatgaccccaaggataaatcacctaagcaggagttggctgctaagctctgtatcccagggaggggattcgagctaaatgctgatgggcaaccattgaagatattgaggaagaacatgaccaccttagctcagacatggagtgttctttccttttctaacctaattcctacctcccacacatctgatgtgaccttggacagagccaaactgatttatggcatcatgatgaagatggatatgaatgccagaggagtccaatcagattctagatcactggagaacatgagccctgccattaacttggcatatattaagaagaactattggaatcttgatgatccaacaatgacatttagagggccaaggaaggccaggggtaagagatcagaggtccccactacttcagcaccagagacaccagctccttatttttccacaactccagtacctcccattcagactccatttattcctcctacatctactcagagaccacttccagctcctatatctgcaagacctttagatttttatttacaccacagacacttcatgccatgccccagtgcctacacagggggcagtccatcatcatgcagagccttcaaggcttgggcttgtcatccattatga

SEQ ID NO: 87309 - DNA, 191 bp, Glycine max
  Peptide Sequence Number=SeqID_178994
atggagctcggcctcaggtgtgacgcgttaaaaggtagcttgtccaaagtagctttgggcatgatattgagggaagagccattgtcaacgagtactttggccactatgtggtccaaacatttgacaaacatgtgcaaggctttgttgtgtcccctgcccttaacgggtatctcttcgtcagcaaaagtgag

SEQ ID NO: 87310 - DNA, 156 bp, Glycine max
  Peptide Sequence Number=SeqID_178995
atgactgaagcacgtcaaaagggggtacggaaagtaaatgaaaacgagaataaaagggaggagcttgccacccagctcgcccaggcgagcaaggttgcttcctccagaagcaaccgccttctggaggaagaaactggaaggcccaagtggtcctaa

SEQ ID NO: 87311 - DNA, 207 bp, Glycine max
  Peptide Sequence Number=SeqID_178996
atgacgttgctacttagcaacattctgcccagcgactgcaataccgatctccccctgcggaagtatcagttgggatcgttcccgcaagacacccagtggacccggagacatccaacagggccctggggtttccagctcgggttacaggcctctgtaaatcctacagggcgcccgtccccccatcaagttcatgccatcgtgacctag

SEQ ID NO: 87312 - DNA, 288 bp, Glycine max
  Peptide Sequence Number=SeqID_178997
gtcagggggtgcgaacacgcgactgctgcgggtcatgccgctcagccccgtgatattggttaccttggccgacagcgtgctgatgttggtggcttcttccttcctttcgcttggaggcgcatacctccatggaactgtgtggttgttttggtatggaaacggaataggtctaactaccgagggggcctcgtagataaccttctaggggtcgtcacgtccttcaaagtcctcttgaaaggtcagccatccggcttctatcaaactttggatcttgtgcttaaaggctag

SEQ ID NO: 87313 - DNA, 234 bp, Glycine max
  Peptide Sequence Number=SeqID_178998
atgagggttcgctgtaatcaagcaagtcggagacctagcatgatcacagattcacctccactccttatgttcccacgagcccggtccccaatggagtcgccaactgttgcaacctacccttcggcgggagggcgacgcggggctcgcaggtgcgtcttccaagaaaggaatacacgcggagtttccaccaacgtttatttgaggaaaacgttggaaaaactggaaaagacgtga

SEQ ID NO: 87314 - DNA, 414 bp, Glycine max
  Peptide Sequence Number=SeqID_178999
atgggtgaagtagaggaggtacaagagcaaatggccacaatgatggaggtcatgatgagcatgaagaagaagataatggaagctaatgcggttacagttgccgctaccagcgctgttgctaaggtgaacccgatgcccccatctggccttaaccaaatgaatcacccaacctcagatatgaccgtgggggagacacatgaaattccccaccacaatctagccgacttcgagccttaccttggatatgccactgaagggcaagcagttggtgatatacccttgcaaaacactttggagggccctaagtttcgcccccaaccacaacctttgcatttcacagcaggtaaaatccctcctattatggaaggaaagggaaaagtcggatcatctggaggaaaggctcagagccattga

SEQ ID NO: 87315 - DNA, 867 bp, Glycine max
  Peptide Sequence Number=SeqID_179000
atggacagagacaggttggtttatggcttggtaacccacatggatatgaacatcggcgccctgaccccaagtcaaatctcttctattgctcagagtaactcctctaggcttggatttccaaccttgatcactgccctctgtagagctagaggagttatctgtgacagtctgacttatgagagcctgagcctagccattaatttggcctacattaagaaaaactattggaatatggatgatctgacagttaacttcagaggggcaaggaaggcaagggctcgactagctgatgttccttcttcttctactccaccagctcctcccacatatgctactcctacaccagctcctccaggcccatctgcccaggactctcagtgctttgagtccatgcttctgagtctttatcagggacaaatattgttaatgcaaagcctgcaggtagtctggccaggaactcagccttctcttgtgagggaaggtggaggttctggtgctcaggtacctcagcaggtacaagatgcatctttagaggccaccatccttgtgccatttgtttttaaggtaggagggacacaggtaaggcaggaggctgctactccagagaggtcaccacagatttcaccagatccaccctcaccaatgatggatcaatcttctcctcaacagttagcagattctcctacaacagtgcatgagatgccagcagacctttctactccattactagagattccagaggaccctgccacaccagtcctgggactgactaccactcctccagccactcctgtgctacattttacagatgaggaggccactcaggatcaagatacccaacaggatgaccagtcacaagagttttaa

SEQ ID NO: 87316 - DNA, 822 bp, Glycine max
  Peptide Sequence Number=SeqID_179001
atggccgtagagcaggatggtgtcgtcgccggtttcggcgccggtagccggaatttccaggaagatcagcggggtacggccttccaggcgcaccacttcaaccttcaggccgggcagctgctgggccttggcccagttctccatcagcgtgaccgcctgttccatgtagccgttctgcacccaattggcgtcgaacatcggcgacttgttgggaatgcggatgtagtcgaccaactgcgggacgatctcgctgtcccacttgtcattgacgaattggccgagcttggcgctaaatccaggaaaccgataggctgtgtgcatgtggtgacggacactgttcctaccgacgggattgccggtcgggacggccagaatcacaaggagatacacgttgtgccttggtttgtcgtgttgagggcgctggtactggttgtggggatcgctggggcgcatgccgccgaaccgatcgacatcaaccgcgccgatgcccaggcgctgcagcagggattgacgatggtcggagccgccaaggccgaggcgatcgtcgagcaccggcgcagacacggcccgtttcaccgcgtcgaggacctgacgcaggtgaagggaatagggaaagcgatcgtcgaacggaatcgacagcggatcactgtaggcaacaggttgttgccggcggatccggtacccggatcggtaccggaatcgtcggaaccggcaggaagctggttcaccggtcacgggcaggacgcctgtgaccaccgaccgccgcaggacgcggcaccaatcaccaggatggtggaatcacagacctgtggaaggggctga

SEQ ID NO: 87317 - DNA, 588 bp, Glycine max
  Peptide Sequence Number=SeqID_179002
atggtgatggacaactattcatggtgctatctggcttgcggtcaatgttataaaaaagctgacatagaaactgtgtcgttcacatgtccgtgtggcaaagacaacgatcaacctttactaaggtatagagttgaagtgatggttaatcaccagggtgaacagaccaaattttttatctgggaccgtgaatgtgcacagttaattggtcaatcaacggatgaagtcaatagactcaaaatagaagttgctatccatttttattcttctttttcgtgcaaggatggcgatgttgatttaaatgcctctcctcaagcacttgataggctattgggttgtttccttgcattcaaagtgaaggtgcaaccaaggttcaggaattttgttgttcttaaatattcagatgaatcagacttgatcaatgttgtgctggatatgattcccgatagtgagtcatgttgcaagatcgagaattcaatacttgagtcgaccgatcctacagagcttgaatctcaatctatgtctgttaccgctgatcatgactgttcaatgcttaactcatacgtagcgcctacagagcttgatctgtaa

SEQ ID NO: 87318 - DNA, 1224 bp, Glycine max
  Peptide Sequence Number=SeqID_179003
atggatgatccgatccgtaaggaccatgattgggaattttttgatcgtctttctccgagaaagaggcgaaacataatcaacttgaattcgggacagctattcgaaatcttagtgaaagactggatttattatctcatgtttgcttttcgtgaaaaaataccaaaggaagtggagggttttttcaaacaacaagggactgggtcaattattcaatcaaatgatattgagcatgtttcccatctcttcttgagaaacaagcgggctatttctttgcaaaattgtgctcaatttcatatgtggcaattccgtcaagatctcttcgttagttgggggaagagtccgcacgaatcggattttttgaggaacaacatgtcgagagagaattggatttggttagacaatgtgtggttggtaaacaaggatcggttttttagcaaggtacggaatgtatcatcaaatattcaatatgattccacgagatctagtttcattcaagtaacgggttctagccaattgaaaggatcttctgatcaatccaaggattatttcgattccattaggaatgaggattcgaaatatcacacattgatcaatcaaagagagattcaacaactaaaagaaagatcgattctttgttgggatccttcctttcttcaaacggaacgaacagagatagaatcagagcgattccctaaaatcctttctggatattcctcaatgtgccgactattcatggaacgtgagaagcagatgaataatcatctgcttccgcaagaaatcgaagaatttcttgggaatcctgcaagagctactcgttcttttttctctgacagatggtcagaacttcatctgagttcgaatcctactgagaggtctactagagatcagaaattgttgaagaaagaacaaaagaaacatcttgttctttccaggcgatcggaaaataaagaaatagtgaatttattcaagataattatgtacttacaaaataccgtctcaattcatcctatttcatcatatccgggatgtgatatggttccaaagggtgaactggacagttccaataagatttcattcttgaacaaaaatccattttggggtttatttcatctattccatgaccggaacagtgggagatacacgttacaccacgattttgaatcagaagagatatttcaagaaatggcagatctattcactctatcaataaccgagccggatctg

SEQ ID NO: 87319 - DNA, 219 bp, Glycine max
  Peptide Sequence Number=SeqID_179004
atggataagagcttgaaggtcggagacgatgagtggagggagagggagagaaggagaatgaaattttgtgccttaaatgagatgatggaagcttgcttgagaagcttctatggaggatggatctttgagcttcaacaaggtgcttcaatggtgatttttagacatggagttgcagcaaaagataaaggagaagaggtgagaggaggtgccatccactag

SEQ ID NO: 87320 - DNA, 1130 bp, Glycine max
  Peptide Sequence Number=SeqID_179005
atgtccagcgcctggctggccggcggcaggaacagggcccagcagctggcgatcgaacaccaccagcggcaggatcagcgcgccggtcagcaggaaattgaacagcacgccctggcgcgcggtgccgcgcacgcggtcccagcgctgcgcaccgacgttctgcgcggccatcgacgagcacgcggcgccgatcgccatcgccggcatctgcaggtagttccacagctgcagcgcggcgccgtagcccgcgccggtgtcggtaccgtactggttgaccatggtcatcagcaggatcaccgacagcgagatcagcaccatctgcaggcccatcggtacgcccttgaccaccagcgccttgaggatggccaggtcgagcttgaacaggcgcatgtcggcacggcccagccacagcgtgtggcgcttgtgccgcatgtacagcagcaggccggccagcgacagcgtctgcgcgaccagcgtggcccaggccgagccggcaatgcccagcgccgggaacgggcccatgccgaagatcagtaccgggttcagcacgatgtccagtgccaccgagaccatcaggaaacggaacggcgtgcgcgagtcaccggcaccgcgcagcgcggcggtgaggaaggcgaacgcatacagcgtcggcctcgccaggaagatgatctgcaggtaggcctcggccagcggcagcgaggcggccggcgtgcccatcgccgccagcagcggatgggccatgaaccagccggcgatggcgatgatcaccgacaggccgatgaagaaggtggcgctggtgccgaccacgcgccgcccctgcgcgatgtcgcgcgcgccgatcgcctggccgatcaggatggtcgaggccatgccgaagccgaacaccgagccgatgaggaagaacatgatgttgttggcgttcgcggtggcggtcagtgccgcctcgccgaggaagcgcccgacccagaccgcattcaccgaaccgttcagcgactgcgcgatgttgcctgccaggatcggcagggaaaacagcaagagattgcggccgatcggccggagtcaggtcaatcgcgctttggccatggagtggttgatcgaatcccggagcgcacacttagccaccaagccgg

SEQ ID NO: 87321 - DNA, 90 bp, Glycine max
  Peptide Sequence Number=SeqID_179006
atgggggttcaaatagaaaccaggcccactcgggccttccaggatgttcctccagaaggcaggggaggagtgaaggagaaaaatgtttag

SEQ ID NO: 87322 - DNA, 504 bp, Glycine max
  Peptide Sequence Number=SeqID_179007
caaaaggccaggaaccgtaaaaaggccgcgttgctggcgttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggattagcagagcgaggtatgtaggcggtgctacagagttcttgaagtggtggcctaactacggctacactagaagaacagtatttggtatctgcgctctgctgaagccagttaccttcggaaaaagagttggtagctcttga

SEQ ID NO: 87323 - DNA, 982 bp, Glycine max
  Peptide Sequence Number=SeqID_179008
gcttagagccgagacagcacgatcacgtggggcatacgtacggctgggatgggttcgagacatctatgagatgagatgtgaggcccggtggtggattgtggcagctcgtgcttatctgctgcacttggttggttgcactttttttgctaacaagagtgcaacatatgttcatgtggtgcacctagaggcttttcgcaacctgggtcagagtggtggttatgcctggggagttaccgcgctggttcatatgtatgaccagttagatgaagcttctaggaccactacacgacagattacgggcactttcctagtgtgcatcagtgtgtcacagatgatgcataccagcagacgtccccacatgcttaccgtcacatatgtgtgctggttgccttacaatgagcatcgaggggttaggggctttgagctgatttcatcattccagggtcagctgagatggggtcctatggtggtcacagctcgattggagagggtgctacggcagtttggttacattcagagcatcccttcgtcgcctgttagcgcttcattgtcatatgatgatatagatgacaggtggatgcatttcgcggaccacgtactagctgtgggtgagctttgtgtagtgcctgagcaggtatctgcggattacatggagtggttttttcggatatctcacccattcatgatactgacccaggcaggtgaccagcccaaacatgcacctaccgcagaccatgaggagtacatgcagccgcccatcccacaggttccagtggcatttgacccccctccacatgcaatggatgattacgacggctatgaggcgatcgcagagaggttggagcgtgtgcttagccttaggatggtcattgcaggcacagagttacatgatattatgcaggattgcctcacgatcgccaaagggggtgccaatgcagatggaagtgtcaaggctcgacagagacggcgtacagagcattga

SEQ ID NO: 87324 - DNA, 1728 bp, Glycine max
  Peptide Sequence Number=SeqID_179009
atggcgctgttcctcctctacgagtcggcgtcgggttacgcgctcttggaggcgcacggcctcgacgaaatcgggcacactacggaggccgttcggaactccgtttccgacctcaacaggttcggcaaggtcgtcaagcttcgctccttcaaccccttcacctccgccctcgacgctctcaaacagtgcaacgccgtttccgaagggctgttgactgatgagctgagaacggttttggagactaacttacctaaagttaaggaaggtaagaagtccaagttcagtttaggtgtatcggatccaaagattggttcccagatatctgaacttactaaaattccttgccaaagtaatgagtttgtcgccgagctgcttcgcggtgtgcgcctccattttgataggtttgtcagtgatctcaagtccggggatttggaaaaggcacaacttggtctggggcatagttacagcagagcaaaggtgaaattcaatgttaaccgtgttgacaacatggtcattcaagcaattttccttcttgatacacttgataaggatattaattcattctccatgagagtcagagaatggtattcttggcattttccagaactggtgaagattataaatgataattatctgtatgccaaagttgctaaatttattgaggataaatcaaagctgtccgaagacaagatttcatccttaactgacatagttggcgatgaagataaagcaaaggagattgtggaagctgccaaggcttccatgggacaagatttgtccccagtggacttggttaatgtccaacaatttgcgcaaagggtgatggacctttctgagtacaggcggaagttgtatgattacctggttgctaaaatgaatgacattgcgccaaatttggcctctttaattggtgaagttgttggtgcacgattaatttcccatgcaggtagcctcacaaatttagctaaatgcccttcttcaactcttcaaattcttggtgcagagaaggctctgttcaggttcttaacttcaccttctcctgacattaccacttccaattcaaaggctaagggagtgatagatgacaaggcattaaaaacaagaggaaacactcctaaatatggtctgatattccactcttcttttatcggtcgagcatctgccaaaaataagggccgaatagctcgctatcttgctaacaaatgttcaattgcttcacggattgactgcttttctgaaaggggtactactacttttggggagaaactccgtgagcaagttgaggagcgacttgatttttatgacaagggagttgcccctcgtaagaacatagatgtcatgaagtctgctattgaaagtgttgaaaccgaatatacagcgatggaaacagaagcaccagttgaagtttcaggcaagaaagccaagaagaagaagcataaagcttccgttacagatgatggtgataatatggctgtagataagatcacagagactacaaatggtgatgcattggaggatcataagtcagaaaagaagaagaaaaagaaggaaaagaggaaattggacttggaggtggaacttaacgatcaagccatggatggtggtgctaatggggttgaaagcgaacaagatggagcagttaaaaagaaaaagaaaaaggataaaaggggtgataatggagaagtactagaggctgctattgagactaagaagaagaaaaagaaataa

SEQ ID NO: 87325 - DNA, 1575 bp, Glycine max
  Peptide Sequence Number=SeqID_179010
atggaggtaagaacgaacgaagttgcaaagcaaagaatagaagacgaagggtatagagctcataacaatccatttggtcttaatttgtttctgttttcttcattctgtcagccatatatggcttccttggcgacggtgcaagatgaacgttgcgttcagagaagctactggattgaacataccacagatttgtccgtagagtcaatgatgctcgattccaacgcctctgatctcgacaaggaagaaagacccgaagttttgtccctactaccagcatatgaaggaaaatcagttgtagaacttggagcaggtattggaagattcacaggtgaattggccaagaaagctggccagttgcttgctgtggatttcattgagagtgctataaagaagaatgaaagcattaatggacaccacaagaatgtcaagttcatgtgtgctgatgtcacttctccaaacttgcatatttctgaaggatcagttgatctgatgttctccaattggttactcatgtatctttcagataaagaggttgagaatttagctgcaaggatgatcaaatggttaaaagttggtggatatgtattcttcagagaatcatgtttccaccaatctggagattccaagagaaaatacaacccgactcactatagggagcctagattttacactaagatttgctggatatggaaaaaagttagatcacaggatgatagggggttccagaggttcttagatagtgttgagtataatcataaggatattttactttatgagagtgtttttggtcaaggttttgtgagcacaggaggacttgtgcaagtgctcattccttgtacagaaacaaccaaggaattcgtggcaaagttgggactaaaacctggccagaaagtactggatgttggttgtggtactgggggaggtgacatttacatggcagaaaattttgatgttgaggttgttggcattgacctctccataaacataatttctcttgccattgaacgtgctattggactcaaatgctgtgtagaatttgagtgtgccgattgcactaaaaaaacatttcctgtgaatacatttgatgtaatctattcccgtgacacattgttacacatcaaagataagccatcactattcagatcattttacaaatggttgaagcgtggaggtacacttctgattactgattactgcaaaagtgaaggaagtctatcattaggatatgctgagtatataaagaaagggggatattatattcatgacatgaaaacatattgtcggatgctcgagaatgctggatttgatgatgttgttgccgaggatcgaactaatttgttcatgaaaacactacaacaggagttaaatgcccttcacagcaagaaggatgatttcattgatgacttctcggaggaagctctggaaggcaaaatcattgtcaaaactcagtcttcaatttcccactatggaattcgccttactgtcaaaggatccgttaacttgcaggttcgtggaggatcagctggggttgttgagtcattctatggtgttattaagcccatcccaattgtgtaa

SEQ ID NO: 87326 - DNA, 159 bp, Glycine max
  Peptide Sequence Number=SeqID_179011
atggcaataggcacaatagtggtagaagtgacgacaatgctattagtggacaatgctattagtggtgtttatgttgatgcagtaacaacgacaatgatattgatgacaatgtatggtggaggaattaatgatgttggtagtgtggtgataggagtttga

SEQ ID NO: 87327 - DNA, 708 bp, Glycine max
  Peptide Sequence Number=SeqID_179012
atgatgaataacatggcctatcccaacaaggccttcttcctctttgtcatgttcttttctgcatctcttcaccttggcatgtttgatacttctcttgatcagcttctgcctggcctaggacaaggtgcgtttctacaagatgcaaaatgcatgcaaaggcttcttccatgccaagaatacctgaaatctccaaacaacccttctccggcttgttgtgagccattgaaggagatgcaagaaaataacacgcaatgtctttgcaatttcgttaacagcactactctatttcagtcccttggtggttccaaggatgagatcttgaagctcccccaagcttgtggcatcaattttgacccttctaagtgcaacaacacaggaggaggaggatcccaagtggcttcgacgccttccctcgccagaatgctaacacatctccgccgcgcggctgccgcatgcggtggtgctacctccgaccacttcctcgctctcaggcagttcagctccgccgtcgtcgccgtttcctccgtgtctgattccgatccaacacttccctcttcttccgattcacagagaaaagcatctagatggttgctatttctacctggggcaatcacatttggccttgggacttggcagattggtagaagagaagaaaagggggagggaataggagggaggaaaggaatgatgttgattgatactatgtga

SEQ ID NO: 87328 - DNA, 624 bp, Glycine max
  Peptide Sequence Number=SeqID_179013
atgtgtttcagatcgcgttgcagcttctgctatatcttcttcacaatctacacccttatgctcatgttcattctttccatcatcctcttctggataatcatctcaccctcaagtgtcaagttccatgtaaccgatgcctcactaacacaattcaacctcacaagcaacaacacattgtactacaacttcaaagtcaacgtcacaatgagaaaccccaacaacaacatcatagtgtactacaggaggatcacagcaatttcttggtacaaagataatgcttttggttgggtgagcttaacaccctttgaccaaggccacaagaacacaaccttccttcaagcagtgtttgaagggcagagggtgattaagctcaaatctaaacaacttggtgagtataaagatgagacaagtgttgggatttacaaggaccttgctgtggattttgatcttagaatcagagccaagtatgcaaagttcaagagtagtcgtttcaatacacccattgttcagtgtcgccgattgagggttcctttgatttctaatggtaaatcagtacctccttttagtgtcaccagatgcaaaagtgcttatttcttctcagatcgtgatgctgctgatggatag

SEQ ID NO: 87329 - DNA, 325 bp, Glycine max
  Peptide Sequence Number=SeqID_179014
acaacgtgatgaagctccccaagtagcaagtaatccatcaactcttccatcatcttcacaagaacaacaatttaaaggtcctagaatagaagaagtagatatctcctcacttaagaaagattcaggaaagcgtctttctatttggaaatatcaggttgaccagatcttcttcatcaatgaattcctttgcttcttggagaatgacaatggaatggagaaggaagagagaaaggagatgccacttcaaggagaagatgattctagaagaagctcaccactatatgaggccatggataagagcttggaggaagaaggagatgaatga

SEQ ID NO: 87330 - DNA, 1647 bp, Glycine max
  Peptide Sequence Number=SeqID_179015
atggaggatgcgcggccccacgccgtcttcgagcggtccggcgagtccgggaggtccttcaactattccgaatcaatccgcattacatcggaatccgtccccgagcagcagataatggcttaccttgtcaaaatccagcactgcggcttcatccagccattcggctccatgatcaccgtcgatgagccctccatctgcatcctcggttactccgacaacgcccacgacatgctcggcattactctgcagtccgtccctttgctcgacgacaagaatgacgccgccttttctctcggcaccgatgtccgagccctaacctccgggaagcctttctatggaatcctccaccgaattgacggaattgtcatcgatttggagcctgtgcttacggaggatcctgccctctctatagctggagctgtccagtcgcagaagctcgcggttcgcgcgattttgcagcttcaatgtctccccagtggtgatgctaagcttctctgtgacactgttgctctgaaatctcatactagtcagggtggtcgtgctggtcgacgaggcattgatgaacgtggaatatgtatcctcatggttgatgagaagatggagccttctactgctaaaaatatggttaaaggggtagctgatagtctaaacaggttctgccagataatggtttactcgtccattttgttagagatcttaatgattctgaaacttcggaaacagattgaatttgagccagaatatttggtggagtttgataatccagatattgatgagaaggaaccaattccactacgggatgcacttgagaaggcgaaaccattcttgatgtcatatgaggggattcaaagtcaggaagtgtgggagaaaacaatggaagagacaatggcgcgagttccattgttgaaaaagattgttgatcactacagtggacctgatagggtaactacaaagaagcgacaagaagaattagacagagttgctaaaactcttcctgaaagtgcaccatcttcagtagaacaatttactaatcgttctgttatttctcttcagtgttcagaatttctgcctttggcatccattgcagcaacatcattagtggaagattccattaacgacaagagtttgaagaggcttatggagcatgatgagtccttcaccaacatagccaagaggaaagagttaaagcgatggcatccatgcaagttcagggtcgttgtagtgttggatatgccacaatggaggtgtgggaagcaaaaagtgggtttaggaagtaaaagccccatatggggttatattgcaggttctcagcccaagtggctaatgggtttgaaaaacccaatagcaacaaaagaaaggctgttgctaggtgcaccgagcaaaattgctggtgcacccagcaattcaatgaacttgcaaaagcgcttgtttcttccccgtgcacccaacaatctccattcgtgcttcttgttccccgatattggccttcttcctcctcgccctgatttccttctcaatttgaaatttggagaagaagctgttgttgaagacgaaggttcttccgcgcgtaggaaaggggcttctgggaattcccgcggaagaagtgtggaaggttctttcgcggattcccgcggaagaagcctctga

SEQ ID NO: 87331 - DNA, 501 bp, Glycine max
  Peptide Sequence Number=SeqID_179016
atgtctgaagaagttgatatgaatgatgaaaatgaagaggaagcttgtgtgaatgaagaaaatggagaggaacttgaagtgcatcaacaagatgaagatgttgtacgtgatatattttgtagtcatcctgatgcaatgaaattatccaatgcatctaatttgggagaacgtctaaataatgttgtttggactctaaaacggtttcgaggtatttttctcaggcgtgatgcactccttggagttattgctactgataaagatctagcattgatgaatgcagtgaaaactatttttcttgagtctaccaatttgttatggcggtttcacattgataagaatgtgaaggaagcctgggggaatttggtggattgtccttctgagcaacagttcgatgagtgtcttatgaagtttgaaattgcttgttcaccatggccagtgtttgttgactatgtcaagcaaacatggttgattccgcataaagaaatatttgttaaagtctag

SEQ ID NO: 87332 - DNA, 141 bp, Glycine max
  Peptide Sequence Number=SeqID_179017
atgagggaggaaagtgaatgtgggaagattttgatgtgggagattgacaaagataaagggaaggttgttgaggaagtcttatggtggagaagagttgaaatgagaacatctccaatagaggatcttggaaagggatcttaa
